United States Patent 12,144,834 (METHODS AND COMPOSITIONS FOR TREATING GASTROINTESTINAL AND INFLAMMATORY DISORDERS) - sequence listing, part 3

SEQ ID NO: 66 - DNA, 41767 bp, Bacteroides thetaiotaomicron
taataatctatttgatcgcaaaatcgggtacaaagtaacatatttatattagttatcacaaggtctattctttgtattttatgatctgattttaagattacattacccaaaacactgttattatagagtttttaaggttcatatttacactacatctaacaaaagagcattaaataaggggagattaaaatcccccctttttattcaaaaatactatagttttcaaagttatatttctaactaattgattcaatctaacctcctcatcattctccaataacctctaactcatcgataattaaagtactatttacagctcctttaaaagctgcaccatctttacttgaggaacatacaattgccagtttatatgatttagacatatcataagattttccgtccaaattattgaatggcaactcaaaagtagtccactcagcttttgctccaccatcttccaatacagctacagctacacgatactccgaagatgcaatatcatgcccagtaagtattacctctttgccttcactatccacagcttcatacaaaacagccattatagagcactcatccacaatttccagatgctccagaacattctttttatcagaaccatctacatagttatcaccaggagtatatttataaatacctttaaatatcaaaggcttttttgcatatggaataccaaatttagtagaatttaactgatctgatgcatcggtcttaaaactaccagtaaataaagagcccgaagttatcgcaggagccaatccaaaaccagctccttttgtatataaagttatcaacttggcagaggagccactataaccatctttatcttctaccacaggaaaaccacctttaaaacctaaagtagctaaaagccctgctccttcattggaagtgctcaattgatccactggagccggattccaatattcatttttcaaaccttcatgttgaacaacccaagtatcaaatgaatactttaaaaaattctgactacccgctattgaagctacatattttttagtcgttccatcttctgctataactgtataggtaacagttttaccagcggaaaaatcctgtgggacaccacttttgggagccactgtagctttttctgatatttcaataatcggagtcaatgatttcaaatcatcatcagtagcttcgtcattcactttaaacaagattgtacccttttcttcatcaataaccggcgctactgtcacaacctcattatcaatagtaaaactagtaattttagcctctgatttttcacttcccgatagtttagcacctttataattgactttaactttcattccgccttctacatctacatcaataaccatatctacagcatccttaccaattgtccccgaaacggatgtattgcacacacccaccacaagacttaacttctgattgcctgagaacttatatgtatcaccactttttgtcagagcacaattatccactgttatatcaccaataagaagttcagtacccgccacggtaatagtaaagtttctcaattctaatttaacggcagtatctgaagcctttgaaatataaaccttctgaaccatatcagaagcaataggagtagatactcccacataatatacatccatcgttcccttatatgcacctgcaagttcactatcaacaggatatttcacatcatcatcatcactacaactcacaaataaacttatggaacaaataagcatgaacaaatacaacaatcttttcttcataatcttcatagttaaatattaaatatttcttatcacataaaattatgcaaagttaattattaaaaagcactaccgcaagtgctatttttggtattatatgttccatttttaatatattctcaatatttactctaaaaacaagtatttataggtcgtgattctatatcctataaatcccacatccatcaacgacagtcaaataaaactttccccaatttaatatccgctcaacagcctcccccttacgaatgacagaagtgaatttacaacattataattattgcatatttattaaaaaagccgtatctttgcagtcttagtcataattgaaagtttgtcaaagtacaaagttagacatgtttaatattgaatttattacaaatgtcgtttcgttgtgatggcggaaccatttgaaattactactgatttaatatcattttactcagaatattcactcgtgacgatgcgatattctttcttaatctataaatatatatatttgcaaatgttgacagcccataatgggcagttagcgccgtttgtatgcgtgatgtcttacgtgtttaaatttagtattgcttatatacatgtttataatgatgaaaaaagccctggaccgtgatggttcggggcttttcttgtacttgcaataagcaagaaggaaaaagatttcagattacatcggtaactgtgctattatctctttcgaacataccggcaatttgccattctttcccatatccacaaaaaccgttgcacacaacaccgtccattggtcaccatatgtcatcgtactgctatggctatacccaaggcaatgcccgtattcatgaaacatggcctgacggggataattatgcggatgggcatccggaggagtcgcatcaaaataaacaccggtataacaataattagccaagccgtacgtattgcctccacctaatccgccgacaccggcaacacaacccagcacaagcccgccatgattacggattctttgacgcaacgcatccagattgatcggatttcctccattgtctttcaacaaaccttcgtatttgttcatttccatattaaactcttcggaagagaacatgaaagccatattgacagccaacgccactccgtgacggcacaataacggattcatatgacgccaatacgcatgaccattgtcagccgaataagaagaaaaacgtataaaccagcgactgtctatctgttctattttcttcataaacggatcttctgtacgaataacaagcgtcacatcatcattggaaagtccgggctgtgcaggcaccactatcttccgtccactacttgtagtgaatgtccgttccgaatctacaaccggcaaggggaatgacgcttccataaacggataaatctgttcaaaatgtgccagttcgaagaactccatgctaaatttattaaagcggcacataatcttcacatcctgaatacctacaggagaaaagaacttgacaagcaactgatgttcgtctgaaatggaaacctgcaacggagcattcgcataaaaagaacgacggcgactgtcataaaagacctcacgtggctcactggccaaaaacatcgtatccgcgcgaaaccgaaagaagtcctccttacgaacataaagtgaaccatcctgattttccggatgcaaataatcaatactaatatgagatacacggcctgcctcaatcttacaatccgtgaaacggtatttacggacaaactgagttccgtcactgcgatcggactcaatcgtcacaaatccggataatgcttttgtgccgggcaatgagtaaaacgagtatttcccggtaatgtcataagattctatctttctggttccggaatatttcccgtctgcaccaagagtcccatatattccttcggcatcgtcgaaagttatatcgattttacgaatgaatctccacatataatcggacgatacattcaaatcgacatccactctccctacagaacgctccaagaccactgtatgcgacaccgaagcctgatctctgccgatatgcaattctattttcttataaaagtaaaccgcatctaacggcgcattttccgcatgatttatcaaccagtcatcggacagtttttcgggttctttaacagcctcatcttcttcctcgctcgtagtagccaaaaaaacgactgtataatcccccatactcaatccttcaatagtcaattttgagaagttttcttccagcttctgatataagggcttaataatctctccacgttcattggcaatagcataccacatacgagtgatctgctccggtttgcttccgcgtgtctgcaccacggacgcatcatcttgctgcaacccaaacaaaaacgacacttgtccggaatgggaaggaacaatgccggtctcctgttcaaaatcgcccgaacagttggtaagcaataatgcgcccagtaatatcattatgattcttagcatcttcataaacagcctcctctatttctttacacaacgtacggatgcaaatgcttccatctgtaaccgctgtttcttaataacggttgtctcggctccttcgaacggcaaccagtaagcccatgcataaccgcccggaagaccgttacgttcgtttgtccacaacacagctcttttcccgaaagccggattattggatgacgacttatctcccttcgagccagccaaaggaataataaggctgcgaccggtgtcttccgaagtaaacttcacataatgctgtgttcccgtcacaccactggacggagttatcagtgttccttctccgatgtgaagtgtagcggcaattgtttctccatttcctgccttatatctacccggaatctcttggtctgcaggaagcagagactgccattcgttaccagtcggtatccggtatccttcagggcaaggcatatgtgtatcattcacccaaggtgcatcagccgtctggttacctaaattgttggaaggattatacccctgccaaggcacgtacatatataaacgtccaaactggaacagaccacccaccgtgttaatccaacttttatgatacatatcttcgaccgtagccccgtccaacggataaatctgatcttccagatcgcggctacgcgcattaaatgccatccatacatttcctgcgatttccacagtttcaatctgtttgtcactcggagccacacgtatctccacgtaatcatatgttccactcaacaaggcatttttcaaatgcaccaaaaccgtatagcccaggcgaccgctgccttgcgctgcaaccgatacattaaatgacgacacgataccttccgcctcttccgacacggacatattgcctacacttgttccgctaccggcaccttctgtagaagaaatatcgatacgagtgtctgtaacgaacgccagcgtcatgtcatcagcacctgtagcaggcacttccagtatattattctcatagtctaccttcaccccttccggaatcctggatttcgacgcattaagcaaaagacgttggttcgtatcaggctttccgacaatcgtttccccttcttcccacggtttgatctcaaaaacgcctgtcacttcagctcccacattgagcactgccaattcatatactttattgcgttcgacaactggtaattcgacttttaacctgatagggacttcaccataggttccacgcaagatgatattgacaggacgtgtgctttcgaacagacggaataccccctcttgcttgccatcgaatgcagaagagaactccttccgatagctcaccgttttatccgacgcccggacattttcgaggaatggtaaagtctcggcaggagcattctctacgatgacttcctttatctgcgttttgctgtcggctgttgtgttcaaatcaatgcgcgccacaccgcgtttcataattacattgacctccgcattgctgcgtgtcactactccgctctccaattcgactacagccgccatgaaatccggcgcagaattatcatgcaatccttcaccgataatcgtattacgaaattcttcttcacttttagctttctctccggcaggaatctccagtccggtcagaaaataaagtcgagatccgctgaccgcagaaatctccgactgtccgccttgcccgggagtcagctgttcctctttatataaattcccgtcactaaactggaaaaccgatacatctttgagctcttcagaagattcttctcctgctaccgtaattccttttaataccactgaataagtttgttgatggccttttcccccggttggttcatcgttcgagcaggcgcctgaaagtaatgttcctattataatgggaacgatggtttttctgcaagaataattcatgttttttgattaaaataatactgaatattggaaactttataaatgcattttccaaaagcggcggcaaaaatactacttttttcaatacagcaagtcatctgcataaaattttaataaatatgttaaataaaagaaatctttaacgtcagactaactaaatacaaaataaaaagttattttgcaaacgttttttaattttatctcattctaatattatgtacaagatttttcacggcttccacctagtagaagcttatcaggacttaaagaaagctaaacggttagcaaagaatcagacagtggcccgatgtataaagttaaccatagctattaccctctctcttattttatggttccttcccattgatacttttggaatagaagggttgaccgttatagaacaaagacttatttccattttcattttcgccacactcatgtgggtgttcgaagctgttccggcatggaccacttccgttcttattgttgtactattattacttaccgtttccgacagtagtttatggttcttaacccaaaatactcctgcggaggaattaggacagacagtcaaatataagtctatcctgcattgctttgccgatcctatcatcatgctgtttataggtggatttattcttgccatcgcagcaaccaaaagtggactggatgtattgttggcacgagttatgctgagacctttcggaacacaatcacgatatgtgctattgggattcatcctcgttacagctgtcttttccatgtttcttagcaatacggctacggcggccatgatgcttaccttccttactcccgtattaaaagcactcccggcagatggaaaagggaaaatcggattggctatggccattcccgttgctgccaatgtaggtggtatgggaactcctatcggtacaccacctaacgccattgctttaaagtatttgaatgatccggaaggattaaatctgaatatcggttttggagaatggatgagctttatgttgccttacactattattgtactgtttatagcctggtttatcctcttacgactgtttccattcaaacaaaagagcatcgaactgcaaattgaaggtgaagcaaagaaagactggcgctccattgtggtttatatcacctttgctataacggttctattgtggatgttcgacaaatttacaggagtaaactccaatgtagtggcaatgattccggtagctgttttttgtataacaggcgttattaccaaacgtgacctggaagagatcagctggagtgtactctggatggtagccggcggcttcgcattgggcgtagccttgcaagagaccggactggcaaagcatatgatcgaagccatcccattcagcacatggccccctgtactgatgattgtcggttccggactgatttgctatgctatggccaactttatttcacacacagccaccgcagcattactcgtccctattctcgccattgccggaatcagcatgcgtgaaaacctgtcatcgttgggaggtgtagagactttattaattggagtcgccatcggatcatcgctggcaatgatattaccaattagtacaccacctaatgccctggcacatgccacaggaatgattcagcaaaaagatatggaaaaggtaggtatcattatgggaattataggacttatcttgggatatacaatgctgatcatactcggctccaacaagttattataaataatctattaaaaaaagaagatgtcaaaagcaggatgatacatttatcttgcttttgacatcttcttctttttcgaatttagcgtcctataatcctctccaaaagtttataagaaacaacaatggtataaaacgatatctcgtctactctattcctgatccgaattcacaaacttacttggactgacattataatacttcttaaatacctccctgaaatacttcgcatccgaaaacccgacaatttcagcaatctccgttattgtatattctttctgctttaataattgtgctgcacgttgcaaacggatcatccggatgtagtcagccggagcataaccggtcagcgctttcagtttattatagaaacttgttcgactcatatgatgctgattactgagtacatctaccccaaagtccaaatctcccatattcttctctatacattccttgactgaagctatgaatttccagtccaaagtattagtacaattgacaggtaaatgcttttctttattttcgatactattatagacctgacggagcaattcacgatttgccaatatgtttttaatagtcacctttagtatacccacactgaatggcttggttatataggcatctgctccgatttccagtcctccgagtatatttttctcatcccctaacgcagtcagcaatatgactggaatgtgagacatttccacactcgttttgatagctgagcacagttcgtctccactcatctcaggcatcattatatcggatataacaagatctggattaaactcctttataataacaagcgcatctttgccattggaacaggactggatattataccctgccataagcatatccacaagataattacgcaaatcatcattatcttccactaccagaatacgctgtaaagaggtttttatctgaggtgcctccaagaccggcaagtcagaagttccccccagtacaacagcatccatacgttcattcggcgtttttggagagataaactttgctttatgcaaatgggtatttcccttcgggaaagtaatttgcacgcatgttccctgatgttcaacactttgaatatggatctttcctttatgcaacttaaccagtttatataccagcatcaatccaatcccacttccggtcactttcaaattgactacattactaccccggaaacaatttctgaataatttcttctgttcagatgaaggaataccaattcctgtatcctttacctcaatactccaagtattcccttcctcgcaagcacaaatacacacgctaccattctctggcgtgtacttcaacgcatttgacaaaatattcttcaagatagaccccattttgtcactatcaaaccacacattcaaataatcaaaattactctcataaacaaatctgacacgcttcatctcagcatatttgcggaaagtagcacaaacatcattcatataagaattcaattcatactcagaaacataaagagtagacgaatatacgtcgatccgttcaaagtttatcaagttggttgtcagctgaagcaatgtattcacattctttagggccatattcatatggggtaatgccttctctgccaccatatggttttcaacaacttcttccagcggtgcttttatcaatgtcagcggcgtacgtatatcatgagcagtattaataaaaaaacgtgtcttctcatcagaaatcttcttttgtttatgcaacatgataacacggaatatgataatcataatcaagaccaccagaattgcataccccaccattgcccacatactggcccacaccggaggggtaataatgatctgaatactccttgtttcataagttttatacttctcctcattagatacagtacgaatttgtaacgtataactgccaggaggcagatttctaacaacaatccgattatcttgactcggacgggtccactctttatgataaccgtcgattttccatgaataaagaatattagaaggataatcataatttatggaagccacatcaagcgaaaaagtattttgaccgtaggccaattccagacaatcagtctcgttaatatccttcttcaagggagatccgtcatcaccaggatagacaggatgataagctatcataaaatcccgtaataacaaacgcgaataatatggctcaggtatttctatgtctgtcggaaacttaacagcaccatcattgccaccaaagacaagcgtactgttactgtaagttgtggcagaaccggcattaaaatttacgctcatcagtccctgctcccgtgtccagttacggaaaaaatgatctttaggtgaataaatcgtaataccattttccgtacccatcaggagattttcatcctgacgcggaataatcgtataaatattatcagaaatcagtgcacaattatcagttcggtactgatgaataaacttctttttattgatatcataaacaagaagacctgctccacgagtaccaatatacaggataccatcttctctctggtataatgcacatatataaggagattcaacaggcaagtcaatataccggtaaacaccggattgcttgtcaagctgatagagtcccattcttgtaccaatccacatttgacgggcatttttctccagaatggtggtgatggaacttactcccggatacaaacgaacatttttagtctcaagattaatgcgtttcaaatgataatatccaccggaccatacatcaccgctcgaatcctttttaatgtcataaatatattggtcaggacgtattcctgcaatggccgcaggcgaaagatagcttattttaaaccctttcttcttttctatcttataaattccagacgtaaaaccaccagcccatatcacaccaggagagacttcacacaacgccaagaagatatgattctcatcatccggcaccggatcaaaagaactaaaaaaagaacaccattctcttgtatcggtctgataaaaactaattccattactagttgcaaaccaaaggtcaccgtcactatcttctatcacatcatgcacctgatcattcactaacgaccggttattgccaagagaatgctttatcaaatcatatcttccataacgattgttacgaatggtaataccagtaggataattggcaagccaaatacgctcctcctcatccacatagatatcattgatattgtttccgttcattccattataactgctatagtcagccgttatataaggttcactcttacaagtatttacattcagcttatatactccttttccacccgtagctatcaacaactcatcagcgttcagagcaacaatctgattaacttccacattgtttggtgcataacaaggagtgattttttgggttttaccaatatcatatataagtatcccttctttataactacccacaaataattgctttgacacagtatggtaatacagttcgtgaacaggtgtaacgatgctttttactacttcatcaggaatttgtttcagttctcccttttctatcccgacacaaaacaaaccgcttcccgtaccgataaaaaaatgaccgccatcagcctgctcaatagtagatattgcaccatcgacaggctttggcatatgttgtgttgttccagtacgaatattataccaggtaattgtatctttgtaacatagccaaatatgatcattcttgtccagataaccataatcaagaaatgcttgaaacttatttcggatcaattcagggtgtacataagccaattcaaatttatcatgttgtgaatcatacctgaaaatacgtcctttctgcccgattacccataatacatcttcctgatccatataaagccagttcaaagctatccgtgagtccagcttcatactgtcatccgagaaagtataatgcttgatgtgtttaccgtcataacgatctaccccctcctgagtcaaaaaccacatatatccgcgtcggtctttttgaatatggtagattttctggttgttcaaaccgtcttccaaccctatgtacttataaatctgccccttgctcacagcactactaatgagaagaactataaacactaaaagttttctattttttacaattatcttcattcctttcacaaaacactcaaaaatatatttgcaaaaatatgaaaatattatttaaacagcaactgaataaattaataattatatgttaaaaacagaaacttaaaaaacacaactatctcatctatcggaaataccgcataataccccaaatactccccaataaaaacatcggaaatagataagtgttctttctaaattatattagtcattttttgtacgattttccagcatcagatcataaatatacacgaacaggaatcatcttattattaggacaatttcaatcatatatttattccttcggctatgcatttaaaatccataagcctctttttcaattttccataaaataaaaaatgatgttaattccattttcaaacttcgaactattttttttaatcccgtgttttttttcatacagtaggagcttaagtacatttcggatgatataacaaaagtaacataataaatcggggaagtgtaatagagtaaacctacatatttttctaaaaaaaataagttttaaacattgtttcatcaataaaatctacagccatgaaaagtataagttcaaatttatggatcagattaatagtcagttctatcataggaacaataatttattgtttatcaagtatgagacagcaaacaagctgactataaagatgaatattctagcgatatgaataaatatttttccattcaacaagcaaaatatttttcctttataaaatactaattatatatctatatatttacatataaacccactaataagtatgtgactttaagaacttaacttacatacagtttcttacttattaccaaactctatttttaactatctaaaaccaacttaattatggaaaatagaacttctgatttatggctcggtcttggtataggatcggtcattggcgccctcgtctatcgtttttcacgaacttctaaagccaaaaaactaaagaaaaaagtatgtgatgcctttcataaaataagtgggcaagtcgaagaaatgttagatactgcaaaggaaaaagtattggatacgggtgctgccgtagccgataaagttgcagacaaaactttcgacctagctgaaaaggcagatgaccttaaaggcaaaatgcatacaatagctgctgatgcaaaaaaatgaaacagattctagtaaaccaattaagaacactagagtgtttctgaataaacctaaattattaactaaaacttttgaattatgaacaagaaaactgaaaagaaacaggaagaggcaaagggcactaaaaagaccgcccaagctaaagagtgcaagtcttcgacttcaagcaaaaaaactgaaaagaaataggcattcagaatcgttaagtttgtgtcattcttcaggcagacaggaatctgcctgaagaatccaccaatttattctcaaagtgactttacaattttaaattaaaagaatatgaaaaaattattatttgcgatttttgtagttacaactataatatccttcacgtcctgtcgtaataaaaaagaacaggataaagcgaaacaacaagttgaaaaagtgaaagaaaacgtcaatgatgcagtggacaaagtatccgataaaatcgaagatggtgctgatgccgtaaaagatgcgtggaaagacaccaaaaaagacgttcaaaacagcgcagagaaaaccaagaaagaaatcaaggaaggatataacgaagtgaaaaaagatgtaagtaaaaaacttgactgattcttaatcgtatatcattctataaatagtaacttcttacatattaataagctatggttggatttgtaatatggattgttggattagtactgactatcaaagccgcactggaaatatggcgtatccatgcaccaatagaaagacggctgatagctattatcttaatcgttcttaccagctggataggattgctgttctattatttctacggcaaggcacgaatgccgcaatggctgggtactggagttcaaaaatattagctacatcagaaagcaatatttatatgaatataattctaaacatgggagagtacagcaaaagtcaatagcaactctcccaaaatttccctccttcaagaagtagatttgagtcactattgacttttactctctgcaaattaccaatatttttcaattctctcataaccgaaaatcctaccgcgttcatcatctataccttgcaacttcttgcagataatctgtgctccaatcatactaaaggttatgccgttgccaccatatcccaaatcaaaaaacatcctgtccttatctggacaattaccgataaagggtagcccatcttttgttgtactaaaagtgccacaccacgccatttctgttttaaaaggaatacttggaaataatctcctaaatttcttttctaatacaagagttttctttctgagtaacgcatcacggcgctccggatcactgaacttttcatcttcaccaccgacaatgatacgatttccccttgtagtccgtatatacaaatatggctcagctgtttcccaaattaaacactgttcaggccacaaatctttagaatctaccggatgcgacacaagtgcataagttgaagtcaaatccataatttcccgagataaaaacttccctgcttcaaatccggatgcgatgatcacatatttacactctattttatgccctctatctgtttctataatatatccttcaggcatttcaacacattctgttacaccggtatgagtaaaaatttccagtccatcttttttcatatggtagagcaaaagaccagtagtcgctttgtaagcatccatctgcgccgatactcggtttaacagtgcattgcctggaacctctatattatacagtttttttatctcctcttttcccagcaaacgaaccggcaaattgtgcttctttcgtatcacatattctttttcaattaattctatatcctttggaatactagcataaaaaagacttggtcgtttttcaaaatcagcatctactcctgtttcctttaataccttttcaatatcagcaattgatgccaaagatgcgcgatatgcagaaacagcattatcctctccaataatttctgccatttcacaaagaggaacatcaatttcatattgcagtaaagcggtacttgcaatggaacttccagttgcaatgcttcgtttgtcaaccatgcaacatcttaaaccggcactacaaagctcgtgtaccatcaaagcacccgttataccagaccccacaactacaatatctgttgaaaaatcatcctccaagggatgaaagtaatctaacaatgaatttttaacaacccaatagggcaatcctgaatgtaagtccataatatattgaattatgtaaactcccttgcatcctcctccacacttacagcagggagaaaaacgtaaaaacatggaaaacacaaaaacattcccaaaagagtttactcccgatttataataagatactattcaccctgttcaattgcgcaatatcttttacattgtatcaaaacgttctcaaaataaacaacatcacacaaaaaaagatagttcgaaggaaaagactggatttaacatctatttaatgcataagaaatattgtaaaacaaccagcatatatgaaggtattcaccaaacaaaatatcaacatactatctaaataatatatcaaggtatgaaattaaatctcagtagatctatcacatacttttttaacattaaaaataaattcaatgacaataattatcaaatatattcggtgaggttgtaattgcccctttatcagcagggcatatggcggtagaaacacacaaaaagctccgtaaatcaatgatttacagagcttttaatcaggaatactcgtactcgaagcgggacttgaacccgcacagccgcaatggccaaaggattttaagtccttcgtgtctaccattccaccattcgagcatcctttcaaagagagcggaaaacgagactcgaactcgcgaccctaaccttggcaaggttatgctctaccaactgagctatttccgcattttttcaacgggtgcaaagataatgagtttccttgtttctgccaaactttcgatcaaaaaagtttggcagaaaatattttatcgccctaataatgctttctcagcctgctccattccacagaaattgaagccatcgaccacttgttgcattaatgcggagatttcatcattacaaagattaccgatacttccttcgtgtgtatgatgcacctgtttgtcatgagtaaattttccggcttctatatcaagaccgactttcttatacgcatcacggaaaggcataccttcacgagccagtcgattcacttcctcgacactgaaaataaacagatatttatcatcatcaaggatatgttcattcaccttaatctcattcatgatataagtcgtcatctgcaagcagtccttcagttcctgaaaagcgggaaggaaaacctctttaataatctgtaagtcacggaagtaaccggatggcagattgtttgctatcatcattatctgctgaggaagagactgcagtttattacatttagcacgtgtcagttcgaacacatccggattcttcttatgaggcatgatgctcgaaccggtagtacaatcatccggcagcttcacgaaaccgaagttctgactattgaacatacaagcatcaaaagccagcttggagatcgttccggcaatggtagccaatgcaaaagcaacattacgctccaacttgccacgtcccatctgcgcataaacgacattataattcagcgaatcaaaacctaacaaatcggttgtcatcgtccggttcaacgggaaagaggagccatatcctgctgcagagcccaaaggattgcgattgcacatcctgaaagccgcttgtaggaactgcatatcatccaccaggctttcggcataagcaccgaaccacaatccaaaggatgaaggcatcgcaatctgcaaatgggtatatcccggcatcaggacatttttatatcgctcactctgaagaatcaacacatgaaagagttgttccaccgcttccgcgatctcgcgaatctgtgtacgggtaaagagtttgaggtccagcaaaacctgatcattccgtgaacgaccactgtgaatcttcttaccgacatctcccaaacggcgggtcagcatcaattctacctgcgaatgcacatcctctactccttcttctattataaactcacctctttcgaccgaagcataaatagtcttcaactcagccaacaactgttccagttcttccttggtcaacagaccgatactttcgagcatcgtaatatgagccatagaaccgagtacatcatgtttagccagataaagatccatctcacgatcacgtcccaccgtaaaacgttcgatgtctttatttacctgcacggatttttcccaaagtttctgcgccataatatttaagtattaggtaataagtagtaagtaataggtaataatcgtagttacgttgatactccgcgggtattacctattatttattacttattacctgtttaatagttaatcatcgacagcatctcaaccatcttctccagaccatcctgaagaggtttctgtaccatcgctttcataaacggattgatatccatactgatagtcactttcaacttgcactcttcctctgctgttgagactagctgaatccacatattaaaaggtagcggagagttggtagttgccagtttaatacatttgcaaggttcacgctcaacaatctgcaacgtcagctgaccgataggcgaaacgctaaagctcagtgtatccgaatcaaaactcaagtcctgtattttatcttccggtaaacggcctttcactgattccaggttgctcaagtccgacagcttggcatacacacgttcctgactgtaaggtattacctttacactactttcaaaattagccataattctttattcgtataaaatcaaagaaagaactatccgaacagatattgtccgaatggttctttcttactaaaatttccgatcaaataatacaatattatttccctgcatcccaatgagccgggtctttacgccaatcgttcaatgtcgcaatatcttcttcttcgatataaccggtacgaagtgctacatcaagtactgcttcgtaattggtcaacgtcaccaaaggtactttagcattcttgaatgcttcctcggcaacgggaaagccatacgtataggcagctaccataccgatcacttcacaaccatcgcgacgaattgcttccacagccttcaaactactaccacctgtagaaatcaaatcttcaaccactacgactttcatacccggacgaagttctccttcaatcaggttttccaatccgtggtctttcggggtagaacgaacatacacgaacggcagattcaacgcgtcagccactaatgctccctgagggatagcacctgtagccacacctgcaatcgcatccacctgtccgaatcgttccaatatcagacgtgtaatctcaatcttcacaaaattacgaagagaaggataggacagagttttacggttgtcacagtaaaagggggatttccatccagaagcccatgtaaaagggttagcgggttgaagtttaatagccttaatcttcaaaagtttctccgcaaatagtctctctaagtttttcataactaaactaactattaattatttgccgcaaaagtacagaaattgaacgagaatagaaagaagaatccgtttattttttaactgaattgttcctcttcctccggaatttcgatacaacgacgtatatctttgagttcaaaaccacggctcaccgcaaatcgcatcagctttccgttcagttcataatcatctttcgcatgaatgcttttccgtttggaagccagcaagtcacgcaggatggagagatattcctcttcatcaatttcgttcagatgacgccatgccacatcggaaggaatcttcttcatgtagagtccctgtgctattttcattttaccccatttggcaaaacgaaacttatcgttcacaaaagcacggcaatagcgctcgtcatcaatatacttttcggtttccagccgttcaaggatacgcgctatggtctcataggctataccccaacgctgtaatttctcatttacttctgcccggcaatgttctgcagcggagcaataagaggcaacacgattcaacgcctcttcatctgttaattgtgcactcatcggttagctgtaagtattctatcttttccaaatatgtcttttataacacgaacgtcccgatattggttcatttctatcatgcgtatcatgtcttgtccgtatgcctgattgatttcaaaatagagtttgccacccggacgaagtagttctcgtcccagttccgcaatccggcgatagaaacgcagagggtcttcatcaggaacaaacagggcaagttccggctcccagtcaagcacattggcttccatctctgttttttcagtttccgtcacatagggcggattgctgacaattatatcgtaagatgtcccctgtattccgtcagcagaaaaaacatcctgtcgacggaaggtgacctgagcatccaactcttcattatttttacgggcaatagccaacgcttcttccgaaatatcccaggcatccactttcgcatccggcagatttttatccagagagatggcgatacatccgcttcctgtacctatatctaataggcgacgggcatccggattctcctttacaatcaggtccaccagttcggcagtctccggacgagggatcagcacgccgggagctacccgaaagttccttccacagaactcagcatatccccgaatgtactgtattggctcatttttctgcaaacggaatataatgttttctaattcacgctgtttgcatgcagataaaattatatctttgcccatgtaaatatcaagcgcatccacccccaacatgtcgcaacagatcaacatcgaaagagctttgacctcttccggcggataaatatcctgtagtgactgacgaatgtaagcagtgatgcggttcatattttacgatttcggagtgcaaaagtaagaataatatagcgaagagcaccaaaatggaagaagaaaaatacatgagacgttgcattgaactggcaaaaaacggactgtgcaatgtcgctccaaacccgatggtaggggctgttatcgtatgtgacggacttattatcggcgaaggatatcacatccgctgcggagaggcgcatgccgaagtaaacgcgattcgttccgtcaaagacaagtctttattgagccgttccaccatttatgtcagcctggaaccttgctcacactacggaaagacgcctccttgtgccgacttgattatcgagaagcagattccccgtattgtaattggctgtcaagacccgttctcacaggtcgccggacgaggaattcagaagttgcgggacgccggaagagaagtgacagtaggcgtactggagaaagaatgcaggtatctgatccggcgcttcattactttcaatacgctgcaccgcccctttatcacactaaaatgggcagaatcggctgatcatttcattgatgtagaacgaacagacggcaatcccgtagtactgtcctcccctcttacttccatgcttgtacataaaaagagagcggaaactgatgcaatcatggtaggcaggcggacagcattgttggacaatccgtcgctgacagtccgcaactggtacggccggaatccggtacgcatcgttttggaccgtgcattgtctcttccccacagcctgcgtctgtttgacggagaagtacccaccatcgtatttacagcagaaaaacatccggacaagaagaacgtcacataccgcacgattgaattcacacaggatattctgccacagatcatgaaagtgctatatcaacaaaaaatacagtccttactggtagagggaggaagtcagctgctccaatcatttattgatgccgaactatgggatgaagtatatattgagaaatgtccgtgcaagctgaattccggtgttaaagcacctgaaataagcgataattttagttattcgactgaaaaacacttcgacagacagatttggcattatgttttcgagaaatagctaaaatagttctattcaaggggttctacgtcgataaaaacagcgttattatctataattttatataaaacttccccttaatgttctatatcggaaaaaatgttcctatttttgcaacttgtaaataaacacaatctttcaaatgagaataaagtttttatcaatcattgcgagttttttcatggtgtcattcgttattacgtcttgccttgacaatgataacgaagtcaattatagtccggatgcgactatacgcgcatttgaacttgacactataggttatggggtaaactataaattcacaattgaccaagttagtcgtttaatatataatgtggattcactgcctgtcaatgctgacacgatcattaatagtattctgatcaagacgctgacaacagcatccggtatcgtgacgatgaaagatcagaacgatcaggattcaatcgttaatattaacgactctattgacctgactaagtatgtaaatgcaaccgagaaaaacaactttctggtactgaaggtatgggcaccgaatatggaggttcagaatgagtataaagttaatatacggatgcatacgatggttcccgattcactcagttggggaaaagaccctatagcgaacaatcccgtgaggaacactgctgaaaaacaaaaggtagtaacgcttggggacaagatattattattcgctcaaaacaatgaaatttacagtacagcaataccggcaggctctcctactgatcgtttaaactatggtcaaaaatgggataaagaaactactggcaaacttcctgatggtgctgatgttacctccattatccgattcgttgacaagttatatttacttactaagaataaggaagtatataattccaatgacggtttgacttggacaaaagatgaagtactcaattccgatggcgtttccgttactaatctgataaccagtttttctgacagtgatggcagtaaccataaaaagataaatggaatagcaggtatagtagaaatcaatggagagaaatatttcagttttgcagagaaagatgtaacatgggagaaagatatagacaaattaacagttgttcctgcagagttcccgataaacaacctgtcagccgatgtatatgcaactgaaagcggaacgttgaatgcaatcgttgtgggtaatacagaagacggtttagacaatgacacagctacagtcgtttgggcttcagaagatggtaaagcctggattccaatggagattccatcaaataacaactgtccgaaattagtagacccgtctattatacattataacgacgcattttacatttgtggaaaagaaactaaagatgatgctaagggattccagaaattctatacctccccgacattacttgtatggaaaggggtagacagaatgttcatgcttcccggaattcttcctccggtgaaacttgaaggaggagtaacacaacatccttctcttcacgaatccagcttcaagggaaaagaagtaaactacacaatggtagttgacagaaaccattatatatggatggtaggtggtcaaggtattgacaaaatctggcgtggtagagttaataaactcggatttctaatacagtaataagaagtagttaaatacgaaccttataatcaaaacatgtcctatatagagaaaatagacaaaaatcggattccccagcacatagccatcattatggatgggaatgggagatgggctaaacagcggggaaaagaacgaacttacggtcaccaggcaggcgcagaaacggtacataaaattatcgaggatgctgcacgtctgggggttaaatatctgactttatatactttctccaccgagaattggaatcgtccgcaggaagaagtagcagctttaatgaatctattggtggattctatcgaagaagaaacgttgatgaagaacaatattcgtttccgcattattggtgatattaagaaattacctgcagaagtgcaggaaggtctgtcaagatgtatagaacacacagctaataatacaggaacctgcctggtactggcactcagctactcttcccgctgggaaatgactgaagcagtccgacagattgcaacgcttgcaaaaacgggagaaatatctcccgaacaaataacagatgaatacataactgctcatctgaccacaaactttatgcccgatccggatttactgatccgcacgggaggagaaatccgactaagcaactacctgctatggcaatgtgcttattcggagctttatttttgtgatacattctggccggacttcgataaagaagaattctgtaaagccatttatgagtatcagcaaagagagcgccggttcggcaaaacgagtgaacaaatcagctaacataattcgaaacttcaaattataacataaatgcattatcgtatttcctttatattcgtaacgtttatctgcctgttctgctttgcagccacgggctttacgcagaataccaacactgacgaagactctaagccagtcatcttatactcaggaacgcctaaaaagtatgagatagcagacatcaaggttgaaggcgtgaagaattatgaagactatgtgttaatcggattatccggactgtccgttggacagacgattaccgtgccgggtgatgagattaccggagcaatcaagcgctactggaaacatggtttgttctctaacgtacagattactgccgaaaagatagaaggcaacaagatttggttaaaaatcagtctgacacaacgtccccgtattgcggatgtacgctatcatggtgtgaagaagtcagaacgtacagaccttgaaagcaaactgggtatggtaaaaggtatgcagatcactccgaataccgttgaccgtgcaaagacattgatcaaacgttattttgacgataaaggctttaagaatgcagaagtgattatcgcgcaaaaggacgatccatctaacgaaaatcaggtgattgttgacattgatatcgacaagaaggaaaagattaaagtgcacgctatccatatcaccggaaactcggccatcaaaacatccaagctgaagaaagtaatgaagaagaccaatgaaaaaggcaaacttctgaatctgttccgcaccaagaaatttgttccggaaaactttgaagcagataagcagctgatcatagataagtataacgagctgggatatcgtgatgcaatgatcgtaaaggacagtgtagcacaatacgacgaaaagacggtagatgtatatatggatatagacgaaggtcagaaatattaccttcgtaatgtaacatgggtaggtaacacactgtatccttcagaacagctgaacttcctgctccgcatgaagaagggtgatgtttacaaccagaagttgctgggagaacgtacctctacagatgacgacgcaatcggtaacttatattacaataacggttatttgttctacaatcttgatccggtagaagtaaatatcgtcggtgactccatcgacctcgaaatgagaatctatgaaggccgtcaggctacgattaacaagatcaacatcagcggtaacgaccgtctgtatgaaaacgtagttcgtcgtgagcttcgtattcgtccgggacagctgttcagcaaggatgacctgatgcgttcattacgtgaaatccagcagatgggacactttgaccctgaaaaactgcagccggatattcagccggaccctgtaaacggaacagttgatataggtctgcctttgacatctaaagccaatgaccaggtagaattctctgccggttggggacaaacaggtatcatcggtaagctgagtctgaaatttaccaacttctctgttgccaacttgctgcgtccgggtgaaaactaccgtggtatcctgccgcaaggtgacggacagacattgaccatcagcggtcagacgaatgctaaatactatcagtcatatagtatctcattcttcgatccttggtttggaggtaaacgcccgaactcactttccgtatcggctttcttctcagttcagactgacatcagcagccgttactacaactcgagctatttcaacaactattacaatagtatgtatagcggttatggtggctatggtatgtacaactatggcaattacaacaactatgagaactactatgaccccgacaagtctatcaagatgtggggactttctctaggttggggtaagcgtctgaaatggccggatgactactttactttgtctgcagagctagcttaccaacgctacaacctgaaagactggcagtatttcccggtaaccaacggtaaatgtaatgacctcagcctttcactgactttggcacgtaactctattgacaacccgatcttcccacgtacaggttcggacttctcgctgtcagttcagcttactcctccgtactcattgtttgatggtaaagactataaaggttatttctacgatccaacagatgataggggtattacccaagataatatgaataaacttcatagatgggttgaataccacaaatggaaatttaaagccaaaacatatactccgttgatggattatatcgcacatcctaagtgtctggtattgatgacacgtacagaatttgggttgttagggcactataacaaatataagaaatcgccattcggtacattcgacgtaggtggtgacggtatgactggttactcaagttatgcaacagaaagtattgcattgcgtggttatgaaaacagttcattgacaccatatggaaaagaagggtatgcttatgcacgcctcggcatcgaattaagatatccgttgatgctggaaacaagtactaacatttatgtgttaggtttcttggaggctggtaacgcatggcatgatatctcaaaattcaatccgtttgatttgaaacgttctgccggtatcggtgttcgtatcttcttgccgatgattggtatgatgggtatcgactggggttacggtttcgacaagataaatggtagtaaggaatacggcggcagccagttccactttatcttaggacaagaattctaatataaaactaaaaactaaacgtcatgagaaagtctgttctatccattatgttactgtttgccatcagtatggcagctagtgcacaaaaatttgcattgatcgatacggaatatattctgaaaaatattccggcatatcaaagcgctaatgagcaattgcaggaagctacgaagaaatatcaaagcgaagtggaggtaattgccaaggaagcacagaagatgttccaggactatcaagctcagtcctctactctctctgcggctcagaagactaagaaggaagatgaaattgtagcgaaagagaaatccgctgccgaactgaagcgcaaatacttcggtccggaaggcgaattggctaagatgcaggagaagctgattaatcctattcaggatgaaatatatggtgctgtaaaggaactgtcgcaactacacggatacgaccttgtactcgacagagcctctgctgcaggcatcatttttgccaatccacgtattgatattagtgatgaagtgctgagaaaattaggatattcaaattaatttcatacatttgcatcgaaaataactaaaaatcattcaaataaattatagaactatgctaaaaaaaattgcacttgtattgatgcttgcactcccaatgggtgtatttgcacaaaatctgaaattcggtcatattaatgcccaagaaatcgtttcagcaatgcctgaatttgctaaggcacaatctgatattgaagcactagacaaacaactgaccagcgaattacaaagaactcaggaagaattcaacaagaaatatcaggaattccagcaagctatcgctaaggactctcttcctgctaacatcgctgaaagaagacaaaaagaactgcaggatatgatgcaaagacaagagcagttccaacaggaagctcaacagcagatgcaaaaagctcaggctgacgcaatggctcctatctacaaaaagttggacgacgcaattaaagctgtaggtgctgccgaaggcgtaatctacatcttcgaccttgcaagaacaccggttgcttacgttaatgagtcacaaagtattaatctgactcctaaggtaaagacacagctcggcatcaaataagaagctataagctataaaataccgaaagggaaagagaaaagaagatcatacatctttctctttcccttttttcatgtaactttgcgtatataaaaccgcactcgtcatgaagcaacatctatctcatacacccggaccaatcggagttttcgattccggatacggtgggctgactatcctcaacaagataagagaggcactgccggaatatgattatgtctatctgggagacaatgcacgcactccttacggcacacgttcttttgaaatcgtgtacgaattcactttgcaggcagtcaataaattgtttgaaatgggatgtcatctcgttatcttggcctgcaatacagcctctgccaaagcattgcgcagcatacaaatgaatgacttgcccggcattgaccctgaacgccgtgtactcggagttatccgccctaccgttgagtgtataggtggcattactcaaagccgtcatatcggagtactggcaacagcaggtaccatcaagtccgaatcgtatccattagagatacataagctattcccggatattcaagtgagcggaatggcatgccccatgtgggtaccgctagtggaaaataatgaatcacagaacgaaggggccgattatttcatccggaaatacattgaccagctgctatccaaagatcccgaaattgatacgatgattctgggctgcacgcattatcctatcttgctccctaagatacaagaatacactccgaagcatatccgcattgtcgcacaaggagaatatgtagccgaaagtctgaaggactacctaagcagacacccggaaatgaatgccaagtgtacccaaaacggcagctgtctgttttacaccacagaggcggaagagaagtttgtcgaatcggcctcttccttcctgaaccagcaaatcgacgtaagaagaatttctctcgaataaatatgggaaagctgatcaatctttccttcttttttgttatatttgtatacataacctcaaatagcataagattatgaaagaagaagattatagcaaggccatagaagtattctccggttcgccatgggaagcagaaattatcaagggattgttggaaagtaatgacatccgctgcgtcattaaagatggtatcatggggacattagccccctatattgctccatctgtatctgttctggtcactgaagaccagtacgaagccgctactgaactgatcagaagccgcaacgagaaagatactgactgatacggtccagtccttcccggatactctccagcgaattcgcataggagaaacgaacatatccttcgcctcccgttccaaagtctataccgggagtgatgccgacatgcgcattttcgagaacatcgaatgcaaagcgataagagtcggtagtgaacttacgtgcatcagcgaaaatataaaaggcaccctgaggctcaactttgatctcgaatcccatttcccgaaggcggctgatcatataccggcggcgttcatcatagatctgtttcatccgttccacatccgagtcagcctgtcgcaatgcggcaattcccgcttgctgggcgatgctggacgcacaaataaacagattctgctgcaacttctgcaaagaacgcatacaagatttcggtgctatcagataacctaagcgcagccctgtcatcgcaaaccgtttggaaaatccgttcaggacaaaagccttatccgtatattccagaatactatgcgcacgtccctcgtataccagtccgtgatagatctcatccgaaataataggaacgcccaaagatgccacacttctcaggaaactctcatccagcagcatacccgtcggattcatcggcgaattaataaaaataccagccgtatgcggagtgacacacttacggatcgcttctatatcatattgcaaaccattctcttcggacagaggcaccaagacaggttttgcctgggcagccaacacgaagttacgataacacgcatatcccggattggacagaatcacttcactgtccgagttgcaaagcaacatcaagaccagaaggatagagggagaagaaccggaagtgacgacaatacaatccggatcgacggtgactccatattcacgttgataaaaagcggctatttcacgacgcagttccggatcccccaaagagtgagtgtaatgtgtgagatgccggtcgtaggcagccttagcagcttccgccacacaagccggaacgtcaaagtccggctcaccgacttccaggtggataacgtccacaccttgtttctgtaattcatttgcacgctccaatacatccatcacgataaaggaggtcatttgttctacttggggattcgtatgtttcattgtttttcttttatctgtcaggctgcaaagataattcttttcagcctgtttttgtaacatatcgacaaaaagctctatatttgtgctttcaaatcgttagtaaggatgaaacaagagtttacacgaatagcagtaaaagtaggcagtaacgtattggcacgccgtgacggtacattggacgtcacccgtatgtcggcactcgttgaccagatagcagaattaaataaatccggagtagagatcattctcatttcttcgggagcagttgcttcgggacgcagcgaaatacacccacagaaaaagctcgacagtgtagaccagcgccagttattctccgccgtaggacaggctaaattaataaaccgctactacgaacttttccgtgaacacggcattgcggtaggtcaggtgctgactaccaaagagaatttcagtacccgccgccattatctgaatcagaagaactgtatgacggtgatgctcgaaaacggcgtcatccccatcgtcaatgagaatgatacgatttcggtcagcgagcttatgttcacggacaatgacgaactttccgggctgatcgcttccatgatggatgcgcaggcactgattatcctgagtaacatagacggaatctacaacggttcaccctccgatcctgcctccgctgtcattcgggagatcgagcacggaaaggatttatccaactatatccaggctaccaaatcgagcttcggccgcggcggtatgctgacgaaaacgaatattgcccgcaaggtagccgacgaagggattacggtcatcatcgccaacggaaaacgggataatattctcgtagacttgttgcaacagccggacgatacagtttgcacgcgctttatcccttccaccgaagcggtatccagtgtaaagaaatggattgcccacagcgaaggattcgccaaaggggaaattcatattaacgaatgtgccacggatatcctcagttcggagaaggcagccagcattcttccggtcggaatcacccacatcgaaggcgaatttgagaaagacgatattgtacgcatcatggactttctgggcaatcaggttggtgtaggaaaagcgaactgcgattccgcacaagccagggaagcaatgggcaaacatggcaaaaagcctgtagtacattacgactatctgtatatcgaataaaaaatataaaacgtaaaaaggagcaaatgactacaaatttaaacggaactttcgctgctgtacaagctgccagccgggaattggcattgctgagtgacgacaccatcaatcagatactgaatgcggtcgctgatgctaccattgccgaaacatcctttatcctgtcagaaaatgaaaaggacctggcacggatggacaagagtaacccgaagtacgaccggttaaaactgacggaagagaggctgaaaggcatcgctgccgacacacgtaatgtagccactctcccctccccgctgggaaggattttaaaggaaacctcccgccccaatggcatgaagctgaccaaagtcagtgtacccttcggagtaataggcatcatctatgaagcgcgtcctaatgtcagcttcgacgtcttttccctttgcctgaaaagtggaaatgcctgcatcctgaaaggtggaagtgacgcagacgattccaaccgtgccatcatcagcgtcattcacaaggtacttgaaaagtttcatgtcaacccacatatagtagaactgctcccggcagacagagaggctacggcagcattactgaatgcgacaggctatgtagacctgattattccgagaggaagcagcaatctgataaatttcgtgcgcgagaatgcacggattcctgtcattgaaacaggagcaggtatctgccatacttattttgatgagttcggagatacccggaaaggagcggatattatccataatgccaagacacgccgtgtcagtgtctgcaatgcgctcgactgtaccatcattcatgagaaacgtctgggggatttgcctgcgctctgcgatcaactgaaagaaagcaaggttactatctatgcagatacacaggcttatcaggcactggaaggatattatccggctgagttgctgcaacctgccactccggaaagcttcggaacagagtttctggattacaagatggctgtcaaaacggtgaaaagctttgaagacgcactggggcatatacaggaaaacagttcaaggcacagcgaatgtatcgtgaccgaaaacaaagagcgtgccaccttgtttactaagatagtagatgcggcatgcgtatataccaacgtatctaccgctttcaccgacggtgcacaattcggcctgggagccgaaatcggtatcagtactcaaaagctgcatgcccgcggtccgatgggactggaggaaatcacttcctacaaatgggtgatcgaaggcgacggacagaccagatggtaaagtgaggaaacgacaaatgatcaattggacaataacgattaatgatagataaaatgaagaaatttacttgtgtacaggacatcggcgatttaaaatcagcccttgcagaagcatttgaaattcaaaaagaccgcttcaaatatgtagagttgggacgaaacaagacattgatgatgatcttctttaactccagcctccgcacccgcctcagcacacagaaagctgctctcaatctgggaatgaatgtaatggtgctggacatcaaccaaggtgcatggaaactggaaacagaacgtggcgtcatcatggatggtgacaaaccggaacatctgctggaagcgattcctgtgatgggttgttattgtgacatcatcggagtacgttcctttgcccgtttcgaagatcgcgattttgactatcaggagactattctgaatcaatttatccaatattccggacgtcctgtcttttcgatggaggcagctacccgccacccattgcagagctttgccgatttaatcaccattgaggaatataaaaagacggcacgtcccaaagtcgtaatgacttgggctccgcatccccgtccattgccacaggctgttcccaactcctttgcagagtggatgaatgccactgactatgatttcgttatcactcacccggaaggatatgagctggcgcctcaattcgtaggaaatgccaaggtagaatatgatcagatgaaggctttcgaaggagcagactttatatacgccaagaactgggctgcctatacaggcgacaattacggtcagatattaagcaaagaccgtgaatggacagtcagcgaccgacagatggcagtaaccaacaatgctttctttatgcactgcctgcctgttcgcagaaatatgatcgtcacggatgatgtaatcgaaagtcctcagtctatcgttatccccgaagctgccaaccgtgaaatctcggctacagtggttttgaagagattgattgagggattggaataaacggaacatctgtgaatgaaaccttgcttttattctcgcacctatgagaaaagattctcatgcctttgagaaatttttctcataggtatgagaattttttctcataagcatgagaatacattgagaatatagcaacatctattcaactgtatactagcacgataacgattgcgtcccttcagaattttatgtaaagcgcaaccatttattctagaatagatagaaaaaagccgtacagcaacaaccttagtattctatctcctttcctgccgcctgccaggcattgaatcctttaccaagctccacaaccttaaatcctttttcactaaggatcgccgcagctttcttgcttcgtttaccgctacggcaatacaatgcaaccggtttgctcttttgcaacaatgaatccgccatcgaggcaaaagagtcatccatcacatttatattgatcgtttttgcaatatgtccttctgaatattcagccagtgtacgaacatccagacgctgcacttcttcatcctgaatgatagaatcgaaatcctctacattcaccgttttaaagtctcctttctgctgacaggagaaaagagaagagagaaataaaaataatcccacgactaattgattcattttaaacatacgtactatattaatcagttcccatccggaacatattcaaatcccggatcacaatacttgcttgattctaccaccacaccatttttatctgtggtatgatacttgaattttatccttatggtttgatgaggattttcttcatccacatatttcgtcagaggaacagaaatgtaagcacggcgattatagttctcctcatccccattcgcatcatgaaacagagacaaggttacgactgtctcatccccctccgactctacactctcttctatcataccaaacacgtgctgtttgccactattgatattgatcttcacgttcagaatcatattcaaatagtcacgccccagccaaatgctggtcacatctaccggatcatacttcagtccgccttcaaaagccggatcgtcagccccctttggctccggtgtcaccaccgactgcaatgaatatatgacagccgtagcatcctccggatttacttcatagttactgatcacacgcctggccgagttcggagatatggttgatccggtacggtctttcgcaacagtcaacagctctcccttgtcaggaagcagactctgtataagaccatccgccccagccttcacagtgacaaattccaacttcacagaaggataatagtaatcatcatcatccccgcaggcagtcatcaggaaaagcattcccaaaagccagagtgtatgtaactttactttattcattggcaagcagctaaatagttcaccaacggattggcatacattaataacaattttccacgcaaaaagtcttcgtctttattcggaatctttattttgcccagttgttgctcgatataggtaacgaatcgttgtttctcttcgggagtgtaatgaccggcaaactcggatgtacccttcagcaagtcataggcaacgtaattgcccgaatagatccgatagttactatgaatcctctggtcgatgcaggcagatatgctggagaacagttcctgcttcggtaacgaacggtccagctgcgccaacctgtcattgatacagggagccgtctgaaaatgcactttccctttgtatccgaaaagaccggtctgcatactgatcaaatcgtcctgagtggttttcttatatccttctatatctcttttcaactgaaactcctgcgctttcagaaagtcacaggggtcatattcgtacgaaatggcaagaggagcgatattcatctccatcaaacggtcgatcaagtcgccttcaccacccatcgccagcatcttcagcacgctgtcctgagtacggtcgttcgagtctttggcacgtccttcgcgctgggcaatccagatggactggttcttctcattaatggtataatgcatataacgggacatccgtgccgaagattccagcatctgccgcatggtcagcgcccgttgtacaataaacgacttgttgacacgaaccagcttcttgatccacggataaaccagcagattgtcgccaatcgctatctcaaccgtatccatcccctgatcgatcagcaagatagaaaggaagcccgaatccaatataatatcccgatgattggagacatatgtataagccttactcttatccggcacagccgtatgatccagagtcagcccatccgtatggtccgctgctattttccataaaataccataacagaatgtttcctgaaaatccagcttgctcttacatgcgcgtattttctgcgccaaaagttcaaaagggacgttcggtatcgcatcagtagccgccttctgaaaagcaggatcagcaatcagctcctcaaagatttgaggaagttcctcatcattgtaaggacgaatctcatcaaactctgtagtatccataagctatgaagtttataaataagtattaggtattaagtattaggctgcgctgtaaaccgcatggaattaatacttattacctaatacttaatacctaaaatttattttctattatatcagtcatcacatcctttatatccagtccggcagcacgcacttgctggggaataaagcttgtagtggtcatccccggagttgtattcacttccagcagattgatcttttcgccggcagtcacaatataatccacacggatgataccggaacagcccaatatgtcataaatggccgaggtcagcatttgcacgcgattcgtcagttcgtccgagatgcgtgcaggagtaatctcgtctacctgaccattgtattttgcatcataatcaaagaactcattatgtgtcaccacttccgtaggcgggaagatgacggtcttgtctttggttttatagcagccgcaggttagctccgttccttccatgaatgcttctacgagcacttcctgggcttcttcaaaggccttaacaatggccggctgtatttgttctttcgtcttaacctttgttacaccgaagctcgaaccgcccagactcggcttgatgaaacaaggcaaaccgatcttttccatcacatcttcgtcggaaaccgattgtccctgacgcaatagcaacgattctgcaatacgcactccgaaggctttcaggtattggttgcaggtaaacttgtcataggtgatcgccgcagccagcaccccgcaacaagagtatggtatgtgcatcatgtcaaagtatccctgaagacggccgtcttcgcccggagtaccgtgaatggtaatataggcaaagtcaaacctgatcttttccgttcccagcataaagctgaaatcattgcggtctaccggtgcttttgcaccatccggcaattgtacttcccaacgggtcccctgcatctcgacaatgtacagtgtgtacttttccttatctatgaaggaatatattccctgtgcactacgcagggatacatgaaattcggaggtgtcacctccggctacgatagcaattgtgcgtttcattctatttctctgttacttatatagcctcgccacttctcgataagccgggtcatgtcatccggaagttcggaagtaaagtacatctcttcgcctgtgacgggatgtacgaaccccaatgtcatggcatgcagagcctgccggggacaagtgtcaaagcaattatttacaaattgtttgtatttactaaagtgagtacctttcagaatttcgtgaccgccatagcgttcgtcattgaaaagtacatgcccgatatgtttcatgtggacacgaatctgatgagtacgtccggtttcgagtatgcactctaccagcgtgacatatcccagccgttcaagcacccgataatgagtgaccgcgtgcttgcccatcgacgggtcggacataaccgccatctgcatccggtctttcggattacgggcgatactgcctacaatcgtgccttcatcctgttccacatttccccagacaagggcacggtatctgcgtttggtcgtcttattaaagaattgtattccgaggttggtcttggcatccggcgtcttggcaatcaccagcagaccggacgtatctttatcaatccggtggaccaggccgacgtgcgggtcattggcatcatattcaggaatatctttcatgtgccatgccaacgcattgacaagcgtaccgtgatagtttccgtgtcccggatgtactaccagtcccgcaggcttgttcactaccattacatatggatcttcgtaaacgatattaagggggatattttcgggaataatctcgttctcataacgaggacggtccatcatgacggtaatgacatcgagcggcttaaccttgtagctgctcttcaccggcttaccgttagccatgacgaatccatcttcggcagccttctgaatacggttgcgcgaagcattgacaatacgttcgaacagatatttgtcgactctgaccatcgcctgtcccttgtctacgaccacccgaaaatgttcgtaaagctgggattcgtcaccgacaggttctatatcatccaaatcattctccagttcatccggaagttcttcctcgatcatgtgaatctgtttcgttatttatcaattaaaaccaactatcatcctgacttgaaggggattctgaggaaacaggttcatctgccccttcaacattttccatggagtcgctttccaacggttcgttttctccgtttcctaccatcagtgtcaatgcagctcccaaaggtactttatctcccgcattcaatgagcgcccctgatatttaatgccgtacacccagtccttctcaccgttcatcaactgaatctcggtcagcttgaatccggcagcaagcactttcgcctgtgcctggcgcagagaactgttgtccgccacatcgggaacagcacgtaaaggaatactcagtgtattgatagtcaggtaaatggtgcggccttctttcactttttgtccgattcccgggttgacatcaagtacaatgccagctgccatattcttcacataattagaatcggaaacgacacataccaatccgtgattgcggaacatttttgaagcttcatccacagtcatcccttttacatcgggcacaaccaccgcctcaccgtgacgagtataaacatccagccatttcatcacgccgaacacaatcagcaccactgccacaatcatgacaaggatattcacccagaaatatttatttgttttaaaagaaaagaattctttgattgtcatacgctttgctgttaatccgcgccaaagatactacaaattagttgaatttcggaatagtgggcaatgaaaatgtccctgcataaatgcaaggacacctgtcatcaccacaattgttgcaactatattccccactcctatagatttcaacaaccttatattctaggatgcggcttccggattctctgagcacaaccgtctgtcgcatatattccgtctatgatctgtgacaaagaaagctaaaaagtgacaaagagcattccattaaacattatttaatactctatttaactactgtgccaagagtcctgtactttttatcataaaaaggaagttataaccaactttaatgaaaatagaagcaaacaaaaaaggcggagtttaaaactccgccttttttgtttctgagtgatgattaccacttctgtccgttgtactcatcagaaacagtcagtttctttctgcctttcgcacggcgagcagctaatactctacgaccattagccgatgccattctctcacggaaaccgtgtttgttctttctctttctgttagagggttgaaatgttcttttcattactgtatcttgtttttatgttattattctacgtaatcgggctgcaaaaatagagactttttttaaattaaccaagcgataagtcatttttgctcaaaagtttttgtgttttttactgatttagattacttttgcactcgaattacgacgaagacaattaaataacaataatataataagaaaaacagcagtatgattaatgctcaagacatcaaaaacggaacttgtatccgtatggacggaaagctctatttctgtatagaattcctgcatgtaaaaccaggtaaaggtaacacatttatgcgtaccaagctgaaagacgtagtaagcggttatgttctcgaacgccgtttcaatatcggtgaaaaactggaagatgtacgcgttgaacgtcgtccataccaattcctgtataaagaaggagaagactatatcttcatgaaccaggaaacttttgaccaacaccccatcgctcacgacctgatcaatggtgtagacttcttgctcgaaggtgcagtgctggacgttgtttctgacgcttctaccgaaactgtactttatgcagacatgccgatcaaagttcagatgaaggttacttatacagaaccgggaatgaaaggtgatacagccaccaacacactgaaacctgctaccgtagaatcaggtgcaacagtacgtgtgcctttgttcatcagcgaaggtgaaacaattgaaatcgacactcgtgacggttcttacgtaggacgcgtaaaagcataaatgtcatacaaatgacataaagaaacggtggatttgcttcggcacttccaccgttttttattacctttgtccatcactaaccctaatattaagatacaaaagaatgaaaaagttgatttacacactgctctttgtccttatttccgttgcagccaacggtcagcaggcaaagtatgtattctatttcatcggagacggaatgggagtcaatcaggtaaatggtacagagatgtatcaggcagaactgcaaaacgggcgcatcggcgttgaacctttattgttcacccaatttccggtagcaacgatggcaaccactttctccgcgacaaactctgttaccgactctgccgctgcgggtactgcactggctaccggaaagaagacctacaacagtgccatctctgtaggagaagacaaaaacccgattgaaaccgtagccgaaaaagccaagaaggccggaaagaaagtaggtgtcactacttccgtcagcgtagaccacgccactcctgccgctttctacgctcatcaggcagaccgtaatatgaattatgaaatcgctgtcgacctgacaaaagcaaactttgacttctatgcaggcggtggttttctgaaaccggacaagacgtatgacaagaaagacgctcccaacatcttccctattttcgaagaagcaggttacaccgtagcacgtggctacagcgattataaagccaaaagcaaggatgccggcaaaatgatcctgatacaggaagaaggcaaagatccatcctgcctgccttatgctatcgaccgtaaaagcgacgacttgactctcgcccaaatcacagaaagcgcaatcgacttcctgaccaaaggcaagaacaaaggattcttcttaatggtagaaggtggaaagattgactgggcttgccacggtaatgacgccgctaccgtattcaatgaagtaaaggacatggatgacgctatcaaagtagcttacgaattctacaagaaacatccgaaagaaacactgatcgttgttacggccgaccacgaaaccggtggtatcgtactaggtacaggcaaatatgcgttgaacctgaaagcattgcaatatcaaaaacattctgctgacggattgtccagacgtatcagcgaactaagaaaatcaaaaggcaacaaagtgacttgggaagacatgaaagaattcctgggtgaagaaatgggcttctggaaacagttccctatttcctgggaacaggaaaagaagctgcgtgacgagttcgaacaatcctttgtcagaaataaagtggtatttgccgaaagcatgtactctaaaagcgagccgatggctgcacgcgctaaagaagtaatggaccagatatctatggtaggctgggtaagcggcggtcactctgccggttatgtgccggtatttgctatcggtgccggttctcaactgttcggtgagaagattgacaatacggaaattccgaaacggatagctaaagctgccggatataaataaagaattgactgcacgaatatgtaatcaaaacactatttattttcatttaggcacggatttcacggattaacacggttctattcaattaaagaccgtgaaattcgtgcaatccgtgcctaaataatattatcattataatagatgattttcattgggtcccttctcttgatatgtttcctgtagtgtactgaataagttgacacttcaaaaatcgaaaataaagatgaaatattcgaaaaagaagtacaactattacagtgatgatgaacgaatgtcttatattcgtgagtatttatcaagtcccg

SEQ ID NO: 67 - DNA, 40784 bp, Bacteroides thetaiotaomicron
caaaatacgacgaatattaagccttattacctaattactgaaaaaatagtcgcatagacaaaaaaagaggaacgactattttatattaaaaaaagaaggggatgtgccttagttttgacacagcccctttctctatgaaaagtgtattttgtctatttcacaatcccacgttccgaaccttttacgaaattcacgatattctcgatttcttcactcatcggaacctgatcgataatcttctggacagcatcctgaacactgaaattaccttgatagatcaaccggtaagcattggcaatatgacgaaggattctttccgacgtattgtgatgctgtgacagaacgactgcattcactccatgataggcaacaggattgccggacataattacgtagggaggaacatctttggagatgcggcatccgctttgtacaagtgtccagctaccaatgtgacaatattggtgcaacgttacgttgccgcttaggatcacacaatcatctaatgagcattctcctgcaattgtagtacctattcctaccacacaattattgctgatctgcacatcatggcaaaggtgtaccttatccatcaggtagttcccgtttccaattctggtagcatttcctgcaaaagtggcacggctgattactacattctcacggatatcgttattgtctccgatgatcagactgctttcttcccctgtatagtgaaagtcttgcggttctgctcccaggacagcattctgatgtattttgtttcctttccccatttttgtacctttcaggatactggcgtatgacatgatggtacagtcatcgccgatttccacatctttctcgatgtaggcgaaaggcaagacagttacattcttgcctaatttcgcttcggggtctacgtaagctaacggactaatcataatagtatatgtttaaagttaatcttctcttccaccgcctaatgcctggtagaggctgaccacagcctgcatcttgtcgaaacagtcggaaacctgagaaatctgtgcgctcagataagattgctgtgccgacaatacttccagataggttgacgtccctaagttaaacaattcttttgtatcttccgaagctttcttggcagattctacctgcatttggcgggattcagcctttttactggtgttttggtataaacttagcgcattgctgacttcgcttccggcattgtacaatgtttgctggaaagataatttagcttgttcttcctgtgctttcgctgctttcaggcgggcgatattcgtaccacggtagaacaatggctgagtcagtgaaccgatagcggaagccagtaacttacccggattgataatggcggaacctgcactgtttgtccatccggcagaaccgctgagagtgatctgcggatagaaagcggcacgggcagagttcgtattataatagcagcttgccaaagacatttcggctgcttttacgtccggacggttagataacaactgcaaaggaatccctgcggaaagttcctcaggaagtgcctgtgcttccagtacaccacgtttgatcgcgtgcggagcttctcccaagaaggtagacagggcattttccgtttcgcggatgctctgctcgatgtcggggatggaagccactacttgtgcataggcagctttgctttgtgctaaagcggcagatgtgtaggtcgatctttccgaaagtgcctgtacggtttcagcattacgtttcagtacctcagccgtagcctgagtgatctccagctggcggtcgagcataagcaaggtataatacatgttggcaatgttggcaataacttgtgtctgtacagcctggcgataagcctttgtctgtttcagggtgacttgtgcatttcgtttggagttcagcagttgcccgaacaggtctacttgccaactggcagtaaccggcaatgagtacgttttagttgctgcgttcttgtcaaaactgctgattgttccctgtggagacaaaccgatggacggtgcataagccagtcgggctgacatcagagacgcttctgccgctttgacgttcaatgcagcggaaaggaggtcagtgttttgtttcagtccctgttcgatgagagactggagctgtgggtcggtgaagacttctctccacggcaggttaccgaagttggtggtatccgaagctaatgtatcattgtccgctgccggatcacgatacaggccggaagcggtaatatcttcgggtctgtcatacgacttatagatgtggcagctgctcaggagagcagttgcacacaacatatatagaatctgtttcttcatatcgaatttcattatttagcgtattgttcaatctcagttacggcatccgtattgtcgatgtcttcccattccatcggtttaaccttctcttgcaggtactggaagataacgaacaaagcaggaacgatgaagatctggcagatcataccgatcaacataccaccaatagaagctgtacccagtgtacggttaccgtgggcacctacaccgaatgcgaacatcaacggaagcagaccgactaccatagccaatgaggtcatcaggatcgggcggagacgggcaccggcacccagaacggctgcccatgtgatgctcatacccatcttacgacggtcgagggcaaactctacaatcaggatcgcgttctttgccaacagacccatcaacatgatcaacgcaatctgcatatagatattgttggacatggtaccgagtatcattttcaaggccgatatactaccgatcgcgctcattccgttgacgaacaggaagctgcctagcaaaccgaacggaatggataacaatacggccagcggaagaatataactttcgtactgagcactcaacagcaaataaacgaatacgaaacaaaggataaagatcaaaccagtcgtactgccgctactttgtgcttcctcacgagccatgcctcctagttcataagtgtaacctgccggaaggttttctttggccacttctgccagtgcagccagtgcctgaccggaagtataaccggaagccggagctaccatcaccttcatggaagtatacaagttgaaacggctgataatatcaggtccgtataccttctctacagagatgaactgggaaatcggagccatttcgccttggttgttacgaaccttgacattattcagtgattccagattcttgcgtgataacgggtccgactgaatcattacgcggtacatcttaccgaaacggttgaagttggatgcgtacaaacctccgtaatatccctgcatcgtgctaagaatatcgcttgggctgatacctgccttcttacaagctgccgcatcaatatcaatcatatattgcgggaagttcgggttgaaggtcgtttttgcagagttaatttccggacgtgcctccaatgctgcggtgtagttgttggctacatcaaagaatttgttcaggtcaccacctgtcttgtcctgcatgttcacctcgatatccgtagatgccgagtaaccggggatcataggaggagcgaagaacaatacctgtgcttccttgataatcttctgcgcacgcatgtataaagaaccgacgataacgtctgagttctgaatcatggagcgttcatcccagtctttcagtttgataatgaaagaaccgtaagacggtccctgaccaccaatgaaactgaaaccggagatcaatgtacgtgaagctacggcagggtccgcagcaatcagactgtctacacgtgccagtatttgttccgagcggtcttgtgatgtacccggaggtagtgttacagctcccatcagcgtaccggtatcttcattagggaccatacctgtcggagtagtgttcataaagaagatcagcaatacgatagagagaaccaccagtcccattgacaaccactttttctggataaagaagagtacgcgtttcttatacctctttaatatagagtcataagcggcattgaaagaagtgtggaagcgagaaacaagtgtttgtttcttatctccatgatcagtatgcggtttcagaagaacggcacacaatgccggactcagtgtcaaggcgttcaatgcggacagaccgatagcgatagccattgtcaaaccgaattggcgatagaacgtacctgccgtaccacccatgaaacttaccggaataaacacggacatcatgaccagtgtgatagatacgatggcaccacccaattcgttcatcgcatcgatagatgccagacgggcggatgtatatccctgatcgagcttggcatgtacaccctcgacaaccacaatcgcatcatcgaccacaatcgcaatggcaagcacaagggcacacagggtcagcaagttcaaactgaatccgatcagtgacagtacgaagaatgtaccgataagggctaccggaatagcaatggtcggaatcaaggtagaacgcaaatcctgcaagaagatatatactacgataaataccagaataaatgcctcgatcaatgtcttcaacacttcgtggatagaagcgaacaagaagtcgttggcgttcatagaaacgttaatcttcaatcccgaaggtagtgttgtggatgcttcatccaataatttctggatatcagtgatggtttgcgtagcatttgtaccagccatctgataaacgatacaggttacagctttgtgtccgtttacacggttggtaaagttatatcccagacggtccagctgaatctccgcaatatcattcagtcgaagtacctcaccgttaggcagagacttgatgacaatgttctcaaactcttccggctgttgcagacgtcctttgtaacgaatggtatattggaaagtctggttactacgttcaccgaattgtcccggagccgcttctatattctgttcagccaaagcggtagatacgtcgttggggatcagtttatactgagccattacgtccggtctcagccagatacgcatggagtagtcctgacccatcacactggcatcacctacaccctgtacacgttgaacctgaggaatcaggttgatttttgcatagttctcgatgaaagcatctgtatatgtatcggtttcatcgtaaagagagaatactaccagcatggatgtctgacgtttctgagtagtcacaccaattctggtaacttcggcaggtagcaaaccttgtgccatggaaacacggttctgtacgttaacggcagccatatccggatcagttccttgtttgaagtagatcgagatatcaccggaaccggtattggatgcgttggaagtcatgtacatcatgttttctacaccgttgatctgctcttccagaggggcaattacagagttcaatacggttgatgcactggcacccgtatatgtggctcttaccgatacggtaggaggcgcaatgtccggatactgtgtgataggcagtgttgccaatccgatagcacctaggataactatcaaaatggaaataactgttgatagtaccggacggttaatgaatttatctaatttcatacgattatctaaattattagttgaaagctgtagctaaatttccgtcgtgctggtctttcaaatgctgttgatagttcgcttctttttgagccggcgtgattggttgtattttttggccgtccttcaggctctgtacaccttcgattacgattttatcgccggggttcagtccggaagttaccagatattcttttccgttgtccaggttgaatataccgatctcggtatatttcaccgtgttgtccggctgcagaacgtaaacgaactttttgtcctggatttctacagtagccgattgtgggatgctgataacgttctccatattataagggatcagaacgttggcagttccaccactacgaagcatatgctccttgttagggaagatagcacgcatgctaacagaaccggttgactggtcgatcactcctgtgatagcgtctacctttccttctgcatcatatgttgtgccgtcaatcaattgtagtttgatggctggtattttactgatttcttctttgatggttcctccggttttggtcatagccagcagttctttttcagttgtagagaagtatacatatacttcgtctatttcagatactgtagtcattggtgtagccatagaggggcttacgagtgctcccaaacgataaggaatgtcgttgataacaccgtctgaaggactctttacttgtgtgaaagagtaattttgttgtgctgtggtcagctgtgctttagcctgggcgagttgtgcctgagcctgtgccagtgagttcttcgccattgacaagtcataatcgctgataatctgtttcttgttcagttcgatcttattgtcaacagtcatttgttgtgtattcacggctgcttctgctgttgcaactgaagcttttgctgtgcgtactgctgcttcatactgagtagggtctatgatgaataagagctgtcctttgcgaacggttgctccttcatctacacataactttgtgatgaatcccgatacctgcgggcggatttctacgtcttgtctacctttgatagtagccggataagctttcattagatttgcagttgtcttctgtaattcttgtactgcatattctgggactttccctgtgtcattgcccttattgccgcaactagacaagagggctaagcaaaatgcaaaaaaaacaattctacttttcatactttatatttatctgttttttaaaattgtgcgttcgtcgctgtgtacattcattgtatggatagatgatctaaggaagaaaagccggaaacttattccatgaaataagtttccggctgcaaaagtactttaaattcggtattcttgtactctgataccgtgttttttaactatgttttttacttcagtttatgatatacaggattcattatgaaactgaactcataatcctgatatggaaggcggtatttttccaaagcgatagcaccccagctatttacgcaggcgagtcccgtttgtaccttatcaatacagaagtttgtgaagttggctttttctacttccggtgagtgtcgctggtctttgccggcaccgtcatccaatgattcgattgtataattcagtgcggaagcggagaacggtgcatcagctacaaactgcagtccgttgccgccgatattaagcagtctccaccaacggatatcagttttggtaccagtttcctgcgggcggatatatggatagaattgttcttctacggtctggcggtacttgccgatccttgcggcgtggttacggtcagaatagttttcacccggtccgcgtccgtaatattcaatctcattgaaggtgacaggcatacgcagctgcattccgaaacggaacatatcggaaactttcttgctcttgtctgcttccatcttttgagtcacttttactgctcccttattattgatggcatacgtcaggaacagctttccaccaatagatttcatgtcgtattctgcgcgaaccactgcttgttcgttttctatatcatgcttcaatgaagtcagttttagttccggattcttccatgcgccatatctgtgttgtaatcctgctccaaagtcgttgtcggtcggagcacgccagaagttgggagtcagtgcacttccgtcttccatcagttgcgttccgctgacgtcgtagcggcagaggtaaccgttgtgcttgttgaattcgagcgtgaagtcttcgccggaaacaatcagatagttgtggtcgttatcctggaaagagggaactacgactgcgatattggaggactgcttgttttccagttttagttccggtgccttgtagtcacggatactcatttggtcataagcgatggtttctcccgcaggaagcaatgtctcggcagcttttagcttgtagctgacgttcagaagcaactccttgcaagaacagatgttctttatgtcgaatgggagttgaagttttgcagtctgttgcggggctacattcaggtctgatacgatgccgttttgtatgatttccccgttagccagtaactgccattccagatagaatgcggacaagtcacggaagaagttctcgttatagatattgatctcacctttggaaagatcggccggagtagtccagatattctgatagaaatatcctacttcgtaagcatgcgggttcggcacgcggtcagggctgatcaagccgttgtcattgaagttattgtccgaagcgtcatatttgttaaagtcgcctccatagccgtagatggctacaccgtctttatttttccaatggcaggactggtcgacaaagtcccagataaatccaccttgatatttcgggtacttgcgggtgatgtcccagtactccttgaatccaccttgtgagttgcccatagcgtgtgcatattcgcattggataaggggtttgtcaatgttgccttcacaatatttgatacagttattgtaatcataatacatcgggcagaaaatgtcggtgaattcactggttcccgcttgttcatattgtacggcacgtgtcttgtcttcgttcttgatccatgtatagcaatgttcgaagttaggtcccataccggcttcattacccaatgaccagaagatgatggacggatggttgtaaccacgttgtacattgcgctgattacgttccatatgtgctttggcgtaaatggggtttttggcaaggctcttgtctccatatcccattccgtgagattcgacattggcttcggctactacgtataaaccatattggtcgcaaagatcataccagcggttgtcgtccggataatggcaggtacgtactgcattgatattaagctgtttcataaccttgatatcttgtatcatacgttcgagggaaacgacataaccaccgtccgggtccatttcatgacggtcggctcctttaaagagtactggttggccgttgacgagtatttgtccgcctgtcagttcgatcttgcggaaacctaccttgacagggatcacttcagtaacggtacttccatttttcagagtagcggtcaatgtgtagaggttgggcgtttcagcagtccatttggcaggattggctacgttgatagtcgtgtttaatttgccggaacctttcagatcggctgtggctacacttttcccttgtgcgtctgtcaggtcaagagctacagtgccgctgcctttcatgtcgatagctatgttcagtgtaccgtctttatactggctgtccagatcgggagtgacgcgaatatcctgaatgcgtttcttgtcgcgtgcatacagatagcagtcgcgtcctacgccggaataacggaagaagtcctgatcttccagataactgccgtcgcaccagcggaacacctggaaggcaatcaggtttttgccaggtttcaggtagttggtcagatcaaattcggcttccagtttgctgtcttcgctatagcctacgtagcggccgtttacccaaagatacatattggaagttaccgagccgaagtgggcaaagatgtcttttcctttccagtcggcaggaagaacgatttcttttcggtaagagcctacgtgattgttttctgtggggacaaggggaggattgttctgaaattggtttctccaggcataaccgacatttacatagatcggatcgccataaccattcaattcccaaacggcgggcactttaatattgtcccatcctttgtcgttaaaactggtctgataaaagtttgtcgggcgtgcgtctgcatttcttacccagttgaatttccagagaccgttcagagtcataaaattctgagagtcttctttgctgcccgctttagcttcatcagccgatgcataggcaaaataattagtgtgcattgcggagcggtttacggaattcacttccggatctttccactcgttaaagttttgtgcttggatggctgttgttagtcctagtgcagccaaacagcaggaaagtagttgtttcttcatgggttttttgtattaggtttgaatttcgggagtcaaagatagggatttattaacaagataaggaccaataatcattcatttaaggctactttttaataaattagctagaaagtgtagtgtttattggtgaagaacgtttatttttgcaccatgttacaatttgagaatcaaaagataaaacatatcgtgcgcaaagctcttccggtgattgcactggtggctatattgtactcctgtgccagcattggacggccggaaggcgggcctaaggattacgatcctccgcgttttgtcggcagtactcctgctgcaggtgcgattaacaataagagaactaaagtttctcttcagttcgatgagtttattaagctagagaaagcaaccgagaaagtggttgtttctcctcctcagattcaacaaccggagataaaggcttccggaaagaaaatacaagtgaatctgcttgactcactaaagcctaatactacctatactatagatttctcggatgctatcgtcgataataacgaaggcaatcctctgggtaattttgcatttactttttctaccggtgcgcagatcgatacgatggaagtatcgggaacggtacttgacgcctctaatctggagcctattaaaggtatactggtcggactgcatgcaaatctgaatgactccgcctttactaaacttcctttcgaccgtgtggcacgtaccgatagtcgtgggcgtttctctattcgtggggtagctcccggcaagtatcgtatctttggtttgatggattcagatcagaactttgctttcactcagaagagtgaagttattgcttttaatgattcactgatcatcccccgtatggaagaaagactccgtatggatacggcttgggtggattcattgacttatgatacgatcgttgagaagaaatatatgcattatttgccggatgatgtgattctccgtgcttttaaagagctcaattattcgcaatatttgattaagtccgaacgactggttccccagaaattcaccttttattttgctggtaaagcagataccctgcctgtgctgaaaggtttgaacttcgatgaaaaggaggcttttgtgatagaaaagaaccaacggaacgatacgattcattattgggtaaaggactctttgctctataaacaggatactctggcccttagccttacctatctttatacggatacgctgaaccagttaattccgcgtacagataccttgaaattggtatccaaacaaaagactctgaccaaagaagagcccgagaagaagaaaaagaagaaaaagaaagagggtgaagaagatgagccgataccgactaaattcttaccggtgaatgtgaatgcaccttcatcaatggacgtgtatggctatgtttctttaaactttgaggagccgattgcaagttttgatactgcggcaattcatctgcggcagaaggtggatacgatttggaaagatattcctttcgaattcgaacaagactcattgaatctgaggcggtttaatctgtatccggaaaatgattgggagcctacaatggaatatgagttctcggtggactcaactgcgtttcatggcatttatggtttgtttaccgataagataaaacaatcatttaaggtacgtagcgaggatgaatattttactcttcattttattgttacaggagcagatcctcaggcatttgtagaattactggatacccaagataaagtggttcgacgaagactggtggaggatggaagggcagatttctattacctgaatccggggaaatatgccgccagactgattaatgatagaaatggaaacggagaatgggacacgggagactatgcaaaaggaatacaaccggaagaagtttactatttccccaaggttgttgaatataaagcgttatgggatgttgaccaaaactgggatatacacgcaactcctgtagacaaacagaaactggatgaactaaaaaaacaaaaaccagatgaagacaagaaaaagaaagaaagagaaagagatagaaataaccaaaaccgtaaccgtcgctaatttgcgacgtcatctaattgttggaattcttgcattgttgatgggaagttttgcgcttcctgccaatgctcagtgtgaagctaaaaacgatgcttttcaatccggagagcatgtaatgtatgacttgtacttcaactggaaattcgtttgggtgaaagcgggtatagccagtctgacgactaatgcaactacctatcattcggaaccggcttaccgtatcaatctgcttgccttaggtagcaagcgtgccgacttctttttcaagatgcgcgatacactgacttgcgtcatgggtgaaaaactggaacctcgttatttccgtaaaggtgccgaggaaggaaaacgctatacggtagatgaggcttggttctcttataaagacggcctttgctttgccaaacaaaaacgtacgttccgtgacggagaagttcaggagtcggaagaaagcgacagtcgctgcatctacgatatgctgactatccttgcccaagcgcgttcttatgatcctgctgattataaggtaggcgataaaatcaaattcccgatggctaccggacgtaaagtggaagaacagacactgatttatcggggaaaagagaatgtgaaagcggaaaatggggttacctatcgctgcctgatcttctcattagttgaatacgataaaaaagggaaagaaaaggaagtgattactttcttcgtaacagatgataagaaccaccttcctgtccgtttagatatgttcttgaatttcggttcagccaaagctttcttaaatgatgtcagaggtcatcgtcatccattgacttctatagttaaatagtctgtctacagagtaaaaggtactttctgatctttccggaaaacacttgattcgaatgtagcgatcaagtctccgttctggttagtaatatctatttgatagcagccggtgcttcggccgatataccgttcgcgtgcctcggcatagagggtgtcgcccggaccgctggcacgcagaaaagtgattgaggatgaaagagagaaagcgagtgttccgtgcgaattggcagctgcggcgagtgccagatctgccagcgtgaaaatcgctcctccttgtgtccgcgctccggcattaagatgttcgggttttatttccagtttggctttactgtatccttcgcgtacttcaagcaatactacgcctgcattttcggcgaacaggtcctttttaaaaaactcttgtggggtcataatgattaattttgaattactaatttgaaacgttgaatgataagttatgagagccgaattagcctataatttaaaattcaagattcttccgcaaatgtaataaatatattcccatatatggctgtcggatacttacgtttttagggggtattattcttcatcaatctcgaataccttatgactggtatggtgtttgcattcgtatcatctaataaaaatgctatatggagtatcctgataaaagaaagaggagataagcttctatgtttaatcaagtgcttgtctcctccttttttaattttctcttaccattcaatagcttgatcctcatccggtatcaacgggttgatctggcgttccattgtcatagaaccttttacttcgtaagttatcggataatccggattggaagtgacatccgtgtacttataactcagttccagtgtggtaaggtggcgttccatatatttgatggtctcgtgctgaatgattcgtttttcatatttgcattctcccaatggtcggatattgattcccggttcgccttcgtcaccgtacaatctcaactttcctttaatagtaccttcctcgtcctccgttccttcttcaaactcgacgaatactttatacctggagcggttctcatcttccacccacgttgaaccggcatagaagaaaatggtattctcgtccactacgcgggctaagcgcgtatctaccttagcgggatcggttgtcgttccttcgatgtagatgttcatcagcgtggtgttatacgttccggagtagtcattgaacagattgactcccagcagcgctttataacgtcccttatatttgttttgaacataagaagggtcttcttcaatagtcagcggaagtacgtatttctcatccagttccaacccgttaaagttgaaatggatggggtagagctgtatattctctcccgcaggaatatggcaaatgtttgattcaaaagaataatgctgttctgcaagggggacataccagaggtcctgacgacctacggggaatttttcctggttaagtattcggagcgtatcctcatccacggctatttttgcatcgatattccgactgttgcttttcgagccgctgacaatgaccggcaactggtatattcctgttccatccggctgatagcgtacataaatttcactcaagccgttgtcacctaaaggtgccttgaaagaaagcatctgtgtgtaaagttcatctttccactcgtcattgcatgcactgaatgttgcatacatccccagtatcattcctaaaatatataattttctcatattgatcttttggtttataatgttaacactaatcataattctgccatccgggagcttgtgagagattattgttgcgtttcagctcatcgaagctgataggccagaagtactgtttgcgtgagaaagaagtctgtagttcggccactctgactggcagataaaacatgtccttgtattcttcgttcatcagtgtattgcaaccgtagatttgttctccttcatgttcttcgacaattttccaacgacgcaggtcatagtagcgttgggtttccgcaaagaattcgatctgccgttcatgaactattttttcaaagaattttttcgggttttcatatacttcatcgctatagtcggggactccggcacgcatacggacaggcttaactccacgtcgcatctgttctttgtcacggaagatgtcgtaagtctggcttccgtcccatgaggtcacctggtagtgtgtcccttcggaaatattattcagtgcttctgcatacattagtaatatgtcggcataacgaagtgtaggttccactttttggtagatagagcctccccatttggcgcaatcgttcggatttacatatttcatgatgccgatgcccgtaatgcaccagttatcagatccattgatacgaccgtcggttgctccgcgataataccagatttgtttatttcgtgagtcttttcctccttcttccttaatgctcagtgcgttccattgagctccgttgaaagctacggaagcatagaaacgaggttcacggttggtgtatccccaccatactccattttttacattgtcgtacttgtgttcatctttgttttcatcgtttgtgaacttccctttccataatgtgtagcattctttgtcaaatgatgtaccatctgccatagcgtatgcttcactctgcttcagggtcattccgtgtacgttatatcctccaaaagttccgggcagttgatgctttacgaaatctaccatcgtgttgtctgtttttaagtcattgctgtcaccattggttcctcgggtaaaaataagttccggattttcggctgcatagatatctccattaaaaagagaccgatatgattcaaatggatctatattggaccatccttccggaaaaggcttgttactgtattcctcatgatatggcggttcaatagtggttggataagcctcgtctgtactaaccgggcgtctttcaaaagtataaagtttgtagagtccgctcatttccgagtactcgatcatgtctctggcagaagcagcggcttttgcccatttctcttcattgtattcttgtggaatcaactgttgcccgtccttgttggtgaagtctgccatttccgtatttccgtttaccagcggactggcagcataaaggaaaactttggcacgtacagccaacgcggcccctttagtcgggcgggcaatgttcaagttatcgcgtttttcgaacagttcggtagctgcaatttccagttccgaagtgatgaatgacacgcactcatcataggttttacgtgggtaggccagctcgtcatacgattttgtatagtcggctccttccggtggtaggataggtatcggaccgaattttctcagcagtaaccagtaaaaataggcacgcagaaaacgtgcctgtcctcttacgtccgtcacttcctccggagtgagatcttcattctcatacaattcattcagtagaatggaggcttgatagattccgtcatacgaccatttccaagcattttggccaccagtggaatttaaatattcgccgcgcttgaatttagcaaaacgatctcctcgttcgttgaatacttggtcgtctgagaaattgaaagggcatacgtcactgtgtcccacctccagattatctccctgcaggcgactgtagcagaatgacagccattgaagtgtatagtctttgtccgagaaaatgcgttctgtagattgttggtctctgaaatagcgatctacatttaggaaatcggaacaggaagtgagtcccaagccgagtaccactgctcccaataaaatgtatttatttttattcataacttttcttttaatgattgttttagattcctactgtcagtccgatggtcactgttctggataacggatattgttgtccattggaactacccagttccggatcccaaagcttaaagtcggagaaggtcagcagattcgttcccatcaggtagaggcgcacacggtccaaatggagtttattgacaaaccgtttggggatgttgtaacctaattccacattctttaaacggatgtacgaaccgtttcgcagccagtaagtagaagcacgatagttgttgctattacctccataactcagacgcgggtatttggcattcggatcttcgttggttcccagcgaccagtagttacccactacatccgtcagaatattgccccatgacttctcttggaatggatatacggtgaatccgtctatgaagaaggatgacttgccggctccttggaagtgaacgttgatatcaaattctttccattgtgcagatacaccgaacccgtaaatcaggttagggcgggtggtcgcaccaatgggcacttcgtcatctccgttaatgactccgtcaccgtttacgtccttgtatttgatgtctcccggcatgatgcctgaaccctgtgagggtctgttgcggatttcttcatagtccttgaacagcccttcggctatcagaccgcgtgcctggtctacacggaatccgtatttcatcttatacggatagcggctgttctcttcgtcatactccttgatttcattcttactataggtcatgttggcacgtactgtaagatctacctcacctattctctgcttataagcgatattaccgtcaaaaccttcggacaagacagatcccacgttagcataaggttttgttgtgatgtgattcagaccgatgatttgaggaaggtaactacgtaccatataaataccgttgcgctgttcgtggaagtagtcaatgctgccactgaacttatcattgaacatagagaagtcaagtccgaggtcatgtttcttggctacctcccaagtgatgctgcttgatgcaattctcgaataggtcagtccggtataataataattactggtgccgatatcaccgtaataataaccgtcttcatcccatgtcccgaatttctctacgtatgggaagcgggttcccacattgtcgttacctaccttaccatatgagtagcgcagcttaaacatattcagccatttgagatgtttcttgatgattgactcttcagcgatgttccatgctacagaataggcgggaaagaatccaaactgctgacctgaggcgaagttctcggaaccgttgtaaccgaaattaaagtcaaagaagtagcggtatttccatccgtatgtgaaacgtcctgcaaacccctgatgacgattctgaatactctgcacaatcttctcgtagctatctgtattgccgttgtgagatgtattggtagtcttatcctgagaatactttaaaacggcccctagcatgtggtcgccaaacgtacggttatagtgtagctctgcctccaagtattccttccgttgtccacttgaatacatcgttccgtccatcagtttctgcgtctctattcttctgaattgcagttctccgtcggaggtacgctgccgttccgctaaccaactttccggccatttgaaacggttgtcaccgttatccgtatatgtatcgaatccgaaacgtccgtagaattttaatccctttgtgataaatttcaaatcttgttcaagattaaccgtagtctgtattttattcttccatgtttcctgatatccctgctgggtggtcagtacccacggatttcttcgtccttcactaccgactgctgcccatttcccgtcactatactgtactggagaagcgatgggactgtatcccattagcgagtgccatatttcatgatactggcttcccggcaggttctgcttgtccaaagaacccgatacgcctacttttagcagcgtggattttgtcaggtctatgtctacattcatgcggtagttccagcgatggtagttggcattggtgttatagtccgtcattgcacgatccgtttcgtacataccgccttcatttacataactggcagaaatgaaataacgggctaccgtaccacctccggtcaagtctacagttgcgcgataagtgggggcaccgtctttcagtattaagttcatccagtccacattcgggaaaagatcctgatccagcccgtttgcaaacagttccaagtcgctttcgctataggccggagcctgactacgactaaccaaggcttcgttcatcatgcgggcatatgttggaccgtccacaaattccggagttctggtgcgtgtattatacgaggtttctactttggcattgacgcgggtcttcccttccttgccgcgtttggtcgtgatcaagacaacgccatttgcaccgcgtgaaccgtaaatggcggttgcggaggcatctttcaacacggagaagtcctggatatcttccacattgatttcattcatatcacgttcgaagccatcgaccaacaccaatgcactgcctccggcaccgaaagtggagataccgcgtatccagaactcagaaatattgctacccggctgtccggaagtctggcgggcgagtataccggctacattgcctgcaagagcattggtgatgcttgccgtcggagtacgtagctgggaaacgtcgactgtggtaacggcacctgtcacagttaccttcttctgagcaccggtccctgtgacaacaacctcgtcgatgaccgtttctttcgtctctgccataacgatgttaatgatttttttgtctttgataaagatttcctgctttgtaaatcccacataggaaaaaatcaagtaagagtaattgggaaccttgatcttgtaacgtccgtttatgtctgttatcgcaccgaagccgggcatatttcttgctgtaacgttcacgcctattaaaggttcgttctttggatcagtgacgattcccgtcacctcaatcgtctcttgttcattttgagcgtagactgtagttgtccagcctactatcaataaaaatagtaagattacatttctcatatttacttgtgttttaaatagtattattccgttgtcatataacgaatccctttattatcaatatctccaatatagaacatatctgtatcagggtcgtaagcaagaccggctggctgattgaaacgtgcctcatgcaatggattgccgtctacgtatccccatattttgccgtcggcgttttcgttacttcgtccggctgcaagagacgctaccccatgaggatccagtttccagatgcagtgattttctctgtcacaaaaatagaagtcatattggtcgttgtcaggaccaattccttcgccgtatttctcgttttttacgaatacaccgaactgtggtttgttaaaccgggcgcttcctcccgttccttccttgaaacttttatcgttcatgtttccggcaatgatgctaggattaccgaatgtttttgccaccggatcataatcggctctgaacactgcgccaaaattgtcggaaagcatatacatgaatttattggacgggtgcctgaataatatcgtatgtgaaccgcccactgccgatatctgactcaggctaaaggcaacttccgcattctcgtcgatattgggaatagccccattgcgtatcattttgtagacttttccctcccaccaggtggtgtaaaagatggttccgtcatccatatacactaagctatatgctgtcctgccatagttgtagggacgaattcgtcgaaagttttcacgacggagagaataatagatatttgcccgggtggtgttgtcctgaccgtgatcatcggtaaatagcaacgtgtctccgtcagcactgaatgtgaaagaatacattgtgctatatcccgttcttgggaagagacgttttacagtccgttctgtcaggtctattagatggagaccgtcagaatggtttgaagaaaaaagtaaccggttgtccccatccttgtacttggggtcgaacaccatacagtcattggaaggaatagaagctccttcatcgaacgaaccctcttgaaatgcagaattattatcctcgtctaccttacgtagcaaggtacctacgatcgttgcaggagtgtacttgaattcctcttcaaatgtatgttctgcaataggtttgccatccggaccatctacacgaacattgattattccatcaaaagccttggaaggaaccatgcaataaatcttttttccatcggctccgatggttttggttttttctccaccgatcgtaatgtgaattttggtgggatcattcccgaaattactgccttcaatgtacaggcgggttcgcatacctccctctttagggctaaaatctgtaaatactactggttgagatgggtcatactgattagagttggctttatcatctttacaaccgatgaagaataaacagcagacaagtactgttattaggtggtttttcataaatataaataataaaatggttaaagtgcatccgaacaataaatattattgcttacaacgtttgcctatctttcttattataagcataatatgtatctaaatctttaggagttttaggtatccttcaccttgttgatgttggcatgttgtgctcataatatgttgtagatttaagtacaaatatctatatatgtctgattctcatcaacgaagagtttgactgagaaaagacatggcaaagctaactaaataagtaatttcttatttagtttgcataactttatgtaggtgtgatgatgataattataattaacaatcaatcggttaattacaaataaatataataaaaatgtagaagagttagaatgccttttttttgaaatgaccagaatatattatatattagtcagattattataattacattttcaattacattaaataattaagcaggcttttggggaatatctgtgcaaatatgcccttcaagggagaaatgtaccaaatttgtccctgaattggattatttgggacggtctattctatttgaaagtactacttttgccaccagataattattaacttaacaaataatccatgtattatgaaaacaattcttagcgcattgggactttcgcttctgatctttacgagttgcggtggacaaaaaaaggttgaagtcgattttattcaggacaacatcgacaacgctgtagcacaaaacacaattcagacagacattatcgagaaatccggtaaaattctgaatccaagaaccatcaatgcagatggtagtatctcctatatacctattgatgactggtgctccggtttctttccgggcagcatgtggctgacttacaatctgacaggggataaaaagtggttgcctttggcagaaaaatacacagaagccctcgattctgtgaaatatctgaagtggcatcacgatgtcggctttatgatcgggtgcagttatcttaacggttaccgttttgcagataaaaaagaatataaggatgtgattgtagaagccgcaaaatcattgtctacccgtttccgtccgggagcaggcgttatccagtcatgggatgccgataaaggctggcagggaacacgcggatggaaatgtccggtgattatcgataatatgatgaatctggaattgctgtttgaagctacggctttttccggtgactctaccttttacaatatagcagtgaaacatgcggatacaacgatggcccaccatttccgcccggacaacagttgctatcatgtggtagactacgatcccgaaacaggagaagtacgtaagagacaaacagcacaaggatatgcggacgaatcatcatgggctcgcggacaggcttgggcattatacggttataccgcttgctatcgctatacaaaagacaagaagtatctcgatcaggcacagaaggtgtataacttcatctttaccaataagaacctgccggaagacctcgttccttactgggattacgatgctccgaacattccgaacgaacctcgtgacgcttctgcagccgcatgtacggcttctgctctgtacgaactcgacggttatctgccgggcaatcactataaggaaaccgctgataagatcatggaaagcctcggctcaccggcttatcgcgccaaagtgggtacgaatggaaactttatattgatgcactctgtaggcagtatccctcacggccaggaaatagatgtgcctttgaactacgctgactattacttcctggaaggattgatgcgcaaaagagacctggaaaagaagtaagaactgccttgcttgtactttagccggatatgtgcatatattagtctcttccggtgcattaactgttattctttatatcatgataaacaaatcagtaaacttattgatgggaggcttgaccctctttgcagcgcaaggctgtaaagcccccaagcaggtggcagagcaggcagaacatccaaacatcatctatgtatttcctgatcagtatcgcaatcaggcaatgggcttctggaaccaggaaggtttcagagataaagtaaacttccggggagaccccgtgcatactcctaacatagatactttcgcacgtgaatctatggtgctgacttccgctcaaagcaactgtccgctgagcagcccccatcgtggaatgttgctgaccggtatgtatccgaatcgcagtggtgtacctttgaactgtaactctacacgtcctatcagctctttgcgtgacgatgcggagtgcataggcgacgtattcagcaaggccggttatgattgtgcttatttcggtaaacttcacgctgacttcccgaccccgaatgatccggagaatccgggacaatatgtagaaacacagcgtccggtgtgggacgcttatacgccgaaagagcagcgccacggtttcaactattggtattcgtacggcacgtttgacgaacataagaacccgcattattgggatacggacggcaagaggcatgatccgaaagaatggtcaccgctccatgagtcgggcaaagttgtttcttatctcaagaatgaaggaaacgtgcgtgatacgaagaagccattcttcatcatggtgggaatgaacccgccgcatagcccataccgttcgctgaacgattgtgaagaacaggacttcaatctttataaagatcaaccgctggacagtctgctgattcgcccaaacgtagatctgaatatgaaaaaagcggaatccgtccgttactactttgcttctgtgaccggagtagaccgtgctttcggacagattttggaagcactgaaacaattgggattggataaaaatacagtagtcatctttgcttccgaccatggcgaaacaatgtgcagccagcgaacggacgaccctaagaactctccctattccgaatctatgaatattccgttcctggttcgtttccccggtaagattcagccccgggtagatgatttgttgctttctgctcccgacattatgcctaccgtactcggcttgtgcggtctgggggattcgattccttccgaggtgcagggacgcaacttcgcacctcttttcttcgatgaaaaggcggaaattgttcgtccggcaggtgcgttgtatattcagaatctggatggagagaaagataaggatggattggtgcaatcttatttcccctcttcgcgcggcattaagacggctcgctatacattggctctgtatatcgaccggaagacgaaacagctaaagaaaagtctgctgtttgatgacgtaaacgacccttatcagctgaataatctgcctttggatgaaaataaggaagttgtggagcaactttatcgtgaaatgggaacaatgctgaaagaaatcgacgatccgtggtatacggaaaagattctttcggaccgtataccttactgataccgtatactaatacggtttgtatgacacccgggtctcatacataccgacacccggatctcatacatgctgacacccgggtgtcgtgcatcctgacacccgggtgtggtaagaactgcctttaaacaattaatgatcatgaaagctgtttgttttatatttctgttcttgttttgttctttgtcctcttatgcgcaggtcatagggtttgaagaaaaggttcccgagacgttcaaagtttcggggaaaggtgaagtgaaactttcttctcttttctataaagagggagaaagcagtctggaatgggatttccaacctgcctcgacactggacgttcagatagaacctttatcgctgaatgccaaaaaggaacagcaatttggtattaccctgtggatatataacgagaaaccccaacaggactctatccgttttgagtttctaaataaggcgggtgaagtctcttattggttcacgtatcatctgcaagcggcaggctggcgggcttgctggatatctttcgcctacatgaacggggataagaaagataaaaatatagtttcttatcgtctggtcgctcccgaccgtaaagggcgcatctttctggatcgcctgacctttccggaaaagaagatgaacctgcgcacgacaccggaccaacaactgccagctaacaacggtctttccaatcgtgacctctggcattggtgtcttgtatggaagtgggaacagcagtcttatgatgtccccttgctttctaaactgacaactcggcaaaagaaggacttgaaaacaatcgaacaacgcctgactgaatttctcgatgtgaagaaagctccccaaggacagatcaacgctgcaaggaagacttttgaaagagctgccattgctccctccgcagccgggaccggctttaccggaactcctgttgtagcaccggacgagcaagacaagaagaaaggggagatgtcatggaatgatatcgaaacgatgcttgccggttttgcatacgatgccttctacaatcagaatgagacatcgaagaagaactattttaccgtattcgactatgcaatggatcagggattcgcttttggcagcggcatggggacgaatcatcattacggctatcaggtacgtaaaatatatactaccgcctggctcatgcgggacgcgatttataaacatcctcaccgggatgcctatctatccactttacgtttctgggctgctttacaggagactcgtcaaccgtgtccgccggagcgggatgaattactggattcatggcatacgctcttgatggcaaagtttatctccgccatgatgttccccgatgcaagagaacaggaacaggctttgaatggtttgtcgcgctggttgtcttcatcgctgaattatactccgggcactctcggcggtatcaaagtagatggaacgacctttcatcacggaggtttctatcccggctatacaaccggagtactggctaccatcggtcaatttatcgctctcaccaacgggactggatttgaactgacggaagaggcacgtcaacatatcaagtctgcctttctcgccatgcgcaattattgtaacctttacgaatgggggacaggcattagcggtcgccatccttttggcggaaagatgggaagcgatgatatagaagcatttgccaatattgcattgtcaggagacttgtccggtcagggaaatacattcgatcatggactggccgccgattatttgcgtctgatacgtgatcggaatacaaggaatgcacatttcttcagaaaagaaggtattcagcctgcacaggctccccacggtttttttgtttataactatggatcggcaggtattttccgccgtgcagactggatggtgacactgaaaggatataccacagatgtatggggtgctgaaatctatgcgaaagataatcgttacggacgttatcaaagctacggatcggtacagattatgggaaaaggaaatcccgtctcccgtgccggaagtggttttgtacaggaaggatgggactggaaccgtctgcccggtacgactaccattcatcttccttttgaactcttggacagtcccctgaaaggtacgacgatggcacggtctacggaaaacttttccggaagcagctctttaggcggcatgaacggaatgtttgcaatgaaactgacggaacgtgattatgagaactttactcccgactttgtagcccgtaaatccgtcttctgttttgataaccggatgatctgcctcggaacaggcatcacgaacagcaatgctgactatcctacggagaccactctcttccagacgaaatttaacggcaaagagcagaagacaggtaaggataactattggttgcacgacggctatgataattattatcatgtagttgacggaacccttcgttcacagatagccgaacaggagtcgcgtcatgagaaaacccgcgaaaagactacaggaacattctcttctgcctggattgaacatggcaacgccccgaagaatgctacttatgaatatatggtactgattcagccttcagcttcggatttggatgaactgaagaaaacgcctgcatacgaagtatggcaacgtgatcagactgcgcatattgtctatgacaggaaaacgggtataaccggatatgctgtttttgaagattaccggtctgctgacgataagctggtggttgcttccattcctgcggaaacgatggtcatgtatgcggcagagggaaaaaaggcgattcgtctcagcgtctgtgacccaaacttgaatattgcggaaaagacgtatacgacaaaagaaccgagccgccctattcgtaaaataatagagctgaaaggacgctggagtttcttggagacaccggcgaatgtaaagcttgaatataaaggtgcccatacgatactggatgtaacttgtcagcatggacaaccggtggaaatgattcttgaaaataaatgaagagagaatttaaataggtattgatgtttgtgtttcataccttgaaagagggtcggttcagcgaagaatcgaccctcagttttatatgcggttaatgagacagtttgctagggagaacttgaattacttgtttaatctccattcgaaaccatcttttgtatctttcacttcaaatccgagtgcagtcaatgtattacggatttcgtcggaagtagcccagtctttgttggcttttgctttcatgcgttgttcaagaagcatatcaacgactttgccataagcggcttcgcgaccgtcggaagaacctttctcttctttcagccccatgatgtcgaagcagaacaggtggaaagtttctttcaggtctttcagatcttctgcggagatcgttgcatttcctgcgttgatattattgatgatgcgggcaccttcgaaaagctgtgcgatgacaataggagtattcaagtcgtcattcatagcttcgtagcatttagcacgcagctctttcacgttgataccttccgaagttgttgcggccggagtgatcttgtcgagtccttcgattgcttctatcaaacgttgcagccctttttccgaagcttgcaatgcttcgttactgaagtctacagtgctgcgatagtgagcttgcaggatgaagaaacggatggtcatcggagtgtaggcttgtgccagcaacttgtgagtaccgttgaagaattcatccagcgtgatgaagttgccgagtgatttacccatcttcgtaccgttgatggtaatcatgttgttgtgcatccagtagtgaaccatgtcatcgccttgcgaagctaccgactgtgcgatctcacattcatgatgcgggaagatcaggtccattcctcctccgtgaatatcgaagtgctcgcccagatacttgcgtcccatggcggtacattcggcatgccatccggggaaaccgtcgctccatggagaaggccagcgcatgatgtgttccggctgcgcttttttccagagggcgaagtcggcgggattacgtttttcgctttgtccatcgaggtcgcgggtggtattcagtacgtcgtccaagttgcgccctgagagtttgccgtaatgataatccttgttatatttagctacgtcaaagtagacggaaccttcgctttcgtaagcgtatccggcgtccagaatcttctgtacgagctggatttgttcgataatgtgacccgaagcgtgcggttcgatgctgggagaaagtacattcagtgcttccattgccttatgatagcggttcaggtaatactgaacaacttccataggctccaattcttcgagacgggctttcttggctattttgtcttctccttcgtcagcatcatgctccagatgaccgacatcggtaatattgcgtacatagcgtactttatatcctaaatgagtcagataacggaagagtacgtcaaatgtgatggcgggacgggcatgtcccaagtgagcatcaccgtatactgtcggtccgcatacatacatgcctacatgcggtgcgtgaagcggtacgaacaattctttctttctatctaacgtgttgtaaatggtaagttgatgttccataacattttatatttgttctattggaagtgcaaagttagaataaataattgatttcaacttaacttgcaagggattttgtctgatctgctgaaggaagaatgccttatgggacgttgaagattctctctatcgcttccgcaaccccatcttcgtcattagtcagtgtaatgtagtcggcagccttcttcacaggctcctgcgcgttgcccattgctacgcccataccagcaaatttgatcatcgacaggtcattgtagccatcgcctatagctatcacttcctcgcgtgtcattcctatattttccaacaggacgctgagggataaagccttgtcgataccttgcggaaccaactccaggaaataaggttccgaacggaagacattgatctttccttgcaggcggatacaaagctcggattctacaggaattagcttgccggcatctccgacgatgaggcacttggctactgggagggtgatgtcagtcaggaagtcgtttgtttcccgtatcgccattttattgaggaaggcttctttttgtacgtatggatccaacgagttttcggtcactatttctgctccgtcgtaagtcagtatgcttagatgattggtgcgggcacattcgtagagtaccggaacgacttcgttgggcagtacattctcgtacatcatttctttgctttcccagttgatgatttccccaccgttataggacaggataaatccgccgaactcattcatgcgtaactcgttggcgagcggtacgatgccataagtcggtcgccctgatgcaaggaccagacggataccttgttcttgtatgcgtatcagcgtttcccggttgcgggaagagatttcttttttagaattggtgagtgtgccgtcgaggtcgagcactatgagtttgtatttcatgtcgcattgttttgggttgcaaagataggagaaaatggatgactacaaagtgcgtggtaattaaaatatgcttagattatgcacttttatggtgcaatagtgagatgtttgattgttatttcagcaaatccgcccactgctcattgctcagtgcaggcagtgcctcactatccgtaataaatgtttctgccagcctcctcttgtcctcctgtagttggagaatcttttcttcgatactattctgagtgataaaacgataggcgataacctgtttatcctgaccgatacgatgtgcacgggcgatggcttgtgactcggcagcaggattccaccaaggatcgatgataaatacataatcggcttgtgtaaggttaaggccgactcctcctgctttcaaagaaataaggaatgcctgcacatccttttgctcggtgaaatgggcgatttcggaaggtcggttgttggtggaaccggtcagcagagcatacttccaaccccgttggcggaatacctcggcaagtatctccaaatgccggacaaaggaagaaaagataagtaccttatgtccttcacttcttagtgtgtcaaaggtatcgatgatttgttccgtttttcccgataccccgtcgaagtcgggaaagataagctgcggatggcaagccagttgacggagacgcaggataccgttcaggatgctgaacatatggtatctgtctttgttttcgggttgctggagtaatatgttgcggaggctgtttttctcctgttcgtagctctcaccctgcttttcggacatggcgcaatagatcgtttcttcggtaagcgggggaagttccggcgctacctcgcttttgcttctgcgaaggataaacggagcgatgatctgttgcagccttttctccatacggacgtttccttgccggatcggaatgataaactgcttatgaaaagtgctttcttctcctaacaggtccggttgcagaaaacggaactgtgcccacaaatctttgagagagttctcgataggcgtaccggtaagtgcaatccggtgcttgccttgcaactggatgaccgaacggaaagtaagggaatcattgttcttgatattctgactctcatcaagtacgatgtattcgaatgtgtaggagcggagaatatcaatgttattcctcatcatcccataagtcgtgaatatcagatggaaatgattgaagaacttctccggatgtcctttgggaaacgcggtgttgctgttatattccgctatcgcaagagtcgtgaagcgtttagcctctcttcgccagttgtggagcagggaggtggggacaacgatcagagtggcaggcttacgggagttctttccgtgttcctgtctgtgatcatcttctttcggtctgtttttctctctgatttcccgtgcgtccggcagcagctcatcttcggaggaaaacgagaataaggagaattgtccttcggcatctgctatctgctctctgacgggaggattgttggcagtacattccttgtccggctgactgtcggaagctgtggtttctgtaaatacgggcttcataggagcagtgaccgcatcaggagaaagcggtttgtatatatattgcagcagcgtcagcgtctgaagcgtctttccaagtcccatatcatctgccaggcagccgccgaatccttgcttgttcagctgtaccatccatgagaatcctttctgctgatagggtcgtagtttcgcattcagtccttggggaacaggaacattgcgtatctctctcttgaaaagcaggtttttaggcccgttttcttctaaagccgattgtacggcaccgacaaaggtcggtttcagacgaatccctgtctccgtctgggtgcccagttccaacaggtttccgtatttgctgaaccattcttccggtaaaagaatcatgcgtccgtccggtaacagaaattctcttttctcttcaaggatgtgcttgcggaagcgtgagaaagggatacgcagattgccgatgactaccgtgatatgtagctcaaaccagtcgggttcgtcatcacaactctgttcgatgcggatttcgtccagacagtaaggagtattccccatgtttcctgtcagcagaaaagactgttggagcatctcccgatatgtactgatccattcggtaattgtcttttcgggtgcatcgggcgacagcttgaaatgaacgtcgctgactcgttgcaagccggaatctgttaacatccggagcttctcttcttcggcatcgctatcccgacggaaaaagaatatctcgccgaaatcgttccggtaaatgatcttcttcatttcggtcacggtgtcgggagtaaatgactggtcaccataacggaagctaagccgcaacatctgttcgtcgtaaatggtatcttcaagagacaggacagcttcgcaggcatacgtctcttcaatgatattcagtccctgagtcgtgatttcatgatagcgtgctattggaatgacgatgttatcgatgtatttctcgatttgggaagcagggacgctgattttctttttcttggtaaagggcagaatgcgtacgctctcaatatgcggaaagaagtacagctccattcccagtaagagggcagacggtgaggaggtcagcacgataacaggcttctgctcacttaatgagagcggctgcccgtcataatagcattgcagctggtagcggaaattggtctcatcggcaagaaacgtaaaacggatttccacgtcatgaggatgcacatgataggcatgatgcgcatatagcagtttgcttccgacctgtttctgatacagaggaagattatgatggcgtatcaatgtcagcatctcctgcatttttttctcgatgaatgggcggatattgttctttacccgctccggatcttcggataatttgcgcagaaaacgggatactgttttctcacgcgaatagatccccatcagatatttctctgtataatgagaggcgatgtcgatagcttgttgctcggcctcgttcatccggctgattgcttcgggtgaagcgtgaaaagcctgttcaatgagttggtatgtaccgtcgtcagatttctctgccatataaggaatcagtagtgtgccgaacgtcagatgttcggttaaaacgatgataacttgtccggtatttgctttctcttccattctctttaggctttaacaaacaaagatacgggaaaatccttaattttgcagcatgatggaagaaaacaaacgagtattgttaggaatgagcggcggtacggacagttccgtagctgccatgcgattgctggaagccggatatgaggtgaccggagttactttccgtttctatgagttgaacgactcgaccgaatatctggaagatgcccgccatctggcagagcgtttgggaatccgtcatatcacgtatgatgcccgcgagatattccgcaaacagattatcgaatattttgtgcatgaatatatggtggggcatactcctgtgccctgcacattgtgcaataactatctgaaatggcctcttctatccaaaattgccgatgaaatggggattttttatattgctacggggcattatgtacggaaagtaaaggtggatgatacctgttatataacttacgctgccgattcggacaaggatcagacctttttcttatggggactcaaacaggatattcttcggagaatgttgcttccgatgggagatattaccaaagtggaagcacgtgcctttgctgctgaacggggatttcagaaagtggcggtgaaaagggacagtttgggagtttgcttttgcccgatggattatcgaagctttctgaaaatgtggttggtcagcaattgtcagccgcaggtcagcgtaggtcagccccaggtcagtgcaggtcagacttggtcagcggaggtcagacgtggacgatttgtcgatgaaaagggagattttatagcctggcacgagggttatcctttttataccgtcggacaacggcgtggcttgggcattcatttgaatcgtgccgtctttgtgaaggaaattcgcccggaaaagaatgaagtagtactcgcttccctacaggctttggagaaaacagagatgttacttaaagattggaatattgttaatcgggaacgtttgttagggcatgcggatatcattgtgaagattcgctatcggaaacaggaaaatcattgtaccgtgacagttacactagataatttcctgcatgtacaacttcacgaaccgttgacggcaatcgcatccgggcaggctgctgccttctataaagatggtttgttgctaggcggtggaatcattgtagaataatcattgcttcagtctcctataaagtttgaaaaagtaaaaatcatctgccatctgcaacagaatcgactcatcttattctttattttttgcttatagcgttgtagataccagttgcaagctggtaatacaaaaaagtcccacagtgcatattatgtacactgtaggatactttctgtcatataatgatttaatttgttcggataactttattcgttgttcagcaccagcattgactctatatattcgcgtgtattgcttaatctgggcactttgtgctgtccacctaattttcccttccttgccagccagtcatggaacaatcccggacgcgcaacgatgacttccagtggttgcagagcaatatctttccaacgcttcgcctcatagtctgaatttacttctttcaatgtagcatcaagtattgcggcaaatttctctacggaatccggcatcttggcaaattctatcagccattgatgacggcatttggcgtgttcgtccataaataccggtgctgcagagtattcgcaaacctgcgctcccgtctcggcacaagctttagccaggcctttttcggcattatctacaatcagttcttctccaaaagcattgatgaaatgcttcgtacgtcctgtgatgacgaacttatatgggttcttgttggtaaacttcaccgtatcaccgatcatgtatcgccacaatccgcaggacgtagaaatcaccattgcgtaattcttgttaagttccacctcttcgaggcagtaagcacgtggattttccttatcaacttcttccagcggaacgaactcgtagaaaataccgtagtcgatcatcagcaacatggcagggtccgaaagatcgttctgcgtaccaaagtatccttcggaagcgttgtaggtctctacataatgcatcatctttgagtgaatcacctgtttgtactgctcacgataaggggtgaaagccactccgccgtggaagaatacttccagattcggccacacttcctccagagtttgtttgccggtcttttcgagaatacgcttgataagtaccagcatccatgagggtacaccggacaaactggtcacattgaccggaatagtactgttggctatcgcttctatcttggtttcccattcgctcatcaaagcgattttcttgctcggcacacgaatgaaattgattaacggattgacgttctgaatcagaatcgccgacaagtctcccaccaaactatggttggagttgaggttcggactatggctgcctcccagaatcaacccttttcccgagaaaaagtggctgtccggattgatgcggaagtaaagtgccgcagcatctttaccgcctctatagtgaatgtcttccagagcttctttgctgacaggcaggaatttgcttttatcattggtcgttccggatgatttggcaaaccagcgtatttccgatggccaaagcagattctgttcccccgcccgcaagcgttctacataaggttttatttcctcataagtctgtattggaaggcggtttctgaaatcctcatagctacggatggaggcgtagtcgtacttttttccccactctgtctgtgcagcttggttcactaagcgactcagcacacggtgctgtatctcactagcctgactagcataaaggtctatttgttttaaacgggaatcgaaagtcttactaataatctttgtaatattcatttctgctttaacataataatgtttagtcgtgcaaaagtaaccttatttatcttttttttctatctttacgacggaaataatcgttaaaatttggcgacttttcttgaatcccgagtttctgactaaaaaaaacgacaatgagaattggaatcctgacttccggaggagactgccccggtataaatgccactatccgtggcgtgtgcaaaactgccatcaatcactatgggatggaagtaataggaattcatagtggttttcaaggtttgctgacaaaagacatcgaatcctttactgataaatccttatccggattgttgaaccaagggggtacaatgctgggtacttcgcgcgagaaaccttttaaaaaaggaggcgtcgtctcggatgtcgacaagccggcactgattcttcagaatattcaggaaatgggactggattgtgtcgtctgcatcggaggaaacggaacgcagaaaactgccgctaaatttgccgcaatgggcgtcaacatcgtatcggtccccaaaaccattgataatgatatttggggaacggatatttcctttggatttgactccgccgtgagcatcgctacggatgccatcgaccgcttgcattctaccgccagctcgcacaaaagggtgatggttattgaagtgatggggcataaagccggctggattgccctgtattcgggcatggcgggtggcggcgacgtcattcttgtccccgaaatcccttacaacatcaagaatataggaaatacaatcctcgaaaggctgaaaaaaggcaaaccctattccatcgtagtggtggcagaaggcatcctgacggatggccggaaacgtgccgcggaatacatcgcacaggaaatagaatatgaaacgggcatcgaaacacgtgaaaccgtattgggatatattcagcgtggcggttcgcctactcctttcgaccgtaacctgtctacccgcatgggaggacacgcgacagaattgattgccaatggacaattcggacgtatgattgccttaaaaggagatgacatttcgtctatccctcttgaagaagttgccggtaaattgaagttggtaactgaagatcacgatttagtgattcagggccgccgcatggggatttgtttcggttaacttataatttactcttttgtcgttaggatggtagttggagtcgtcattccttctcagtttctgttgcttcgacctcattaacagtcgtttcgactttgtctgcagtcgtttccgcttccggtgcttcggtctccaaagtatccggttccatggtttccgactcagttaattcaggttcgaccgactctgtttccacttctgacggcttcgaatgctgcgacttcgcttcattgactgtatccatgaatgtctggtctttcaccttcttgatagccatttgtgcggcattctgctgagattcttttttggaatagcccgtaccagttccggcaggaagcccttcgatgcgaacctctgtctggaaaacgggattactgtcatggtcgaggaactgctcgatcaactcaaaggaaacctccatcttgttcttctggctccattcgataagcttggacttgaagttaacctctttgcgggagattttgtccagatcaatataacggttgatgattcgctgctccataaactgcttgcaacgttcatacccctgatccagataaatggctccgataaatgcttcgaaagcattcccatacatataactgttgtgggaagaggagcgggtagaatatttgataagtttgtccagaccgatctccacggctaacttgttcaaagtctcccgttgtacgatcttggaacgtgtgtttgtcaggaaaccttcccgttttccttcgaaacgtttatagacaatatctcctacgatggcgtcgagtatggcgtcacccaaaaactccagtcgctcgttgttcagcggacgtcccttctcggagcggacggcagatgacttatgcaggagcgcttgttcgtagatctggatattgtgcggataaaatccgagtatccggtaaaaacaaagataagactctctgtctttgcggaacaggagtcttatcttatctatttggttacgtaacacgattttactcagcgtatttcttgaagataacgcacgcattgtgaccaccgaatccaaatgtattggacagggcaacattaacctcacgtttctgagctttgttgaacgtgaaattaaggtcgtagtcaatgttctcgtcgttgtcaccttcttcgtggttgatagtcggaggaacaatgccgttcttgatggcaaggatgcttgcgatagattctaccgcaccggcagctcccagcaagtgaccagtcattgattttgtagaactgatgttcagttcgtatgcgtgatcaccgaatacttccttaattgctttcgcttcagaaatatcacctaccggagtagatgttccgtgaacgttgatgtaatctacttctttcggatccatttctgcatcttccagagcgttcagcattaccagtttggcaccaagaccttccggatgggaagctgtcaggtgatgagcatctgcagacatacctacaccggcaacttctgcatagattttcgcaccacgggccttagcgtgttccagttcttccaagatcaggcaaccgccaccttcgcccatgatgaagccgtcacggcttgcgctgaatggacgtgaagccttgctcggctcatcgttgcgtgttgacagagcatgcatagcgttgaaaccgcctacgcctgcagggaagatggctgcttccgaaccaccggatacgattacgtttgctttacccagacgaatcaggttgaaggcatccgcaatggcattggtagaagtagcacatgctgaacaagtcgcgtagttaggaccatggaagccatacatgatagaaatctgtccggcagcaatatccgagatcatcttcgggatgaagaacggattgaacttgggacctatttcctgatgagtgtagtagttgcctacttcttcctcgaatgtatgtataccaccgataccggcgccaaaaataacaccgattctgttcaaatcttctttttcgacgtcaagaccggagtccgataccgcttctttggcaacagcgacagcatactgagtgtataagtccatctttcttgcctctttacggtcgatatatttagttacatcgaagtttttcacttcgcatgcaaactgggtcttgaattgcgacgcatcaaaatgagtaataggccctgctccactaaccccgttcactagattttcccagaattcgggtacatcattgccaacaggagtaatggcgccaaggcctgttactaccactctttttaattccatattgatgaaatcggataattacttagcgtgttcttcgatataagatacagcatcacctacagtaccaatcttttctgcttggtcatcaggaatagagataccgaattctttttcgaattccatgataagttctacagtgtcaagagaatctgctcccaggtcgttagtgaagcttgcttcgttagtaacttctgattcttctacgcctaatttatcaacgataatcgcttttactcttgatgcaatttcagacataactttaagtttttaattaataattagttttatttctttaaatttgcggtgcaaaggaatgaatatttatcgttttgcgcaaatatttgactaaataaatgcagtcttttgcacatttttcactgttttgtgcattgaattcgagtataatgaagaaaaacatcgccattttcgcttccggttccggctcaaatgccgagaatataatccggtatttccaaaagagtgactccgttgaggtgtcgttagtactttctaataaaagtgatgcctacgttttggaacgtgcgcaccgtttgaaagtgccctgtaacgtgttcccgaaggaggactggatagccggagatgaaattctggctattttgcaggaatatcgcattgactttatcgtgctggcaggtttccttgtccgcgtgccggatttgcttttgcatgcatatcccgataaaatcataaatatacatcctgctctcctgcccaagttcggtggaaaaggtatgtacggcgacaaagttcaccaagccgtagtagctgcaggcgaaaaagaaactggcattactatacattatattaatgagcactacgacgaaggaaacatcatcttccaagccacctgccccgtacttcccgatgactcacccgaagaggtggctaaaaaagtacacgctctggagtatgagcatttcccgcatgttgtagaagaaacaataagtattaagtattaggtattaagtattaaccatgcggacttttgccgaatggaagtttaagcaactacggttaatacctaatacttattacttaatacctattatattatacgc

SEQ ID NO: 68 - DNA, 39359 bp, Bacteroides thetaiotaomicron
aaaataagtaaaccggaggcaggaataataaataataaagtaaacagctgccagggttagtaatatttctagtcaacacatagcagctattagagataaacaagtcaaccattattagggaagtacataggtccattcgtttccatatgccggaaccaacagttccaagcggatgaaactctagtttcaagcagaggaaactttagtttcaaactgaagaaactttagtttcaagctggtgaaactctggttccaagccccagaaactatccagctctatatagaaagagaaaatgcaatataacgatcccgctccgaagacaggaacatgcgatagttttatacgtaacagtaaagttcttatccttttatgttgcacaacatataagagtgtatttgatacaccaaacaaaagtgttacttttacacccaaaataagataagcatctcatttacattaaaaataaaaccatgaaaaaacattttctaattgcaggaattgccgcgctgatgcttgccgcgtgcaataacaagccggcttccgagctgactttatccggtcttgacccggcaaaatttcaaacagaagtgaacaatgcccaaacagctctttataccttaaagaataaggcgggtatggaagtatgcatcactaacttcggcggacgcatcgtgtccatcatggtgcccgacaagaacggcaagatgcaggatgtagttttaggttttgacagcattgctgattatattaatgtacccagtgatttcggtgcttctatcggccgttacgccaaccgcatcaaccaagggcgttttgtactggacggagataccatccaactgccgcaaaacaacttcggccactgcctgcacggaggcccgaaaggatggcaataccaagtatacgaagccaaccttatcgatccgacaacactggaactgactcttatctctccggacggtgacgcgaatttccccggaaatgtgactgctaaagtaacctatcaactgacagatgacaacgccatcgacatcaagtacagcgctactaccgacaaaaagacaatcatcaacatgaccaaccactcttacttcaatctggctggtgatccatcaaaaacatcgacagacaacatcatgtatgtaaatgcagattactatactccggtagacagcaccttcatgacaaccggcgaaatcgctccggtcaaagatactccgatggacttcactactccgaaagcggtaggcaaagatatcaacaactacgacttcgtccaactcaagaacggcaacggatatgatcacaactgggtgctcaacaccaaaggtgacatctcgcaggtagctgccagactgacgtctcccgaaaccggaatcacattggaagtatataccaacgaaccgggtattcaggtatacacaggtaacttcctcgacggaaccgtaagcggaaagaaaggcatcgtttacaaccaacgtgcttctgtctgcctcgaaacacaacactaccccgacagccccaacaaagccgactggccgtccgttgtgctggaaccgggacaaacgtacaacagcgaatgtatctttaaattctcgacagagaaataatattaacttataaatcaaatttattgtggaagcattagattggctagtaattggagtcttctttttggctctgataggtattattgtttgggtagtcagacaaaaacaaaatgactcggcagattatttcttaggcggacgtgacgcaacatggcttgcgatcggtgcctctatcttcgcatcaaacatcggctcggaacacttgatcggactggcgggagcaggagcttcaagcggtatggcgatggctcactgggaaattcagggatggatgatcctgattctgggatgggtattcgtacctttctattcacgaagcatggtatacacgatgccggaatttctggaacgccgttacaatcctcagtcacgtaccatcttatcggtcatctcactggtaagttatgtattgaccaaggtagcagtgacagtatatgccggcggactggtattccagcaagtattcggcatcaaggaactctggggaatcgacttcttctggattgccgccatcggactggttgttctcactgcactatatacgatcttcggtggtatgaaatcggtactttatacttctgtacttcagactccgattcttctgttaggctcgttgattatccttgtgctcggtttcaaagaactgggaggctgggacgaaatgatgagagtgtgcggtgctgtgacggtaaacgattatggtgacaccatgaccaatctgatccgcagcaacgatgatgcgaacttcccttggctgggtgcacttatcggttctgccattatcggtttctggtactggtgtactgaccagttcatcgtacaacgtgtactttccggaaagaatgaaaaagaggctcgtcgcggtactatcttcggcgcttacctgaagctgttgcctgtattcctgttcctgattccgggtatgattgctttcgcattacatcagaaatatatcggtgccggtggcgaaggtttcctcccaatgcttgccaatggtactgccaacgctgacgccgccttccctactctggtagctaaattgcttcctgccggtgtgaaaggtctggtagtatgcggtatcctcgctgccttgatgagttcgctggcttcactgttcaactcatctgccatgttgtttacaatcgatttctacaaacgcttccgtccggagactccggaaaagaaactggtgggtattggtcagatagcaactgtagtgatcgtaatcctcggtattctctggattcctatcatgcgtagcgtaggtgatgtactttatacttatttgcaggacgttcagtctgtattggctccgggtattgccgctgccttcctgctgggtatctgctggaaacgtacttccgcacaaggtggtatgtggggattgatcgccggtatgatcatcggtctgactcgtctgggtgccaaagtatattacagcaacgcaggtgaagtggcagattctaccttcaaatatttgttctacgatatgaactggctgttcttctgcggatggatgttcctgttctgtatcatcgtagtcatcgtagtcagccttgccacggaagctccgacagctgaaaagattcagggactggtattcggtacggcaacgaaagaacaaaaagcggctacccgcgcaagctgggatcactgggatatcattcatacagtaatcatccttgctatcacaggtgccttctactggtatttctggtaattaaataaattcattcaaacgatgaaaaactattatagttcgaatcctaccttctatctcggtatcgactgcatcatcttcggttttaatgaaggcgaaataagcctgctgctgctgaagagaaacttcgaaccggcaatgggcgaatggtcactgatgggaggattcgtgcaaaaagacgaaagcgtggacgacgctgccaaacgtgtactggctgaacttacaggtttggaaaacgtatacatggaacaggtgggagccttcggcgccatcgaccgcgatccaggcgaaagggtagtttcgattgcctactatgcgctgatcaacatcaatgagtacgaccgcgaactggttcagaagcacaatgcttactgggtaaacatcaacgaactccccgcactgattttcgaccatccggagatggtggacaaagcacgggagatgatgaaacagaaagcatctgtcgagcctatcggattcaatctgttgccgaaactgttcacactgtcccaactgcaaagtctctacgaagctatttacggcgaaccgatggacaaacggaatttccgcaagcgtgtcgcagaaatggactttatcgaaaagacggataaaatcgataaactgggttccaaacggggtgcagccttgtataaattcaacggcaaagcctaccgcaaggacccgaaatttaaattataatcaatatgctggaagaactgaaagaaaaagtatttcatgccaatctcgaattggtaaagcatggattagtcatctttacatggggaaatgtttctgccatcgaccgtgaaacggaactggtagtcatcaaacccagtggagtcagttatgatgatatgaaagcggaagatatggtagtagtggacctggatggcaaagtcgtcgaaggacggctgaagccatcctcagatactcctactcacgtggtactctacaaagcattccccgaaatcggcggagtggtgcatacccactctacttatgctaccgcatgggcgcaggccggttgtgatattcccaatatcgggacaactcacgctgactatttccatgatgcaatcccctgcacagcggatatgacggaagctgaagtaaaaggtgcctatgaactggaaaccggaaacgtgatcgtaaaacgtttcgaaggcctgaaccctgtacatacaccgggagtattggtcaagaatcatggtcctttctcttggggaaaagacgcacacgatgccgtacacaatgcagtagtgatggaacaagttgccaaaatggcaagcattgcttatgccgtgaatcccaatttaacaatgaacccgctgctggtagagaaacacttcagccgcaagcatggtccgaacgcttactacggacaataaaataattgacaattgacagttgacaattgacaattaatgcgagaggacatgaaggataatgtagtaaaagataaaagtttggagttcgctgttcggattgtgaatttatataagtttttagtaaatgaacaaaaggagtttgtgatgagtaagcaaatattgcgatccgggaccagtattggtgccaatattcgtgaggctgagcaagcacaaagtcgggctgattttattaataagctgaatatagcacttaaggaagcgaacgaaacagagtattggctggaattattgattagaacagagtatatcactcgggaacaatatgagagcatcaataatgacagcacagaaataaacaaattattaatatctataattaaaacaacaaaaaacaattaataataacccgcaattgccatttgactttcgacattctctcattgtcaattgtcaattgtcaattgtcaattcaataaattatgaataacgtatttgatcagtatgaagtatggttcgtaacaggagcacagctcttgtacggaggtgatgcagtaatcgcagtagacgcacactctaacgaaatggttaacggtctgaatgaatcgggcaaacttcctgttaaagtagtatacaaaggaacggccaactcttctaaagaggtggaagctgtattcaaagcagccaacaacgatgacaaatgtgtaggcgtcatcacttggatgcatactttctctcctgctaaaatgtggattcatggtctgcaacaattaaagaaaccattgctgcacctgcatactcaattcaacaaggaaattccttgggatacaatggatatggactttatgaatctgaaccagtcagctcacggcgaccgcgagttcggacatatctgtacccgtatgcgcatccgtcgcaaagtagtggtaggctactggaaagaagaagaaacattgcataagattgctgtctggatgcgtgtttgcgcaggttgggcagactctcaggatatgctgatcatccgtttcggcgatcagatgaataatgtagccgtaaccgatggtgacaaggtagaagcagaacaacgcatgggctatcatgtagattattgcccggcaagcgagctgatggaatatcacaaagatatcaaaaatgctgatgtagatgctttggtagctacttacttcaatgactacgatcatgacgcttctctggaagacaaatcaaccgaagcttatcagaaagtatggaatgctgccaaagccgagcttgctctccgtgctatcctcaaagcgaaaggcgccaaaggattcactaccaactttgacgatctgggtcagactgacggtagctatttcgatcagattccgggactggcttctcaacgcctgatggcagaaggctacggattcggtgctgaaggtgactggaaatcggctgctctttatcgtactgtatgggtaatgaatcaaggacttccgaaaggctgttcattcctcgaagactatacactgaactttgatggtgccaacagttctatcctacagtcacatatgttggagatctgtccgcttatcgcagctaacaagcctcgtctggaagtacacttcctcggcataggtatccgtaagagccagactgcccgtcttgtgttcacttcaaagacaggaacaggctgcaccgcaactgtagtggatatgggtaaccgtttccgtctgatcgtaaacgatgtagaatgtatcgaaccgaaaccacttccgaaattgccggttgcttccgcactctggattccgatgcctaacctcgaagtaggcgcaggcgcatggattctggccggtggaactcaccactcttgcttctcatacgacttgacagcagaatactgggaagattatgcagaaatcgcaggcatcgaaatggtacatatcaataaagatacgactatcagctgcttcaagaaagaactgcgcatgaatgaagtatattatatgctgaacaaagcgctttgctaaaaaccaatcactgagtccacttaaaaaaatcggtaccatctccattggtaccgactttttagtcacacacaatatggatactggcgacttttaattcaacccgaattaaagacacttccgccttttgaaagcagactcagtttttgttctccacacttattgttataccttaaaatatcggtttccaacatgaaattagatgcaaaatcaaccatcgagacaggtaaagctatccttggcatagaactcggttctacacgaataaaagctgttctgattgaccaggaaaacaaacctatcgctcaaggcagccacacatgggaaaatcaactggtcaacggactttggacttacagcattgatgccatctggtccggactgcaagattgctacgccgacctccgctccaacgtgaagaaattatacgacacagagatcgaaacactggcagccatcggtgtcagcgccatgatgcatggttacatgcctttcaatgaaaaagaagaaatcctcgtgcctttccgcacttggagaaataccaatacaggccgtgctgcggcagaattatccgaattatttgtctataacatccctttgagatggagcatttctcatttgtaccaggctattctggacaacgaagcgcacgtcaaagacatcaagttcctgacaactcttgcaggttatgtacattggcagataacaggcgaaaaggtgttgggcattggtgacgcatcgggtatgctccccatagatccgactaccaacaactattccgccgaaatggtggccaaattcaacaatctgattgcttcgaaagaatacagttggaaactggaagacattctgcccaaagtattgtcggctggtgaaaatgccggtgtcctcacaccggaaggctgtaaaaaactcgatgcatccggtcatctgaaggcaggaataccggtctgcccaccggaaggagacgcaggcaccggcatggtagcaaccaacgccgtcaagcaacgcaccggcaacgtatcggcaggtacttcttctttctctatgatcgtattggaaaaagaattgtcgaagccatacgaaatgatcgacatggtcaccactcccgacggaagcctcgtagccatggtacattgcaacaactgtacttcggatcttaacgcatgggtcaacctgttcaaagaataccaggaacttctgggtatacctgtagatatggatgaactctatggcaaactttataacattgcccttaccggtgataccgattgcggtggtctcctctcctacaactacatttcaggcgaacctgttacgggacttgccgagggaagacctttgttcgtacgttcggccaatgacaagttcaaccttgcaaactttatgcgggctcatttgtacgcctcagtcggagttctcaagattggcaacgacatcttgttcaacgaagaaaagatcaaagtcgacagaatcacaggtcacggaggattgttcagaaccaaaggagtcggtcaaagagtacttgcagcagccatcaactcgcccatatctgttatggaaacagccggtgaaggcggtgcatggggaattgccctgctgggttcttacctggtaaacaataaaaagggtcaatctcttgccgatttcctggatgaaagtgtatttgtcagcgatgctggtgtcgaggtatcacccacacccgaagatgtagccggcttcaacacatacatcgaaagctacaaggcaggtttgcctatagaagaagcagccgtcaaattcaaataagcggcttcacggagacctttctccccctttccctgaatttagtattaacataaatatcctcattccctctcctttttggagggggtcagggggaagctattatcatgaaaaccacctcgttcatacttgcccttattatatccatctccatcggaaaagcccagacgaaccatcaggtctcttacttttcccttcaagatgtgaagttattaagcagtccttttctgcaagctcaacagactgatttacattatatcttagctctcgacccggacagattatcagctcctttccttcgcgaagccggactgacacccaaagccccaagctataccaactgggagaatacaggactggacggtcacatcggcggacattacctttccgcactttccatgatgtatgccgccaccggagatacggcgatataccaccgtctcaactatatgctcaacgaactacaccgtgcacagcaagctgtcggcacaggatttatcggaggaacacccggtagcctccaactttggaaagaaatcaaagcaggtgacattcgtgccggaggcttcagcttaaacggcaaatgggtacccctctataatatacacaaaacgtatgccggactgcgggacgcttacctgtatgctcacagcgatctggcacgtcagatgctgattgatcttaccgactggatgattgatattacttccggtcttagcgacaaccaaatgcaggatatgctccgcagtgaacacggcggcttaaatgaaacgtttgcggatgtagcggaaataacaggcgataagaaatacctgaaactggcacgccgtttctctcataaagtcattctcgacccgcttatcaaaaacgaagacaggttaaacggaatgcatgccaacacacaaattcctaaagtaatcggatacaaacgggtagccgaagtttcaaagaatgacaaagactggaatcatgcagcagaatgggatcatgcagcccgttttttctggaataccgtagtcaatcaccgttccgtgtgtatcggcgggaacagcgtacgcgaacattttcatccatcggacaactttacgtctatgctgaatgacgttcagggaccggagacttgcaatacttacaacatgctccggctgaccaaaatgctttatcagaactccggagacgttgacaactccaacaaaccggacccacgttatgtagattattatgaacgtgcactctacaatcatatcctgtcatcacaagaaccggataaaggcggattcgtctactttactccgatgcgtcccggacattatcgggtatactcgcaaccggaaacatcgatgtggtgctgtgtcggttcaggcttggaaaatcataccaagtatggtgaatttatttatgcgcatcaacaagatacgctttacgtcaatctttttattccttcacaactgaactggaaagaacaaggcgttacattaacgcaggaaactctcttccccgatgatgaaaaagttaccttacgaatagacaaagccgctaagaagaacctgacattaatgattcgtataccggaatgggcaggaaactcaaaagggtatgaaatcaccatcaacggtaagaaacacctatctgacatacagacgggagccagtacgtacctcccaatccggcgtaagtggaaaaaaggagatatgatcaccttccatctgcctatgaaggtcagcctggagcagattcccgacaagaaagattactatgctttcttatacggtcccatcgttcttgcaacttctacaggaacagaaaaccttgacggaatctatgcagacgacagccgcggcggtcacattgcccacggtcggcaaacacctttgcaggagatcccgatgctgatcgggaatcccgattctatccgccattctcttcacaaactgagcggaagcaaactagcttttagttatgatggaaacgtttatccgacacaaaagagtaaatcactggagcttattccgtttttccgcctgcataattcccgttatgccgtttacttccgccaagccagtgaagaacagttcaaaacgattcaggaagaaatggctacagccgaacggaaagcgaccgaactggcgaaccggacagttgacctgatcttccccggtgaacagcaaccggaatctgatcatagcattcaatatgaagcttccgaaaccggaacccacaaagaccgtcatttccgccgggctaaaggttggttcagctataacctgaaaataaaagaagaagcaagccagcttatgatcaccgtacggcaagaagaccgtaacaaagcagtgatcctgctgaataacgaaaaactgaccgttcatcccactgtgagcaaagccgacaaagacggttttatcagactctgttatctcctgccccgtaaattaaaagtaggaagctgcgagattctttttaagccggacggaacagaatggacctctgccgtttatgaagtacgcttactgaagtaaccgtaagaacaagagaatgatcatcgtaaaaatcaaacttctatataatcatttaaacaaattccatttatgaaagcaaaactattagtcagcacggcctttctggcagcctcggtatctctttctgcacaaaagagtgctaccatcactgtacatgccgaccaaggcaaagaaattatcccgaaggaaatctacggtcaatttgccgaacacctgggttcatgtatctacggtggtctttgggtaggcgaaaattcggatattcctaatatcaaaggataccgcacggacgtatttaatgcattaaaagacttgtctgttcctgttctccgctggccgggcggctgctttgcagacgaatatcactggatggacggtatcggtcccaaagaaaaccgcccgaagatggtgaacaacaactggggaggaacgattgaagacaacagtttcggaacacacgaatttctgaacctttgcgaaatgctgggctgcgaaccatatataagtggaaacgtaggcagcggcacggtagaagaactcgccaaatgggtggagtacatgacttccgacggtgattctccaatggcaaatctgcgtcgcaagaatggccgagacaaggcatggaaagtaaaatatctcggtgtaggaaatgaaagctggggatgcggcggcagcatgcgtcctgaatattatgccgatctgtatcgccgttattctacttattgccgtaactatgacggtaatcatctgtttaagatagccagtggtgccagtgattacgactataactggacggatgtactgatgaatcgtgtcggtcaccggatgcaaggtctatccttacactactatacagttacaggatggagcggcagcaaaggtgcggcaaccaaattcaacaaagatgatttttactggacgatgggcaaatgtcttgaagtggaagatgtcatcaaaaaacattgcgccatcatggacaaatatgataaagacaagaagattgcccttttgcttgacgaatggggcacttggtgggacgaagaaccaggaacggtcagaggtcatctgtatcagcaaaacacattgcgtgatgccttcgttgcttctttaagcctcgatgtattccacaaatataccgaccgtctgaaaatggcgaacattgctcagatagtcaacgttctgcaatctatgatcctgactaaagacaaagatatggtacttactcctacttattatgtatttaagatgtacaaagtgcatcaggatgcaacctatcttccactcgacctgacttgcgagaaaatgaacgtacgcgataaccgtacagttcccatggtcagcgcaacagcttctaagaacaagaacggagtgatccatatttctctctccaacgtagatgcagacaacgcacaggaaatcacagtcaatcttccggacgtaaatgccaaaaaggcgattggagaaatcctgacttctgctaatctgactgattacaactctttcgaaaaacctaatattgtaaaaccggcttccttcaaagaggtaaaaatcaataaaggaattatgaaggtaaaactaccggctaagtcaattgttactttagagttacagtaatctaatagtaaatacttactgtattgtaaacaagaaggctgttaaaaagcctacaaaaaagatagctcttttggatggttaattacacataaagagctatctttgccaacattatgagaaatatgccaagtaattggcacattgacagactagcaaatctattaattattaaagatatgaacgataataaacttatgaatcgtgcagcggataacatccgtattcttgctgcttcaatggttgagaaagccaattccggtcacccgggtggcgccatgggtggtgctgactttgtaaatgtactcttctctgagtttctagtatacgatcctgaaaatccgcgttgggaaggtcgtgaccgtttcttccttgatccgggtcatatgtctccgatgctctattctacattggcattgacaggtaagttcactttggacgaactaaaagaatttcgccaatggggaagccctactccgggacatccggaagtagacatcatgcgtggtatcgaaaatacttccggtccgctgggacagggacatactttcgctgtaggtgccgctatcgcagctaaattcctgaaagcacgcttcaatgaagtaatgaatcagactatttacgcatacatttccgatggtggtattcaggaagaaatctctcagggtgccggacgcattgccggtgcattgggactggacaacctgatcatgttctacgactccaacgatattcagctttctacagaaacgaaagatgtaaccgttgaagacactgccatgaaatatgaagcatggggatggaacgtactcagcatcaatggtaatgatcctgacgaaatccgtgcagctatcaaagaagctcagacagaaaaagagcgcccgactctgattatcggtaaaaccgttatgggtaaaggcgcacgcaaagcagacggtagcagctacgaagccaactgtgctacacacggcgctccactcggtggcgacgcctatgtaaatacaatcaagaatttgggtggcgatcctgtcaatccgttcgtgattttcccggaagtagccgaactgtatgcaaagagagcagcagaattaaagaaaatcgtagctgaaagatatgcaaagaaggccaaatggaccaaagccaatccggaactggcagctaaactggaagcattcttctccggcaaagctcctaaagtagactgggctgccatcgaacaaaaagcaggtactgccactcgtgccgcttctgcaactgttctgggtgctcttgcaatgcaggtagaaaatatgatcgttgcttctgccgacctttctaactctgacaagactgacggtttcctgaagaaaactcattctttcaagaagggcgatttcagcggtgcattcttccaggccggtgtatctgaattatcaatggcttgtatctgtatcggtatgtcacttcacggtggtgtgatcgctgcttgcggtaccttcttcgtattctccgactatatgaaacctgccgtacgtatggctgctctgatggaacagcctgtgaagttcatctggactcatgatgcattccgcgtaggtgaagacggtcctactcatgaaccggtagaacaggaagctcaaatccgcctgatggagaaactgaaaaaccacaagggacacaactctatgttggtacttcgtccggctgatgcggaagaaacgactatcgcatggaaacttgccatggaaaatatgtctactccgacaggtctgatcttctcccgtcagaatatcgctaacctgcctgccggaactgattacgaacaagcagccaagggtgcttatatcgtagccggttcagacgaaaatccggatgtaatcctggtagcttcaggttccgaagtgtctactttggtagccggtacagagttgcttcgcaaggatggcgtaaaagttcgtatcgtatctgcaccatcagaaggtctgttccgcagccagtctaaggaatatcaggaatcagttcttccggctgatgccaagatattcggtcttactgccggtttgcctgtcactcttcaaggtctggtaggttgccacggcaaagtatggggattggaatctttcggtttctctgctccttacacagtattggatgaaaaacttggatttactgccgagaacgtatataatcaggtaaaagcaatgatttaatgaaaacaattggattagcatgcgaccacgccggttttgaactaaaagaatatgttcgcggctggctggaagtaaaaggctgggcttacaaagatttcggaaccaactctgccgcaagcgtagattatccggactatgcccatccgctggccctagcagtagaatcgggtgaatgttatcccggtattgcgatctgcggcagcggaaacggaatcaacatgactctgaacaagcatcagggaatacgtgctgctctttgctggaatgcagagatcgcacatctggcccgtcaacataatgacgctaatattctcgtgatgccgggacgcttcatcagcactgaggaggcggacatgatattgacagagttcttctcaacacagtttgaggggggacgccatcaaaatcgtattgataagattccggtaaaataatgcctgaaaatctataaaaataaggtggaatatttaataaatatcccaccttatttttaaaacatgaggctcaaggaatatataaccatagtctttgtcttcattttccttctatatctttctcaagttaaagccatctactataacacatctgttgaagaagattgctatatacacttatgactaagtttaccattgaacaatgtaataagacaatcctatttccaaagagggaacaattaaatgaaatttttcacgagggcgtatagacaattcacctatactggtatttttgtgaagtcctttaattttagcatacaaacaattcacacccaacctaattcccaagcgggagtcaaaagcatattcataagcaatccccatattgcctcccactgtcgaacatgttgtattataattctccaactgcgatattgttcccttacttctataattaacatatccaataccagcactcacatacataatcccatccaaaaatccagcctgccgtttaataaaagaaatctgcggagctacataatagaacgattttttttcattgattcccgatgatagcactccatcatgtttctttgtaccattactatagtcataataaaacaatccacatcctatattactgtaaggggtataagtcatcaattgtattgaagaaacaaaaggaacatcatttttattatttcctatataccaagagctgcttccatttttttgtataccagtaaaaccaatccctaacccgacatccaagatatatactcgtttatatgactcgttattagttgaaacattcagtgaatctttctgagcatacaaagagttgatactgaacatcaaagatattaatcccactagcaggcatttgttttgtttcataataagtgtgtttaataaaaagagaaaaaacgaaagctcccttaatcaatcatcattttgtttcaacccacaaaaatttgctattttcagcaatagctatcatagtttttaatcgagaaacagctgatacatctaaagatgaagcatcaatttgggcatatacttgtttagtataatcacgaacagttgatttatcatccatattcactaaaccattaatataactctctacaagctgaaattcagatactcgctgaggaaattcttgcttcattaaattcatcagttgatcaacagaagtacttttcttaaccagatccattatttccagcaatcttgtctgaagcaacaggggcatttcttctgtatatccataacttttcaattttttgttagtagaattatataaataataattagaaaaagtaccattagctattacgggatcttccctcatcatattatatattgtcttattatgatcatttccaattatttcataaggtcttaacggagcatcgtataccttccaatttgaactcaaatgccaccaatttctaggaagatcatcatctgaagccgcacaaataagtgagaatacaacagccgtaatcaagccacctctaggtgttaaacctttatttactccccaaccataaccccaagcatctcctacaagaaaacgctttattcgattccaaaagggaccacgagtctgtattttattagcattcaaggtttctataaagtctattaactcttgaatttcaacatcttgtgttttttcttgattttgttgtgtatttataacaacatcatttgagtttgaacaagaataaaaacaattcattacaagtagtaatgagacacaaaatacaatttgcttaatcgtcttcataatttcaatttttaaagtaggtactattaaagaattacattgcatcatttttctatttgccattataccaaaagagaactatatgatactaatttaacaccaaatatattcgttatttttgtaacgtccaacttattatcgcataaagtgtaataatttcatcctctccagtacattatccgccgagatattttatataatatgccattaagatcaatgaaatgttcagtctaaaatccttcacttacgttgattctagtgcgtaaaatatcatagatacaattatgacacatagttttttataataatcatctattttttatgcaaacttcaagattacaaaagaacaataatatcgtcttactatatgacgaagttaaaaaacagaagttatgggtaaactgaatatgaaagactggatcggtcagacgatcctaaataaaaaggtcatttccattcctatcatgacacatccgggcatcgagcttatcggaaagacggttcatgatgcagtaacgaacggacaggtgcattatgaagcaatcaaagcgctctgcgacaaatatcctgctgctgccgcaacggttatcatggatttaacggtagaggcggaagcattcggagccgaaattatatttccggagaatgaagtaccaagcgtatccggtcgtttgcttgcagacgaagctgccattgatgccttggaaataccagcactgaataaaggaaggatcgcgcaatatctcaaagcgaatatgctgactgcaaagaatatcacagaccgtccggtgctggctggttgtatcggtccttattcattagcgggacgcttgtatgatatgtccgaaatcatgatgctgatttatatcaatctcgaagcagccaacactttgctccacaaatgtaccgatttcattattcgatactgcatggccctgaaagcgaccggagtgaatggagtggtaatggcggaacctgctgccggattattatccaatgaagattgcctgcagtattcttctgtattcgtaaaagaaatagttgagaaggttcaggatgatcatttcaccgttgtacttcataattgcgggaatacaggaaattgcacccaggctatggtatatacgggtgcggcagcctatcatttcggaaataaaatcaacatggaagaagcattgaaagaagttcctgccgatgctcttgcgatgggtaatcttgatccggtcagtcttttcaagatgtcgagtccggaggaaatgaaaaaagcgactctacagttattggaagccactgccgcatatccgaacttcgttctgtcgagcggttgcgatataccgccatatacgccattagctaatataaatgctttttatacagcattggaagagttcaatgaaactcgaaattaggctgtcattcagataatgtcaattaataatgattgagcaagaactcacttatcaagacttacgaatcccatcgtccgaaatttatgaagcaatgggatacaaagattctataccggatcagatggtaatagatgagactaatacgttgctaaaacgggttattcccctgcttcgccctcggttcgcattcttctttatggaaggtacacttgatatcgaaaaagagactcttagcgtacaaagcatccatccacccactgtcaatcctatacaagacaccattcccacacggagccctgagcaaaacactttttctacacaaagtaaaagtaccgttttctctgttggtaaaaccatcgcccgtcaattaagaggatcggaagcgtttgtcttttttgcagctactgccggaactgagtttgaggtattccagcatacgttgcaacaagaagaagatatggtcaaaatatacatagcagactcgttagggagtattattgcagaaaagacggctgattgcatggaagtcgctttggctgaatatatacgggagaagaactggaaacataccaaccgatacagcccaggatactgtggatggcacgtttcggaacaacaaaaactgttcccattgttccccatagctgctccctgtggcatccggttgacagattccagcctcatggtacccatcaaatcagttagtggcgtcatcggaacgggcactaatgtccgcaagcttgaatacacttgtggactgtgcacttacgaaaactgttatcgcaaaagaaaacacagataaatttgtgatcgggggcttactaaaagtcggtagtaccaccattctcctccttcgggaaggagtggtcgaagaccgaggtggtaggtgaagaaataaattaatgataataaacaagttatataattacctaccacctccccctacgggtactcctccttcccgaaggaggagacttaagatactatcgactttttagtcagctttatatcttctttaatggccattaaagaagatataaagccctatcatagttacgataagcaacccccataagataagtacaatgcgggcaggcttttcttcgatcttctccatattcaatattgccgtctgaggagtcttatccaatagaccgacaactaccatccctatcccgataataacgaacagatagaaggataataacataaaatgaggccatgcagaatattgatccgcaggaaatacccatagatacaatacacctactcctatactgaataccgtccccactgtcagggcagcgttagcagccaacgtagtcgtacgcttccagaaaacgccaaaaaggaaaactgccgccataggaggtgcaatgaatcccaatacagactggaaaacattgaataaattcagtccgtgaatgctgtcaatggcaatcgttatgattaccgatatcagagcaccggctaccgtcaccacttgtccgacccggatgatctccttctgcttcgcctgcgggcgaatcttcttcacataaatatccattgtaaacacggtactcaaagcattcaatgccgatccgatagtactgacaagcgcggcagtcaacacagccaacaccagccccaccatcccgacaggaaacaaatgggttaccatcgtcatatacgcctcatcgggattctccaactgcggaaacaaggccagacagatgatacccggaagaatataaagaggaacatccagtattttgagccatccggtaaagttcgttcccaactgtccttctttcagacttttggctgccaacacaggctgtaccatcgactgatccgtacaccagaaccatactcccatcacaggatatcccaaaataatcggcaaccaagggaaagcggtatcatcattcggtctgaacagattccagaagtctgccggaacggcatctgtcagagccgatataccaccaactttatagattcctacaatagccaacgcagccgaaacaagaatcaacaggatcatctgataaacattcgtgtaggcaaccgctttcaatcctccgagcatcgtaaagaatgcggatatgatcagcaatatcaaagcggactgccacatcggtatatcgaatacctgacgaatcagaacgccacccgcaaacaatgtcaatgctagccaggaaatcaagattgtaacaatcgtataccatgccaagatattacgggtagactgtccgaaccgctttcccataaactccggcaaggtggaaacacgagaacccaagtaacggggagcgaaaacaaaagcaagcaggcatataaaaacgaaggcataccaggcataattgcccgaaacgatgccggtagtaaatccggcactggcagaagctatcaacatagacggccccacattagtcccccacatggagaatccgatatggtgccatctcaaagaatgttccgccaaaaagagactgctccccttctttcgtttggaacttgcccatataccaatggcgataagaatcagaaaataggcaatcagaatgccccaatccagtgtgtctaagaatttcgcatgcataattcaagtattaacaattaaaatattcttaatctcttttccccatcagcactttggcgaccgccacggcagtattagcattatcactatacccgtcagcaccgatttcatcggcaaatccctgactcacgggtgctcctccgatcatcactttcacctgatcgcggatccccgcctcttccaatgcccgaatcacatcctgcatataagtcatagtggtagtcagcaaggcactcatacataagatgtccgctttgttttccttcaccgcttcaacaaacttgtcgcaagtgacatcaataccgatattaatcacttcgaagccacaaccttccagcatggaagccacgaggttctttccaatatcatgcaaatctccttttacagtaccgatcacaattttcccgatagtagcagatgcattccccgccagtaaaggtttcaaaagttccaaagctcctttcatggcacgccccgccatgagaagctgaggaacaaaggccttgccgtcctgaaaacgctgaccgacttcgcccatagccgtaatcatataaccattgataatatcctgcgggagtaccccggcagcaatggcatcctttgtaacttcaacagccggttccaattttccggctacaatggcatcatacaaaggtttcatccgatcctcttcctgagacttttcttctctgatccgaatactttcctgtgcattatcctgttctccaacgggttgattcgtgtgaacatctgcagacacagacgaagaagagccggtatattcctcaatgattctcattgcctgctccacttccctctcattgtggaaatccatttccagatgcactccgtctgccccgatatggtccaacaaaggtttcagttcctccagagtcacccagcaagccattacgctcttacctcctgccagtatcttcttatataaatcgtaccacttcggagaacctccctgcggctcgccgacaccgggcgtccattggatggcattcagttcttcaatctccagcaaggcgggaaggtgatgcatcgctcccactccatcaagatgatagagcgtataatcgattttctgacattgctcacgaataaacggctgcacaaaacgacgataatcatcctgactgatcatggtagaaatatcgctctgcaacttactcatcttgcccggagcccatgaagagaaatagcagaatgccatttcatccccttcacggataatgtcgtagagttcatcaaagactttaaaatagatgtcattgatctgctgcatctgttgctccagcacttcggactgcatcaccgtatccagcaataccatatccgtacctttcaaagccgccaatacatccagtccttccatcaggtcgggcataccgacaaagtagtttccgttggctttagccttacaggctttcagaagttctttatgcaagagccagttcggatgttcgggattgaatacgatctcatcattaaagttcggatcgggatgtatccagatcgtatcttcgcctccttcaaacactccgcccagaatagcagccagtgagccgggacccaactgagtatttgcaacaggcagcatatccgccatcagactactgtgagcgacataccaatccagatattccgcccgccattgagggtcgaaccacttctgcgacaaatcccttgccggagcaggtggagcaatgtcggcgtgcggtttcacgccttcctgaaagtgttcccacatagaaagaataattcctttatgattccaccaatttatataacgctgtttcgtttcttctaagtttgttttccaagttttcatcgctattctttatttagtccaaaatcctttgtaattatgatctatgcgcaaggcaatacttttgcctaaatccatctcgtccgtacaattcacttcctccggataaatcgggataacggcattctcacgcacataaacaggcatctcttccaagggcacatacacctctttcagccagcgtccgccttgcaaccgttcgccggtaaagaaattcacccactgtccttcggggagataaatgtcgcgacggttttcgctattcatcaccggagctaccaggaaatcattgccgaagtaatattcgtcatcgatatgccagcagagtttatcttccggatgatgcaggatgagtgcctgtaacaatggccagccactttctactgccagtttactttgctctatgatgtagggaatcaacgagtagcgcagtttccaccacttcttcaccagcggggcgatagccggataatgccagggttcccgcttattggttccatgataacggatgtgtgaggtgaacactccaaactgggtccagcgcatatagacgtcctccgctacgattgagttcataaaattgggcaaggtatggaatccggggacatcatggctccagaaggcaaagcccgataaaccgaagtgcaggcctcctttgagtgaaccggccatgccatcccatgaactgcaggagtcacctccccagtgcaacggataacgttggcaacccgcccaagcggcacgtgcccagacaatgccgtcccctgttacctcctttgttatttcgtaagctgctttctgatagagcaaggcatacaggttattcaacagttccggtttcatgcccttgtagacagcatccatgtggatattttctccgaaatcggttttaatacaggtgactcccatatccagaagttgctttaatagccccttgtaccattcggttgccttcggataagtaaagtcgatagtacccgcataatccagagccgagaagttggaaccgtccgtgtcctgctgcttcgtcagaggagctatatactcattcgcctttgcctcctcgatctgttccgcatcttcagcaacataaggtaactgccataaggacacacgataaccgttcttcttcaatctctgaatgaatcctttcgggtcgggaaaacgttcctcgttaaacttccattcacacagccagtcggttctgaaccatccggtatccagatggatgacatcgcagggataatgttcggcacgcatacggtcgcagatctcatttacttcgtcggcactgaaataagtcatccggctcatccacactccgaagctccagagaggaggcatcgaaggatatccggtcaggtcacggtagccgcgaagtatctcttccatcgtatcgccggcaatgacaaatgcatccagcatagcctgatcgctcaggaactgtacggagcgggtggaatgtcccgccagcgaaagtttgctgtgggcgcaggtatggtaaaaagtcccgtacatccggctggagagatagaaaggtatattcttataggtacgccggttatttactccctgcccatcctgattcttgaggaaaagcgtctgtccgctcaagtccattttgaagaaacgctctccggttcctgcaaagcattcatccggccggctctcgaaagaaagggtggcacgttcctttttgcccgtccgtttgcagaaggcaatgggcagtccgtcatagcggggaggcgagaaatgatcgtatgctgccaggcggatttcccgtttgccgtcaggatacagagtgatgtccagtgtttcctgaggatcgggcagtaactcgctccatcggtccaaagccggctcttctacattgataacggcacgcttcgtcccgtcttgggtgaaaagaatccatttgcctccctgcttctctacagacaaaggtactctgcgaatccgttcgctgaattgcagcatttccgactgatctgtcagttcatattcaccaaatccaagaaacagacgggtaatgccgatattatactggcgtatgatcaacgtatattcttctcgggggacagccgtatccgcaaccatatcattagctaacagctgtttttgaaaggggaccgtgacacagatatccccatccttttcgtaaacggctgtcggtttacaggctttccaaagtgactcatcccttaataactctgtatcgaaatcaaggaaatcgaacaaatggtaattagtaggtttcatttatgatctattattattagttttatctttatttatctatactcatgcagacttcacaagtctctatggccccactttttgcacagcccgacactgcgataggctcagtgtcggactgtacttactccggttttatccttccggccttattcttaatgctttctgtcacttgtggtccgttatttttccatacattccgattgccgggacgattcgagtcgaaacgttcagtcggacaccagttgttttcaatcgtatatccgtccgtagcttcatccaaataaatataaaaggccctgtcattggtggcgtaaggtgcttcttcgagatgttcgatccgattattccgcatcacggagcccggttggttggaaagcgtataaagtcctccggcatcatacagacgacgggcaaagtgatgtacgtagttggcttctatccggttgtttttcattccgctttccagcgatgtccacccccagccgacacaaatacccgaataattcaagtgacagacttcattatgggaaatggcgataccgctgacgtatcccgcaccgatccccacgcacccccagtcttcattggtcacatcagtgatcagattatttttaatggtaatgtccgtgcataggttacgttcttccggagggatgaaaggcacatgcgtctcaaaacctccgtcggggaatgcaccgatcagtatgcctgtaccaccgatatccgaaaagacacaattctctatgccggaagatgaaacagcccattcataatccagtccggtagatgccagatgccggaacctgcagcgactgaacgtaagatgctcagtaccccgtacacgtattgccgtttcggggcgtgcaatccacgcctggttctccagttccgctttctccggaagtcccggttcatgcagtttataagcatccagcagaggaaaacctccttgcaaagtgacatgtccctgataggaaggacgcatccatgaagtatgggcaaaggtgattccttccactcgaatatgccgcaccgggcgttccaatgtgccgtctacaatcatcaatgtttccagagcaggaacgatcacttcggcagtctccatatcttcttccgagcggggataatagtagattgtccccgacggatattcctgaaaccactctccgggttggtccagcagttccagagcattcgtcaggcaaaaggaagagttgcctttctctcccccgatgacgggctgaggccacggatgggcaaactccagatgactctccggttcgtgaaagcgaatgacggcctgttctcccctaacgtctatactcttcacacgcagaatggcaatcgcccaacgttgatgaactatcatttccagtcgacgggcattgaggaggtttccgatctgagaagcagggattattatcgtctgttcttccggattgaaatcaatcatccgttccatcactccatcaggaaactgtgccgctcgctgggccttgttgccgtctaccaacatctggcgggtttctacgattctatttccaaaggatggcgcctttgccacccatatttttgatcttaattcctttgcaatccgaggatcatcacatccctttttccatccggtcactgccactccgccactgatgacaggatgcgcattctccaccgcacggatgagtgtcggagaatcgggcgtgccgctatcctccggtcggataaacaaaggagcggactgtgcataaaccccgtcttccaaacagatacaaattcctccggccgcctcgggacgattcagccttctccattcacgagcctgcttgatggcgcgattcaaggtaagataaggagcttctttggtacctgcattcctgtcactcccatgcggagaaacataaacctcgcctgcgacgagaacggaaaataaacctaaagaagccataaaaagaagaacaacgattgtctttttcatggtacaaactcaatgtgctattatagttaggacgggcatacatcaatttagtactcgaataggatgaaaataataaaaatgccattgctacaattggagtactttcagtattcagactattcagttttactcgcaaacgacttgatagaaggggatagcggctgaaggcactattttgtaccctgtctttaggagcttctaaacggtgcaagtggcttcagtcctttcatcctcaataataaatccatagttaattggttatagctctttgcatgcaagttgtagctactccgcatgcgaggtgaattttataagctcggcgctaaacgtcactcagtaccgaggcgaagggtactcaacaccgagggtaagattggtgggataccggcttacttcaaatcaataaactaaccaatagttcagataaaaaacagaaggtctgtttgcctcaaacagagcctgtgtttattccaaacagaacctttgtttgagataaacacaggctctattaagtcagtaactaccgacgttcgaatggattatttttcaggctgaagggactgaagccacttgcaccgttcagaagctcctaaagacagggtataaaatgcccccttcagccgctatccccttctgactgggcatttgcggacaaggctgaaaggactgaatacggaatgtcgtttctttgttggcgaggtcgagttttgcccctttttgttccgaaaagaagcaaaaacttataattcaaatccgtacaaaacgaattctatgatcgaataaacccgactataaactgataacagaaatagccacaaactacaaatttcaggaatgttcccagtagaaatccaatcaatgatcctacccccgatctaagtgcttgagaaaactctttattccctagcaattcgccaataactgctcccaagaacggaccgaaaatcactccccaaggcaggaaaagaaggccgataagggtcccgatgatacatccccaattgccccatctgctaccaccgctatacttgctgccaagcataggggtgaagtagtccaagacttgcacgacaagaacaatcagcagccatacaataagttgtgtggtagtgtattgaaccttatccgtaaaatgaagaaggaccaatcccaaataagcaacgggaggaccgggtagaaagggaagaatacatcccatcagtccggtaatgaggcataacacacctagtataatcagaataatatctaacatcgttttattgcatttgaaagatgtactttatatccggtggcaatttaagcaaataaaccgaatcctccaaaaaacaatcagtaacgtcgggaaggagtataatcaattctataaatacggtcgaagaaaggactccattcattctccgcaatcccaagttgcagaccgtagaaatgcgtatccacttttctatattccagcatcttgtcagtcagttccggcacggataaaggtatcttaaaatcactgatccataacacatccgcattcatatactccttttttgactgaagcaaccggaagatagcttgcagcattcgggtagcatccgtatctccacaagaggtggtggagaaaaattcaagcagccgcgccctctctctccgcacatcaatcggattgatggatacagaaaaggcaataaggaaacagtcccgacgttgcctgtcagctatttccaatattttaatcagcagcgaatatgcaatcttttccggtttcccgaccatacttccggaagtgtccagacagactatcatcggtcctttctgcgtagcaggctttatttccagtcgccgtgccggttgcatgatctcggatttatagcggaaggtctgaagttttcgggtaacatatttatagacaaacaagtcttccagctcatcatcggcacaatgcgccagttctgtaggaagcaatgcgttcaggtcattccctactgtgatacccaaaatgtcacttttagaagaatgctccatcttatatacattcccctgcgcgacatgtagctgctcctgtccttcatcgtcagccatacgccccatcttattggcaaccttgaccacttccggatattctttctgaatgcggacgattttgcgtatccgctcaaaatccaccgtattccacataccgctcatcaagccccaagcctgatagaactcgtctttctctatgttattttgccggatatatccggggatattcctgagattggcatgaagtctgcgttcgaaatcatctttgcgctgttctatctccttttccttttgctcctgcaaatcccgttggaaagcctctttccagtcgtccaccatcctctcccagacttcctcatccgcatatttcccttcattgccgaactgcccctgataaaatgccttgtcgaaaccattaccttcatgtttgtcggcaacctcctgtagtaaagcctgccacccgtctttccgcttggtctcggaccattccagcacaagttccattccttgctgttccgactggcttttctgcatattgtacttttgcttttccagattcagacggataaactggctcattgcatcgtaaaagattcgggcacaaagttcatcactcaggacttgtatctttatcatcggatcgttcatgacggaaagcaggtaagcgtacagcggttcgttatccgcctccgcacactctccggtcgctacatacttatccagcacctgcacataaaatgcagcatcatatctaagactcatcgccgtatctcagtttacggacatccacacgtgcccatgcaatctctttacgaagggtcgccacatattgtgccaccccttttttatcttcttcggaaataaaaatattctcagacaagtcttttactaatttctcaatccggccatgggctgtctccaactccgtctcataatcccggtcggtgagagtcatattgcccagccacaactgctgttgctctcccctcttcagccgacgcatcggaaagcggacaccattgatataaagattcttctcatccctgtaaagtgtcaccctttcggcaccttgttccttcattttggtggcatccgaaaaagtacgtataatcgttcgcttcggattcagcggatcggcatacatgactcctgttgcaggaacatccttcggactgtattctttcagattcttataatccacaataaatatgtaggtatttcccgtaccatgattctctatctgatagtagaaatgatcgatgatcatcaaatcatcgtctctgcggtcacctttctgacgggctttctccaatgcttcacgcacgcggctcactttcaggtccgactttaatgataagttgatagcggctatctccttcacataaggaacaaacagcgcacggacaacgatctgccggatatccgcacactcttccggttcattccacaagcagtggtaaacaggtaataaatctgtcagacagacttccttccgaccatgaatgaaagcagaagctttcagcagcttcacgatattcttccagcgacggtcactcacatagacattccgatgtacttccgagccttgaatctcgactttctccaggttcttacggatttctgtgatgcaggacaggacttcggcagataccttgatctgccgtatctctttctgccatccagcatattcctcatccgaaatctgccaccgacatgcttcctgttcttcttcgtcatcatcgtccagcaacatttgatagaacgcttcctcctgtttcacgcaagtgctgataatgcgaatcaagaaacggtcccacaaggcttccagtccttcgccctgcgtaggcagttcattactggcagccaccagcagcttcaacggaagtttcagttccgtatctccattccgaaacagcttttcattgatgaccgtcagcaacgtattctgaatagccggaccggctttccatatttcatccagaaacacgacatccgctgtaggcagatacccgtccacagcacgctcgtatttatccgattccttcagacggctgatgctcaccggaccaaagatctcatcaggtgtggagaaacgagacatcaggtattcaaatgcccttgcatctacaaaagctctcttcaaccgacgggccaccatcgactttgccaccccaggaggtcccagcaacaaaatactttcgcccgccaaagcagccagcaaagacaaaccgatttcagcctctttctcatatacccccctgttcatttcggacagcagcaactgtatacgttcttttatttccatattattctttgattctgcacataaataaagatgttattcaccttaccgcctatgcattgtttgcagataaacggcttacaaatatacggttttacctgtcattaacataaatacatcttctctaattctgtcttttatactcaagaattatcttaaggcatatttaatattgattatttattcacccaatatgcaataaaaacaaaaggaggtaaatttcctttctcattttcccccatttacataaataaaaactatctttgcgattcagaatcccgaaagacgaaagaaaatggagcaaatagacaacctaaaagagcttatcaatcaaggggatgtggacatagcaatcaagcaactggaccaacttctccaagacgattctgtcgagaaagataaagatatgctctactatttacggggaaatgcctaccgaaaaaaaggagattggaagcaggcgctggataactaccagtatgctatcgatcttaatcccgacagccccgctgttcaagccagaacaatggcgatagatatcctgaatttctaccacaaagatatgtataatcaataaccgaattcaaagataacgtaataaaatagagattatggcaaaaattaaaggagcaatcgtagtcgacacggagcgttgcaaaggatgcaacctatgtgtagtagcgtgtccgctcgatgtaatcgccctcaacaaagaggtgaatatgaaaggctataactatgcctggcaagtaaaagaagatacctgcaacggatgcagctcgtgtgcaatggtttgtcccgacggatgtatctcagtgtataaagtaaaagtagaataaaagaaaaagaatatggcagaagaagttgtattaatgaaaggaaacgaagccatcgcccacgcagctatccgttgcggtgcggacggatacttcggatatcctattactccccaatcggaagtactggaaacgcttgccgaactgaaaccgtgggaaacaaccggcatggtagttctccaggcagaaagtgaagtggcagctatcaatatggtatatggaggcgcaggtagtggaaagatggtattgacctcttcctcaagtcccggcgtgagtctgaaacaggaaggtatctcctacatcgcaggtgccgaacttccttgtctgattgtaaacgtaatgcgcggcggtcccggattgggaaccatccagccgagtcaggcggactacttccagacagtgaaaggaggcggtcacggtgactacagactgattgcccttgctccggcatccgtacaggaaatggcggatttcgttgcactcggattcgaacttgctttcaaataccgtaatccggctattatccttgccgacggtgtaatcggacagatgatggaaaaagtagttcttcctgcacagaagccacgccgcaccgatgcagaagttatcgaacaatgtccgtgggctgctaccggaaaagcgaaaggtcgtaaaccgaatattattacttcactcgaactgaagccggaagcaatggaaatcaacaacatccgtttccaggctaaatacaaacagattgaggaaaacgaagtacgcttcgaagaaatcaactgcgaagatgcagaatatctgatcgtagctttcggttccatggcacgtatcggtcagaaagcaatggaactcgcccgcgaaaaaggaatcaaagtaggtattcttcgccccatcactttgtggccgttcccgagcaaagccattgccgcttacgctgacaaagtgaaaggtatgctcgttacagaattgaatgccggacagatgatcgaagatgtccgcctggctgtcaatggtaaagtaaaagtagaacatttcggacgtctcggcggtattgttcccgatccggatgaaattgtaactgctctggaagaaaaaataatcaaataacgaaacgacgatgaatcccgataaaataagaaacgtattgaacatccttttcatgatattggcacttgccgctatcattgtctactttgtagtaggaaaggaagattttaaaatgtttatctacgtatgcggcgcggcaatctttgtcaagctgatggagttttttatacggttcaccaacagataaggagaagaagttatgactaaagaagaaataatcaaacctgagaatctggtttataaaaaaccgactctgatgaatgataatgccatgcactactgcccgggttgcagtcacggcgtggtacacaagctcgttgccgaagtcattgaggaaatgggcatggaagaaaaaacggtgggagtctctccggtaggatgcgcagttttcgcctacaactatctggatatagactggcaggaagccgctcacggacgtgcacctgcagtagctacggctatcaaacgcttatggcccgaccgtctcgttttcacttatcagggtgacggtgacctggcctgtatcggtaccgccgaaacaatccacgcactgaaccgtggcgaaaacattaccattatctttatcaataacgctatctacggtatgaccggcggacaaatggctccgacgactctggtaggcatgaagagttctacttgtccttacggacgtgatgtcgaactacacggctatccattgaagattaccgagattgccgcccaactggaaggaactgcttatgttacgcgtcagtcggtacaatcagtgcccgccatccgcaaagccaagaaagcaatacgcaaggcattcgaaaattcgatgaacggcaaaggttccaatctggtagaaatcgtatcaacttgtagctccggctggaagatgactccggaaaaatcaaataaatggatggaagaacatatgttcccattctatccgctgggtgatttaaaagataaagaataacgcaaaagtcaacagaacaatgaaagaagaaataattattgctggattcggtggacaaggcgtattgtccatgggtaagattctggcttattccggactgatggaaggaaaagaagtgagctggatgccggcatacggtcctgaacaacgaggcggaacagccaatgtgacagtgattgtcagcgatgacaaaatctcttcaccgatcctgagtaaatatgatacggcgatcatactgaaccagccttcactggaaaagtttgaaagcagagtaaagccgggcggtatcctgatctatgacggatatgggattatcaaccctcctacccgcaaggatatcaaagtatatcgcatcgacgcaatggatgctgccaacgaaatgaataatgcgaaagccttcaatatgatcgtacttggcggtttactgcaactccgtcctatcgtaactctggaaaacgtcatcaaaggattgaagaaaactcttccggaacgccatcaccacttgattcctatgaacgaggaagcgatcaaaaaaggaatggaattaatccacgaagtttaataaattaagagtttaaaattgagaattgagaattatttgctagataatagcgcgatgcaacataattttcaattctcaattctcaattctcaatttaagtaagtatctttgcctccaattatgagacgaatcttactattatatatattattctccgttgtaggactgagtgctatccatgcacagctcaaccctgcccgccagcaaatcgacgagaacggacgcgaccaatatggtaatcaggtagaccctgccatgattccggacaaactggatagtgccaatgttgaagtacagggactgccgcctacactatatatgtggcgtatcaagaaccaattaggcgaccggacaatgattccggcagatacaacttaccatcactttcagaatacgaatcttacagaaggaatcaccggacattataattatctggccaatttaggttcaccgcgtctgtcgcgtatcttctttgagcgccgttatccggaaccaaccatctttatggagtctttctccagctttttcattcgcccgacggaatttaactttacgaatagtaatgttccttatactaacctgacctatcacaaggccggaaataagcaaaatggagaagaacgtttcaaatcttatttttcagtcaatgtaaacaagaagttggctttcggctttaatattgattatctgtatggccgaggctactataataatcaaaacacttcttattttaatgccgcgcttttcggtagttacattggcgaccgctatcaggtgcagggaatctatagcaacaactatctgaaaacgaatgagaacggtggtatcactgacgaccgctacattaccgcaccggaagaaatggcagaaggaagaaaagaatatgaatctgtcaatatccctaccgtactcaatgccagtgccaaccgtaaccatgacttctatgtctttctgacacaacgctataatctgggattccaccgggatattccacaggcagaaaatgatacgatgcctgccaaacaggaatttgttccggtcaccagctttatacataccattcaggtagaacgttcgcgccataatttccgttcggatgataatgtagaaaactattataagcaaactctccttgataaagagaatacattcgtcagagacagtactgtctatatcggagtcaagaataccataggtattgctttgctcgaaggcttcaacaaatatgcaaaagccgggttgacagcctttgcctcacataagctgagcaaatattcattaatgagcctagacccgctaaagcaggataaatacaatgagacagaaatctatatcggtggcgaactgactaaaaaacagggaaactttcttcattatcacgcaatcggtgaagtgggaatggcaggaaaggctatcggacagtttgatgtcaaaggagatatcgacttaaatatccctttatggaaagataccgtcagtgtgattgcacgcggagaaatcagtaataaacttgcgccattctacatgcgtcattaccactccaaacatttttggtgggatgatgatatggataaggaattccgcacccgtatcgaaggcgagctgagcatagccaattgggggacccgcttaagagccggcgttgaaaacataaagaactatacttacttcaaccagcaggcattaccggaacaaaaaggtggtagcttgcaggtagtatcagcttgcttcaatcaggatttcaaagtgggaatcttccatctggacaatgaagtaatctggcagaaatccagtgatcaggctgtacttccattaccggaactttcgctgtatcataacttctatatgcagttcaagctggcgaaaaaagtattgagtgtacaattaggtgctgatgtacgttacttcactaaatatgatgctccggcctatatgcctgctacacagcagttctacctgcaaccggaagaaggtaaagtagagataggcggttatccgatagtgaatgtttatgctaacttacatttgaaacgtacccgtttctatgtgatgatgtatcacgtcaatcagggaatgagcaaacctaactacttcctggcacctcattaccccattaacccacgtgtgctgaaattcggactttcatggaacttctatgattaacaaaacctctatgatttatgaaaacgcacccgaaattgagactattcagatatctgttgccggtagtcattgtactggcactcatcttctctgtccgctattgcggtaagcaagaaaaacctctggggcatccgcgtgattatgcagccatcgccaaagaaggcatcctgcatgtagccaccgaatataattcaatcagtttctatgtagacagtgacactgtctccggattccattatgaactgatagaagcgttcgcacgtgacaaggggctgaaaactgaaatcactcctgtcatgagcttcgacgaacggctgagaggattaagcgacggacgctacgatgtcatagcctacggaatactggcaaccagcgaactgaaagattctctgcttctcacctcccccatcatactcaacaagcaggtgctggtgcaacgaaaagcgaacggggagaatgattcactttatatccgaaaccaattggaccttgcccaaaagacacttcatgtggtaaaaggctcgccttctattctacgtattcagaatctgggaaatgaaatcggagatactatttatataaaggaaatagagaaatacggttcagagcagttgatttcgttagttgctcatggagatatcgattatgccgtctgtgatgaaagcattgcccgtgcagtggcagattcattgcctcaggtagatatcaataccgcaatcagttttactcaattctactcatgggcagtcagcaagcaatcacccgcattgctcgatagtttgaatacatggctggataaattccaaaaagaaaaagagtatcaaaagatttaccggaaatactatggtgataaatagataaaaaataatacgccgaagacttgactttcgcatttgaatgtcgtatctttgtcaacgtaatcataaagtagtttcagttaaactacacgtaaaggagggaatcacagttccctcctttctttttgttacaatgaatgaaaatcagcctttttcccagctttttgctcattttacccccgagcttagtccgttttacctcgtttgttaccatacttaacatagtatcttatgactaattagatgctttgttatgattaatcagatgctttgttatccataaaccgatgctttgttatcccaaaacagaagctctgtttccggacagctcccaagagttaacaatcaataaagttgctcttgacaaaaatttgctctacttttgaaaaaaattcccttttcgatgtcacgtttttaatccgccaccgtcttatcagtgtaaatggaactgaaacaatttaaaataaccgttgtaccccttcgagacaagctgctgaactacgcccgaaggatgacagatgatccttcggatgcggaagatgccgtacaggaagtcatgctgaagctgtggaatctgcgccagaagctagacgagtacagaagtatcgaagccgtagccatgaccatgacgcatcatctctgcatggatatgtggcgtgccaaacgaccggacactctatcactcgaccgtgtacaggctcccaccccttcggctactccggagcgactgctggaagagaaagatgagttcagattgatgcgggaaattatcgactccctgcctacgctgcaacgaacgattattcgcatgaaagacatcgaagagtacgagacggaagagattgccgaaatcaccggctgcaacgcagaagccatccgcagtaatctgtcgagggcccgcaagaaagtaagggaagtctatttgcaaacgatacaagaacgaaaaaggaggaacaaagcatgaaagatatagaaaccttgctaaacaaatatttcgaaggagaaaccacctgcgaggaagagcgcagactacgacgtttctttgccgaagggctcgtaccggaacatctggaggtatatcgcccggtgttcgctttcttcgaagcggaacagaaggaacttccggaaatctccggtataggtaatgccgtcgaaatgccagaactcgccccattcgagaaaaagacaaaaacgatcagacagtatctgacttacagtctcagtgctgccgctgccgccatactgctactcgtaggcatctccggtatctaccgtcatctatcccctgcaccggccaactatgtaatcattgacggtaaggaatatacggacgttcatttaatccgcgaacaggcgatggtcgccttccgtgacgtcagcctcagcgaggaggaagtgttcgctactttatttgatgaataatataatataaaaacagcatataatta

SEQ ID NO: 69 - DNA, 39341 bp, Bacteroides thetaiotaomicron
gttattgggagtgggaggatatgcaagctgaattatttaagatataaatgaaggaatctaagactccaataaagccaagaagcaggaagtctttttataaatgaaattaaaaatattgtaataactgtggtggttgcaacatctgtggttcaaggaagtctgactttaagtttcttgtgccttatccgtatagagcaggagcaaccatcttccaacatctgttctttttacaaaagaaatatagatgaaaggtggattttatattctccgcaaaggctcatcctgccaatccaggggaatgttcattgacttgctgtcaatatttcggatattaacccagtaacttttggaaatgctgtttcatatcgttgtccagcgatataatgttgataaaccactaaatgatgcagatttcataaaatgtcctgtgtagtgatatcatatcgtttatccaagggaattgcatcctccggactaccatcggattgatggcgtactgcttgttttatacccttgtatgatgacagcaggaatttcttataaggattatgactgtcagccacgaagtgaaaacgggaacggatagatcatagcacaccgtaatcttttttcaatggattggattttatattttcatggatgctagttacgatgcccattgacaacatgtccacaagcatccatgcaagaggataagtattgctgtatttgttcttgaaatgcagaatgaaatcctcttctggagttattgacctccttctctattagttccattgtacaactaaacttgttggggttggagaatagggatctgtcggtcattcagaagatattgccggtctctttcgccacgacactatgcaggaaaacctcgatctttttaattgaagatgaaaaacggagttaaaacatgcaaatcttaccggagatatttgctaattgtcagcgtctttggtatttttgtcctgaaaaaaagcttctttgagttgatgcagaataaaacagaatattgtaattcgctcgtttctaaagtgttacctattatctacaaagtgagtgataactattttattttcagttagatagagaattggttgtgtttagcagtgtatgaacttaagtcagcagtcaatcctaacactcctttcagaatcaccagttgactattaaaataacgaagggccagctgatattcacgatacgcttcttctgttccttccttgctggcgatcagcgaaaaaagataaggagaggcaggatcagtattcatgtattgcctgatcagtttcattgcttcgggcagaagagttacggtcagcattctgccggtctttcttcggcgataagtcaggacattcccttctatatcacgcttcttcaagtaagcaaggtctacgaatggaatgccgcgaagcataaacattaataaaaagaaggcacgtgtacgttgtaagtctctgattccggaataaagctgattcggcagctttgccatcaatcgttccatatcctctttgtccagtgcacgttttctgtcagccctcgtccctgtatagacataacgaaaatgatgaggcacataaggagcaagatgtcggtcaaccgcccggttatacactgcacgcaatgtgcgcatataggtggaaaccgtattccagctacaatcttttccacgcaaatacgtttcgaaattttttagaaactcctgattcactttccgaaaaggaagattcccacttccgtggaatgaaatgacggctctcatactactcctgtaaatatgggcggtcccataattcccactttcccgcagcccatcggctacgtctttcatgaatgaaattaaattccccattattatacgaatttaaatgatacttaaaaggctgttttaagaggaagaatattccctttcccatgcttcttccataacaccttttctttctatttccctaaatcttaaaagacaaagatagggatatatttgttcaaaatcccaaagtgctattggacgtgtgacatttttgtatatatcttaagttttatatggggaaggattatcatcaatgatatgcaataaaaagggacgttcccagggaaaaaggggaaattaggaacgtcccttgaatagagttagcgaaaagtccggtctttcgcaagtgcagacctttcctctcttcactaaaataaactaaggactatagtggggaaatccttagtggggaaaaacgactatcaatcgcttcacagagacagatacccgcaaagtagtcgcatccgttacttacgtatcggttgagcaacatgatttattcagcaatacagatactcacccggttttcttccggtgttttgtagggctgaacagtatcacctttggaatcggcaatgattctatcaggagttattccttttgttttcagaacttctgcaacattagctgcacgtttttcggacagtgttttattgatcttagaatttcctgtattagcatccgcatagccagtcacttttaccttggcagacggattcttctgcaaatattctaccaacatattgattttagacttttggtcgtcttgtatcttagccgagttcaaggcaaaaaagatatcctgtttcattggctgtactactacctcttttctaggttgtggctgctctaccacaggagcaggtttcggttgttccaccacgaccggttccggttcgtaatacacaggcgggatttctttataacctttgccaaatttaatagtcaaacccaccaaagcattgaactgccagtcggcatttcccgctttcttcgaattaaacttgtcggaaagaacattggcattaccttctatattgatagccaaacggtcattcaagcgcaagttgcatcccagacctaaacgcccggcaacaagaaactttccttctgtccaaagatagcccatcgggtaaccggctgcgttaattgcaacagcttcgtcattgtcgaagccacggttaagacccgctccggcaaatatatagccattgaatacacgcttgggattgaaaccacaaaacagcgtactcaaatcagatactatatccacattaccttgaagatatttatatttataatcctgccgtggagcaacccaactacctttagcctgccatccgctaacgcctacacgagcactccatgcgggagcaaactgataaccgacattcaatgcaactgcaggagatataagatcagtgaatttggcctcaccaacggtatgcgcagcaccagcttgtacctgcataaaccaatgggatttgaattccgtcttaccttcttctttaattctctgttcttgtgcagagacggctatactgccaaatagcaaagaaaacgctgctatccacaatttctttttattcatgctcatctcttttctttaaataagatatttattaaagaagggtaccctctcttatgaagatacccttctaaaactatttacaagttaatgttagttcaaatcagcgtatgagcctaatccttcaggagcagccaatgttccaaggaatcctgtagccggtacagtatacttagtatccgctttcttaacgtatacagtgatttcttgggtttgtgtagttgtctgttccggttgacccatccatgaattctttatcgttacatcgataataatcggctgatcaacatcaccaaccaatacaccttcatcgttgttccatttcagcaagccaacttctttaccatctgtcgatttaagtattgaagcatgtctctgtacaatagcatcattcttatccgaaagtttataagaaacttctactttatgcatcttgaacaggcctttaccaatctcaacctcatttctttcgaaccaaggctcttcttgacttccatcaaacatcataccattcgtttcacctctctttatatcatacaatttaacgaagcggtagataggcagataagcaccttccttcaggacagtagtattagctttgtcaaccaaataccaagctgccgctgcatttacctgagcataaactacaggattaacgaacatgatgtcaaattcactagtcttagtagctgatacaatgttattgatcttacgattatttttcgctgcatctttcgtttcaatatactcaacggcacggacacgaatctttttgcccatccatttcttatcaaagatattcagtacgtgcttattagtagcaatatctgttgtaagagtcatctcgcttgcaggagctgtagttactaactcgaagtcccattgaccacaaccatcccatgaatccatgaatccatcttcgatagtagctttcatcaagaacggtgcgccatagtctcctgaagtcggttgaccataaccaagcatatactctgttccttcccacattgacgggttataagtccatgtatgtacaggatctttcactaccaatgtagcagtaatagtgaatgctttgtatgtaggtgcagtattcgttgtagaataagtaaacttaatcacataagtaccggcacgcaactggttcttcaatccgaagtatacattgttattgtcagtaatggcagatccttcgatgttagaataatcgattgtcaaattcttacctgcttcttcagaatcaaagctccagccatcaaatttaacgccatccttcgttacttccacagtcggattacctccaccataatattctacgaatttagctttgcttacttgtaatgcattaaagtattggtcgaagtctatcttaagaccttccacaacagtagcagtctgatatgcagtagctgctgccaacttcgcaccgccaccatacaaagctgtacaagccaacgtctgttctttcaaatctgtattaacaaagtctttagtctgttgctcttgttctacaaactcaatcttcatcaacttactcataacaaatttgccatctacatacatctttactttcaaaacagcctggcgcccgatagaagcagattgtttgtcgattacagaaattttgctaccatccaatttcagataacgttttgtctgatcaacttcagcatccatataactcactgcctcatattggaatgttacgttttcaaaaccaagatcagtcaatacatattgactttcatctgcgtcaaagcctgtgttagtatggaattctgttgccaaacctgtgagcaatggttccaaatccaaaggatcagcagtatacaaaaatttcaaattaacaggaagacttgctaaataatcgtttaccttagtttctgccttcttgtacatatcagacaacaaaggaagagccggagcttttactgtaggatcagcatatttatctgcatcaacagcaaaaccaatagtagtttcctcttgttcaaccaccatacgttttgtagcaacataatcagatactacattgatatttgcagtctcaccaagttgttcattcgtattcttaaccatgtaggcaagcatattcactttaccagcctcaccgtatttagtagattctttcatcggtttgccatctggattatcataagcagtaccctgttcagaatcatctttatacattttgaacgcatttgggttattggcgttatcaccagcagaggcctttactatcaatctgccacggtctgtagtagttactactttagccaaaggtaacccaacttcagtagctctggtagttgttgtagctgtttgttcaacaaacgatattccagtataatattgaggatttacattagcaggattcaatttatattcatattccgcccatccattaaccaaagtacgatataatggttgattactactattatactcatacacagccgtattcttcgagttgttatcatatgcaataactggcaagaatacaacatctcctaaatccttattgatatttgaaggtacatgtactaaagaagaaacaaaagtagcagagtatttataaactgtagcagaagttgcttcaccagcttcattcttcagattactgaagatatagtagtcacccatatcagcaacagaaacaactcctgggacaatccaagtcttatcagtcttgttttccggcttcacttcattcttgtaccagaatccgtcttcacccggaatataggtatcaccgtctttacctggagtacccggctcgcccggagtgcccggttctcctttatcacctttagccttgaactctgttttcttaccatcttgataccagtatccgtcttcaccaatcgtccactgagtaccatcttttccggcatcaccatttttaatggtaaagctcttaccgttgctcaatgttacttccacaccaccggtaatgttctcaacttttgtgatcacagatcccccttcgatcagcttgttgatttccgcaatagcgttggcattttcggttatcttctgctctaaccgatcgatatcgtcatcgtagtccttacaacctacatatgaaaatgtggttagcgccaatgctccgaaaaacatcactctaataaattttttcttcataactacttaaaaattacattaataatatattattaaacactaagttcaaataatattcgcccgttactttgtaggtaacgggaaacagcctgtagctacttctgaagaagcgtctaaagggtagacaagaaacataagtatcaaaatatatttaacccctgctttagaatagcagcagaggggagggaaatcttttgcaataataagagagcatggtgtgttcttcacaaaaaatccgcagttttgtttggtgtatttcctttttttagtagtttatcagaaaaaatatcttttttgtttgcatgttttccaaaatatgttcatctttgcagcgtattatctccccgttacctacaaagtaacaggctttaattcaaacaattacctaccgagaaagacttcctaaaggaagagaagaccattacattcgcttcatcaattttcttattcttgaaaggtttcagataagtctctgtgacagtgatagatgaatgtcccatcgcttctgaaatgacaccggggtgcacctcacaataataagccatcgtagcccatgtgtgacgcgctgtatatgaactcagatccgtagtcagtcccagcacttgtttcagaatcatcagctgataattaaagttgcgcaatgccaactggtattccttatatgcctcctccgttccttccttgctggaaatcaacgaaaagagataaggaaaagcaggatcggtattcatatgctgtttgatcaatttcaccgcttccggcaaaagagtcacagtcagcattctgcctgttttcctccgacgataagtaaggacatttccgtctatatcatgttttttcagataagcaagatcgacgaaaggcataccacgcagcaaaaacattaatatgaaaaaaccacgagcacgctgcaattccctgtttcccgagtgcagctgtttcggaatatctttcataagacgttccatatcctctttttccaatgcacgctttttatcagcacgtgtccccgtatagacataccggaaatgatgcggtacataaggtgcaatgcgtcggtctactgctcgattgtacacagctctcagcgtacgcatataagtagaaaccgtattccagctacaatttcttccacgcagatacgcttcaaaacttttcaaaaactccggagtcacttttcggaaaggcagattcccgctttcattgaatgcaaggattgcactcatgctactcctgtaaatatgggcggtcccataattcccactttcccgtagcccgtcggctaccttcttcataaatgaaattaaattccccattttttactgtttaaaatgatcaataaaggctgctgcaaaagagaagtgaacccttctccacattccccggcagtgccttttttcctattcccaatcataaagatacaaatctattgccacatttgtttgatgtaaccccaaaaacattcgataccagctcacagccgatcattttctccaaaacatttggctatctgataaataattcgttactttgcaccgctttcgcgcaatcgctgtcaagagaagagatacttggtatgttgcgttgtaacgataaaacaatttaataatagcaacaatggatttaattaaaattgcagaagaagcatttgctaccggtaaacagcacccgagcttcaaagcaggagacactgtaacagtagcatatcgtatcatcgagggtaacaaagaacgtgtacagttgtaccgtggtgttgttatcaaaatcgccggtcacggagacaagaaacgttttactgtacgtaaaatgtcaggtactgtaggtgtagaaagaattttcccaatcgaatcaccggctatcgatagcatcgaagtgaacaaggtaggtaaagttcgtcgcgctaaattgtattacctgcgcgctcttactggtaagaaagctagaatcaaagaaaaaagagttaacaactaagctgaactctgagattcgaaataaaaaagaggaagttccggtaacgggatttcctcttttttatttcaagtctttctcttccatacttttgtcataacgagcgtttgaacatagtgacaccatcctactggtatagtgttaccatacctaccggatactgacagtatgtgatcaggatagtgtcatcatcgcaaaagtctatattgttcgattggcaacaatagagaaagcggaattcaatgtcccatttttaagatttacattattaataaacagagaaaaatctgtgtttcagacaaattattgcataaaatcacctataaatatgcaatatacaactgtttttctgcataaaaccaaagcaatatgcaagttttcaaaggattaaaaagtggttttggttttaaaggaacgaggcgttggttttaaaggaacggaagcttcctttaaaaccaagttcatcttacttgctatacattgcaattttatctatttccaagggattttatttctatttcatctcatatccccaacagtctacaaatatcatatcatccaacaaacaattacatcaccgaacaaaaagacaaaagatcatcgacaaaacgaacaaaacaatagtcaaacagaattttcacaaacatatcaagaatcctaaaaacaaaatctatcgcgtattcatagagttattggagttgaagaagttttattgaaatcctaaatgcataaaatgtcctgataataattttccaacctttgctttctgaaatgatcactctttcataatttcatctatctcctgctgaatttcatccaatttgcgctgcatcatgtgatactgtttatatccctccctaaatgaaaaaataagactaacacaaaaaattataatattgctatttcctgccaattgcagttcaataaagagccaacacaaaagtataataataaatggaatactaaatttacgccaaatggaataacgggattttatttccatcaactttcgagctaccaccagtaaatcctcactcattaaatcatttgttcgtaatcgtttatgcgtaaaatagccgtgcataactgctataaacaggaacaaacaaaacacactacaaaaccaccatgatattcccaaataaggacatgcccaaatataaaacggaataagtaataatgccaatgaattcataatccctacataccgattcattcccgacaccttatttttaataaccttacgtaacaacttctcattaacaacgacctccgcatccaacttgctgttaagaatagctatctgttctttcatttgtttaagttcaatcgtatctatatattcttccatacccatatattttctagttgttagacattttttttaattcttctttaattctaaataagcgaacggaaacattcttcacagaaattcctacaatagctgcaatttcctcataactgaaattctcaagccataatagcactatcgccctatcgaaatgtttcaggcgactaattctgttatacaacatctttatctgtgttgtatcttcgtccctatcttcaaacagatcaatccccataatcagaggtacagaaacaatcttctttttcctgtctgatgaaatgcaagtattgagacttacacgccatatccatgttcctatattactttctcctttgaatgtatcgaaacctttccaaagattaactaacacgtcctgaaaaagatcgttcacttcccgggagtctttagagaacataaaacatacagtgtaaattgtatttttatattgcttcacaacttgctcaaactctatttccaattttttcatcttattttgattaatcgtctatacattagacgcaatataacgcaaaaaactacagaatatccagttttatttcctgtagatacaacttttgagaaacaacacatacaaaaaatccccggaaactcaacgcccccggggatccaattacctttattattaaaaaaatgatattattctttcagatctttcaattcccaagccaaagcactggcacccagtacagcagcatcagaatctttcagttcggaaacaagcaatttagtcttgcctttgtagatattcaggatattgtcatcgattgctttctgaatcggcttcataatataatcacccgacttagccaaaccaccgaacaatacaattgcttcagggctggagaatgcaatagcgtctgccaaagcctcacctaaaatattacctgtaaattcgaagatttcctgtgccagtttatcaccttgtacagctgcatcatatacatcttttgaagtgatgttttcagcaggaatattacgaagcaagcttgcatcagtacgagcagccaggaattcacgagcagtacgagctacaccggtagccgaacagtaagtttccagacaacctttacgaccgcaaccacaaacacgaccgtcacgacgtgcaattacgtggcccaattctccggcaaaaccgtcatggccataaaccatctgaccgttgataacgataccgctacctacacctgtacccagagtgatcataataaaatctttcataccacgggcagcgccgtaagtcatttcaccgatagcagcagcattagcatcattggtcaaagcagtaggaatacccagtctttcttcaaacatagcagccaacggaagaattcctttccaaggcaagttcggagcaaattcaatagttccggtataatagttaccattaggagcaccgacaccgatacctctgatcttatctacaccaccattagcaatgatcaacggaagcaagtttttgcatacttcgtcagcatattctgcagcagtcggatagccggctgttttaatcgagctactggcaataatagttccgcgtgcgtctacaatcccaaagacggtgtttgttccgcctatgtcaatacctactacgtagggtttctccatgtttgaattcatgatactttatttaaaagggttagttaattataaagtttactgcacacaaattacgtaaagaagattgagtctacaaaatgttttttcaaaaaagttcactctgtttgcaacttttcgtatctttcatgcgtctaatagtgaaaaataaaaagaaaaaagaaacttaataagggaaattgtgataaaactaacagacattaacaagacctacaacaacggagcacctctccatgtactcaagggcatcaatctcgacattcagcgaggtgagttcgtttccatcatgggagcttcgggttcaggcaaatctactttactaaacatattaggaatactcgataactacgatacgggggattattatctgaacaacgtacttatcaaagacttgagcgaaacgaaagccgccgagtatcgaaaccgtatgatcggatttatcttccagtcattcaacctgatatcattcaaggacgccgtagaaaacgtggcactgcccctgttttatcaaggtgtaagccgcaaaaagcgaaatgcactcgctctggaatatctcgaccggctgggactaaaggagtgggcacaccacatgccaaatgagatgagtggcggtcagaaacaacgtgtagccatcgcccgcgcattaatcacccagccgcagatcatccttgccgacgaaccgacaggtgctctggacagcaaaacttccgtagaagtaatgcagatattgaaagacttgcatcgaatgggaatgaccatcgtcgtcgtaacccacgaaagcggtgttgccaaccaaacggacaagatcatccatatcaaagatggtattatcgaacggattgaagagaacctcgaccacgacgcctctccattcggccaaaacggaattatgaaataagtaataggtaataagtattaagtattaattccatgcggtcacagcgcagcctaatacttaatacctattacttattacctattacttattacctattacttataacttattacttaaaatatgattgatatttggcaagaaatatatagtaccatcaaacgcaataagttgaggacttttctcaccggatttgccgtcgcatggggaatatttatgctcatcgtcctgctgggtgccggcaacgggctgattcacgcattcgaacagtcggcttcggaacgggccatgaactccatcaaaatttttccgggatggaccagtaaatcatacgacggtctgaaggaaggaaggcggatacgactggataacaaagacttgaatacgaccaataaaaattttccggatcatgtcatcaaggccggagcaaccgtatatcagggaggtgtgaaccttagcttcggaccggaatatgtcaacctgaatctttccggagtatatcccaaccatacggaagtggaagtagtaaagcttttcaagggacgtttcattaacgaaatcgacattaaagaacgacggaaagtaattgtactccacaaaaagactgccgaaatcctgttcgacaaaacacatactgaccccatcggacaattcgtgaatgcgggcaatgttgtctatcaggtagtaggactgtacaatgacaaaggtgacagcggagacagcgatgcttatcttccgttcacaaccctgcaaacgatttataataaaggagacaagctgaataacctcatcatgaccaccaagaatttggaaacaatagaatctaacgaggaattcgaagcccactaccgtaaagtgatcggcgccaaccagcgttttgacccgaccgatcatagcgccatctggatatggaaccgtttcaccaattatctgcagcaacagcaaggatcggcgatgcttcgtattgccatttgggtgattggcattttcaccttattaagcggaattgtcggagtttcgaacattatgctgattaccgttaaagagcgtacccgagaatttggcatccgcaaagcgctcggagccaaaccactttctatcctttggctgattatcgtagagagcgtcacgattaccaccatattcggatatataggtatggttgcaggtattggagccactgaatggatgaacaatgccttcggcaaccagactatggacaacggtatatggtccgaaacggtattcctgaatccaacggtcgacataggaatcgccatccaagctacactcacattagtaatagccggaacattagccggattgttccctgcccgcaaagcagtcagcatccgaccgatcgaagcacttagagccgattaaagattatgagaatagacatagatacttgtgaggaaatcctcatcaccatcacaagaaataaaacgagaagcctgctaacggcattcggcgtattctggggaatcttcatgctcgtggcgcttatcggcggcggacagggattgcaggatatgatgcaaaagaactttgagggatttgccaccaactccggcttccttgccgcccaaaaaacgggagaagcctacaaaggatttcgtaaaggacgctggtgggatctggaagccatcgacatcgaacgcctccgctcgcaggtaaaggatgtggaagtcatcaccccttccgttgcccgttggggatccaacgctatttatggagacaaggaatacgattgtagtgtgaaaggattatatcccgactatctccatatcgaatcacaagaaatggcatacgggcgttttatcaacgacgtagatatccgtgaagcgcgtaaggtctgcgttattggcaagcgtgtttacgaaagcctgttcaaaccgggagaagacccgtgtggcaaatatgtacgggtagacggcatctactatcaagtcatcggcatgtcttcttccgaaggagatatgaacatacagggccgtgcctccgaggctgttacccttccattcaccaccatgcagcagacttataatctgggcggacaaattgatgtaatctgcttcaccgtcaaacggggcgtaaaggtttccgatgtacaaccccaaatggaagaaatcatcaaggcagcacactatattgctcctaatgacaagcaggcgcttatgtatctgaacgctgaggctatgttttccatggtagacaacttattcaccggtatccatattctgatctggatggtaggtttgggtaccttgctggcaggcgccattggtgtatcgaatatcatgatggtgacagtgaaagaacgcactacagaaatcggcatacgccgtgccatcggtgcacgccccaaagacatcctgcagcaaatcttatctgaaagcatggtcttgacaaccatcgccggcatgttcggaatttctttcgctgtcatggtgctgcaactggttgagatgggagcgaactccaacggaggagatgctcatttccaggtcagcttcggattagcagtcggaacctgtgccctgctgatcgcattaggtatgttggcaggactggcacctgcttaccgtgcgatggctatcaaaccgattgaagcgatcagagatgagtagaagtggaaagttgagagttaaatgaagaattaaaaattaaacatatatattcaagatgaaaaagtatctgaaaatcacattattggtaattattgccataatccttgtcggaacgttcgtatttctttatcagaaatccaagcctaaagtgatcgtatatgaaacactggcagcagaagtcacggaccttgaaaagactacagtagccaccggaaaggtagagccgagagatgaaattttaatcaagcctcagatttccggtattgtagacgaggtattcaaagaagcgggacagagcgtaaaaaaaggggaagtgatcgcgaaagtcaaagtaattcccgaactcggacaactgaactccgcagaaagtcgtgtccgcctggcagagatcaatgcaaagcaggccgaaacagactttacccgtatcaagaagttatatgaagatcagcttatcagtcgtgaagattacgaaaaaggagaagtagcggtaaagcaggcacgggaagagaatcagactgccaaagataatctggaaattataaaagaaggaatcactaaaaacagtgcttcattcagtagcaccatgatccgctctactattgacggattaattctggacgtaccagtgaaagccggtaactccgtaatcatgagtaatacattcaacgacggtactaccattgctacggtagcaaacatgaacgatctgattttcaggggaaatattgacgaaaccgaagtgggtcgcatccatgagggaatgccgattaaactgacgatcggagctttacagaatctgacttttgatgctattctcgaatatatttcaccgaaaggagtagaaaccaacggagccaatcaatttgaaatcaaagctgctatcacagttccggataccgtgcagattcgttccggctattccgccaatgcagagattgtgctccagcgtgccagcaaagtactggcagtacccgaaagtacgattgagttcagcggtgactctacgtttgtatatatcatgacggactccgtaccacaacagaaattcgaacgtacacaagtgactaccggaatgagtgacggtatcaagattgagataaaaaaaggtgtaaccgctcagaccaagttacgcggtgctgagaaaaaagataaataactgacatccaatgaaagtaatcaataaaatgatggcaatcatcctgttgagcggaaccggtatcggttctgttcaagcacaggataccactccgcagacatggactttacggcaatgcatcgactatgccatcgagcataacatcgacatccgccagacagccaatgaagccgaacaaaataagattagtgtaaacaccgctaaatgggcacgtctgccgaacttaaatggtggtatcagccaggggtggagctggggacgtacagcttctccgaaagataattcatatagtgatactaacagttccagtacgggagtgaacttaagtactaatgtacctctcttcacaggcttacaattatccaatcaatattcccttgccaagctcaatttacaggctgctatcgaggacctgaataaagccaaagaggatattgcaatcaatgttacctctgcctatctgcaagtgcttttcaatctggaattgaacaaggtagcacaaaatcaggttgagttaagcaaagatcagctgaaacgtatcaaaggactgcatgatgtcggcaaggcttcaccggcggaggtagctgaagcgcaggcacgtgtagcacaggatgagatgacagccgtacaggcagacaatacatataaattgtcattattaagtctcagccagttattagaactgcctacaccggaaggtttcgttcttgagaatccaaaagaagaactgaaatttgaacctctaacagctccggatgacatttatatccaggcgattgcctataagcccggcatcaaggcagcagaatatcgcttacaaggtagtttaaaaaacattcgtatcgctcaaagtgaattctacccccaactttctttcagtgcagggctaggaagcagctactatacactcaacggtgaagcagaatccggttttgcccgtcaattaaaaaataacctgagcaaatctatttctttcaacctgagcgttccgatcttcaaccgttttagcactcgtaatcgggtacgcactgcccgcctacaacagtcaaaccttgctttgcagctggataacgccaagaaagtactttataaagaaatccagcaagcctggtataatgcagtagctgcagaaagtaaatatacctccagcgaagttgcagtgaaagccaacgaagaatcttttcggttgatgagcgaaaaattcaataacggtaaagctacttttgtggaatacaatgaagcgaaactaaacctgaccaaagcactgtcggataaactgcaagctaaatacgattatctattccgtactaaaatactggatttctacaaaggagaaatcatagaatagaacagatttccagctatttatcaaaatccttaaaaatagaatacatcggaaacgtattctatttttaaggatttactcatgttttcaaacttccccaaaagcacttgttatttatgtaagagatttctaaaacatatccaccggttcatccgttactatagaaagaaccaacagttatgaaacatataatcatcgcagtgattctaacaattagtaatgtatttttaggaattgcaaaaccaatgaaaagtcaagcggaaatttattttgcaggaggatgtttttggggaaccgaacacttcctgaaacaaatcagaggagtagaaagtactcaggtgggatacgccaacagcaccgttgccaatcccagttatgaacaggtgtgttcgggcaagacaaatgctgccgaaacagtgaaggttgtttatgatccggaagaagtaaatctgagtttattgctcaacctctattttcagacaatcgatccgaccagcctcaaccgacaggggaacgatcgtggtacacagtacagaaccggtatatattatatcaataaagccgatctctccaccatcaatcaggcgatccaggcattagccactcaatacaacaaaccgattgccgttgaagtggaaccgttgacaaacttttatccggcagaagtctatcatcaggattatctggataagaatccgggcggatattgccatatcaatctggctttatttgaaatggcacgaaaagcgaatgctcccaagcccccaacttttcaaaaaccggacgatgccactctccgtaagaaattatctgccgaacagtatgcagtgactcagaaaaatgccacagagccggctttccataatgagttctggaatgaacaccgccccggcatttatgtagatatcactaccggagaaccgttgtttgtttccacagacaaatttgattccggttgtggatggcccagtttttccaaacctattcagaaagagctgatcgcagagaagaaagatactactcacggaatgatacggacagaagtacgcagcaagacaggagatgcgcatttaggacatgtatttacagacgggccaaaggacaaaggcggattgcggtattgtatcaatagtgcttcgctgcgttttatcccgaaagaaaaaatgaaagaagaaggatatggagaatatctgccgctcattaaatagaacaacctagtaaacagcaccggtttcagacagatacaataaaaacggcggattccctcgtttgggtaatccaccgttttcgtttgttaaaaccttaagagagaaagagaatttcacaatccccggtattgttatcttccggcaagtagcaagtctgcttcatctgtcaccggagtctgtatattcatagcccagttgccggctgattcttcaatccatttatagtcattccacttgtagttcatatacgcgatcggcatattagcatcattcagttcataaacactcttttctacagaatcatcataagctctgtgagaattattccaacgtgcatataccaatgtgatttcattagaagaataagcataatcgatcttgaaatacggaatccatttttcagtggatgaatcccacttgaaagcttctttagctgttactctcttttgatcatcataagtaaaatcatatttcatgtgacgatagagagaaccatccagtctgtaaatcaccttcgaaacaacaagatcatctactttctcttcattagtaatgaagttattgtcctgtgctttcaactctgtattggcgataccggcaactaccattgccactaaaaccatcattctgaataatactgtagttttcataattgtatattttttattagttcaactttctttttttgttcttctgtttattagacggaacgtctatatggaatggttgcaactatctgaacttttttttcatttcttttgttgcccgccttcgaatatataaatgcaatgggcatgccaaaaagataaatacttaatagtcagcgcaaagaagaaaaattgagatgtacgaaaatgaacagttgtacgctcataatcggacacactaataaaaaaagactgcttatatcttgttgaacagaatattatctacctttgcagccaataacttattaaaggcaaaagatgaaaaagaacagcaaaaaaagtattcttcttctatcaatcggaggaggcttgtttatctgccttatcagtatctatttgagccgcaatatgcttctgcaaagcataactaacaagcgtacgactcatatcgaacaaacatacggactgcaaattcattatcagaatctacaaatgaagggatgtagcgaaattaccctgcaagggctttccatcgttcccaaccaacgggatacccttcttacactacaatctgtcaatgtcagactgaatttttggaaactgctgaaaggaaatattgaagtccgcaacgtccacatgaatggactggcaatcgcttttatcaaacgggacagtgcagccaactatgattttctattctccggacaccacccagaagcaaccacagagccggtcatagaaaccaattacgcccatcgcatcaaccgaatattaaacttaatatatggtttcttccccgaaaacggtcaactgactcaacttaatataaccgaacgaaaagacagcaatttcgtaacagtcaatatccccacctttacaatcgaaaacaatcgctttcagtccactatcaaaataaaagaagatacactgactcaacaatggaaagtagcaggagaactgaacagaaaggtacataccctgcaggcagaactttttgccacagagcaaaagaaagtttcactaccgtatatcaaccgccgttttggagcagaagttactttcgataccttatattatagtatgactaaagaaaatcgtaccgaaaaccaactgcaacttgacggtacggcgaaagtaaacggacttgatgtatttcacaaagcactctctcccgaagtgatccatctggatcgcggacaactcacgtatcagatgaatatcggcaagcaaacgctggaactggacagtacgacgacggtattattcaaccaaataaaatttcatccttatctgcgggcagaaaagaatgaaaatcaatggcacttcactgctgccacagataaatcatggtttccggccgacgaactattcagttctttgcccaaaggcttattcagcaatctggaaggtataaaaacaagtggtgagctggcttatcattttctgttagatatagattttgcccgactagacagccttaagtttgagtccgaattgaaagaaaaagattttcggataatagaatatggtgcaacatctctttcaaaaatgagtgaagagtttatctataccgcctatgaaaacggaataccggtcaaaacatttcctgtcggaccttcatgggaacattttactcctttggacagcatttctccattgctgcgaatgtctgtcatgcaaagtgaggacggagcttttttctaccacaagggctttttgcctgatgcaatgcgtgaagctttgatttatgacctgcaagtcgaacgtttcgccagaggaggcagcacaattaccatgcagctggtaaaaaacgtatttctcaaccggaacaagaactttgcccgcaaattggaagaagcgctcatcgtatggctgatagagacagaaaggctgacttctaaagaacgtatgtatgaagtttatctgaacatagccgaatggggaccgctggtttatggtattcaggaagcctctgcctattatttcggcaaacgcccttcgcaactcacgaccgaagaaagtatttttctagcttctattatcccgaagcctaaacacttccgcagttcctttgcggaaaacggacggttaaaagagaatatggaaggctattataagctgattgccggacgcctcgccaagaaagggttaataagtgaaatcgaggcggatagtatccgccccgatatccaagttacgggcgacgccctgaatagtctagtcggcgaaacgccggagtccagttctcctaccgctgaggagcaataatttattaataaaggaataggttttatcttcttgagctgctttctctttctgaagaacgggaagaagaacctcggttgctgttgcttctcgaactttctgaagatgagcttctttctgttgatctgccggatacgttccctctgctggaactactgccggaattgctgttcctaccggagctgctgccacggtttgtgctcgtaccactacttgtcggacggcgactggaattcgaagaccctgaattcgtttccggacgacgattagaattcggagtacttgtactcgttcccggacgacttcctgaatgacgatctccttcacctctgttgtggcctctgcccggagttacttccttattcggtttatcatttctgcccggagtggacggtctgcttggaatagacggtcgttcattgaccgaaggtctttcagagttggaaggtcttccggaagtggacggcctgcccgatgtagatggtctgcctgaagtggacggtctatggtccgtttcaggacgaggacgggaagtatttcccggacgtcccgatgtattaggccgtgacgttgttcccggacgtcccgaagtccccggtcgggtaggtgcattatgcggacgaacagaagtgttcggacggaaacgtacagaaccgaagtctgaacgacgataagaatggaatacccgctgatctcttacccgatatggcgtaggatagtgcacaagattattatatcttccccgataataactcacatgatgaatatgcggacgataatgtgcaccacagtaagtccgataatgataaggtacaccaaaatagaataaactacgattcggataattgatataaatccggaaattccatcttcccccggtgacataaatcggacgatagaaatactcagctcccaagaatctgcggtattgcacatcgctcaacacccaacgaagatcatcgttgcgaatatccagcgcttcatagtaatcatccaatgcccactcatcaccccgtactacataatccataatattacgaagcgaataaatgaaatcatagttaatctcatacacgtcattatattggggattattcaggtccagttcgtatgccatcttatcagtaaggaaacgtgtctccttacgtaccttgctggtactcattcccgccattacagtggtactggcagtcacgactaacaatataaatagaattcttttcatggtttcattcttttttagttacgtccgctatcgtaagattccgcaaactccctcatctctcttttgtccatctcaaaagtgaaaacatccgtcagtatggagaagttcttcttatctgcgattttcggataaagtttctttatcatattctttttatctgtctgaaaagtacacatatccaccaatttacggcattgggcacaagtgaatcccgaaggaggtacaacttcatccagcatcctggtacggtcagactcaaaagatttacctctatattcattgaagaaacggtcaaaatcggctgaactcatagctctgggccgtacatatcctacgtctcccggtcgttggtcaccgtggtaagcctggatatattccttcatcttgtcacggtcaaaagacgaaaagagcttattgacgaccgaagcaaaattttctttatccacaatttgcggatacatacgtttcatcacagtcatctgggcatccgaaccacttatctgatcaatgatctttccgcattgggcagaagtaaaattgcaatccaacaaaacgtcatctatatatttaatctgctcatcagacatgatcaccatccggaaatcactaagaaaacgatcaaactcatcacgcatcataagtgttctgcgacggggactttcttcatagcgtggcggacgaaccggatccgtattggttacaacaacggaaggagacatcacaaccggaggcggcggaagaagtatttcatcaccattaaaggtatccatacccgtaactcttccatctgcaaaatatacaataatcttgatcgagttgccgtaaagcactgaagaaatccggtggtactcccattcctcgccacctccgtcaaaacgtctgtaatccggtttacccaagattttttctacattctgccgggacattccctgctgaacctccatcacttgcttgttggatacgtaataagtagaacagctaccgagtattacccacaacgtgaaaaacaggattatatgtatatttttcataaccgtatcgtttttagtgaactaatgtatgatcagcgtccttcgtattccttgatgaaatcgttcattttggtcttgttactggagaatgtaagagtaccgatcactgtaaagaaagcctctttatctacaatattgggatacatcattttcataatcttcagccgttcattatcaaaggtatagaatttcaccagttgaagacactgctccgatgtaaaatcagagttcgccaatgcagttgtaatcaaccccatacgatctttttcaaaaggctcattcttcacactatcaaagaacttcttgaaaagttggtcattcatcactctatcgtagcggttatagtccggacggtgtccaccctgaccggttcccggtcttccgggtctgcccggacggatatctccacgttcttctacaatgatatcttttacttcgtttccgttaaagtaaacgcggtcattatacaaccgttctcctttccatacacgttctcccgggcgagtcgggcgggaagcgtacacttcaatggtataatttcccggtttcagattggcaacgaaacaagtagtagtaggataacacatctgccttccgccaaaataaacaagaatcggagtatctccgccatcaatccggattccgctgacaggctgcgcttttaaagaaagggcagcgagcaaaatacagaaacttattattatcttacgcatagcttatctgtttttaaaattattatctttaactgatatcacaaaaatagggtgagaaaactccccaccccaatgattctctctattcctgcatagggatttccctattctgtttaggattctgccaaagtgatgccggtctcatgcaaagaaatcaatcgtttcttatacaagtcacctacacctttcttaaaagttttcttgctgacaccaaaggtatcgtaaatatcttccgcaggacttttatcgttcagattgatccgtccgccatgttcccgaatatactccaacagtgtcttcgagaaatcatcgactttctcaaatcccggtttctgaagtatcaggtccaccttaccatcttcgcgtacctgtttcacaaacgccttcatctgcataccggtctccaatgcacggaatatttcattttcatacagcaatccgctatacttattgtctataatcgctttgaaacccaagtccgtcttctgccagatcagaatatccacttccgcacccggagcataatcgggcatatctttcgacaggtaacgttctaccttcgccgaagctacaatacgataactttcctcatccacatgagcatggaccacgtaggatcttcccacctgcattttcatcttctgctcactgaaaggtacaaataagtctttcatcaatccccagttgaggaatgccccgaactggttcacccaagagacttcgagacaggcgaactgccctacctgcaccaacggagtcagtgtcgtggcaatcagtctttcgtcaatatccagataaagaaatacattcaacatatcccctaccttacagtcttcgggtacataacgggtgggcagcaggatttcaccttcatctcctccgtcgagatacaaaccgaaatcgacttcctttaccacttcgagttggttgaattttcctaattcgatactcatacttttatctatttattatataacgaacaaagataagaaataaaaacgagactaaaagcagagctcagaaagaaggttgtaaaagagcgatttatgcgataatcagagaaaagtggagtcaggcattttcgttgaaggggctaaggttgttccgaactcttaacgaacaaacatgaccaagctgcaagcggttctgataaaaatcgtactgtcgtactctatccaaagagtattttaccagaaatcttatatgttctaagccttgcacaacctttgccctgcaacgtaaactaccgcctcataaagacacacataattctgtaaaaacaagcatcctgtgaaacgaattggcatatcatggttgttattttgcgaacataacagtctgcgatatatcttatcgatttatttcttgattcaaatagtttttgtaattttgtaaatgaactaaagaaacagcaaaaaagaaatagattatttaaagacatatagcataacttgcggactattatttgattcggttaaatctggtaaattaaacaaggaatctaaaatattggtcgaagcaggtttgtaccctctaagggcgcagactgttttacctattttgattccgggcttaccagagcctaaccgaaaaatagagaaaagatagtgttgcgtccttttttctttttaggcaaccggaacatcgataatccgataaatatcggttaattaaattaatcaactatgacaaaacaaattaaagtaattctgaaaatagttagaaatggaaatggagtagtaattactccggaaatggaaattatacgaaaggtgattttttatgttgaattattaaagtaggatattatgaaaacatttatatcgtggattattgccaattttgaaggagttatattttgcattattttttcgataatagctatatttctatttagtaatccaccaataaaagacgatggaacaataatctcacacaaagggctacttgagcttctaatactatctgcagtttttattggaggattaaccttacaaacgaaaaatgctggtgtaggaataataaaatatttgctgatagtagcctttctcatttggagacctggcttagatgattcactaatacaaaatttcctaagttggactttcctctggatattatttattggaagtagtgtaattggacttatatctgcaatctacgcattcttaaactttgatgatgttgtttctctccgaatgctatatcgtaacagctgtgtatctttatttgaagcaaactggctatataccattgatcgatttgcaggtctttcactctcaatatttttaaatataggttggtttattatgatattaaaactatagcgtcatgaacaatattttagacaaatcattagattctcaatttgataaaattgaaaatcttacgtggttcccttgggtggggaaaggttataaatgtgctaaacgaaaactcttagtagttggtgaatctcactatctcaatgaagatagtgatgaaaataatgagaaaaggagagaattacttataagagataaagaacacactagaaattgcttatatgaggtattaattaataaatcttggtctagcaaaacatattccaatataatggaggccttgtgtgacaggggtattctatcagataacaaaacagcattatcggaaatcgcatactataatttcatccaaaggcaaatggattattcaaaagatagtaaagaacgtcccaatattgatgactataaaattgcttggaaatgttttctgcacattattgacatattacaacctacagactgcatttttgttggagttgagtcagtgactttatttgaagaaataatggataaatatggagttcagtatactggcattgatgtactggaaaaactcaatgacgcttatcctaagaaaacctcgattagattggactcaaaaaataatatcaatattatattcatcaaacattcttcttgctattttagtcccggcaagtggcatgatttcttgaaacaacaaataccggaagctatagaatggctaaatcgggtttagaaaatataattataactacggcatatccctttataaaagaggctgccgtagtttgggtacaaaactccattctctctgataattactcctgctgtcgtgagaaatgcggactgataaatgataagggagagtttattatacctccgatatatgacaatataaaatataacggaggagcaaatatagctgtcaatattggatttgaagagcatgaatcatatgaagagtctggaaaatggggcgtgatcgacttgaataataatattctgatcccactaaaatattcggaaatttatctgtgggagaatggtctgtatgctgtagaatttctaaaaaaatggggagttattgatatatccgaaaagataattattccattcgaatatgattggatttcgtggtcagatcaatatggatggattcaagctctccttcaagggaaatatgggagcattaccattgaaggagaaataatgatcccatttatatatgatgaaatgctatgctgtggagatgcccaattaattccggtaaaacacgggaatcaagcttattatatagataggaatggacatagagttctactatagtttaaaaataaatacaattactaatcttattttatggcaaaaggcttatttgacagatatatttggttgatagacacaatttatcgtgctggaaaaattacatttgaagaaattaataagcgctggttacgcaccgaaatgagtaacggagaagaaataccattacgaacattccataaccaccggaaagcgattgaaacaatgtttgatatcaatattgaatgtaacaaacgagctggttactattattacatagaaaatgccgatgatatcgataaagacaagataaaaaaatggttacttaacacctttgccataaataacttagctaacgaaagccatcgtcttaagcaaagaatcttgtttgaggatatcccctccggaaaacaatatttatcctcaattattgaagcaatgctggaaaaccggattattgagattacttatcagagttattggaaagaagaagctaatacatttacaattgaaccattctgtgtgaaagtgttcaaacaacgctggtatatcatagcccgcagtccttattatgatactataatgatttatgcgctcgatcgtattcagaacttacaagttacggatataacgtttaattatccatcagattttgatccacaaagttattttgagtttagtttcggtattgtcgtagatgaaatttgtaacattgataaaatccgaattaaagtatatggcaaaaaatgtcaatatattaaagctttgcccttgcatcactcgcaaagtgaagttgaaacgaccaaaagctattccatttttgagtatttattaaagccgacctatgatttttgccaagaactattatcgcatggtgatgaaatagaggtattgtctccaacatcactcaaagaacaaattaaagagattgtaaaaaacatgagtagatactataattgaatagtatttgcctattctatattcgtacaaagttgtttgatgaaatgcacagaagttcagcacaattacattgtcgccaaatcatttccagcaactttccatatctctacttggtggtgtcattcatattgatacaggaaagtttcttatcctctgcaaagataatctattttaggcacatccctttcatcagacaggtataacttttcgttatcaaacaaaactattttcgatgaacaatcggacgattaagtcgttatctttgtagcggtaataagcaagaacagattattcatctttaaacatatataattatggaatttttaaccaacgagaaacttacgattgtaggagcagccggaatgatcggctccaatatggctcaaacagctatgatgatgaaactcactccgaatatttgtctatatgatccttttgctcccgctctggaaggcgtggcagaagaattatatcactgcagtttcgaaggcgtgaatctgacttatacttccgatatcaaagaagcattgacaggagcctcttatatcgtatcttccggtggtgcagcccgcaaagcaggcatgacccgtgaagacttgttgaaaggaaatgctgaaattgccgctcagttcggtaaagatgtccgccaatactgtccgaatgtaaaacatatcgttgtcatctttaaccctgctgatatcacaggattgatcacactgctatattccggtctgaaaccatcccaggtttctacactggcagcactggacagcacccgtctgcagaatgaactggtgaaatatttccatattcccgcttccgacattcaaaactgccgtacgtatggcggacatggagaacagatggccgtattcgcctcaactaccaaagtaaaaggcgaaccgctgactgatttcatcggaactacccgtcttccgctgacagaatgggaagcattaaaagtacgtgtcatacagggtggcaaacatatcatcgatcttcgtggccgttcttctttccaaagcccggcttatctttctatcgaaatgatcgctgccgcaatgggtggacaaccgttccgctggcctgccggtacttatgtttccaatggtaagttcgaccacatcatgatggctatggaaacttccattacgaaagatggcgttacttacaaagaagtggccggatctccttccgaacaggaagaactggaaaagagctacgaacatctgtgcaaacttcgcgatgaagtgattgaaatggggatcatcccggcaatcaaagactggcattctctgaatcccaatattgactaaccagtatcattaatataataaacaccggaactcaacgatatttttccgttcgagttccggtgtttttcttttaccattactgcttgtctgcaattaatcctacacttttgagcactccgcacacactccctttactacataattcacactatgcaaagtgaatcctttcggtaagtcgataaccggaatatgaatcttttccaaacaaaatgtccgatggcatttctcgcaataaaaatgtgaatgcaagtctttcaggacacagttgcaggaatcatcgcaaacggcatacttccacgaaccgcttccgtcgtctatgctatgtatcagatgatgagacaaaaaaagcgtgattgtacgggatatagtcgatttatcaaccgtatccagcaacgtttcaagatcaagctgagacacggcacgccccgcttccatcatacttttcaatatgagaagtctgatagccgtcggcttgatgtctctttttgccaacttatccagataaactttttcttccatattcttttattttatcattttctgtatccttacggcattcatgatagcaatcagtgctacaccaacatcggcgaaaacagcttcccaaagtgtagccagtccaccggctcccaaaatcagtaccagcagtttcacaccaaacgccagtgaaatattctgccatacaatccttcgcgtcagttttcctacctttatcgcttcagccactttggaaggctggtcggtctgtatcaccacatcagccgtttcaatagccgcatcactgcctagtccgcccatggcaatacctacattacttaaagccagtaccggagcatcattcatgccgtcgcccacaaaggcaacctggttctccgtatgttggcgcaattcttccaaatgcttcactttcccatcggggagcagatcaccataggcttccgaaatacccagcttctctgcaaagttactaacaatactttgtttatcaccggataatatctgaatgttttgaattcccaatgctttcaggttctgaatggcgatctttgcatcctctttcagactgtcggataatagcagataaccggcatacttgtttcctatcgcacagacaacgatcgtatctgtaatggaaagaagttcgggcggatattctatctgaaattttgaaagcaaacgcccattacctgccaaaacctgaattccatttacggcagcttccagtccgagacctgcatactccttactgtcggttacagaggaaagctcgatatcccgctgtccggcataattcaccacagccttagcaatggggtgtgtactgctgctttctaccgaggctatcatccggattaattcttcttcggatacaccggattcacagttacaaaactgtacttcaaacgtacctttggtaagggttcccgtcttatcaaacacgactgtattaatcttcgtaacagcatccagataatttccacctttaaataaaattcccaaccgggaagctgccccgatgcctccgaagtatcctaacggaatactgaccaccaaagcgcacgggcatgaaatcacaagaaagaccaaagccctgtatagccagtcattaaaagtaaataagaactggggagtgatcaaggaataaataaacggcaataaaacaatcagaaccgccagccctatcacaatcggagtataaacacgggcaaatttacggataaacagttctgccggtgctttgcgttcggaggcattctgaacaagttccagaatacgggcaagagcacttttatcaaaaggtctgatcaccttgatacggattactttatcggtaacaatcattccggcaagtacttcctcacccatccggatacttcgggggacactctcgcctgtcaatgctgccgtattgaaagcagctacctcattgagcatcattccatccaaaggaactcttcctcctgtctttatttcaattgtttctcctacttttacgctttgaggattctcaataacgacacgttcatctctgactactgccgcttcttccggacggacatccagcagagctccgatattacgcttcgccttatcaacagccttctcctgaaacagttctccgacggagtaaaacaacatcaccgctactccctccggatattcaccgatataaaacgctccaagcgtagctacaaacatcagcgtaaactcactgaaatagtccttatccttcatactctcccaagcctctttcataacgggcaggccgaccggaagataagccacgacataccatatcagagagaaatatccttcacggaagaaaggtaactccagagcgttcatgatgattccacttatcaacaggataaatgaaagtcccactttccaatattcagcgaatattgattctttcttttcaatatgtttttcgggtgcacattcgtgtgtatgtgcgcaacaactacaatgtcccataatcattctttcttttttatctgctgcaaaggtagcgaatgattcgtgcaacaaagttgcaaaagaagacgccacagccaatctccaaataaatatcgttcaagggattggcatataaagaaagtttcctatttttgtatctaaacaaaaaaaatgggcacagccccacatatataaatgggaataagtaatataaaacaattatatagcaaatggaaatcgcttcagcctcttaagcctgaggacctgaaacgttggaatgataaattcaagttagagtttaattataactctaaccacttggaaggaaatacactgacatacggacaaacaaaactattattaatgttcggtgaaacttcgggtaatgccagcttgaaagattatgaagagatgaaagctcacaacgtaggactggaaatgataaagcaagaggcgcaggacaaagaacgtccgctgactgaaagttttattcgcgagttgaaccgtaccatccttgtgcaggactattggaagaacgccaaaacacccgacggacaagacatccgtatgcagataaaagtaggcgaatataaatcacgccccaattccgtactgaccgcaacaggagaagttttcagttatgcttcgcccgaagaaactccggcatttatgacgagcttggtagactggtacaacctggaagcagacaaaggaatactgactcctgttgaattggcggcgttgcttcattaccgttatatccgcattcatcccttcgaagatggcaacggacgcattgcccgtttattagtaaactttgtgctgcaccgttatggatatccgatgatcgttattcactccgaagataaatccaactatctgaacatcctccatcaatgtgatgtagaagcaggattaaccccttcagatggtgctaatgccactttgaatgatatattaccattcgtcaactatttgagcagttgcttgatacgcagtctgacactcgcaatcaaagccgccaagggagaaagcatagaggaagaaggtgatttcgataagaaaatagcgatgttacagcgtagatactcagataaagctatcgaaaaaagcagtcgttccgtagaacaggcaagaagtgctttttttgaattggccgtttatgtggagcaaaagatcagtggactccaaaagctatttgacagaacatttataaccaacactcccacttggaacatggctagaaaaataaatacacccaatcctgatgagccaattatccagtcacacattttatatactaagtcaaaagagtatagctttgtagaggatatcatacgtttatccaagaaatctcaggttgactactttaagctaaaatatgatgcagtaacttttcattttaatcattgccgatatgcaggcgataatacttttgatttcccattctgtatttatattcaatacttatcagatggatgtgaaataagctgtgacatcacatccgattctgtgaaactgtcttataatccggatgttttggctgaagaaggcaaagaatacatggatactgcttgcaacgaactactcaaactacttgaagaaaaaatgaatgataagtcaccagaaaactaaatcaataactcataatccaccacatccagccaacggccaaactttaatttttccttctcgaagcaggatacttgcttgaatccgattcagctatgccgccagcgaaacagtacaaaaagccatcggcacaacgacgctccacaaaataatggtcgtctatcgtggcatggagatagtcgtatgtgaagaaatccccgcttttcgttgagatttcagaataaacacttatctttgcatacacctttctccccgtcagcgtgacgtgaatgtaggagaaaggtgttttttataaatattggaatataaacgtattacttcttcgcacataaagttggcttacttttaaaatcaaggagaagtgatgcaacagatattccatgctaattgttatatagaatccctatatataaaattggcatggatgtctgttgtttatcactattcttgatagggtctagccaacacctatgtgtggatagtgaaacgacaacagcgtccgtgcctttcctttttttaccccaaccccacatcctttttttaaggagagtgcatggacgcccagtcgtttttagaagacaatcaaaacaacgaaagcgatatggatttagaagaaacactggcacttaaaagaaccaatcacgaaaagctcatccggaatatggataaagctatcaggaacgagatgctcaaatatgaagaagcagaattctacatccgcttgcagagcgaatgtttcaacctctacccgatagtcgttaaagcattggcactgcaaattatagataacaaaaggcgtagcatcttctgctccatcgtaaaaggacacaagctaaaacgtctggctgactttcacaagcaaacaccggaagaaatagcaatagaattccgttctatcgtatgcgaattgcgatgcaagattaataacggagcatttacagccaaagagtctgtcaatctccggctaaaaatggaacgggatatattagaacataaaatacgggattatgatgaattatgccaaaggttgcagttgaaaaacaaaatattgcacgaccaacttgacatgcttcgggataatcagaaaaggcattcgaaggacgaacaagaaataacacatgaaaaagaacaggaaataatacggaaaacaagaaaagcattgctggaagaattgcagcgaaagatggaaatacagatagaagaacaaaccaaaaacctgcatcacgaatctttcgtcatgcgctgtatgcaatggctgaaaaatgcccttaggcttccaaccgtctctcactagagttaataaaacactttgttattgtcacttgtcacttttaaaggataagctccttattattaaggcagtaatggtgataataggtggtgataataaggtgataatagaactttttctggtttctattatcacctgcttttaataagaaacaggattaacacgctgattaacaactataaaacagactattcagaagcattatctgcatgtgttaaaaactccattttcagcgtgaatatgcgttgtttatgccatatataacttaatgtatgccgcctgcattaagccatagcatagtaaccttaacaagctaacaaggtttgactaatatatttagtacgtttcatgtattcgtttcacgtgcgtggaccgttcggttcacgtacatgaacccaatagatcacgtacgtggactgatggacccatgtacgtgaaatgacttcttcttactgacagaatacattaatctaacctacataatagcctaatgaacggttctcctactattaatcccgggtggttatcttccccttgtacggataaatgtttgtgtatactataataaaagacaggagttgccttaagcaaacttaaagcaactcctgtcttaactatttaaaagtataactgattaaagttccagttctttccgatcattgcggataaattccagcaaccgttccaccgcctcttcttcgggtatgtttttctctacgcaaactttacctttataaaggctgatttttccgcgtccggcacctacatagccgtagtcggcatccgccatctcaccgggaccgttgacgatacatcccatgatgccgattttcaagcctttcagatgtgaggtagccgccttgatacgcgcaattgtcttttccagatcataaagcgtacgaccgcagcccggacaagaaatatattccgttttagaagtacgggtgcgtcctgcctgcaagataccgaaggcagtagcatctactaccgcatgactcagacttccttgattgaacaggaaaatcccgtcacataaaccgtcaaaaatcaatgctcccatatcaacggcggacttaatctgcaaatcttccgcctcgtcctccgcataatgctggaagaaaacaaccggattctccagaccttccgtcataagttgatgcaccaatgcacggtgctcgcccaggcgattcggatgattgctctgagaaataaccacaacttcgggatgcaccttaagacaggcaatcacttcatccgtttgcgccatgtaaggcataaacaggaatttcagttctgcactgcactcgcccatcaacggcaactgcgcatgattgaaagcaggccatgttccggcctccccttcccatacatcggcatcaaggatatattccactccttcttcccgctgttcgggcaacgttcttccggcatagatataatccggagtaaactgcggattgacttccgtcttcccatccatgcggtcggcaataacgacagggagatgttcgcccccgatattccgcactgcccgcgtcttgcggcgcgaaggagaaagataattaaattccggtgcctccatacccgggatatacggatgatcctgcctcaacagaacataatccaccagcttgcgcgctacgggaatttccgcttcgggagcctcactaagcgacacacgaatcgtatctcccaatccgtcacaaagcaatgcaccgatgcccaaggcagattttatacgtccgtcttctccgtctccggcctccgtcactccaagatgcaggggaaatgacattccctcctgttccatcacggcaacaagcaagcggacggtcttcaccatcaccaccgtattggaagccttgatcgaaatcaccacatccgtgaaatgttccgccacacagatacgcaggaattccatacaggattccaccatcccttcgggagtgtctccgtagcgggacatgatacggtcggacagggaaccgtgattgactccgatgcggatagccgtatgattctccttacagatattcagaaacggcacaaaacggtcgtgaatcttctgtatctcctgcgcatactcctcgtcggtatattccagtttcttaaaagtacgcgctgcatctacataattgcccggattgatccgtaccttttctgcatattgagctgctacatcggccactttcggattaaaatgcacatcagccaccaacggaaccatatatccctgacttcgtagcccgatattgatattcatcagattttccgcttccttgacaccctgcgtggtcagtcgtacatactcgccgccggcatcgacgatgcgtttggcttgttccacacaagcttctgtatccatagtggacgtgttcgtcatcgactggatacgaataggattggggccgcccaaaggtacagccccaatatttacttcggatgtttctcttcgaaagtaattgaataaatccatttaattggttttatattcgaacttcacttctttcagttcttcgtttgcctttacgattttctttttcagtccttctttgtaagcagcaaaagcctcagccaatgcggcatcgctcaatgcaagcatctgaatggcaaggatagccgcattcatcgctccattgatagcaaccgtagccacaggaatgcccggaggcatctgaatgatggagtacagagcgtctacaccgtcgagcacagagccttttacaggtactccgatcaccggaagtgttgtgttggctgcgatgacacccggaagggcggcagccattccggcagcagcgatgattactttaatgccacggctacgggcatttttggcaaactcttccacagcctccggcgtgcggtgagcagaaagggcgttcatttcgaacggtacatgcatatcattcagcagttgcgcagccttctccataacaggaaggtcggacgtgctacccatgatgatacttacaattggagtcattttcatctaatctaaaagttattacatacattcatttacctaccacctccccctacggggagaggcagaagtactgcttattcaaattcagccgttgaccactgccttgtatgcttcggcatcgagcaggtcttccgcagcactggcatcagcaggcttcatcttgatcagccagccttcgccgtaagggtctttgtttaccagctccggattttcttccaaagcttcgttctgttcgagtatctcgcctgccaacggtaagaaaagatcggaaatggtctttaccacttcaatcgttccgaaagtttctccggcttccaacgtttctcctacggtaggaatatcaacgaatacaatatcgcccagttgttcctgtgcgtaatctgtgatacctacgtaagcgatgtctccttctacgcgaatccactcgtgttcattcgtgtacttcaagttctgtggaaagttcataat

SEQ ID NO: 70 - DNA, 38918 bp, Bacteroides thetaiotaomicron
cttcactactcctgacggcacaaaggtttcaggggcacaaaaggctgtttatcaaaaagaaaagatatactggtcagggaaagaatacgatgaattgatattctaccctcagccaaatgccgggatcagggattcgaaccccgggtacctcgcagtacaacggttttcaagaccgccgcaatcgaccactctgccacctctccaaaactcctttatcagaagtgctttccgttgaaagcggtgcaaaggtacgaatcatttttaaatctgcaaacaatctgacatttttttcgcgaaataatcgtatttttgcagcctataataagtataaagacatgatatatcctcaaaattttgagcaaaagataggattcgaccaaataaggcagttactgaaagacaagtgtctcagcactttaggcgaagaacgggtttcagacatgagctttaccgagcaatttgaagaagtggaagagaaactgaaccaggtaactgaatttgtgcgtatcattcaggaagaagacggatttcccgatcaattcttcttcgatgtccgcccatcactgaaacgggtacggatagaaggcatgtatttggacgaacaagaactatttgacctacgccgttcattagagactattcgtgatatcgtacgttttctacaccggaatgaagaagaggaggaaaacgatgtaccctaccccagcctgaaacggttggcgggagatatagccgtatttcctcaactgattggtaaaatagacggtatccttaataaatatggaaaaataaaagacaatgcatccagcgaattggcccgtatccgtcgggagctgtccagcacaatgggaagtatctcacgttcactaaacagtatcctgcgcaatgcacaatctgaaggctatgtagacaaagacgtagctccgactatgcgtgacggccgtctcgttattcctgtcgcaccgggattaaaacgaaagatcaaaggtatcgtgcacgatgaatcggcaagtggaaagaccgtattcatcgaaccggcagaggtcgtagaagccaacaaccgtattcgcgaacttgaaggggatgaacgacgggaaatcattcgtatccttacagagttttccaatatcctgcgtccatctattccagacatccttcaatcgtatgaatttctggcagagatcgactttatccgtgcgaaaagttattttgccatacagaccaacagcctgaaaccgacagtagaaaaggaacaactattggattggacaatggcagtgcatcccttactgcaactctcattagccaaacatgggaaaaaggttgttccactggatatagaactaaaccaaaagcagcgtatccttatcatttccggtcccaatgccggaggaaagtctgtctgtctgaaaacagtcggtttgctacaatatatgttgcaatgcggtatgctgattcctttgcacgaacgcagtcatgcaggtatgttcagcagtatcttcatcgatatcggtgacgaacagtccatcgaagatgacctgagtacttattcttcgcacctgaccaatatgaaaatcatgatgaaaagctgcaatgaacgcagcctcatcctgatcgacgagttcgggggaggtacggaaccacagatcggaggagccatcgccgaagctgtgctgaaacgtttcaatcagaaaggaacgttcggagtaataacgactcactatcagaatctgaagcattttgccgaagatcatgaaggagtagtcaacggcgccatgctttacgaccgccatttgatgcaggcactctttcaactacaaatcggaaatccgggcagttcatttgccgtagagattgcccggaaaatcggattgccggaagatgtgattgcagatgcttcggaaattgtaggaagcgaatacatcaatgccgataaatatcttcaggacattgtacgcgacaagcgctactgggaagggaaacgacaaacgatccgccaacgggaaaaacacatggaagacaccatcgcccgttatcaaacggaaatggaagagttgcaaaaatcacggaaggagattatcagacaagctaaagaagaagctgaacgaatgttgcaggaatcaaacgcccgcatcgaaaataccatccgtacgattaaagaagctcaggccgaaaaagaaaagacccgcttggtacgtcaggagctgaacgatttccgtacttccctggaaacaatgacttccaaagaacaggaagaaaagattgcccgcaaaatggagaagctgaaagagaagcaggaacggaagaaaaacaagaaaaacgaaccgaaaaccgccgcatcacagacagccgctacccctaaagtaatacctatcaccgttggtgagaacgtaaagatcaagggacagacaagcgtcggacaggtcatggaaatcaatggtaaaaatgcaaccgtcgctttcggaagcattaaaaccacggtgaaactggatcgtctggagcgaagcaacgccgcccccaagacggaaggaatagccaaaagtacgtttgtcagcagtcagacacatgaccagatgtacgagaagaagcttaatttcaagcaagatattgatgtacgggggatgcgtggtgacgaggctctgcaggctatcacttatttcgtagacgatgccatccttgtcggtatggaccgtgtacgtattcttcacggaacaggaaccggaatactccgtacactcatccgccaatacctgtccaccgtaccgggcgtcagtcattatgcagacgagcatgtccagttcggaggtgccggaattacggtagtcgattttgactaatctgaaaacaaaacgatcgaagaacttgttctcatttagaaaaccactacctttgtgttacagtggttttctaaaacgagaataaagcatgaagaataatctgttaagcgaaaagcttatttacacaggggacagccttacccccacccatttacatctctgcacatacaatgcaaccgagatgcaggaaagttccggtgacaccttccaaagcgtcaaagaaacattggataacgaacgaatcaactggctgcaggtacacgggctgaaagatacggaaaccatccgtgagatttgcagtcattttgaaatagacttcctcgttttacaagacatattaaatgccgaccacccgacgaaaatagaagagcatgacaaatatattgtcctgatcctgaaaatattctatcccaatgagcataaagaggatgatgacctcgacggattgctccaacaacaagtctgcatcattctgggaaataactatgtacttacctttcttgaaaaagaaacagatttctttgatgaaatcaacgccgcattgagaaacgatatactgaaaatccgtagccgtctgacggattatctgctcagtgtattgctgaacagcatcatggcgaactacatttcaacgatatcttccatcgacgatgcactcgaagacctggaagaagaactgctgatgattaccaatgagaatgacatcggcattcagattcaggggctgcgccgccaatatatgctgatgaaaaaggccatcctcccgcttaaagagcaatatgtaaaattgttgcgggcagaaaatctccttatacataaagtaaaccgtgccttctacaatgatgtgaacgaccatttacaatttgtattacaaacgattgaaatctgccgtgaaacactgtcttcattagtcgacctgtatatctcgaacaatgatttacgaatgaacgatatcatgaagcggctgaccatcgtatccaccattttcatcccgctaacgtttcttgtcggtgtgtggggaatgaattacaaatggatgcccgaactggactggcggtacggatatttatttgcctggattataatggcggttatcggtattattgtatatttgtacttcagaaaaaagaaatggtattaactaaagcgcacccatccatgaaatcaataaaagaattatacagaatcggcacaggtccttccagcagtcatacaatgggccctcgtaaagctgcagaaatgtttgttgaacgtcacccggatgccgcatctttcaaagtaaccctttatggaagtttggcagctacaggcaaagggcacatgacggatgtggctatcatagatactttacaacctgccgctccggtagaaatcgtatggcaacccaaagttttcctccccttccatccgaacggaatgacgtttgctgctctggatgcagacaacaagatattggaaaactggacggtttacagtatcggtggcggagctttggcagagaataatgacaacccgacaatcgaaagcccggaagtatacggcatgaacaacatgaccgaaatcctgcaatggtgtgaacgtaccggaaaaagttattgggagtatgtcaaggaatgtgagaacgaggatatatgggactatctggcagaagtatgggacacaatgaaagacgctatccaccgaggtctggaagcggaaggtgtattgcccggaccgctgaacttacgtagaaaagcttccacctattatatacgtgctaccggatacaaacaatctctgcaatccagaggactcgttttctcttacgcactggcagtcagcgaagaaaacgcttccggtggaaagatcgtgactgcccctacctgtggttcctgcggagtgatgccggcagtactttatcatttacaaaaaagccgtgacttcagtgacatgcggattcttcgcgccttggctacagctgggctaattggaaacattgtcaagttcaatgcgtccatctccggtgcggaagtaggatgtcagggagaagtcggcgttgcctgcgcgatggcatcagcagcagccaatcaattattcggaggaagtccggcacagattgaatatgctgcggaaatggggctggaacaccacctggggatgacttgcgaccccgtatgcggtctcgttcaaatcccttgtatcgagcggaatgcttatgctgctgcccgtgcactggatgccaatctttattcagcttttacagacggtatgcaccgtgtttctttcgacaaagtggtacaggtaatgaaacaaaccggacatgacctgccctcactgtataaggaaaccagcgaaggaggactggccaaagattatcaacaaatgtaatataatgactacagaggagtgtctgtccacattcctctgtacataactaattctactccataaccggccaattcgtatcatcgccattggtgatatccctttcatgcaacaagcctccttcctgcgaaaagtacagtgcaaatctcagatttccctgtttcacctgaatcacggactcagtaggatgctgcggatacgtcaatacaaacacatcggtcactacccatgaactgtagttggaattacggaaaccggtataaacggcaggtactaactgatcgatactatccagttcgttttccgtcatcacccagttggcattcgcgtcgaaccagacatccagttcgtcaccagtcacccagcagtcagctacataataatctcctttcatctcccactccacattctgggcattcggatatagttgcttcaatgcctctgtgatattggcaggcggattatacgtttcatcatcattatcatcacatgcgctgaaagaaaaggcagtcagcattaaaacgactgcccatgcgccaaacttaaacttcaacataattaattcttaggatttaggttatatcatattttcatttaatcatcaatcatccgctttcaggaattttcctttcttgtcgaacttgaaagaaacgccggtacttaattccacttcatatcctttccggtcacgctccacttttgtcacaggctctgtgaagttatgctctttcagataactgacagcaaacgaaggaacaacacttgccggaactgcatgccctttactagcacttacttcctcccagttacctttactatcaaaatctatttccgtaccgtccgtcaataacacttcatacttggcagactccaacagatctttatcaatcttgatatgagccacctgaggtttggtaaaatgacggttgataaagttgcgtgccggaagcggtagctgattcatatcctttgtaatcacatcgccggcaaatgagaactgtatagctacaatagccatcacaagcaaagataaaattttcttcataatcgttattctttttagttaatactatatctgataagttttatactgcaaataacgatacagatttaggaaagatttgggaataaccagagatcacattcttttttgtgttctttaactttcagtcttgaatttaccccataaaaaagatccggatgcccactcaggaacatccggatcgctctctcttcaccttaacttttaaccttaactatttacctatttatctttccgaatatcctgcgagattgtagcaaacgggaacggtactatcacctacgcggtaaattccgaacttaaagtaatacccgtcttcgtcgttacgtccaatcagaatcttctcattatcgacaatgtgtttgctcactttcttaccttgctcctgataatccatccgtacatccagcatgcccggtttcacaatcgtttccgcttccttgccatagaccgtccagtcgatatggacacggaaagtaatccagcagtctttcgggaaatcggcaaaaggtaatttgtaggcaatggtggatgccttgtattcagaagtcagcggtttcataacgggcgtctttcccgggtttgcattgcaacggtcatctttgtctgtcagccatttacggtcggagtttgctttgatataaaacagtcctccggaaaatccgaatgccaatggcgggtatcctccctgttcaaccaaccatccgttgggttttcctgccttatatacaggttttccatttttatctttcaccggattaccttgtttatccagtctggccactttttcgtgtccgacattctttttgaagaaggtcgttttttccagttctacaaattcgtcaacagtcagtttcttcacctcgccctgaggagtctggaccagcgtccggtcgggcattccgtgccattgggcaaagatggtggagacattgctgtctaaagaagaaggaatataaaccgaaaactcatagtcgcgggaacttccttgcggacaagctcccttcccgtgatgataaactgtctttgtgatctgtgctttctgataaacgtcggcaggtaatcccctgaaatcgtcggaagttgcatagcaatatgaaaactcggcacgtcctttcgtttctcctttcgcataaccttccagtgtattgtcttcagttttgagttcaaagcgataggagggcttgccatcaaacaggttggtaaaatcacgctgaatggcatgaggtttattcgtcccgacagctacccagcaaccgtcaataatctggttgatacgtgcagagtcagcctgtacgtttacccgttcggtgagtggcatcagtgtttgcgtatttttagtctgagcagtcagcatcgtgcatcctgccgccatcatataaataaccaaaatgtattttttcattctatccggtattaagtttatcgacggtgcaaaaatacgaaaggcaacccttacggctgcctttcgtttgtctcaaatgctttcacatttgtgcaattcttctgtcagaaacgtcttatatccccattcacaagcctattcaggtgtttcttccgtataatcgtcttccaacatatctactttctttatgctcatttttccatcggccgttacagtgatggaaagcggaacatacaaatcggtctgcggatagcacacactggcggcgtagacaattccctccggtgtagtcttgtcatatacgattccttcaagtatggattttgaaaggaatttcgcgtcgactaccgatgaaaagtcgttcttcgtaaatgtcttgttgagtacgttttcacttccccgggtgatgcgcaacactattttattgtctacatacgtatcccccatctcattggagacgtgaggcagactttcgtcaggagtacgcgaaaccagcgaatgatagtctcttcccttaaacttaatatcagtttcagcttttgaactttgcatacgctgcaacccgtgagcatctacactgtcttgccttgccaataccgattctttatttgaacttccgttcttaccgccacaggctgccactgccagagccaatggtaacaaaagcagataaattagctttttcattccgaactattctgttttataaatatagagcaaaggaacaaaaagacggggagatttacaagtgtaaccgacatttttcctacatttgcaatcaagagtgctaatattaacacaacatttaaagatttaatgccttgcaaacctgatatcatgtatcaacgaatcatagccattctttttttcctttatgcatcttgcatcctaagcaacagcgcttatggaaaaaaagtaaattatcagcaattcgacaatatttatctcggtgctgaggcatcggttgtcagctgtttccttcaagacagtgaaggattgatatggataggttccaacaagggattattcagctatgacggttactccacacagcaacattttacttacggtgaaaacaataatacccgtatctactgcggtgtcattatagacaacacctatttatatatggggacagacaacggaatcctggtttataattaccgggctgaccgctacgagcaaccggaaactgactttccgacagatgtacgcaccatggctcttcaaggagataccctatggctaggcgccttaaacggtttatacacttatcagctgcaaagccggaaactgacatcttttgataccagacgcaacggacttcccaataataccatatactccattatccgcaccaaggataatcaaatttatgtgggaacctacaacggactatgccgctatatcccgtccaacgggaaattcgaaggcattcctcttcccgtccatagcagtcaaagtaacctgttcgtcaattctttgctggaagatactacccgccagtgtgtctggattggtacggaaggctatctcttccaatactttccgtcaaccggacagataaaacagacagaagccttccataataattcgatcaaatcattagccctggatggaaacggagacttactggcaggtacagacaacggactttacgtctatcataacgataccaccccgctacaacacatcattcacgactcccgcaatatccagtcgttgaccaataatatcatctggaatatctttgccgaccaggaacataacatctggctgggtaccgactatggcatctccctctcacgctataatagtgcgctgcagtttattccaatctcacagattacaggtacgggagacggaaaccaattctattccctgtttcgtgactcaaaagggttctattggtttggaggagccaacggattaattcgtttcactgatcctgccggagaaagacacgatgccatttggtacagaatgggcgacaagacttatccattatctcacaaccgcatccggcatatttacgaagacaaagaacagcagttatggattgctaccgacggaagcatcaaccgctacgattatgcaacccgccaattcatacactacaacattgtagacaatacaggaacgtataataccaactggacctattatatatttgaagataccgccggacaactatggatttcaacatgccttggaggaatctttgtagtagacaagcacaaattgatgcaatctacctccggacaatatatagccgaacagaattactccgtccacaacggactgtccggtatgtttatcaaccagattattcccgataatgaaggcaatgtatgggtattgctctacaataataaaggaatagataaaattaatccccgcacacgggaagtaacgaaattatttgcagacgaattaaccggagagaaaagccccaactacctgttatgtgatgaggacggcttgctttgggtaggatttcatggcggtgtcatgcgcatcaaccccaaagacgagagccagcagagtatctccttcggaagtttcagcaacaacgagattttatccatgacttgcgtgaagaactccatctgggtatccactaccaacggcctctggattatcgaccggaaaacaatggatgcccgacagcagaatatgacaaacaaacgctttacaagcctgctgttcgacccgaaagaagattgtgtctatctgggaggagccgacggcttcggtatctcacactccaacctagaagccacataccaaccggaacgtccgattctgttgactgccttatacattaacaatcaactggtatcgccacgcaccagagatgacgtgcccaatatccgatataccaactcaattaaattaaaatatgatcagaataacctgtcattcgagttatccgaccttccttattcgctggacgagaaaaacaagtttgtctatcgtctggaaggcatggacaaagaatggaactttctgaaatccaatatcaaccgtattacatacagtaatctgagttatggaaattatcagcttatcatcagcaagctggagagagacggacaaccatccaaccgtcctcatattctgaatatccggattcttccaccgtggtactatacgatatgggcaaaagccatctatatcttactgctgctcagtcttatcgcatggacaatcaactttttccgggttaaaaaccgcctgaaagcagaacgcagggaaaaagaaaaaatactggaacagtcccgtcagaaaatggcattcttcaccaacttatccaatgagctgaagacacctctcagccggatcatagctcctatcagccagttacttccgtctacggaagaagtacacgaaaaacagacactggaagaagtgcagcgcaacgccatgaaaatcaactcgctgattcatcaggtactcaacttcaaccggattgaagacaataaagattcattgcttatcctgtcacgcatcgaacttgtatcattcagccgcagtttgttttcagtctatgaagaggacaaacggttcacgttccatttcgaagcaaacaaagcgaagatttacgccgatatggatgccatcaaacttggagtaatactagataatctattatcaaatgctgtcaagttcacctcagagggcggaagtatccgcttatcccttttctatcggcaggaaaccggtttgctggagatttgcgtttccgatacgggagcaggcattccgcaacaggatattccttatatcttccaacgtttcttccagtcaccccatagcggcagcaaagaaggcacaggtatcggactttatctggtaaagacctacacggaattacacggcggttctatcgatggagtcacctccgaaaaaggaaagggaacttccatcgggctgagcattccggtcattgctgtagaggaagacgaaataccagtcatagcatccaaaaaacagttggaatctctccccatacttaaaccgatcgaagcagaatcgcaggatgagaaatttctgtcgaacattatccgtctgattgaagatcacctctccgatgcagacctgaatgtcaacgcactttgcgaactgtcgggaatcagtaacaagcagatttaccggaaaatcaagcaactcaccggaatgtctcccgtggaatatatcaagtccatccgcatgaagaaagctgccatgttattgcaacaaaagaaattcaccgttgccgaagtgatgtatatggtaggattttccaatcattcttatttctccaaatgctttcaggcagagtttggaaaaacaccgcgccaatacttgaatgacgggctgtagaggcattttagggcttttcgtcctatttttatccttatatgtccaatctgtgcttttatgaaaatgccaggcagtctatctttgccgctatcaacaaaccactaaatttgatagcatgaaaagacagtttattcttacttgtatttgtccgttatttgccttcgtcagcacacaaggtaaaacgacttccacacctttcgcacatgcttaccgtgccctcggctatttgagagcagatcgtaaggcagctatagataaagatgtataccacttctcccgaccgaatgatactattaaccgatatttcaataaaataaatcttttaccaattacacaataattatgaactgtaatatcttaaatctacgccatctgactgtactacttatattatgtacagcttttcttggaggcgcaattcctgcctttgcccaacagggaggcaagaaaatgaccggacaagtgatcgatgagaacaaagagccgatgatcggagtcagcattcttatcgtaggaacatcgacaggtacagtgaccgactttgacggaaactatactctgaatgtaccgaaagacagtaaggaactacaattttcttacgtaggatatgaaactaaagtgataactatccccgtaaacagtaacgtactgaatgtacaaatgaaaagcgactcacaagtactgagtgatgtagtaatcatcggatacggaacacaacgcaaaagcgatctgaccggctcggttgcctctgtgggtactaaagactttaataaaggcatggtttcatcgcccgaagagcttgtgaatggcaagatagccggtgtgcaaatagtaaatggcggaggttcgcctacatctgtctcaaccatacgcattcgtggtggtgcatcacttaacgcatccaatgacccattaattgtactggacggggttcctatggaagtaggtggttccatatccggcggcggaaactttctaagccttataaacccgaacgacatagagagtatgaccgtgctgaaagatgcttcatccactgctatttatggatcacgagcatccaacggcgtcatcatcataacaaccaaaaagggaagcgggagtgatattaaggtctctttccaaacgaccaattccattgcaaccaagaccaagacttcggatatgctgaacacagacgaatttataaatattgtcaatcagtatggtacggaacaccaaaagtcattgcttggtgactatcgtacaaactggaacgatgaaatttatcaaacagctttcggaacagataataaccttagtgtttcaggacttgcacttccttggttgccatttcgtgtttcaaccggtatgtattatcaggatggtatcttgaaaacggataatacaaaacgctttaccggaaacgtaaaccttactccttcgtttttccataacgagctgagatttaatataggtttaaaaggcacttattctaagaaccgctttgctgataccgatgcaatctgggcaggcagtacgctcaaccccaccattccggtatattccggaaacgatacctttggtggttacaacgaggctatcgatgccaatggcgtaccggtgacgggagcattagccaatgctgtcggccgactgaatcaatacgattccacatcggatgtctatcgatttataggaagtgccagcgtggattggaatgtaagatgggtaaagggcttgcgtttgcatactacgggcggatatgactggtcaaaaggcaaaggacatatttatgtacctaaagaggccgtttcttattatacaaccggcggacgtgactacacatacggcccgcaaaagaattacaataaactgctcacgatttatgccaattatcataatgacttcgatgctattcattccggcattgatgtaacagtaggatatgattatcaattctggaaatataccactccgttttatgccattctgagtgccgatggagtacagcagtcgacttctgccgcaaccgatcagcggcattcactcatgtcatactatgggcgtttgaattacacattcatggatcgctatttgcttatggccaccatgcgccgcgacggctcgtctcgatttgcatccgacaatcgttggggtactttcccctcagtagccttagcttggagggtttcacaagagcacttctttgagcctttgcgcacagtgatgaatgacgtgaagttgcgcgtatcctatggtataaccggacagcaagatggtatcaccaattatggctacattccggtctacactccgggacttgacggagcacaatacctgtttggcggaaatccgatatatacctatcgtcctgaagcatataatcctgaattgaaatgggaaactactaaatcatggaactatggtatagatctggcattcttagaaaacagatttaccttttctgctgatttctataccagaaagaccgaaaatcttctggccactgttccgatgccagccggtacgaactttgataagctaatgcttcaaaatgtgggcaatgtagactctaaaggacttgaactctctgttaccggacacatcatcaatacaaaaaattggtcatggacagcaagtgccaatgctgcatggcaaaaagtaaggataaagaatcttacgcttactcccggtgctccaagccctgacacagaagtaggcccttggattgatgcttaccagatgcaggtgttctctactgattacgctccctactcattctatttatacaagcaattgtatgatgcggagacggggcaacccattgaaggcttgtatgccgaccttgacggagatggcgagataacgaacaaagaccgctaccatcatcattcaccggctccggactggattttgggcttttcaacctcgctgcgctataagaagtggacactttcaacctcgcttagagccaatataggaggatatatctttaatggtatggccatgaatacaggtgcatgggaaaccatgagctataacgattatcaacttaataacttaaatcggagtttcctggatacccgctttaccaagaggcagtttctcagcgaccattatcttgaaaacgcttcgttcttgaagatggacaacctgcaactctcttatgacttcggtcgcatatataagaccatcggccttcatgcctctgccatggtgcagaatgtctttaccgtgactaaatataaaggtgtagaccctgaaacagccaatggtgtcgacacatctgtttatccgcgtccccgcacgtattctatcactattggccttaatttttaactgaataaaccatgaagaaaattaatatactaacaataatcgtatggtgcatgacccttgtagcaagctcgtgtacagatgttcttgatcaaatgccgacaacagaggatacctcaaaagaagtttatgctgacgcggcaaattataagaaagtccttgccaaaatatatgcctcttatgttcttgcaggacaaggacaagggggagataacggagacctcaagagcatcaacaaacaagacttttcccgtggctatttcaatctgcaagaagccgctaccgatgaagtagctaatacctggctttcaggaaacaacctgtctgaccttacctatatcagttgggatgcgaaagattcttgggtttctgactcctattactggcttttcttcaacatagccttgtgtaatgagtttcttcgccattgttcggatgaagagattgcccggttttcagaagccgaacaaacagaaatccgtactttccgttcggaagctcgttttatgagatcattcagttattggatggtactcgatttgtatcgtcaaggtcctaaagtggatgaaaatacgccagttatcggttatatcccggaagcctacgatgggattgggatgtttgattttatcgaaagcgaactgaaagaactggttgccgaaggagtttcatcagcattgcccgctaccaacgaatacggccgtgccagtaaacccgtggcatgggcactccttgcccgtctttatttaaacagcgcaatatatcgtggcaatgtggatactaagtattatacagaatgtattactgcttgcaaacaagtaatttccaatcctgcattctatctggaaccggaatatgccaaattatttaatgccgataatcacaagcgaacacatgaaattttgtttgctatggtgtgtgacgccacaacatcagttacgtggggcggaggaacatatataatttgtggatcatgtggcaattcgagcacacaagaccccgccaagtacggattgtccaacggctggggtatgtttcgtgcgcgtggtgagatgacagcaaagtttggagatattgctacaaccaaagacagccgcgctatgttttatacagatggacaagcacagttctttaccggtgcaatcgataaccaagccgaaggctatttctttgaaaagttctccaatctcactgatgagggcgtagcagcatccaattctgctgccacaggatgctctaccgactatcccctactccggcttgccgacatctatctgatggcagccgaagcacaactcagaggaggaacagggctatcgcgagccgaagcattggaacttgtaaatcaggttcgtttgcgtgcatataaccaggatgaaagcggaaaaatctcagatagtgattttacgctcgatttcattcttgatgaaagagccagggagttatacctcgaatcagtgcgtagaactgatcttataagattcaataagtttgtatcagcagattatatctggcaatggaaagggggcgttcttgacggccgtgccgtgaacaaaaaatataatatttatcccattcctgatacagatcttacagccaatcctaatctacataatccactctattaaaaagatacgatatgaaagtttttagtacaatagttaaattgatattattgtcagctgttatgacagtagctaccacctcctgtgatagcgatattgatccggtttacgtcttgtccggagactctatggaattgatggggggcccgaatgaagttattcttacgccagacaatccgcaggctttggcattgacagtttattggagtggcgacggacgtttggcgcttagtgatacacttttgcaagctccggtgaatgttgcggaaataacgattcagttctcaaaggatgaacactttactgctccgttaaatattgcggtggataagaatatccattcccgtcaatttctttgcgaggagcttaattctctgcttgatcgtttaggttatgaggccaatgagaaggctccgttatggattcggatgcgttcggcattggcagccaacatcgctcccgaatactctaatgtcatggaggttctggtccagtcttatcgcattgagcttgtcttggctcaagtacttgacaaggactggaagaacacatctatgacgcttgcctctcctgctgaagacggcatttataaaggttttatgggcgtcaacggatgggaaaactggtggcttcgcgaagccaataatgtaatgtggggtaatcttggtgaagaaggaaagacattttatgcttcatcggaagacagtcactggaacttttggttcccgaatccgtcaggatgctattacactaccgtaaacacggttgaaggatggtggagtgcactgcatgttgccagtctgtcagttagtggagatgtaacgggcgaaatggcttacaacaagcagagcaatcaatggacactgccggtaaatctggcaacacaatctaccctgaccatttccgtatcaggaaagggtagcctgtacaaccgggaaacaaccgatataggacctgctattgagcaaactgtcgcatttggcggcaattcacaaaacctcttgttcggtgagagtgcagataatatttctgtaactatgcccgccggagaaaatctcctggttcttgatttatccaatcctcttcaatttaccatcggcatcggagaagacgttccgcagccggaagtctctcagtatctgtacttctccggcataaccaattgggaaggttttgacgattacctcactttatacgatgaagccggactttgctatggtggtgcacattggatagattctgaatggggatatcgtgcatatactgaacaagcatgggagcccgcctataatgcagccgatggctctaccgacttgtccggcacattgatccttgcagagtctaaagacaacattcccgcaccggcacaagggctgtatgttatggatttcaacatgaagtcattgacctatgaactgactcaagtgcagactgtgacatttaccggacttaacgataattggtctgaatcccccatgacacagtctgcagaaaatccagagatatttacagccgagttcattaaagaaaagaaaagtccttggggagtaaaagtgctgataaataacaactggaaccttttcttcggcggtggttccggcattctgcacctgaagcattctgaatcctcagcaggatttgacggagacgatgaactcgaaataggcaaaacctatgtccttaccgttgatttgggacaccaaacttattcttactcacttaaataaatcagtttcaatgaaaatagcaagcatattatcaatagtagcactcattgcttcaatggctacaaacgggtgtagtgaagatggcccggttacaaatcctcgtcaagaagaaccgcaaaaggttgtaaaagaagaaggctttgcacgtggtgcagacgtaagttggctgactcaaatggaagcggaaggactcaagttctacacgccggacgagaatcgccaagagatggagtgtatggacctcttgcgtgattattgcggagtcaactctatccgtcttcgtgtatgggttaacccgaaagacggctggaacaacatgaatgacgtaatagtgaaagcaaaacgtgccgagcgtctgggattacgtacgatgatcgacttccatttttctgatacctgggccgaccccggacatcaggaaatgccggaggcgtggaaagagctttcatttgatgatctcaaaattgctctcagcgaacatgtgaaatcagttcttaccgcgttaaaagcggttggggttacaccggaatgggtacaggtaggtaatgaaacaactcccggcatgatgcttcctgtggggtctgttgataatcccgaacaactgactgcactcaacaatgcgggatatgatgccgtgaaagctatatgtcccgacgccaaagtcattgtccacctggacgcgggaaacgaccaatgggtatacaaccgcatgttcgacattcttcaagccaatggaggtaaatacgacatgataggcatgtcgctctatccatattgggcagagcaggaaggcaaaaccggtggttggctgaaagtagccgatgactgtattgccaatatcaagcatgtcaagcagaaatacaacaaacctgtcatgatttgcgagataggtatgccttatgatcaggcagaggcctgcaaacaactcattacaaaaatgatgcaagccgatgtggaaggtatcttctattgggagccacaagccccgaatggctataatgacggttataacctaggctgtttcgataataatgcgcctacaattgcactagatgcttttaaaatccaataaaaaagtgagaatgaacatgaaacaccagaaacagttgtttactgtacttttgatgagcgcagcctgtatgctacaggcacagcgcagcgagacgctgcttgagaagaactggaaattcagtaaaggagattttccggaagctgcgcagactgactacaatgatactaaatgggaatcggtcgttatcccgcatgactgggccatcttcggacctttcgacatgaacaacgacctgcaaaacgtagcagtcacacagaactttgagaagaaggcatcactgaaaaccggacgtaccggaggactgccttatgtcggaaccggatggtatcgcaccagcttcgacgttcccgccgacaaagaagtcactctcctgttcgacggagcaatgagtgaggcgcgtgtatacgtcaacggacaggaggcttgcttctggcccttcggctacaactctttccattgcaacgtcacccctttcctgaataaagacggaaagaacaatacactggcggtacgcctcgaaaaccgcccccagtcttcacgctggtatccgggagcaggtctgtaccgcaacgtccacttgatcgtgacggaaaaagtacacattccggtatggggcacgcagattactaccccgcatgtcagtgatgaatttgccgccgtacgcctgcaaaccaagatagagaatgccggcgaaaagacagaaatccgtatagagacagaaatcctgtcaccggatggaaaggtagtgacccgcaaagaaaacaaaggccgcatcaatcacgggcagccgtttgaacaaaacttcatcgtcaacgcgcctcaactctggtcaccggaaagccccgctctttacaaggctgtatcgaaagtgtacgcagacaaccaactggtagatacatactctacccgcttcggtatccgcagcattgaatacattgccgacaaaggtttctacttgaacggaaaacaccgcaaattccaaggtgtatgcaaccaccatgacttaggtccgctgggtgcggccatcaacgtagcggcacttcgccaccagctcacactcttaaaggatatgggatgcgacgccattcgtacttcccataatatgccggctcccgaactcgtggaattgtgcgacgaaatgggattcatgatgatgatcgaaccgttcgacgaatgggacatcgccaagtgtgaaaacggatatcaccgttacttcaacgaatgggcagaacgcgatatggtgaatatgctgcacaactatcgtaacaatccctgtgtagtgatgtggagtatcggtaatgaagtccccacgcaatgcagccctgtaggatataaagtagccaagttcctgcaagatatctgccaccgtgaagaccctacccgccccgttacctgcggcatggaccaagtgacttgtgttctagccaacggatttgctgccatgatcgatatccccggtctgaactaccgcgccaatcgctatcaggaggcatatgacaaacttccgcaaaatcttattctgggtagtgaaactgcgtccaccgtcagctcacgcggtgtctacaagtttcccgtaaaagataagaaaagtgcccagtacgatgatcatcaatgttcttcttatgacgtagaggcatgttcatggtccaacatccccgatgaggacttcgctttggcggacgatcatcactggaccatcggacagtttgtatggaccggcttcgattatctgggtgagccttccccttatgatactgatgcctggcccaatcatagttccatgttcggtattatcgaccttgccagtctccccaaagaccgctattacttgtatcgcagcatatggaataaggaagcggaaacactgcatatcctgccgcattggacatggccgggacgcgaaggtgaagtaactccggtatttgtttacaccaactaccctgctgccgaactgtttatcaacggaaaaagctacggtaaacaaagcaagaacaacagttcactgaaaagccgctaccgtctgatgtggatggatgccatatatgaaccgggtgaagtgaaagtagtagcctacgataaagacggaaaagcagtagcagaaaagagtgtacgcaccgcaagcaagcctcatcacatcgaactggtcagcaaccggaacgaactgacggcagacggcaaagacctcgcttatgtgacagtgaaagtggtggacaaagacggcaacctctgccctgccgacagtcgtctgatcaacttctccgtcaaaggtgccggaaaataccgtgccggagccaacggtgaccccacgagtctcgacctgttccatcttccgaagatgcacgctttcaacggaatgcttacagctatcgtacaaacaaatgaaacagccggagaaattattctgactgccaaagccggcggagtgaaagcaggaagtatccgtcttctgacgaaataatcggtctacataaagaaatatatttgaaaaactgctgtcacctgtcaccaaacgagtgataatagtctgataattaaatcataagaccgtgacagcaacgtgtgacagcagtgtgatggcaagtattgtcgtcacactgctgtcacacgttgctatttcattttagctaccctctgcacttctactgatagtaagccaagttcgtttccctatttgaaactatagttcccattgcttgaaactctagtttctattacttgaaactttggtttcatacgctcgaaacttttagtttcaagcctttggaactatggtttcttactgatgaaactacagtttcaagcagtggaaactaattaagctacaacgagtggcagtagcgtgacggcaaattctgccatcacactgctgccactcgttgctatcaccacatttatatctcaaaatcaatctgttaactctaaaacagtgacaggtgacagataatatttgtttttatttatataggatgaagaaaatatagatgctactgattcgcattattcagtgttatatttcattaaatagctttccagaatgactggaaatcacggtatttaccatagcataccagttcatctccttcttccaccttctcatctccgggcaactcattcttgacatgacgctccatcaaagaaatgcccaggcaattagtgactttgttcgcacgcttcagtgcgatcagtttcagatgaaactcttcatccatattcagctcattcacaaagtatcctacaaacttcttcggaacagtaaacttcacgacataataatcctgatcaatacggaacgcttccatcgtcgccccaaagtcgagcaactgcaccaggctacgggcagcatcctcttccggtgtcagaatcttctccagactaaacgcttcaagcactgccttgtgcaccgcatcaatggcacgggcaaaaatacgaggcacctttttctgcttcaacaacgcgacaacacgtaccgatgctccaaaattctcgccaatcgccacaacaacaatatctacgctattcaaaggcagcaccgacaacgactgttcgtccgtagcgtcaatgacaaaagcagtggcaaccttatctttgattgagtcgacacggctttcgctgatgtccgctccaatgatctcatgccccaatgccgataattcctcggcaagtacatgcccgtaatttcctagaccaataataatatacttcatgatgttagtttatgatgatgttatcactcggataacggtattttgtattctttttctgcttgacgatgcccagcatcaacgtaatcagaccgacacgtccgataaacatcagcaacgataccagcaatttactggcatcgcacaattgaggcgtcagattcaggctcgatcctaccgtactaagggcggaaacacattcaaaggtcagcgccagcaaagaggctttcggttcgagtatgctcaatatgaagatgaagagaaacaatacgcccagcgacatgacgaccgtcgcattggaacgccggatagagtcatgagacaattccctgccgaagacctccacccgctcacttccccgcaatacggctacaaggttcaacactaccactgcaaaagcattcactttgacaccgcctgccgtagactgcgaaccgccgccgacccacatcaggaagagataaaccaacagcgtctgcacgctcaatgatgccagatcgacactgctgaaacccgccgttcgcggacaggtcgcattaaagaatgcttgcgtccatttatcggccacagacataccggcaaaagaggcattccactcaaaagcaaggatggccagtgtaccgatcagcaaaagcaggaaagtcatgatcaatacgattttcgtattcagattgtagaggtgcggcatcttatgtctttccagtttgcgggtacgcacaaacgtccagacatggcgcaaatggtataatacgatatctttgaaattaaccagaatcggaaagccgataccgcccaagataatcagtaaagagacggagatgaacagccagttgtggttggtcatcaccatcgaatttcctaaattgcctgaaagtgtggagaaacccgcattacagaaagccgaaatggaatggaaggcggcaaaagccagttcctcttccagattcatcccaagcgtatcgtgaatgctgaaccagatggacaccatgccaatgccttcgatgaccaatgtaaatccaaggatatatagtagtgtggacagtaacgaccccaacgaattggaactgaccatatcacggacaacgagctgattgtaaatggaagtatttcccataaagaacatggcgaagaaactggttaatgtcatcactcccagtccgccgatctgaatgagcaggataatgactacaagtccgctggtggtgaaagtggtggatacatctaccggcaccaagcccgtcacacagacggcactggtggctgtaaacagagaatcgacccaagtgatgccattgaccgtacatcgtggaagcatcagcaatcccgtcccgatcagaataatagccataaagctgacagccagtatcaaagacggattcgtacggcgtcctaaaagacgcaccaagccattggacaggttcagcagagaaaaaaccaacaataatattaaatgataaaacttcccgtgaaggaattcccagacttgcagaatcgctccctcttcttccggacgatggaagatgacgggaaccaaagttaggtaaagcaatacgctcaatatccatgccagccttcgatattgctttttcgtattccggtattccagcgaaatatgcagggtgacatcaattaaaaagataatccatacggctttatacaagatctgtatctgctgtacctcgaccggggacaatggaaaaccatgttcgtaaaccactccgacaatcaacaacagagatgccagataagtgagtgcttctaccaaccccagcaggatacgtacatagggcttgagaagcttattctgatataacagaaatttatgataaatcttcatatcacatttttttattgtcgtatttgctatgccgtgcaaacttaactaaaataacaatcgaattcgattctttgttgacaaaattacacgaatattaaaaattttgcctacttttggcagcagaaaactaataaaccacaataacatgagtgacaaaagaaaacggtatatcctaccggaagaagaaattccacattactggtacaacattcaggctgatatggtgaacaagccaatgccgccgttgcacccgggaacaaaacagccgctgaaagcggaagatctgtatccaatctttgccaaagaactgtgtcatcaggagcttaaccagactgacgcatggatcgaaataccggaagatgtacgcgaaatgtataaatattatcgcagtacgccgcttgtacgcgcttacggactggaaaaagcgctcggaactccggcacatatctatttcaagaacgaaagtgtcagcccgatcggttctcataaactgaactctgcgctggctcaggcatattattgcaaagaagaaggcgtcacgaacgttactaccgaaaccggtgcgggccaatggggagccgccctttcttatgctgccaaagtttttggtctcgaagccgctgtttatcaggtaaagatcagctacgaacaaaagccttaccgccgcagcattatgcagactttcggcgcgcaggtcactccttctccgtctatgtctacccgtgcgggaaaagatatcctgacggctcaccccacctatcagggttctctgggtacagccatctcggaagctatcgaacttgcacaaatgactcccaactgtaaatacactcttggttcggtactcagccacgttactctccaccaaaccattatcggtctggaagctgaaaagcaaatggaaatggcgggcgaatatccggacgtagtaatcggttgtttcggaggcggttccaacttcggaggtatctctttcccattcatgcgtcacaacatcctggaaggaaagaaaacgcgtttcgttgctgccgaacctgcttcgtgcccgaagctgacccgcggtaaattccaatatgacttcggtgatgaagccggatatactccgctgctcccgatgtttacattaggacacaacttcgctcctgcccatatccatgcaggcggtcttcgctatcacggtgcaggcgtcatcgtctcccaattgctgaaagacaatctgatggaagcggtagatatccagcaactggaatctttcgaagccggctgtctgttcgcacaggcggaaggtattattccggcaccggaatccagccacgcgattgctgccgctatacgcgaagcaaaggcgtgcaaggaaacaggagaagagaaagtgattctgttcaacctgtccggacacggtctgatcgatatggcatcttatgacaaatatctggcaggcgatttagtgaactacgcactgactgacgaagatattcagaagaatctggatgaaataggagacttatccaagtaagccccggtttctgaaccgaattctgtaagcataaaagcccggtatgatgccgggcttatttattatctctacgaaactatccaaaagaatacagtcttttgtactttattcatggggtatttaaaggaaattactatctttggcgtcattattaatctcgtgaactaataatgagcaagcttaagaagatagtaatctacttgtttttcctatgcttaggaatgcattccgccttttctgaaactccggaacaaatcacattttcctatatttccatcaatgagggactatcacaaagtacggtgttctccatcgatcaggataaaaggggcaatatgtggtttgccacttatgacggagttaacaaatacgacggatatgcatttacggtttatcagcataatgaggatgacccgaacagtatcgccaacgacatctcccgtattgtaaaaacagacagtcagggacgggtatggattggtacacgtgatggtttgtcccgttatgatgaggaaaaagacatattccagaacttcttctatgaaaagaatgggaaacatttgcaagttaacggtatcgaagagatttcaccggaacagttacttatcagtactccggaagggctgatcatgttcgatatcaaagaatccaaatttatagatgattctttcagcacagcgatgcataagacaatcgcctccactctttacagacagggtgaccaaatttatatcggaacttcgaccgacggactctatacttactctattactcagaaaacttttgaaaaagtgatccccattttagggactaaacagattcaggctattcttcagcaatcccctacccgcatctgggtggcaaccgaaggagccggactgttcctgattaatccgaaaacgaaggaaataaagaattatctgcattctccttccaatccgaagagtatcagttccaattacatccgctcactggcaatggattcacaaaaccgtttatggatcggaactttcaacgacttgaatatttatcatgaaggtactgattcttttgcctcgtacagcagtaaccccgtagaaaacggcagtctgtcacaacgttcggtgcgcagtatctttatggattctcagggcggtatgtggctgggaacttatttcggtggtctgaactattatcaccctatccggaaccgcttcaagaatatccgcaatattccttataaaaactcgttaagcgacaatgtagtaagctgtattgtcgaagataaagacaaaaacctgtggataggaacgaatgacggaggattgaatctttataatccgattacacagcgatttacatcttatacactgcaagaggatgaaagtgcaagaggcatcggttccaacaatatcaaggcggtatatgtagacgaaaagaaatctttggtatatataggtactcatgccggcggactgagtatccttcaccgcaacagcggtcaggtagaaaactttaaccaacgcaacagccagctggtgaatgagaatgtctatgccatccttcccgacggagaagggaatctctggttgggaacactcagtgcactggttcgttttaatccggaacaacgaagttttactacgattgaaaaagagaaagatggcactccggtcgtctccaaacaaatcacgacactattccgcgactcccataaacgcttatggatcggtggagaagagggactatcagtctttaagcaagaaggtctggatatacaaaaagcatccatacttccggtttccaacgtcacgaagctctttacgaactgtatttacgaggcttccaacggaatcatctgggtaggtacacgcgaaggattttattgtttcaatgaaaaagacaagcagatcaaacggtataacacgaccaacggtctgccgaataacgtagtatacggtattttggaagattccttcggaagactctggttaagtaccaaccgggggatttcctgctttaatccggaaacggaaaaattccgtaactttacagaatcggacgggttgcaaagcaatcagttcaataccgcttcttattgtcgtacgtctgtgggacaaatgtattttggcggtatcaacggaatcacgactttccgtccggaattattgctcgacaatccttatacgcctccggtggttatcaccaaactgcaactgttcaataaggtagtccgcccggatgatgagaccggtattctgaccaagaacatcagtgaaacgaaaagtatcacactgaaatcctggcaaactgctttttccattgagttcgtggtatccaattatatctcaggacaacataatactttcgcctataagctggaaggttatgataaggaatggtattatctgacggacagccgcaccgtctcctactctaacctgccacagggaacctatcagttccttgtcaaagcagccaacagcgatggcaaatggaatcctatccctacagcattggagattatcgttctgccaatctggtataagacctggtgggcactactcatcttcttcgcaaccttcgcaggtttcatcacttttgttttccgcttcttctggatgcgcaaaagtatggaagcccagcttgaaatagaacgcagagacaaagaacatcaggaagaaatcaatcagatgaagatgcgtttcttcatcaacatctcgcatgaacttcgtacacctttgacgctgattctgactcccctgcaagagatcattaacaaaatcagcgaccgatggacacgtaaccaactggaatatatccaacggaatgcaaaccgcctgctgcatctggtcaaccaattgatggactaccgccgtgctgaactcggagtgttcgaactaaaagcgaaaaaaggaaacgctcatcaactgatacaggacaacttccttttctacgataaactggcacgccacaaaaagattacttatactctacactctgaactggaagacaaagaagttctttttgatgccaactatctggaactgatagtaaacaacctcctttccaatgcctttaaatatacggaaagcgggcaaagcattaccgtaactctgaaagaggagaacggctggctattgttacaagtcagcgatacaggcataggtatccctatcaacaaacagggaaagatattcgaacgtttctatcagatagaaagtgaacacgtaggaagtggtatcggactttcgttagtacaacgtctgatagaacttcatcatgggcgcatcgaactggacagcgaagaaaacaaaggtagtacattctctgtctatctgccacaggatctgtcggtttacaaaccttccgagttagcttccaataacgaacagaatgaagaagagcaagtgtattctaccaattcgaaagcaatgtatttcatcgacacggagaaagtggaaaacgaatctgtggaatccggtgataagaagcgcggaacaattctgatcgtagaagataataatgaaatccgccgttacctgagtaacggactggcggatttgttcaacacactggaagccgggaacggtgaagaagcactggaaaaactgaaagacaacgaagtggatgtgattgtcaccgacgtcatgatgccggttatggatggtatcaagctatgcaagaacgtgaaacaaaatatccggacttgccatatcccggttattattctttccgcaaagaccgatatcaaagatcagatggaaggtctgcaaatgggtgcggatgactatatccccaaaccattctctcttgccatcctgacaaccaagatacagaacatgatgcgtacacgcagacggatgctcgataagtacgccaaatcattggaagtagaacctgagaaaatcacattcaatgcaatggatgaagccttgctgaaacgtgccatggcgattgtggaaaagaatatggataacatcgaattctctaccgacgaattcgccagagaaatgaacatgagccgttctaatctgcatctgaaactaaaagcaattaccggggaatcaaccattgactttatccgtaagattcgtttcaatgaagcagccaagctactgaaagacggacgatatacggtagcggaagtcagtactatggtaggattcaatacaccgtcatattttgccaccagtttcaagaagtacttcggatgcttacctacggagtatatcaagaaatcaaaaggatagtagtgagacatacagtatagagtcttttatagcaatcgtgttttttgtctttttccgaaagaaaaatgcacctgccttgtaccatataccacatttggtatcgcactattatacctcaaaacacgtttttttcttcttttattgaatgatgacggattttaaaatcatccatccaaacaacctaaattgtacagaacctattccatatcatattacaatgtcataacattatgacacataaaaaactaggatacaggagataaacagcttttttaaacaaaaacaacatatgtctcaacaaatttgatatcaaaaaaatcatttttgaacaaagtatgaacaacctaaattaaagaatctaattaatgaggttacatttgcaacagtaaaataacacttttaataattataaaacctaataaagtatgaagaacatcttctttatttgcttttgtgcgctattcgcatttagtggatgcgcagacgatgatgatgatctattaaccggagggaatgtagatatagatctgcttcctgatgccaaaccaaacgatgttgttgatcctcaagtattcgaggctatcaacctcaactaccccggtctggaaaaagttaaagaattctacgaggcaggcgaacattattatgcagccaatgctttattggaatactatagaacgagaaccaatgttacaaatccgaacttatctttaattaatgtgacgatctcagaagcagagcaggcaaaagctgattatgcactggtagattatcgctttcatgttaacaacttctatgaagataaggaaaccctgaaaccctattcagtaaaacaagacggaggtataaactgggagtattcaccgaaagatgcatctgatgaatatcagaaacaacttcatcgccatcagtggttcatcccccaagccaaagcttaccgtgtaagtggagatgagaaatacattcaatcatggattgaggtatataagaattggatagaaaacaatccgaagcctacaacaggacctaatactacctcatggtggcagttacaggtatctacccgtatcggtgaccaagtacaattgcttgaatacttcaagaactctgttaattttactccggaatggctttctacattcttggtagaatttgcagaacaagcagactttctcgtagattatccgtatgaatcaggaggtaacatacttatatcacaagcgaatgcattggctactgccggaacgttaatgccggaatttaagaatgcggagaaatggatgaatacaggatatcagatacttagcgaagaagtacaaaatcaaattatgagtgacggatggcacaaggaaatgtcgctccactatcatatcggtatcgttgcggatttctacgaggcaatgaaattagcagaggcaaaccaactctccagtaaattgccgtcagattttacagaaccactgcgtaaagcagcagaagtagtgatgtacttcacatatcctaattactttatcaagggttccgataatgtggtcccaatgttcaacgactcatggagccggacacgtaatgtccttaaaaatacgaactttaagcaatatgtggaaatgttcccggatagtgaagaattgaaatatatgcaaactgccggaaatggtggaacagcacagggacgtacccccaataatgatatgaagctattcgaccaggcaggatattatgtattacgaaatagttggacaccggcttctacagtcatgattttaagcaataacaagagtaatgatgcttctaattcacttagtgcttatagtcataaccagccagataatggaactttcgaactttaccataacggacgaaattttttccctgattcaggtgtgtgtacttattataccagcggtggagacaatgacttacgttactggttccgtggtatcgataaacacaatactttatcaatcggaaaacagaatatcaaaaaggcagcaggcaaactgttgaaatcagaggaaggagcgactgaattagttgtatttgagaatcaaggatatgataacttaaagcaccgtcgtgcagtcttttacgtaaacaaaaaattctttgtattagtagatgaaggtattggaaatgcagaaggtactattaatctaagtttcaatctttgcgaaggcactgccagcgaagttgttatggatacagataaaaatggagtccatacagcattcagcaataataataacattatagtccgcacttttgccaataaagcagtaacctgttctccattcacggggcgtatagcctatctcgtagacggggcttacaacacacgtcaatcttataccatcgatatgaataagagtgctgatgaaaccgcacgttacattacagttattcttccagtcaatggaagtactgatacgtccagtatctcagccaaattcatagatagcggatattccgaaaacagcgcttctgtagaagtaagtgtgaatggagagacacatacattatcttataccttataaactaataactcttaaaatatgagatctaaattactaaacattacttcaagattactaggagtcctcatagtaattgcagtgacaatagtcaatagttcctgttcggatacagaaactactgactctacgaagtttactatttattatacaggaatgactgatatcggtccatctatgacaggagttatcagtagcccgacttacaaaggcggcactccatacgattttgccattaccagaatcactcttgatggagaaccgttttccgatagcatcttcgccattgattcggaaacaggaaaaattactttaaatagtacaagcaatactcctgtcggactatacaaactatctgtcgcatgttattccaacaataacagatatgaatataccgacattgtggaaatcaacatgatgaaacctgtgcctgatggaatcaaaacagatccggagaaactacaggtagaatatgcagatattatcgacacagaaagcagcaatgaactgcccacctctcaaattagaactgaaggaaatcatatttctatttcaaactacaccattgcttctgcaatgtggaatggagttgcagtagaaagtcccgaagactactttgctgtatcagataaaggtgaaatttccatcatcaaaggaaatcaaaacattcagcctggtaagtacatcctatcattcaaactgacaactgccgcaactggagaggatcctgaaaaaggaattttcgagaatgcgttggaaatcaatgtaacttcccgcccactttcattaatatacactcctgatgaaggaaaaatagaggaagaaggagagcgtagtcctgagaccactttccaaagtaatattcccgcattaaaaggttctgcggaagggcttgtatacagtatcagttcagttagtccgaatacggataaaatcacaattgatccgacaacgggcgtattgtctgtagcggctcatcatggattcaaggatggagaaaaatatcaaatcagtgtgaaggctatcaatgaattttctccagaaggcgtagtattcgagaatgtattcacactaaatacagttgaatttatagaaccgatagctaacttcggatacgctgatgtaaacgatgtacaagctgtagaaatcgacattaacaaaaatgagaatttcaaaggtgatgaagtgaaatatgaatttgtaaatctgccaactgaccttcaaggtgaattagctcttgatctggatggaaacatcgccattaagaagggaaacaagattcctgtcgggcaatatacagttcaggttatggctaccaataccaaaggttcagagactgctacatttacattaacaatcacagcaaatccgaactattttacttatttccgctacggaaataacctcggattaactcctattgaaaactatgccgatcaattcagaattgaggcaggcggtaaacttaactctgtaaaaccggttccaacagcaacagatgccaaagatggtttgtcttcactaaagtgggaagtagaattgaaacataatcccaataatacaaaagcgactattaatgaatctaccggacagattacaataaccggattaaaacaaggacaatgtggcatggtaatggttaccgcaacagccggagaaggaaaaacggcagtttctgtaaaacaacctgtatttttccatttctcaatgatttcagacagtaatgtacaattagagtatactccgtttgtcttccaggtaaatccggcaagaggtggtgagtcaatagctccaagtttaggagcaggtatagataaatctacattcagattagactatcgccgtgacttcttctactataatatagctggtccggattcacatataagtggggcattggcacaaaaagtagataacttcttatcggaaatgtggaattcttatgatgcgacagccggtacatccagaaaaccgatgtcttactttgaaaacactactaatttaagcaaagcgttaggttacattgaccaaacagacttcaaagtacacattaacccaaatctgtggcgcaacaaagacggctacgctaacggggctatgattggtcagataacctatgacgtcaccggaaaagatccacaagctgcaacaagcggggcacgggtttctccgatatttatttggtttgatactaagttctaataaatacatgcaaaaatacacgttatgtactatacaaatataataaaatcaattagcgcaagagggttgttcaccctcttggcactgatcatgtcgatcagcttacatgcccagaacgctactgtaaaaggtgttattgtagatgaaacagatactcctctcatcggagcaactgttcaggttaagggaaccgcaacgggaagtataaccgactttgatggaaattacacaatcaaagctaataaaggtgcggttattacattctcatatattggatataagacacaggaaattaaattcacaggccagtcgccgcttaacgtaaagatgattcctgacaatcagacactagatgaagtggtcgtagtaggttatggtactatgaaacgtagtgacctgacaggttctgtagcttctatcgccgccaaagatgtagaaggcttcaagacaagttctgtagcaggcgcattaggaggtcagattgccggtgtgcaaatcacatcaactgacggtactccaggcgctggcttcagcatcaatattcgtggtgtcggcacattgacaggagattcttctccactttatattgtcgatggttttgaagtagacgatatcgactatttgtcaaactctgatatcgaatctattgaagttttaaaagatgcttcttcttccgctatctatggtgcgcgtgccgctaatggcgtggtattaatcacgaccaaatccggtaaaactggaagaccgacaattacctacaatggttcagccagttatcgtaaaatatctaaaaagctagacgttctttccccatacgaatttgttaagttacaaggagaagttaattcaaaatattcagactcctacttcaagccgggaaatgacgataatgatattccctaccgttatcagtcacttgatgactatatgggtgttaaaggtgttaactggcaggatgaaacattcaatcctacctggtcacaagaccatagtttgtcaatcatgggaggtacagatgattctaaatacaacgcatcattctcacgctatattgaaaacggtattttcaagaacagtggtttcgataaaaccacaggaaagtttcgccttgaccaaaagttaagtaaaagtttgtctttcaatatcaccgtcaattatgcactgactaaccgtaaaggtgtaggtacatccgcagactccggtcgtttcaatatgttagcgcagattttaagtgcccgtcctactgggggattaaagctgactgatgatgagcttcttgattcagctattgaccctgaaatgctcgaatctggcgaaagcttggcacaagtgaatccagtgaaacaaactgaatcagtaacaaataccaaacgcgccgaaatgtggtctggtaatggttcgataagctggcagattattaaaggattgacatttaaaactgccggaacctataacaccactaataaccgtacaaatattttctacaaagatggttccaaggaggcttatcgtaacggtcagaagccttatggacgtacacaaatgggacgcgacgtacgttggacgaacttcaataatctgacttggaaacagaaggttaagaaacacaactacgatgttatgttagggcatgaagtttctttcagaagcactgaatatttactaggcgaagcaatggatttcccattcgataacttaggaaatgattaccttggtctgggtgcaacacctagtaaagtagaaagcagctatagcgaaaaaatgttgctatcattctttgcacgtggaaattataactacgataaccgttatttactgacggcaacagttcgtgctgatggctctactgttttctctaacaaaaataaatggggattcttcccttcattttctgccgcatggcgtgtttccgaggaagcattcatgaaagatgttgattgggtatctaacttcaaagttcgcttgggttggggtattgtaggcaatgaccgtatctccaactacctttctatggatctttacgaagctagtaaatatggtgtaggcaacaatacggtaactgtattgactcctaaacaactgaaaaacgctaatttgaagtgggaaggttcaagcactatcaacttgggtgttgacttaggttttcttgacaacagattaaatgttactgccgacttctttgtcaaaaacactaaagacttattattagcacagtcacttgcccatgttaccggatttgattcacagatgcaaaacatcggtaagattcagaacaagggtattgaactaagcttaaattcgactaatattcagacacgtgatttcagttggcaaaccaacttcaatatttcatttatcaaaaacacattaaaaggattagcttcaggcgttgaatcgatgtacgcccgctccggattcgacagcaactttactgcttatgattatattgctactgtaggccaatcactcggcttgatttatggatatgaattcgacggagtttatcaaagttctgacttctatactacgccagacaatcaactgatattgaaagaaggtgttacaaacaatgcacgatatggcactgtgaaaccaggagtagttaaatataaagaccaagatggcgacggcataatcacgaccaatgaccgcacggtaattggtaacgctatgcccaaatggtttggtggtattacaaatacatttgactacaaaggtatcgacttcagcttcatgcttcagttcaactatggcaatgacatatataatgcaactcgtctatattctacacaatccagaaacggacgtagaaatatgctggctgaagtagctgaccgttggagcccgacaaatacttccaacctggttccttcacaggatggatatattgtaaatgatgtatattcccgctttatagaagacggatcattcttacgtctgaagaatgtaactttaggatacactttgccgcacaaatggactcgtaaatttcatgtatccagactccgtttgtatgcaaccggtcagaatctgttctgcgtaagcggatatagcggctatgacccggaagtaaacagcgcaagcaataccccgatgactccgggactggactggggtgcttatccaaaaagtagagtatttaca

SEQ ID NO: 71 - DNA, 38069 bp, Bacteroides thetaiotaomicron
gtataataatatgtattatctttattggtatctttctggtattgatcttcgatatctgcttttaattcaaacaagttaatcaatccctttccatcttttggataatttgccaatgtagattcgttattgcaacgtgcaaatcgcagccatttgcaatcatgacctactactgatttgtcgtcattatttgtttctccaaaaggagtttttacatagaattgcaatccatctttcacttctgagtacttgaattttaaaatcaaatatccataatgagcgtctagattatatacagtagtctgtgagtctacgatatcaccttctgctcctggagtattttccggatttccctcctctgttacttccgtaacaatatcttctacattattgatagttacattatatgtatattttttatttctttcatttttgaagtcagccgcaacattatcaacatatcccaaatgaatgacgtaagtaacgtcggctactcgtataccattgtcattgtctgcattttcaatttccatgtgcgccttaatctctacaaaggtcgcataaggttctacatatttatattctcctgtatttttatgttcattagttttgacctcttcttcacgttgtttgtaattctcgattgatctaccttcataagttttggcattctttcggttttctaacatataaaagtcgaaatcataaatgttatcagtttgttctccaaacctaatagaagattctgtattctcgtaatcttctgctgtattaccgactgcatcagcgtcttgagctactatataagatttattgggcacattgtatactctccaactttttggagtaaatgttttgatctttcctccattagcttgcatgtttggagtaatcttgaagataatatgtgagtccagacgggtgaggctaatctttccgctaagagtggttgactgtgccggaatgttacaatatccagtttgtggttgtgtgcttccatctatataagcaccactcatcacaagtgcgggcgacgaacgctccacattcgctttgattgtcaatgctacagacaactttttaaaatcggctaatgaattaacgttctctaatgctgcagtgatatcaccacctagatcgttaccttttacattggctactgcgtagataaggctttctccactagttgtttttaatgttagtgtgccggaagaaactttcccgtttgcttggttacctgtaataacattcttaatcagatcactgttatagtaccctcctccagtttttctagcctggtcgttgttggcattgaagatgaggacatacaggtcgtttacttggaattctccttcatcgcttaatccgcgagtactgactttctgcatggaaggtatagtgaatttaaatccgacctctacgggaactccctctacaatctctgatgatttatatatttcttcatctgtacaagcattaaaagctatacaagctaatgtcaagtatgttatattttttattaatttcaatatattgttttgctttttcatctgattatcctccttgcattaattaaatgacggaatattcacagttttttcttcccatatttttacttcatattctaaaataggattgacatctacttccacctttacattagtaatattgaatacatacatatagttacgaagaacgtcataatcacttccattttcactgaacataatatcatagtattttatttgtcctttcacttttgcttctatcttcaaatagagctgttcagctttatctacacctatgttcttatgttctggaatatagaatttattctcaatattattgccttgcgttccgctcagagagcctgcagacagaggtgttgttgctttaacaacattggttgggatagaaggttgaccattcgcattggtcggagcacaatatccgccattattgtaattgtgtaaacttacattggtgatttcaaagttttccaatcctttaccgtcattcaccgttacattcactttggcaatagcacgttgcaatgtaagttctcctatattatattctcccgattgaatggatgcaatagttccctctccccacatcggaatatttgttgaccagtttttgccttcataactataaaccaattgtttatataaatcagctttactgtttccttttgtcatggtaggagattgcacacccttactttccgtattcaccattaccacaaaatccatagcggttcctgtcatatatgtctctgtcagttttccttctacaaagcgggttgcatctccgttggtgccgcttatcagaatatactttactttctcaacgaattttcctcctacgaaagtgtatacttgaacatcgttaattgttcgttcgcttgctaaaccttctgatgagccatttatgcctcgtgtggaagaagtcgggaaagttaatgcgaaattgactttgccaccttctattagtactgcttggtcgttgttatcgatcggacaatcacccatgactccgtctgagacacacgatgttgccatcatgcataagatagctagcagataatatgtcaaatgagagtatttcattttttgctttattttaaagttcgatatcattgagttggatgatccagtcgtttacttggattacagttttgatgagtgccaatttctcatctacaaaaatcactagttcatatttatcttctcggtctaagtattcttgaagagaataattacgatctttatatttttcggcatctacttcttcgaagtatttcaccaagtcggaactttggaataatacttcctgagtagcagtatttttgattgtcaactccggcttttggctttccacaagtcttgccacgctcatttcgctaacgataccgttgtattgtttggcaggttcatctgcagaactaaaagctcgggtactgactacatccgatgtgacattgtatggcttgtaagtcaataagttatcttctaatagcgtgttgtcatagttcatgtaaccattattgtcgtatatggcgcattcgaaagttttttgtgtcaagcgggttacaggtcctcctgattggtttacttgtgctacaacgacacggattgtattggtattttttactaatgagacttcggtgatttgctgtctgccgctacgagtggtagttccttttttaacctctccatgccagagtgaatgtaggctgttgtctactatgtattgtcccttttcatcctcggtggtgctgcgagtagcttctttgcgtaatgtttttactcttaattcgtcaattttagcttgattgggatatagcaaagggactgcaaatgattcatcatttaatcctgcccataccaccaggtggtattgcgagagatctatatctacgttcatcgcgtaggtttcttctcctaatggctcaccttcatcggtgttctggaaaacaagattgttattatcgtcaaaagcgtaaagagtaacagttcttacttgttcggcgaatacatccttttcttccatattgtagtcatacttgaacttgacacaatattcgatgtcacaattctcattgtaatccaaaatggaatcacaagatgtaattgcaccagccaatattgtgaataacaatatgttatttgctttttcttgtatggtagttaggattcgtttcattgtttttactttttatgcttttaaagagcggatgttttgtttgaatgtgatactctcttctttcggagtataatttagggagaagagacttctccctaaattaatttattatagttgattaaagaccaacattattgatatggatagtccaaggagctatagtaacactcatcattaatttcgtttcattttcaggagttggaggtacaggtttcggataacctaaatcagcaatagaagtaacttttagttggtaccagttattgcgagcgatattagctccaacaccaaaatgctcgataggtgcttgataatagcattttcctcctgcatatctcatgatacttctgttagccaaagctacgtcgtcattttctccaataccagtaagatcaacatctgcacataattcttcccaattcttgtaaatttgaactttccatgtttcaccatcactttgtaatttaggtctgctgtagaatgttcctgctatttcttgatttccgtcattttcgaagaaaacttgtccttgataaagaacgctggtgctagttgctgtattccattcactacctaaattttcgagtacgtatgttgttcctgttgcattcaaccatctgtaatcagtctcacttacttcacctgttttatatgggtgtaagaatgacgaccatgctgcatttctaccaccaagtacataagaatcgtcagctagattagtgtatgtatggctcaaaatttgtacatacacctttggtcctacgaaagtgggagttgttaattcatatttgttgtctatagagcgctttgtctcttctgttaattttgcactgattcgttcaacgctaatgtttgctgtattggtatctgttccacctacaattgcttttattacagtaggttctccattaacattgctcatcataaaattaccagatttagctattgtttcagctatataatccaaaccttcacttggtaatttttgttttccaacctttaaattctccaaaccagttgttggtatctccataataggattaataaatgcgtaaacctttacattgtttcctgcttcaacttggaatttctctgtgctgtatattctagcaccactttcagtttgttgaccaaaggttaatccttttacaacaattcttttgtttgtttcagtgtactctaaaactgctgtaatttcagtagctgcatactcaatatctatacctgcatttgtgccaccatctgatacaactctagttgtgggaaactggaaattgatttgcattgctgcattttcaccatttgtttggattccatcattgtcaatgatttcgtcattgctacaagctgtcatggctgctactgccaaacctgctaataataaattctttactttcattttagttttgattttaatgtgtgatgctataattcttttttttagggtttgcatattatactatgtatgtataatacgctaattgttttttcttttttttaggagagtcatctaaaggatgagggtcgtttgttttgttaaaacatcattttctttttaataggaagcccttatattatataaggaaaaagaagtaacttccgagaggaatgattttgtttgtttctaataggcaatgtttctttaattgtttatatactaattttattgttttgttcttttgtttgtttcgcaagaaacttttgttccttatcgacattgcaaaggtatgggagaaatgcgaaatcgttaattggtgtttttttcaattttgaaggtgaatttttcaatcttttaaatggtcttttgaaatgggtgaattgatcgttttttgaatgattttttggttaaatgaatgttttgccgcctatgttttctatttaccgctgttgttgttttattattttcttcaactattttagatatagcgaatagaatttgcagctaatgtatggggagttagtgaaattgtgtttcgttcattccgttttgaatgatttactactgctttgcatcacattgagaattacagtaccgattagggttcagattgttcagctttatcatgaacctccttgttcatcgatattccggctgaaagtactatcctaaaaactggaaatatcgctttcagtgctttcagccgtgttaccaaattcaatcatcgtcttaccaccaaatatacattcccatattccgtatgcttccgttctacccccatttttatcaatacttgtgcaaaatggttcggattgaaacctcgtagagcagcagcattccgtttcttcagttctttataaatatcggcggcagaaagtcgcagatatttctcttctgctgaggctgaggtgcggaaacaactgagaaatacttcttcggcagggcaagtacggtaaaagggggcacttggcaatagctgcgttgtttggcgttgatacactctcttttttccgaatgcaataagaatatgctgaaatttactctttcctaaaatcgattgcttatctttgttcttttgaaatatattataataaaatgaagatatgacagaacaagatatatataaactgcttgcagatggtgagcgtgttacgcttgaatgcaaaaaggcacaaaatggtgtgccaaattctttgtgggaaacatattctgcatttgctaatacgaatggtggaattcttttgttgggggtatatgaaaacgtagcagagaaagactctttgatgagattcacaatcactggtgttgaggatgcagacaaaatacgcaaggatttatggaatactattaacagtcgtgagaaagtaaatgtgaatctgctacatgatgaggatgttcagacgattagcgttaatggtaaggaggtaatagcgataaatgtaccacgtgccgattataatttgcgtcctgtttacattaataacaacttgatgcgtggtacttatagacgcaaccatgaaggtgattatcactgcacagagcaaatgataaagatgatggtgcgcgatgcttacgaggatggcaatgatcgtatgttcttggagtattacacaatggatgatattgacatcccgacattagagggttatcgtgttatgttcaagactaataatccagaacatatttggaatagtcttgatcataaggagttcttgatgcaacttggtggctatgttgtaaaccgaaaagatggtactgaaggtctgactatagcaggtcttctgatgtttggtaaagggttgccggtacgtgagcgttttgattatctgcgcatggactatattgacaagtcaaaccttataggtgaccaacgttatagtgaccgactgacctatgacggtacatgggagaataatctgttcaacttcattcgtatggtagttccccgtttgacgcgagatattccaaggccattccaaatggatggcattatccgtaaggatgatacaccacagcataaggcagtgcgtgaggcttttaccaatatgattatccatgccgacttaatgctgaatggccttcttcgtgtcgagaagtatgatgaccgctttgtgctttccaatccaggcttattgaaattgcctgttgaacaaatctatgctggtggcgaatccaaagctcgtaaccaacgaatgcagcatatgctccgtatgataggttacggagaaaacctaggctcaggtttcccgctcatccttagtgcgtggaatgagaagcattggctgaagccggaattggttgagcagccggaactgatgcaggtgaaactaatccttcatattgagaatcgagtgtatgtcacgaaagatgtcacgaaagatgtcacgaaagaactaacagaacgtcaacagattatacttgaattcatgcaagctgatggaactataactatctctgaaatgtcccaaaagacaaacgtgacagaacggactattaaacgtgatatagaatctcttacagagaaaggtatactttctcgtgaaggaggacgcaaagaaggtcgatgggtaatccgtaaaatttgatgatataggcacattatataagataatataatgcaagtgaaattcatcgtcttaccaccaaatatacattcccatattccgtatgcttccgttctacccccatttttatcaatacttgcgcaaaatggttcggattgaaacctcgtagagcagcagcattccgtttcttcagttctttataaatatcggcagcagaaagtcgcagatatttctcttccgctgaggctgaggtgcggaaacaactgagaaatacctcttcggcagggcaagtacggtaaaagggtgcattattctgttgtatttcacgttccgtttctttgtcgaaccaatacggacacccgtcggcaagctccgctttcagttgggcgaagatctgttcatgctcgattccctcacaatttatcggcttttctacttctacacagaagaaacggcggctgcctgtcgggtcactcatcagatcggagcggttggaagttccgatgaaagaagcgatgcgcggcaagtcccggaagttacgctgatacgctttgcagacgtggagactcgacatttgcattaaattcttcagaagcggcattttactctctgcatatttgtcgaattcatccagattgatcagccccatttctgacagaagacgttctgcctgtccttctgatgtcagtttgagattatccatatagtaacgttgcagtactttgggcatcagcgatttgcagaaagtcgatttcatccgtccctgttcggcactgatcaggatgggagccaggctgttggcatggacacccgtctttccttcccattgggcagccagtcccagcatccatgtgtggaatccttttacccatagaggtagtgcagatacacgtcgggcaagcggagtcaaccggtcgatgccgtcccagggaggaagttcgtccatataaagccggaaaggatgatactctccgatttgtgtggaataaatatatcggctcacatctttatcccagcaggaaatgccctctgcatgagcctccatgcagagggtgttcagttcacgttttccgatgggacgaaattcggtctttgctccgcttaatgggcgaaattctgtttcttccgtcaggcggttgtagcggaagtcatagtgagtttgcagaaaggtgttgacccgttccgtcaggcaggcggagttgttgggggactgctgcttcggttcgggcgttgcgggaacgggaggtgtgtcaatctgtgatacgctctcttttttccatgcctttatcagcatggcgatcatttgggttactttttccatcatatttgttcttttttttaagtttcgtgcatcaaagttacaatgccgggatagcgatttgcaagtgttttcgatagattcctttaaatacttccgtttatgaaataacgtaggaatcattaggttttcctgcctttctgttgtatctttgaaggcgcaaacatcagaggctaatgcagattagctgatcagctatccttcattagtcaatcggctaatctccattagccgggcagccatagcacattagccgatgaaaatgaagcttctttcatcggaagtttccgtaggaataacagattagaagtacttatttaataaaagaggaagctatggctatattatttgactggtatgagaacccggtatcaccggatcaaccgaagaaaaaaagattccatccccgcattgcttacaatggtcaggtagatacggacgaaatgaggagtaagattcaatcccgttgtacgctgaatgaagtcgatgtgactgctgtactggatgctctttcgcaggtgatgggagaggagttgggagaaggacggcaggtgcatttggacggcatcggctatttttaccccacgctgactgctacggaagagatagccgccgacactccacgacggaatatgaaaatcaaactgaaggctatccgctttcgttcggatcagaaattgaaaaactctatcggattaattaaggtaaagcaactgaagaagaattttcattcgtccaaactttcggaagtagagattgatatgttgctgaaggagtatttcagtacgcatcagatgatgcagcgcagagatttccaatctttgtgtggcatggtacgttctacggctatgattcatatccggagaatttgccaggaaggaaagttgcagaatctcggattgcgtaatcagccgatctatgttcctgttcccggattctacgggacatccagagatcagccgacgctccggtaaattcccggctgaaaggactgaaggctgaaagggtgctttttcgggggcggctttcagccgctttcgcctgctggcaggcggttgtggcggatggctgaaagggctgaaacgcttgaaaataaaaaaacattccatgaatatttatggggctttttttatttttgatgaaggcaatatcgtgatgttgtttaatggctttcagaaaaagacacaaaaaacgcccgaaagtgagattgaaaaggcagtaaaacttaaaaatgaatattatgcaagtaaaccctgacgttggaagtatggatgctgtattagacaaattgtacggcaaggtaggtaccaacaagtcctatatatctagaattgagaaaggagcgcttgagccgggagtcggacttttctttcgtatcattgatgcattgggcttaaaagtggagattgttaagccgatgatatgatgattatgatataaaaaaaacgcactgccttctcaggtggtgcgtttgtgttttggggtaaaattgtttgttattattctttgggataatttcttatgctttttagttgtttcatattggtgtcagcctgagtggtgagtccaccggcttttgctgcattgaaatatttctctgccgcatcgtagtcgccttccagcagtgcgatgactcccaggttattcagcgtttcgggagctttctgatcagctttggcaagatgcttcttcgctgttgtcaggtctccgcctttctgtatttccatggctcctgcattcagattggcaatagggtcatccgggaacatggcggctgctacctggaacgaacggttgaactcttcgcttcccggctgacagctttccgcaatccgatagatttcctgtaggctcaacagttgcggacgtgtcttgataatctctttggtttcttccagattgaacccgcgtacggtatagttgacggtatagtctgaatgacgcaaagccggataacattcttccaatatatatttataagtttgaggacctgccaattgagcgatctggcgttctttcttgtctatgtccagtgtcgagtcatccatcagtttcagtatctcgtccttcttctccaatgaagaagctgcgataaacttgcggaatccttcccaatcttcagaagtatactctgaagtgatcagtttattgtcgaacttgtaataactggtcacataatctaccaatgcctgtgtacgaccttttgccagtcgggtattgttggcatatccaccttccggtgatgcataaccgtgaattcttatactgctgagcgttgtcttgtcatcattacgtacactgtcaatggtagcacgtatcttggccagctctactgtgttgcgacgatactccggtcggatgataatttggttcaccgggaagtcgaggaaagcgcttccttctatggcacggtgcttgacggcttctgcctgtggagtgatataggatatagcgggctgtagctgcacgggtaaaatgttcaatcgggtgattaattcaccgctggtctcctctttcaggtcgcagcagccgcatacatcaatattcagtttcatttccgcatcacgcatccaggcttcgaactggaattgctggtggtagttgataatctgttctttattatgcttgcgacggataacactgtaagtattttccgaaggagcgatgttattgcgttggtttactacttcacgtttgcgaccgtaaactacgatggaaggtagtatcttggtgcggccatttgattcgaggaacggagtgagggtgacgacatgattggaggagagcttcagattctcctgcatcacgatatccatatcgatgctcagcacattgttatcttcattgcgtgtgatagattctttctctatacgcacctgatctctataaagtgtctgcgctttcccgcccaatacaggcagcaggcaaaagagtatgcataatatctttttcatatttgttttgttttagaataaatagattaaactgatagcagctttcgtgggacctaaatagttcttatgtccttcgctaaccttctcaccgcacgtcttgcattcgaactgctcatacttgacacgtgcgtaacctacaccaatattcccttccagattccaatgcttggcaagaatccattgataaccgtaggaaataccagcaccgaagaaattgcctttgaagcggtggtccttcagttccggccagatgccccagggcatattgatggcggcagcctggtagacgcctccatgtacatggaatcccacaaagtgtccattgaacttgtcgcagaaccagtaacggagttccggctggatggcgagcatcttcatcatcttctgatctttgtatttccacggattatagttggcatacaagtccagcgttaacttcttactcagaccgacttcggctccgagattgataattttcatcgcgtccattacaagattggttttcactccgactacctgactatataataaggtagaagcaaacaaggtaacgaacaaaaataagattcttttctttttcatcgcatgatgggttttgtttgttgatgttgcaaaagtaacggttatatgaatagacgttaattggtggattcatctttcttctctttcctttcaatggaaattaataagtggggtggtatatcattctttttataggtggcatataattcattggtaatgggtggtgtttttaccgctcgtattgaatgaattgcagatgagcggcgatttgatacttgcatatcttattcaagtgcttgaataagctgtatttcgttcgttaaagagtggtaattcattcattttgtctcctgaaaaagttttttctattgaataaaacgcctatgtttgcagtgtacaaacaaacaagaaaagataaataagaaaacttaagtttaaaagattccctcctaaggaacatgaacagataaacaatatgaagtgtaagaagcggacgaaataacaaacaacagttcgcaaacaaattaaaaaaacaaataaaatttaggaggtactaatatgaaatcaattaaattctttttcgcatgtgtattggcattaacttttgtagcatgttctaatgctgaaagtgatagttttgaagacaactcttcaaactttgaatccatgatatctttatatggtatacaatctgcaactgttgactctaaagtaggtgatgtaccttctgtgactgcagaagaaatggcaagtgtgcttgaagcgcttcgtcagaatggtaatactatccgtaactgtgaatcggaaactttggaaggatactacgaaggtggtgacagaaaagaagtgaagatgatcgcagaatatcaggcccgtaccagaagcggtgctttcgtagaacaattcgcattgtgtgtttccatcaactttaatattgataataacggcggagtattttatataggtactacatactcttcctcgactgacctgttcaactggcagggttatggagcttccttatctactactgctgaaggaaacagtgtattcagctcgacttcttatctctatttccgtgtaagcgaccagggtaattgcctggttaaggtacccgtaagctttaaaggtagctacaacttcaaggataataagggaacttatagctttactctttccaaagcagctaattaatacaacaggaatttattgattttaggtattacgttacaatatatacaacttatataaaagggctccttgcgccgtgcacggagattccatcagacaaaaagaggaaccagacagcaaacaatatagctttggtcattcaggcaattaagaaacaaacaatgggaggcccgccgattcttttacgaatcagcgggcttttactttattgtgaattattgctaaaaaatatttgttatccgatttgctaatgatttaattatatatctttatcagccaatacacatgaacaaaatacaattaagatatgaggaagttcttctttctgttgttgctgttgacggtttttcttccgtcatactctatagatacccactgggacctagaaccgcaaataattaaaaacggagtcggaaataatactatttatcatgtttgttacggaagcgaaggctttatgtggttctctaccgacaagggaatctcccgctacgatggcttcagatttcgtgattatccgctcattatgagcgttgactccctttccactcctttgcatcaggctgtaaaaacgctgaaggaaggttccgacggtttattttatgcttcactctatcaggggggaataacctgttttgacaaagaaatggaaaagtttttgcctgtacgttttgacaggtcgctgaaacttaaagagattcaggatttttgctggaatgatggcagcctgtatctggctacttcgcatggattgttcgaatcgcgtcccatccgcaaaaaagaaggaaaagaagatttcgtctattgtatattgaatcccgaacctttgataaaaggaaagattactaatctttgcacggatggaaaaacaaacctgtactttgccgttgaccgcgaaaaggtgatacattatgatctcgtaaccaaaagaacttctgtgatcagagaatatgatgtggtgaacagactctttttgcgacagggatatttatggatatgcagattatggaatgatattgtatgttatgaccttaaatcgcataaggaacgtgtagtctctctcgaggggggcgaccagccggatttctccaactcgtatgttacagatatggtgatgaaagataagcagacgttttatctgacgacatgggacggattatataaattgcattttgagaatctgaatttgtgtgagagtccgtttacattgacactgctgacacagggggaaagagcgttccattcaaggatcgaaaataagatgaccagtctgctatgggataacaggcagcagattctttgggtaggtacctttggcgggggagtggtaaagtttgatatcagcgacagtatgtacagccgggtacggcagaatttcaaatccagagtggatggcatggtcgaagatgcaaaagggtatatctggttgacggtgaccgatggaggcatcatgagaagcactactccgtcattttcgatggatacacattttgaaccatggaaaaaagtatccggtctctccggacgttatcacatatataaaggtaaagatggaaacatttggctgggtaacaattttggagagatcatctctgtcaatccgcttacggaagacgtggaatcttttcagttgaaaaacagcgaaggcgggaggatgcaggctgttgtccattgtttctgtctggattcgtggaatcgtttgtgggtaggtacttcgaatggactggtacaggtagatcctaaaactcacggatgcaaaaatataaaactgcccggtgaaatcaagaatgtatttgccatcactgaagataaggaaggaaatgtatgggtaggtacggataaagggctgaaaagaattgaaacgaacggtgaccagatacgggtggaaggaaactatgaaaaggagaatgggctggaagaagccggagtgcgaaccctgtatgtgaataactataatcagatttatgcagcctatctgaacgtcgttattcgcatcgacggaagagagaaggataagatagaatctgtttatacactacagagtggattgacggacggacatgtcagttgcatggtcgacgaccatatcggaaacacatgggcaggaaacaatgtaggagtgatgaccatcagaaatggacaggaggctttttatagttatctgtcggtgggaaactgcagtgcagtctgtcgtttgaatgacggacgcttgttatgggcgaattcctgggggctgattttctttgatccttctgctaccaaaggcgatagtggcaagaagcatttgatgctgaccgatgtggaagtcggtggagaaacggtgctggcaggagaaaagcggaacgggcagatgattctggctgtttctccggaaaaacaggagaaactggtgtttgcttccgataacaacgactttcatttgttcttttccgatctgcgttacggactggcacagcgcaagattgcttaccgtctgcttcctgcggacaaagaatggaaaatgataccgcttgcagaaggactgtggttcaacggattggctgccggaaaatatgccttgcaggctaagctggttttcccggatgggaaagaaggggaggtaatcgagattcctctggtggtgaagggtaaatggtatcagactatatgggcgtatatcatgtatgttctgttacttggcggattatcttatttcttctattcttatttcagaaagaaggatcagcgcaaacagattcatcgtgaccgtgagatgatactgaaggagaatctgaatctcgaaaagctgaaacaggaacaaaaaaaagagatagaagcgatgaggaaccggttgctgatgctctttgtgcaggaattgcgtacgccgttgtcactcatcatcgctccgctgaaggaattgcagaaggatgacgctcagacttctcagctttctctacaggtggcgtaccggaactcactccgcatggtggatgcctgcgaccagttgctggcagtatacgggcagggcaatatggaatcaaaactggaagttgctccgtattcggtggataaaatgatcgacagctctctttttggtgtccgggacttgttgaaggtgtataccattgatttccattgcgagaagagaatcaagaaggagatggaattttatgtggacaaaaagaaaatagaattcgtcattcataatctgttgacaaatgctttcacccatacgcattatgcgggaacggtttctttatctgtttgtgaggttgtaaatgacaatatgcactatgtctgcctgatagtagaagatgacggaaaagaaagggtaagaactgttgagcagttgatgagcgagaatgaaggatcggaacgtgatatgtcggctgcgcaaatgggattcaccatcatgcaacagatgatcgaagctcattacggaacgattactcttgaaagtactgaaggaaaggggacgaaggtcacggtcaatcttcccgccgacagagatgtctttgaaaacaatccgaatattcagtttattgatccggaagaactgacagaagtagcagagctggaacccgaatcggcagaaacacagaaacaggatttggcagtagaggatgctgtggtgcaacaggatcagcaactgccgctttttgcggaggcattgcctgccgaagaagtagcatcccccgtagcgggcggagttaaaaagacgatattgattgtagaagatcataaggatatccgcctgtatctgaaagtgctcttcggcaatgaatataacttgttgatggcaaccaacgggcaggagggagtcgatacggcaatgaaagagatgccggacttgatcatctgtgatgtcatgatgccggtgaaagacggtttcgaatgttgccgggaggtgaaggagaatccggaaacgtgcagtattccttttatcatgctgacggcaaaggtagaagacgacgatattattcacggactgcagctgggtgcggatgattatgtactgaaaccatttactccgggcattctgaaggcgaaagtcagcagtctgattaatggtcgtcagacgttgaagcagatgtacacgaagttgttcaaattgccgggaacggatacaattgtcgtgagcgaaccggaacaggcgggtgaagaagtgaagacggaagatccgtttatcacagctgttatcaaaattgtggaagaaaatatttgcgaggcggacttcagtgtgaagaaactggcagcggaaatgaatatgagtcagcccaccctttaccgcaaagtgaagcaaagtacagactataccattatagaactgatcagaggagtacgtatgcgccgtgcgggagtgctgttgaaaacgaaacaatatgcagtgcaggaagttgccgaaatggtggggtataatgacattccgactttccgcaaacattttgtggatgcatttggtacgactccttctacgtatgaataaaaaaatgactacttttgcagtcgaaaaccctaaaatgaggaatcggcgtgcaaaggtattttatttatttggcttatgatggaaccaactatcacggttggcagatacaacccaacgggagtagtgtgcaggaatgcttgatgaaggctttgtctacttttctgcgtcgtgatgtggaagtgataggtgctggccggacggacgcgggggtgcatgcctcgctgatggtggcacattttgatcatgaagacgtgctcgatacggtgactgtcgccgacaagttgaaccgtctgttgcctccagatatttctgtctatcgtgtccgtcaggtaaaaccggatgcgcacgcccgttttgacgcgactgcccggacatataagtattatgtgactaccgccaaatatcctttcaaccgccagtaccgctaccgtgtctatggttcattggattatgaacggatgaacgaggctgcacgaaccctgttcgaatacattgattttacaagtttcagcaaactgcatacagatgtaaaaacaaacatctgccacatctcccatgccgaatggacgaagatggaaggcgaagacaccacctgggtatttactatccgtgccgaccgctttctccgtaatatggtgcgtgccatcgtaggaacattgctcgaggtaggacgcggcaaactgaccgtggaaggtttccgtaaagtgatagaacaacaggatcgttgcaaagcgggaacttccgctccgggaaatgcgctcttccttgtcaacgtagaatatccggaagatattttctcagaggaaactaaaaagtcagtactatctacactccttcccgaaggaggggagtgttagatactgccgacttcctagtcagctcaatattacttgttacttattacctattacttatttcaacatgtggttattattagcttttctctcggctaccttgctgggattttatgatgtattcaagaaacagtcattgaaagataatgcggtgttgcctgtattgtttttgaatacgcttttctccagtctaatttttctgccgttcattttggtatcggcattcgagcctgatctctttgggggaaccatctttaatgttcccgttgcaggatgggagcagcataaatatattatcatcaagtcgtttatcgttctgtcatcgtggatattcggttacttcgggatgaaacacttgcctattaccattgtggggcctatcaatgctacccgtccggtgatggtgcttgtaggagcaatgctggtgtttggcgagcgtctgaatctctaccaatggatcggagtgatgctggcagtggcttccttctttatgttgagccgttcggggaagaaagaagggatcgatttcaagcataacaaatggattctctttattatactggcagcagtcatgggagctgtcagcggattgtatgacaagtttctgatgaaacagctgaatccgatgctggtgcaatcgtggtataatgtctaccagttctttatcatgggaaccattatcttccttctctggtggcccaaacggaagacgaccactcctttccgctgggactggaccatcattctgatttccgtattcctttcggcggcagactttgtctacttttatgctctgagctatgatgactccatgatctccatcgtttcgatggttcgtcggggaagcgtgatcgtatctttcattttcggagcgctcttcttccgtgaaaagaatttaaaaagcaaagcgattgaccttatcctcgtgttaatcggaatgatattcttatatttggggtctaaataaaaagtacaatatgaaatcaaataaaatcactcataccatcgcatttttcatcatcggcttgtttacttttgtctcttcacaggcgcaggaagcaaagactctttttatcaacgttccggattcactttgtcccttgcttacgaaggtgaaccgtgaagactgcatcgactttctgagcagtaaaatgaaagcacaggtggaaaaccgcttcgggcagaagtcggaaatgaccgacctgagtaaggactatatccggatgcagatgactccggaaaccacttggcagatgaaagtattggctttgaatgataccacgaatgtgatttgtacggtagctacggcatgtgctccggcttgtgacagcagcatccgcttctatactacagactggaaacctctgactgccgattcattcatcaccctgccggtcatgaacgattttctgcttactccggactccactgcgatatacgaatttgacgaggcctcccgttctgcagacatcttattgatgaaagtggatatgaacaaggaaaatacagaactggctgtcactctgtccactcccgactatatgtcaaaagaaacggcagaaaaacttaaaccgtttctccgccgtcctattgtttatcagtggaagaatggagcgtttaccaaataaacagctccgccccatttccactaattatccattttccattctccattatccattaaccaagcactcattgatgaatgccaccatctccggtgtatgttcttctacgctttgaagtagtttgaactgtgccttggtgcgcaccagattatgttcgggatatttgattttgtagtaagtatctccgttgatataatcggcaaggaaccgtacgcactgcatataggggaataaagcggcagcataaggcagattctctatttcaatgggagtgaggaacgatttggcacctttcagatatcctttggtgaatgccttgaatatctccatgttgaagttcacacgattcaggtctttgtcatcttcatctccggtgttggcacctgtacggaggaaatcaccgtagtcggagaagatgaaactcggcattaccgtatccaggtcgatgacgcaaagcactttcccgtcttcatcaaacatcatgttgtttactttcgtatcgcaatggcatactcgtttcggaagctttccttcgcggaacaggcgttctgccttgcacatttcgtccgcacgtttttctatctcgtccagataatactgtacttcggctactcgtccggcagcattggcagcgactgcatcacgtagctgtttgagacggaattccatgttatggaagtcggggatggtttctcccagtgtttccggaatgtcggcaagcatagcctgaaagtttccgaaagcctctcctgcataattggaatattccggattgacagtctcgtacgttttggcacgcggaatgaataccatgacacgccagtagctttctccatcaaaccaataagtttttccttcttcagtggcgaggaaagagagaactttgcggtcgatgtcggcttctccggcttcggtcagtttcttgcgaatatgtccggtgactgcggcaatattggattgaagcatttctacattctggaagatggcatggttgatgcgttgcagaacgtagtcgggggcgtctgcttcctgtgtgttaactttgtatgtgtcgttgataagtcctgctcccaaaggcttaatctctgtgatagtaccttgggtgttgaacttggctacaatacttgataaatctttcatgggtcttttctttaaaatttatactaaggttatcgataatcatatttggcggcttcggtagcctgactgccggaacggactggtaccagagtgaacccccagttgtattcgcggttggcgggaatctggtggaaaggttcgggacgtgccccccaactatcataaccgcctactccctgttgcttcatgtcgacacaaacttcgacgaagtctcttggagtgacgtcgttgacgtgatgcatccggcgcaatacattgcgggcggccttctcgtcgtggttggcagcttcttccgggctgaagttattccattggtaggggtggggtagcgcttcttccgagtcgaagtcctcgacggaattgcgcagtgcgttgaaaccgatcaggctgtcggcaacgatgacaaggccgtttcctttatcgggagacaggttaagccagcgcgtatccgtgtggtgtccgttctcctgaggacgtacatagttgaagtacatcttatcggcggttgtctgatagatgcctaccatggttccgtgattgcggtcgatgtagttttcttccggaccacgtccgaaatactgtacattattcatctgtgccggtaagcggaaacgtacaccgatgcggggaacttccagcttggaagcggctttgcgggctgcatcacttccgggagtgaaggtagccatgcgggtagcttcggagacttctgtttcggcagcctgcatatcggtagaagtaaattttgcatttacatgaacgattccgcttgggtatatcttataggtgacaacatacagattgccggctgccagcagataagttgcctgcaacaggacggctttgtcttctgtgcttaccttcgtgtctgtcacgtggaagtctttgctggactgtttccatacgtggaggcgtttgggagcaccgtttccgtaatcattgtcattaggcgcacgccagaagttgggctggatgccgaatccgtctttgaagtattcggttccatccactttgtatgaggtaaccagaccgctcttcttgttgaatacaaaatttacttttgaagaagaaacagtcagttcgtctccttgggtttgagtttgtaatgcggggccgttggctttgtacgtattcctttcggcttcaacgggcagacggaactggtcatatgcaatttcgtatccggcgggaatcagcggttccggttctacggctatcacactgaagttaacgaaatattccgttcccggacgggctttcagaccatttaccggtacggtgaattctttcgaagcttgcggagcgatgtccagtgatacctttccgcttttgacggtttttccgttggccagtacgctgtaatgtatctgatactttttcagattggtgaagtagaaacggttcgtgatgttgaacttgcccgatgctgcgtcaatcgcatcgaagccgacattctgatgcacgtatttcacttctgccattgccggatgcagaccacggtcggggttaacaagaccgttgcagaggaaattaccgtcgctgggtgcatttactccgaagtcacctccataagcccagtattctcttccgttcttgtctttctggagcagaccctgatctacccagtcccagatatatcctccctgaaggttcggatatttatagatagcctgccattgtccccagagatttccggtagagttgcccattgcgtgtgcatattctgacgggacaataggacggtcgctgccgttcttgccgatatcttccagccagccggcacccggatactgaggtacgtacatatcggtgttccattcccattgtgcacgttcatagttgacgggacgttgcatgatgttcttgtcggcttctttcaaccaaagataagtctggtagaagttgtatccgtttccggcttcatttcctaacgaccagaaagtgacgctggggtagttcttgttgcgttcgaacatattgattgtgcgatccatgtgtggtttcagccattcgggattgttgcctaatgagccgcctttacgtagatcgtagtacataccgtggctttcgatattggcttcatcgtacacgtaaagtccgtattcgtcgcaaagttcatagaaacggcggtcctgcggataatggcagagacgtacactgttcagattatgctgtttcattagttcgaagtcccgacgcatcagttcttcggtgacgtaatgtccggtttccggattatgttcgtggatattgactcctttcaatttcagcggttgtccgttgataaacaggcatacataaggttttccgttggcggctttctgatcgataggtttgatctcgatgcgacggaatcctacgttgaaagggataatctcattgactttaccctcttctttgacagtcattaccagcttgtaaaggttcgggtgttccgatgtccatgtgtgtacatcggtcagattcttgtcaaaagaaagggttcgtgtctcgttgacagggacataagttgtcttctcttcggtggcaactacttttccctgagcgtcgagcagttcatatgccagtgtcagattggttgcagccggacgatgattgcgcaggtcgacgttcaaagcgaatactccgttcttgtaactgtcatccagtgtcgatgtgatgcggaaatctttcagggcggctttgggctgtgaatacagataaacatcccgttcgataccgctgatacgccagaagtcctgacattccagataagaacctgtgctccaacggaagattttcagtgtaagtacattcttacccggtttcacgtatttgttgatcaggaattctgcggggttcttggaatcttcgctgtatcctacttcttgtccgttgatgtatacatatacacctgatttcgctccggcgaggtggaggtagatatcccgttctttccaatcggcgggaatatcgatgtcccgacggtagactcccacgggattggcttccggaaggctgggaggctgcggattacggggcttgaactcataaccgtggttggtgtagatagccactccatacccttgtacttcccagttgcccgggactttgatatcattccaggagtccgtgctcacggaagggtcggtgatattggcgggaaggtctttgtagctgtctgcgaagaagaacttccatgtaccgttcagcaactgataatagttgcttttttcaaacttcccggtaagtgcatcagtccggttatcgtacgtcatgaaggaagtacgcggatattctttattgaccgatacaacttgcacatcctgccagtaaggtttgtcggatgtcttttcggccatagcgcctgttgttaacagagagaatattcctgccagtaataggtgatatgatctgtatttcatgtttttcaatcttgtttctttttttatttaactttgatatggtcgaagccttccccataaactccgataacggcactttgcgatacaaatgcgttggggtcgatatctttaatcagtcggaagatgatggtagactcccgctttttggcaagcacaaacatcattttcacttctctgcctgtgtagaagccggttgcattgatgatcgtcactccacggtgagggtattcgttgatgtgtcgtcctatctcctcatatttattggatatgataaaaaactggacagactgacgtgcgctgttcactacctgatcgaggacgaaactgcaaatgtaaagtgttgcaaatccgtataccaccttctcccagtccttcagaacgaaataactggaggtaatgatgatcatatcgcagatcagtatgactcttcccaaggttatgtcccggtatttgttgatgatggcggcaatgacgtccgtaccgccggtgcttccgttggcgcagaacgcaactccgataccgccgccacagaacgatgctccgatgacgcatgccatgaaaggttggtcgcgaagaagggaaacgcctgatgccagttgctggataacggacaggaagaaagtcagggtgaatactccaaaaatagttttaatacagaactttaatcccaataacttaagcgcaagcaacaataagaaaaagttaatgctgaaatatgtatactgtaccgggaatcccgttgcccaatatacaatagatgcaatacccggcactccgcccgtcgtaatgtcgttggggagtaggaaaacggtccatccgatgccataaagtatcatacctacggcgatcatcacataatctttggcttcccgaaggatagtctgtctagagggttttaaaatatctgctttcatataggtgattataataatcagtaaagtgccgaacatgaacttacggataacctgactttttcccagtctggctatccgtaagtttatatattaataaggtataatggcttattcggcaaaagcatgtctgtaaccttgcactttgttccatccgccacgggtgaaatcaggaacttctaccggagcagaaccgttttcgatggagagtctggtcagttcggccatacaacaccattctgcgaggtcgtaaacgtccatgtccagtggcaaaccattgcgcagacagtataccagacgatagtccatgatataatccataccgccgtgtccacctactttcttggcagtttcttccagttctttgtgaataggatctttgtatttagccatcaatgctttttttacatcttcagatacagaaccgtgtgcgttcagcttttcgtgattcggcacatcattagagtctacttgtgtaggtctcagacagtattcctcaatcggatatttgctggcatagccatcagctccaactacctggtacatacggctgtaaggacggggagtcattacattgtgctgtatcagcattgttttgccgttctccgtacggatgagggttgtggtctggtctccgttctggaagtcttttacttcttttccggtagactttttaatgtatgccggaccgttcacagctttggtgtccatagctacgagagttttcatacggtcgccacggtgaatattgagtacctggcaagccgggcccataccatgagttgcatatacatcaccacgatgtttctgattgtagtccatacgccagttgttccagtaatacggccagaagtcttccagattgtgtatataagcaccttctacgtgaagtacctcaccgaatacaccttgttgtgccatattgagtgaagtcagttcaaagaagtcatatacgcagttttccagttgcatacagtgtttgcgagtcttttcagaagtgttgattagcttccagatttcatccagtgtcatagcggcaggtacttcgatggctacatgtttgccatgttccatagcgtatacacccatgtctgcatggtgtttccagtctgtagctatgtataccacgtcgatatcgtcacgttcgcagagctttttccatgctttttcgtctcctgcgtaggaagctgctttcggcagaccggctttctccagtatcttttgagcattttcaacacgttcggggagaagatcgcataaagctacaatctgagttcccggaatatgtgtccagcgttcaaccgcaccgggaccgcgcattcccaatccgataaagcctacacgaaccgtttcaagtttaggagtaacgagttggattacatcttgctgatttgccggacgagccggagtttctactttaatcggagagaactttgcttttgtcttttgagcaaaactggtctggcaggtcaacaatgcaagaccgatgagtgtgttaagtagtagtttcttcatctttcttttaatttttaattgggggttattaattggtttttcatttcggtgtcaaaaatactaattaattaatcaatccagtgtaattattgtagatattttcattgcccgtctatatttttggtagaaaaagagtcgcactattcgctatgttataatgatattttcggcatcgcccgaacagtgagcgatgccgtttctacatctgtaatgtgtgttaagttaaattattcttataacagaatacgttttccgtcagcttgtacggcatataatttggcattcaccatcaatatagatgaaggaatctcgaaagtcgtgaaggtagaaaaataaagtaattttccattttcatcattctctctgagttcaaaagccacagcttcatctccgttttggatggagaccttgcgtcctgccagctctgccgtgatagctttggttatcttctgattttctttgaattgagtgtaatatccgacatctccgactgccgaatagcggtagtcattcgatggaaactcacttttctttctgtcttcaatgtattggaaagcatgtttcggggcagggaattgtgccatgtattcttttgcttcccgaatcatcgcatcacttacatagtatttgtatgttccatactgttcgatagtcgtattgacaggttcgaagaatccccacatctcgaaaaagtctgtcaggttctgattggcggctttacttgccattttggcaaattcaagttgctttttcccgggatcttcaccttcggtcatattcacttcacgcatcagtttgaaaagtgtttgccagaaatctgttttatattcgcatcggtgatagtaaatccatagttgccagttcattctcatatgcgtttctgtgtcttcgttctggtgggttgcgtctcccatattataccaagcctgcccgttggcataacgggcggttgcaacgcttcctaacccgttaccacgcgatttgtattttcctaatttatagataatgaaattagagaacagattattagatgattcggtagaactggcccagttaatagctgcctgatgaacatggccaatttcatgagctggtccccacgcgttatcttccgccgccattacattatcttccaacaagatattgcctaagtaggtatagacaaatccgatttgatagtcagaagcccacatataacttccttccggtgagatggcaaataaatggttgttgacttgtgatgggcgtacatcgtcaattcccattaattcttgttgccagccgacaatgttatcccatagatggatggctgagaggatgttgttgggtacatattccaataatttgttgcggtggaaatagaacatgatcttttcaccgcgtatgcagaagtatttgtgtgttgattttttcaataattcagcgtatttttcgtctgtcttatgttctttcaggtcgaagaaaccgttcactgtgccacttccgagtggtatgtgaattttgatgggttttgctgtatttgaagtcagttcggtgttgtacatgacaaacaattgtccttctcctttcatagtcagtttgttgactccgggatttagcatatagacatcgcctgaagaagcagtttgcttgtattctgttcctgtttcccaaatacactgcattgaaatattctgtccgtatgtgtcaccaaccaatacgatgatatcgtctcctgccttgacggatataccagtcggattgtcgagatcactatatttcttagtcattaatttatccgcccattcagcaatattactgtatggttcatagctgcgaatgcgaaattctttttcccatttgtcgtatgtattgtcacgaaccgcttctgctattctgacgaaatagtctggcagagcttgtatctgttcgttggtgacgttgttctttatttccgtacaagttatatcggtgaatacggtaagaagttgtttatccagtgttttatccgtatttgttttgtaaaattccatttcatcacagcttacaaaatcacccagaccgcttaatacttcgaatttgattccggtcgcttttatgccttctgaaaatgaaactttggaaggagcattctgctctttaaagtcatattctccctgtaatgtataatctgatcggtcaggattggttgttgtatatactttgacctttccgaagtttccattaccggatcgtgtataataaattaagtagtctatttccgtatctcctttaaaatagtattccagcgtgacagggaatttggcggattgtccccacggagtgtggaaaggggcagctccatcagttgaaaatttgccatcatatgtattttcaatatcctgtccctcctgatgctcactcgctttgcctccggttggtgtaaccttgatgtcaccctcaacaattacttcgcctttggcatattgattaacggtgatagtataggtagcagtagttgatgttacttttatgttggctgttcttttggtttcgcctgtattttcattcactgtaattctcaggaaagttccttctgctgctgtcttttgttttgagcattgtagccagtttgcttcataagagacactccattgagctaactccatagatgtgttaattggaatctggacagacgtacttgatttatccagattttgtatcagatattcttcactgatactgaaggagctatttataatcgatttttcggtatccttgcatgccagtgaaactgtgaatagagtaaaaagggctaacaggttagtaatgaatctttttattgtcatttttttgctgtattagtttttaagatagatgaggtataaaagggtgaatcaaaagtctgactcaccctttgtctctcatttattattcggacagtatgaacagactaaattcgctccatacaaagaaggaaccaccggtccagttgctttcacatttaaagcgtaaggtgttggcagcattgtctattgaaacgtcgggagaaacataaactcctgcagcacctgacgggagaccatcttcatcccacgcaaaacgcttgtaaagttgtaaattgttctcattcgttcctgtatataaattgaaccatgccaaagcggcatttccgttatttgatctgtttgtataggtgaaacggaatgtcttagttgatacgggcaattttacttgaacataatgcttgtcggcaattgatacactccacgcgctgtggaagtaggtacctatatctccatccaataaattagctaaggaaccttctgacggttctattgcattactggaaagcatgtccgctgtcagactgtatttttcaacagatgcaaccagtataaatggattcgtgtcgaattcgaaaccgtcttttccattaatttccagaatctttatacccacatttccggaggtcttcgtaaacttagggatattaacttgaacagaagatgtgtttccaggctcaaatgagatgatatccgaaaccaacgttgctccttctaaggtagtagtagtttcatcaattgctactttacaggtgaaattccattggttttcgacttgcaatcctaaatcaagagcaatggtgcctccactttggggcagatatttagtcacggttcctgaactggattcagtgactgaaagagagggagtaataatctccggtttcagaactaatgtgtttttatccgccaggatggaatcggatgtactggtcagcatgattggaaggacacacgtttgtccctcttcaagagtctgctcaaagatttctatctcgttggtattcaactgtaaattgatgatcttataggtttcagcagaagaataatcgagttcttccatgttgaacgaataacaattggcaggcattgccacatagtccaaacctctctcggagatatacttctcaaaattgactgcatccattgcaccgatatgggcagaagctgtcaatgtgggttgacttccggatttaatgaccgttattgaatagttagtagcctctcctgttttataaagatctacggcttgctcaccggtggtctgcagtgatagtattttctcatattcctgcggataggtatcgtcataattgtcgcaggaagtattcatcagaatcatcccgcacaaacacaatgctattgatatatgtttcatatatattctatattgttatgaatgaataaaaaataattaatatccgggtgcttgtaccatttgcggatttttgtatacttcgttgtagaataccggattcaggtacatgcggttttcccacacataaggtgcatcaactgtagttcgtttattaaattcttcgaatgtgggactttgaacttctgcattcaatccttcccgtttgtttgctccaaagtacttggctccttctgcccaacggcggacatcgaagaagcggtgaccttcgttccataattcaacaaaacgttcattgtgtacccagtcttttattgtcatattatttgtgatatcagccaatgttaatttagggattccggcacgttcacgaacaggatttagtgcatcaatggcttcctgtgtatttcctaatgctgcatggcattctgctacgtttaggtagagttcggccaggcggaataagatagtaggtgcgcttgttccgcttgtagaaccgccggctgtatagaattcagttaccggatcaacaaacttttgtgtcaggaaccctgtgacactatggtcacgattaaatagagacggattgtaaccgtgcatttccgaattcctcatttccagtttcagaggagaaccggccgcaaatttagttccgtagtcaccaccgtcaaaagccatccatgcatagaaacgaggttcacgacccacattcaatttgataatgtcttcccgtgaagagatacctgctgactcaaaccattcagaggaaggagtaaagtcaaggtctttttcaggtagtttcccgttagctgtatagaaatgttcgaacgtatataatgtaggagatacaccactataaccagcatgccatgttccatccgatttcttcagaatacgaagcggataacgggaataaaaatcaaactggttggataatccccagataatttctttgtttccttcagattcacgtgtacttacggcatagcgcatcttcattacgtttttcaggaattctttattatcttccacgtctgctactccgggaacaaaaggtaagttcagggattgtcgggagtaatattcgtcgtcatcgtaaagttcacggtcaccggaagttgtagctaatgtaagtgcttcctgacatgcggccagtgctctttcccatttgctcttgtcataagtattgcttaccaaagctttaccgtaacccggagtctcgaaattctcattctgccagttagggtaggggaaacttccgttccataaaggagatgcggcataaagtaacaaacgtgcttttacagctttagctatagtagatgtagcgcgaccccattcattggtaacggtgcggttggcaggaagtactttggcggcttcatccagctggttcgcaatccagtctacacaatagtcaaagtgaaaacgtccattatactctgacgttggggtatccatcggaatgtacgagtctgtaattgggatgggaccatatcttcttaaagtagcgaagtggtaataagctaccaggaattggcattcggctctccattgttccttttctgcatcagatgcaatgtcgcttcccgcattttccaacttttgtaaaaacagataacattgtcctatatattggtaagtagttccccatagccagtcttggttagtggatgatgcagtgttaaatgcataggcgccccaataaccgtctgtgttccatgaataaggtaatacatattcgtctgtcgtagagtttatttcccccagataggcactgggtaagtctgtactgacacctccataacaggaataaagaaatcctaaagctcgggtggggcttgacattgcgtcatcgatattgggttgttcgggtggaacgacgtctagataatcacatgaggttaagcccaatgcagtgataataactgctatacttatattttgaaagatgcgtgttagtttcatattttttctcataataaattagaactgaagttgaattccgacattgacagttttttgcataggataactgttccaagaagacagttcaggatcccaaaggtcaaacggactaaaggtgaatagattggctgcgctgacgaaaatacgtccgtaaggtatcttatatcctacttctacattcttcaatcggaggaaagaaccatttctcaaccagtaactactgttcactgtattgttggcaacgtctgttgcaagtagtcccaaacgaggatatttggcatcccaattctgtttttcttccgaccagtaattatcggctatatattttaatacatttctgttaccgacggctattccttcttggaaagggtcaataccgtttgtcatgatagaacgcagagcagagccactgaagaagacaccaaaatcaaactttttgtagttgacagttccgccaaatccgtattgtaagcgtggagtacttccatatttggagatcatcgtctggtcatccgaatcaatgataccatcaccgttaaggtcacgatatttaatatctccgaccttgggtgtagaacccaaattctgggcagggctgttatctatttcttcttgtgacttgaataagccttctgctatgtagccggtaatgcgtgaataaggttttccggtttctgacttccatatagtcggatattccggttcatccacatagaccattttatttttgttgtaggtgaagtttgcctgtagactgacagacaaatctttggagaagttattggcataattaatactgaattccactcctttattatccattttaccaatattactccaaggtttggcaatatgataagccagcgattgtggccatgcttcacggttcatgaagatgtcataacgcttgtcgtagaaataatcgaaggtaaatgtccagtttcggaacaatgtaaaatcaataccgatatcgagcttctttactttttcccatcccaaaccggacatggcgtagtatgccatctgaggacctcctaattggtagtccatattttgtccggaagtccatttcagataagacaggtcgttgtttgtaatcttgtctatatacaggtaataacttccgccggctgttgccagatcgtcgctacctacaagaccgtaggaacctctgattttgagattgtccactacatttttcattggttcgaagaaagcttcattgcttatcacccatcctaaagacacggcagggaagaatccgaaacggtcttctttggccagacgttcggtcccgttgtaaccgaagttaaactcaaacagatagcgttgtccgtaatcataagtaagacgtccggaaaggccttgattacggttgggtaacacatcgcttctgtattcgcgttgtttgtagagtaacatggcacctacattatgcagaccgaattgacgggcatagtttaggttgaactgtaattcaaatgtttggtcggatgactttccgatagccgactgactgatataatcgctgccattcgaatttagcagttccaattcataattcgtattttccaggtcggtttcatcgtagcttccgctttttatgcgataataataaggagcaatgctacgatcaaagtaagaacttgaccaggttttgaaatttacaaaagcattaattttaagccctttagtgataaaatccaaatcctgatctatcttgataactgtgttaagtgtattttcgttcgtttcggcaaatgatgtcatcatcctggcataggggttcgtgtataaggtacttcctgagatgatgttgttgccgtacatgatacgcccgtcttgacttggataagtaaccggaaattctatgggggtagtagtcagaatctgtttgaacaaatcctcgcttgatacattcgggctttttttctgacggatctgagcgttcatattcattttgattgtcgtcgtcggcgtcagtttataagcaatattattctggaaggtatagttcattatattaatattgttgttccatgaatatgctttccctgtgttcagcaagcctgaatcatggctgacatccaaactcatgtaatatttaactttagaaccaccaccggaaatgttgacgttggcacgttggcgcatactcatgtttttaaacaatacgtcttgccagtttacatcggggtataggtatgggttgactccggatgccgtacgttccatgtctgtagcactgtatttgggtgtagcggaagagtttctggctaatgaagctttattatacatatccatataagtagctccgtccacaaattccgggaacttgtctaagtagttgaaagaattttctgctgtaacgttgatggatgttttactattgtattctccgcctttagttgtgacgatcattacaccgttagctccgcgtgaaccatagatagcggtggcagatgcatctttaaggatagagaaactttcaatattctcggccggcacataattaaggtcaccggatgatatttctacatcatccagtaaaatcagaggagttgctcgtccaccgaaagtaccgataccgcgaatgtaaaattcggcaccggagccaggctctccggaatttgtttttgcgatgacacccgccaactttccggcaaatgaattggataaagtagatgacggcagcttgaggctggcaccttttatacttgtgatagctcctgttacgctgaccttcttttgggtaccggaaccgactacgacaacttcattcaaggtatgatcgtctccttccagtacaattttgatattccctagatcttctacaggaacttcgcgagttttatatccgatgtaagttacgacaaggatcgtcttattgtcgggtatggaaagactaaaattaccatcaatatccgagattgtaccggtgttcttgtcacctttaatcgtgatgttagctccaatgatggggctatcgtccactgcgtctataatagtaccggttacagtacgttttttcttttgttgggtgttattcgttttttgtacgttaagaataacctctttgttttttacgatatagctaataccgctgtctttgaaaacttcatccagaatctcgtcaataggaccattacaattaatgtctttccgttgtttgtcttcgagatctgctgcattgtagaagaacgtgtagtcgctgtttttttctataagctggatagcttgcataatagtgattgattgccccttgatagatatgtgtccttgagctccaagagcggacaaggggtaaaagagcaaaacgagtgcgatatgcttcagatatcgcctccggtaacaactgtgattttttttcatgatttaacttgttgtgaggttaaatattgggttaattattagaaatatggttaattatatattactatttttctattctgttttttgtatgtaaggttaaggctgaaacagagtttatctatcacgtcatccaatgtttcatcataacggatgctgcctgtgaatgaaggctgtttagtaaactttccttctagaattatatttgattggtatatttgatttataatcgaaatgagctgggataatggggtttctttgaagttgtatcttccgtccttccaattgatatccataacattctcaactaatgtttgtgcattgtttggattatacattaccttttgcgatggagacatgataattttctctcctgtagattctacattgaattcaattttaccatgaaacagcgtgatttcatttttttcagcattagtttgcttgatttggaaacaggttccctttacttctataaaagctttattaatatgtacttggaagaaactgccttcatgtttatatacctcaaaaaatgagttgccttctaaccatacttctctttttttgttgaaggcttttgtgtatttaatggaactacctgattccatccatacttttgtactatccggtaaaacgtgcatttggttttgttgtgctatcacctttataaattcgtcgttaatattatctctgattgaattcatccaaaatcctcctattgttagtaaaagagcaagtgaagctacggcaaaatgccatcttagttctgttagaactaagataaaaaaatgacttttcgaaaaaaaaacttctttttaattgggtggtagtatattgattattaagttgttgtggttttaataataattttgctattttttttatcgaagggatgtggggatagacttaactcaagtgtatttataatatacgagtaataataa

SEQ ID NO: 72 - DNA, 37574 bp, Bacteroides thetaiotaomicron
gtagacagatatataacaatatctagcaataataagatgaatggagagttgagagttactatgcagcgtcatcatttattgtgcagccgactctcaactttccattttcaattctcaacttcttaccatattatttccgtttctccgtttgctttcagataatcgtttgcacggctgaagtgtttgtttccgaagaaaccattgtaggcagaaaggggagagggatgggcagagctaagtaccagatgcttgttgcggtcgatgaaagctccttttcgttgagcataagctccccacaggataaatacaagatgttcccgttcttctgccagtgcgcggatagcggcatctgtaaaagcttcccatccacgattctgatgagagcctgcctgatgagcgcgtacagtcagagtggcgttgagcaataatactccttgctcagcccagcgagtcaggtttccggtagtaggagcgtctgtacctatgtctgcctttatttctttaaagatgttgaccaaagaaggagggaaaggtactccgtcgtttacagagaaacagagcccgtgtgcctggcccggtccgtggtacgggtcttgtccgatgattactaccttcaccttgtcgaaaggacagaggttgaaggcgttgaaaataagttttcccggagggaaaatctgatactggctgtattcactttttacgaattccgtcagtgtgcgaaagtaatctttttcaaattccggctgtaagtgtgttttccagctttcttctatttgtacgttcatagcaattatataaggtgtatatcaagttcctcacattctttgcgcatatcttccggccagatgctggcttgtatttctccgatatgagctttgcgaaggtagaacatacacaaacgggattgaccgataccgccaccgatagatagtggaagtgtgtcgtccattaatcgtttgtggaaataaagtttcagtctctcttcttcgttttcttctttgagctggcgttgtagcgcttctctgtctacacgaacacccatagaggatagttcgatggagcgttgcagtacatcatcccaaagtaaaaggtcaccgttcagtccgggcaggttgttcaggccggtggatgtgtagtcatcatagtccggtgcacgtccgtcatgttttttgccgtcgcttagcttgcaaccgataccgatgataaatacggcaccgtatttttggcagatggcatgctcgcggcatttgggttccaggttcggatagagttggcgtagttcttccgaatggataaaatgtaatttctggggcagacaaggtttgatctgcggatacatttcatataccatgtattctgtacggatcatggcagcgtagatacgatttacgatctctttcaggaattctacgtttctgtcctcgttggtgatgacacgttcccagtcccattggtctacatagagcgaatggaggtttccgagttcttcatcagaacggatggcgttcatgtcggtatagataccgtatcccggttcgatattgtaatcggcgagagttaatcttttccatttggctaatgaatgaacgacttctgcttgtgcgtcacctaaatccttgatagggaatgaaacgggacgttctataccattcaaatcgtcattgatacccatccctttcaatacgaaaagaggggctgtcacgcgtctgaggcgtaattcggatgacaagtttaactggaagaactcttttatttgtttgattcccaactctgtttgttttaagtcgagtaacggtttatagttctttggttttatcaagtaactcataggattgttgattgttaattgtcggcaaagataggaataatattgatatctgtattggataatctctaaaagattgtcaaattgataaagtatatgctctaaagcatttcaaaataacagaatgttaaggggcgatactgacttaagaactataaaaaaagatgaatcattaggaagatgagaagattttttatacttttgtcatcgcatttaggaaatggccccgtagcttagtgaatagagcgtcagattccggttctgaaggtcgtgcgtttgaatcgcaccggggtcacataaaaatcccttgataatcagtggttatcaagggatttttgttcttatataacttttttcttagcttctcgatacctgtaatcctttatcggaaagcgtcatttcaacaaagcgtgcacgcggattaggagcctgttcggtcaatatccgacggatgcatccggccgcttgcggatctttagccaccatatataagtaaccgccacctcctgcaccgggcaatttatatcctagcgtataatctttaatctgttcgataatagctgctactgccggtggattcgtgccactgtccaatgcttggttttgtatccagcttttgccgacaagattgccgaaagtttcgaaattacctcgcaggatagcttcgctcatatccatcgcatgggctttcatctctgctaataaactaagatgctttccggagttaaggaacatggaactgacaatttcagctaagatgcctttggctgtacgggtgattccggtataataaagcagatggcaatcccgatattccggctgcacaaagagctggtcgggtaaccaccgtactaatggatgttgttcgaagccggattcggattgcaacagttttacgccggggaatacgccgccgtattgatcctgccatccgccgccggtggtaagtaattgttccaataccagtgtataattgcagatgtcgttcctatcccatgccagtccgcaaaaatcattgatagctccgagtacggtagatgcaaggatagaactggtacctagtcccgaacctgccggaatggcagccagtaaagtgatttccagtcctgaaccgaacgcttttagatgttcttccaatgacgcatgagattccgccgcaaataatggggcaaatcctgccaaggtaagtgctgccttcggtatggagaaaggcgaaccgactttcttgtaatcctgcaattcctcataacttcggataacctccacagctcccatatcaatggaacgaagtacgatatggaactcgtgacatggtttgacgtatacttgtaacggcggctgcccattcaactcaatcgccagattgactacacttcctcccgaatagagagagtaaggaggtgtatctgtccatcctcctgcaacgtcaatgcgcaccggactacgtccccatacgatctgatccgaataaacattgagcttcggatagttcttttttccggcaacggcttccagtaatccgtcacggagtagctggaacgcagcttgttcttctcctttgcagccttcattgccttgcagcttcaggatacgtgcccgaagcatacggttatgtatacgcaccatgggtgcggcatcctctttcaagacagcgggaacatccagattgagccggacaaattcattggctgcgtcttgcaagtcaagctgatagaatacactcttctcataattggcggacaatcctttccagttatccctgcggaaagcgctgcgctgtgcgtaaagacgttccaggttcgcttgtgccgatatctcgtcagcggatagtttttctgctctcagccatagctcttttccttcttttagttgtggctcagctgtcatccagcgtattaaaatacccagttcttcgatggaagtcgttacggggaaaacaggagcagcttgcagatcatctgtacgtccttttatgtcttccagtccaatctctctttccttcatccactgtgtgaaagagttccccaagtaggtggtcgagtcattacttaaatcacctttgaaaacatcatccagcccataaggccgtgcgacaaaggctgcgtctcccataggaacgatgtcgatgcagactccgtccggcaggtttatattccaatggttttcgggaactcctgtaataatctgtcgtgaacctaatttccatccttctcctacgtggctgttctcaatccataaattggcgttctctgcagataacttcacttgggtaaacgagttttgtataaagatggcaggattcggttttactttccggtgcatgatacgcctttggtcacgcactttatcctgtatggcgagtgtggaagaaatcagttcccgactcgttccgaaatgataaaactctccgccgggtaaaggcaggattgctaccgaaagtttgtttacttcatcgtctgtcgtttggggatgctctcccagtgccaggccataatccgaatataaatcgtagtagctgatatcattcgtgccttctttcaatgaccgtttcatcaatacctcaacggcacggtcacttaatatccatataccgatatccatcaggaaaagatgggtctttgataatccttccaattcctctaaagaaggtttctgcaacatgaagtcgagcacttccggcttcttgcggtccgatacgaatactccgtggtgagtagccaatgaaggattcacccataaaccataacatacgacatctacttccgggatgtcttgcagcggtttttccgaacggatatatacgtctccgctggctatcagcgtgttcaagcctttcggagcctgcttcatgattctttcgtatagcggaagttgcagcgacagcagattctgtcccagcttttgtcctctctcccaactgaaaaccggtatgggagtcagtattttgcccgaaggagcatagccgggcaagcggcggctttgtcctcccgcatgcagcaaaatctttttttcgtttccaatccatttgctgaaagtctcttccggtgcaaaagcctgatggcaggcctgcaacagccaggtcgttcctcctccggagcctaacttgctgcctacagggtctgatgtacaaaaccagtcagtatgattcacttcttccagttgatgaaaactgtcaattaagttgggaggtaaggataataacttttgcatagtagaatcggtatttataggtttataacatgattgtatcccagctatcgcagagtgtctgcatagaaggaaacagcagatcggctccggcatccagcaacacctgtccgtccaacggaccagtattgaccgcgattgtgaaaattccggctttatgtcctgcttccacgcccaaaggtgcgttttcaatcacaacagcttcatccgctttcaagcctcctttcttaagagccatcagataaggttctggattaggtttgccatatttcacgtcaaaagcggtcaccattagctctttatgaaacattcccggaaaattgtgttccagacgttccaacaaagaaagctgtcccgaaccagtgactaccataggagtcagcccttcactctttactttctgcaaaagttcccatgcgccgggcatacgttctgcttccggataagaattgaacaggatacttttttcgtgatatatactttctatttcctcttgtgtggcctcttttcctaattcacgttgaaatacgatattgatagtcgatgcccccgtgcgtccttcgtgcatatatgcttcttcccggctcagatcaaggccgtgagttttcatgacttgatgccatgcttcggagtgatagggcatggagttaaagagcacgccgtccatatcgaacaggacggctttcagtttctttctcataattgggttagatggaatctgtttgatatttattcttttttcagcatatctttcagttcaggcacggtgatcactacatcatgctgagcttccgattgtttgccgatatatctgtagactatatttctgtcacaattcacacaacttttgataaacagttgggtagcaagatcggtctgattgcctaatgtttcgataataccttgtttcacctctgcggcatttgctttaatctggttcatatcacacagatcttcgtcaacacgacagatataaatcactgcttcatcgctgagttcgattttctcgatcagaacgtcctcacttgcctgtatcgggaactgtaagtttgccatctgtacctgcgtttccagtttagccaggtcgctttcggtggtgtcgacatccttattgagaatttccttaatttcatctgttgtcagttcgcagactacctgctctcccgaatctttacctatatatatcatttgcaggcccgctttacattttacaacaaggtccagcaatgactttacttctttattcggattctggaacatgattttcagggaagtcttcatgctttccggatttttctgcagagtcttgatgttggcagcctcttcgttcagataaaaggtatacactacgttctctccatcatagacgatgctggtgatttttccggtctctcccatgtctatcggacattgtttgttggcagcctcgatgcctgctttgagtttgatttcctgacaaccggtggttaacatcatcagtagtgacaagctgataaacaatatcactgcattcggtcttcttactaatttttccattgttcttttatttagaattcatttattcttgggataaaaagagatatacgaagcaaagatagtcataaaaaatgagagatataacagaatggaggagatagttgctggttgtgttttggatgataaatcgtatgataatttgtcgtttagaagataatatgtatttttgtagcatgataaaactagtcaatagcatgaaaaagaaagtattgtttctgctgccattgtttctgggtgcttgttcggatagcggagaaagccctgttatcacgatagaaaagctatatgtgaaagtagatcaaggcgatggagaaaccatccgcgaagactatgcaaaccggatgagtgaaatgcctgctttgaaagtgggagataaggtggatgcgtttttgatcttggacggcaatggagccgaactgaaatctttccagcttcagaatggggaagagatgaagactgagctccgttatgaaaagacagaagtcactaccgaaggaaatctgacagacgaagaaaaagggcagttgcgcttcaaagatggcgtgacaaagactaaggtgctggttcatgccactattgagcatgtagataaaaatggtgatgtacaattatctttttatctctcttcaaaagcggagtgtgaaggagcgcaggaagtgattgacttgaaaacagaagtcgttgagaatgaatgaatcctgaaagggagtgagtcactttaacgtaacgaaggaaatataataaaaagaagcggtctccggagaggccgcttctttttattgtcagttattggatattacagtttagcctgaatagcctttgattcttcttcgtatcccggtttgttcagcaaagcaaacatatttttcttgtatgcttccacgcccggttggttgaaaggattcacgcccaacagatagccgctgatgccgcaagctttttcgaagaagtacagcagaccgccgatgttgtattcgctcagttccggaagaacgatgcgcatgttgggtacaccgccgtctacgtgagccagctgagttcccagttcggccattttgttcacttcgtccacccgtttgccggcaaggaagttcaggccgtccagattagcttcatcgaaaggaacttccagtttatggtctactttatccagtgagatcacagtttcgaagatcgagcgttcgccttcctgaatccattgtcccatagagtgcaggtcggtagaaaagtcaacagatgcggggaaaatacccttgttgtctttaccttcggattctccgtaaagctgtttccaccattcacttacgtagtgcagtttcgggcagaagttgacaaggatttcaatcttcttgccttgtctgtacagttcgttgcgggtagcagcgtagatagccgcagggttttctgcaaacggaacgtcagaaccgcatgccttttccatatcggcagcaccggcaaccagtttgtcgatgtcgaatccggcaactgcgatcggcagcaaaccaaccggagtgagcacagagaaacgtccgcctacgttgtccggaatgataaatgtcttgtatccttctttgtcggcagtcacacgtgcagcacctttcttggcgtctgtcacggcaacgatgactttcttggcggtttctttgccgcgttggtcttcacattgctttttcagcagacggaaagcaagagcggtttcggtagtcgttcccgatttggagatattgataacgccgaatttcttgtctttcagatattcggtcagttcatacagatagtcttcgctgatgttatgtccagcatagatcatgacaggagcagttttcttgtcctgcaaccatgtgaaactgttagacagcgcttcgattacggcacgtgcgcccagatagctgccaccgatacctgctacgatcactacttcgcagttgtctcttaatacttttgcagtagcgttcaggtcagccagatgctctttgctgatggacgaaggcagatgtaaccatcccaggaagtcgttaccttctcctgttcctttttccagcatttcctgtgcagcttttacctcggcttcataagcagaaaccttttctttggagatgaatccaaatgttttttcaatgttcaagctaatcatatctatcaattttaagtaatatgtaataggtaataagtaataggtattaagtaataagtattatgcatgagacgtaaagcttaggtggctacggttaatacctaatacttattacttattacctatttttctcatctaaaagaatcagtcagcaatttgatctctatcatgggtgagatgcgttcatacaagatattgtatacggcatccagtatcggcatgttgacgtggtgatgcttgttgatctctttgatgcacttcgtgccgtagtatccttccgcgatcatttccatttcaatctgcgcacttttaacggagtatcccttgcctatcatcgaaccgaacgtgcggttacggctgaagttggagtatcctgtcaccaataagtctcctaaataaacagaatcatctacatttctgttcaggggatgtactgtattcaggaagcggttcatttcctgaatcgcattggatatcagtactgcctggaagttatcgccgtatttcagtccgctgcagatgccggcggcaatggcgtatacatttttaagcaccgaactgtattcgatgccggctacgtcgtcgctgacggaagtcttgatgaagctgcttcccaaacggcgggcgaagatgcgcgctttgtccttgtccgggcaggcgatggtcagataagagaggcgttccagcgctacttcttctgcgtggcagggacctgccagtactgcgatgttttcgggtggtacgccatattcttttgtgaaatattccgatacaatcacgttgtcatcgggtacgattcctttgatagcagtgataataaacttatccttaatctttgttttcagctttttcagatgagctttcagataaggagagggggtgacgaaaatcagtgtatccgattccttcacgacatcgttgatgttagaactgaaagtgatacgcttcgtgtcgaatttcacccctgtcagataggcgggattatgtccaagtctcttaaaatcagcgatgcggtcatctcgtcgcatgtaccaattaatagagtcttcctgagccagacacatctttgcgatggctgtagcccaacttcctccgcccattatcgctatcttaccgggtagtttcatatttagttgaaagttgaaagttgaaagttgagagttggtcattaaaaaggttgttcaagtaacaactttcaattctcaactctcaactctcaacttatttaagtttatttatccactcggtcacgtcgttcacgcttggattggtcagttctaatttgtatttcttattgattccgcagatgtcctggtgcaacttttgcggattaacatcctgcatatcagctactgtgttgtagccggctttctggatgaccggcacccagtcttctgcaatacccagttccatgtatttggcggcagggtctttcttgattactttctccggacgcatttgcgggaagaacagtacttcctgaatggtggtctgtcctgtcatcagcatcaccagacggtcgataccgataccgatgccggatgtaggaggcataccatattgcaaagcacgcaggaaatcctggtcgataatcattgcctcgtcgtcacccttgtcggcaagacgcatctgttctttgaagcgttcttcctgatccagcggatcgttcaattccgagtaggcattggccagttccttgccgtttaccatcagttcgaaacgttcggtcagtccaggtttggaacggtgcatctttgtcagaggcgacatttccaccggataatcggtgatgaaagtcggctggatgtagctgccttcacagaattcaccgaagatttcatcaatcagtttgcctttgcccatggtgtcgtcgatttcttccatcttcagttctttgcagatctgacggatttcttcttcgctcttgccgttgaggtcatatcctgtcttttctttgatggcgtcgaggataggcagacggcggtaaggagctttaaagctgattgtctttccgtctacaacggtttcggtgcttccgtttacggcgatacagatgcgttccagcaacttttcggtgaagctcatcatccagttgtaatccttgtactgtacataaagttccatacaagtgaattcggggttgtgggttctgtccattccctcgttacggaagttctttcctatttcgtatacaccttcaaaaccacctacgatgagtcgtttcagataaagttccgttgcgatgcgcaggtagaggtctatatccagcgagttgtggtgagtgatgaacggacgtgcgcttgctccgcctgcgatggattgcaggatcggtgtttctacttccgtatatccggcttcgtcgagggcgttgcgcagtgttctcactacggtggcacgcttttcgaatgtctctttgatgccttcgtttactaccaggtccacataacgttggcgataacggagttcgggatcttcaaaagagtcgtaagctacgccgtctttatattttacgataggcagcggtttgatagacttggcaagtacggtcagtttcttggcatggatactgatttcgcccatttgtgtacggaacacgaaaccttcgatacctacgaagtcacctaagtcgagcaggcgtttgaatacagagttgtacaattccttgtcttctcccggacagatgtcatcacgtgtgatgtatacctgtatacgacctttagagtcctgcagttcgatgaacgaagccttgcccatcacgcggcggctcataatacggcccgctacagaaacttgacgcggttcgtcttcatctttgaattctgcttttatatcagtagagaaagcattggttacatactctgcagcggggtacggatcgatacccattgcacgaagctcattcagactattgcgccgaataatttcctgttcacttagttctaatatattcatttcgttatgtattaactcaattttggaggcaaaaatacgaaacttttctcatatatcctgtaatccgtctcttttttgtatctttgcgccctcaaaacaataggtatgacaggacaaaagacacccactgcgctgggtacggaaaagatcgggaagcttttaatgcagtacgccattccggcaattatcgccatgacggcatcttctctttataatatggtagatagtattttcatcggtcacggggtgggggcaatggctatttcggggctggcacttacgtttccgctgatgaaccttgcagcggctttcggttcgctggtaggtgtgggagcggctacactggtatcggtgaagctgggacagaaagattatgatacggcacaacgggtacttggcaatgtgctggtattaaatattatcatcggactggcttttacggttcttaccctgatcttcctcgatccgattctttacttcttcgggggaagtgaggcgactgtcggctatgcccgcgactatatggtggttatcctctggggaaatgtcatcacccatctttacctgggcctgaatgcggtacttcgttccgcagggcatccacagaaggcgatgtatgctacgattgctaccgtggtcattaatacgatactcgatcctatttttatttacggctttggctggggaatacagggtgcggctatcgctacgattaccgcacaggtcatcgcacttctctggcagttcaagctgtttagtaataaggacgaactcctgcattttcataaaggcattttccgactgaaaaagaagattgtttttgattctctggccattggtatggctccctttctgatgaatcttgccgcctgctttatcgtcatccttattaataaggggctgaaacagcacggaggggatctggctatcggagctttcggcattgtcaaccgtctggtattcctcttcgttatgattgtgatgggtttgaatcagggaatgcagcccattgccggctataacttcggcgccaaacagtatccgcgcgtgacgcaagtgctgaaaataacgatttatgccgcgaccattgttacaaccatcggttttctgatgggaatgtttattccgcaactggctgtttctatctttacgacgcacgaagaattggtgaatatctcggcaaagggcttacggattgttgtgatgtttttcccgattgtcggttttcagatggtgacttccaacttcttccagagtatcggtatggcgagcaaggctatctttctctctatttcccgtcaggtgcttgtactgattccttgcctgttgattcttccccggttttacgggcagctcggcgtgtggatcagtatgcctatctctgatttgatagccagtctgattgcaggagggatgctttggtggcagttccgtcagttcagaaaggcaactgcctgatctgtttattccgatactctttcggagagacacctacgtattgcttgaaatacttaccgaagaaagactgagtcgggaaattcagctttgttgcaatttccttgatggtgagatcggagttttcgagcagttgtttggcttcggtaattaccatttgtacaatccattgcagggcggtactaccggatttttctttaatgacagcagaaaagtaccgggaagaaaggtactgtttactggcatagaaggtaacgtcccgttcctgctgataatagcggaagagggtaatgacgaagttctgaaagattttatcctttttgtcttgcgataaaggtttgagaggctggttggtaaaataaacgttcagcaattcatagcataaggtttgcccccatgatttgatgagctcggatatcaggtgctgtctttgcagcgggatgtcatgtgcttttatatccattcgctgttgtagggctttgattaattgttccagatagttgtattgatattctgtaattgagaaacagggattttcccgtagatagagcaggttttctgaattgactatcttattaacgatcggaataatataattcaaatccacctccagcataatcccttttatatccttgctgatacgctggatgcgcaagagactgcctgtcatataaatgcagacacttcctttacttattaaatacgacttgtcattcagggcaacttccacttctcctttctggcaaaaaaagaaaccacacttgtctatggtagatatcatatagccttctttttccgtagcattctccggagatattataacataactaaaaggtatctgttgttccatttcctcttttcttttggggtggtttctgttgcaaagaaacgtataaataaatacaaatagcaaagtatttgaggattttaagttgaaaaaactgcaaatcggacaatttatagcttaaatcaacctttttacttttatctgcttgggatacttttgcatgaactaaataacaaatgaaaatatgaaacgattcaactttttattaacaggaattttagtcgttttgttggcatcttgcagccaacgtacacagattacagatagcaaacctacagtgaagattgatactgtactttctgccggtggacagacggctttgcaatttcccggacgggtgaaggcggcgcaggatataagtttatcattccgtgtaagcggaactatattgcgtatgtacgtcaacgacggaacgtatgtgcgcaaaggacagctgcttgccgaactggaccctgctgattatcagattcagctggatgctgcggaagcggagtatcaaagtgtgaaggcggaggcggagcgtgtgatggcactttataaggagaatgtaacgactcccgacgccaatgataaagcgatgtacgggttgaaacagataaccgccaagtacaatcatgcgaaagatcagctggaatatacccgtttgtatgctcctttcagcggatatgtacagaaacgtctttttgattcccatgagactattgcggccggtatgcccgttgtctccattatcagcgaggggacaccggaggtggaaattaatcttccggcagtagaatatatccgtcgccaacagttcaccggttacacttgtacgttcgacatttatcccggtcaggagtatgcgctcgatctgataaatgtcacccctaaagcgaatgccaatcaactgtatacgatgcgtttgcagttgaagaaaggtgaagcgcaggcgcttccttcccccggaatgaatacaatggtcactatagaatgtaccgaaggggaagtgcgtcatctgtccgttcctacgggtgcggttcttcgtgataaggggatggcgagtgttttcctttatgatgcttccagccggaccatccgtcgttgtgatgtgacagtcacccgtctgctgggcagcggcaggtgcctggtgactgcggagggcttgaagcccggtgacttgattgttgcttcgggagtacatcatgtgaaagacggggaacaggtagaaccccttttgcctgcttctaaaaccaatgtgggaggattgctatgatcgatataagtaaatgggcatttgaaaataagaagttaatttacttcttgattgcggtgctgatagtcggaggagcttattccagctatgaaatgagtaagttggaagacccggaagtaacggtgaaagtcgccatggtagtgactacctatcccggagcgtccgcacatcaggtggaactggaagtgacggatgtacttgaaaagaatatccgtacaatggggaatatagataatgtagaaagttattcttacaatgatctctccctgattcaggtggaactgaaaacgaccgtcaaggaggcagatgtggaacaatgctgggatttgttgcggcgtaaggtagcgaatgcacaggcggaacttcccgaaggcgctgctactccccttgtgaaagatgatttcggaaatgtgtacggtatgttttatgcgctgacaggagacggattgcaggacagggaactgtctgattatgccgaactgataaagcgggaagtcagcgaactggacggagtggaacgggttgacttgtatggaaagcgtgaggaatgcatcaacatctctttactgcaggaccggatggcgaatctgggcgtgaaacctgccgaagttctcgctaccttgaacggacagaataaaaccacttataccggatactacgataatggcgataatcgtattcgggtaacggtgagtgacaagttcaagacggtagaagatatcggacgtatgctgattcaggggcacgatgatgaccagttacgtttgagtgacatcgcccgaattgagaaagattatgagaatcctacccgcaatgaactcttttatgaccggcagcgtgccatgggaatactgattgcggcttcttccggttcggatatcatcaagattggcaaacgggtagaacagaaactggacgaattgaaagcggagcggcttccgacaggagtggagtgtcataaagtattctaccagccggaacgtgtatccggttcgttgggaacattcattcttaatctgatcgaatcggtcattatcgtagttgtcattctgatgataacgatgggattcaagagtggagttattatcggaatcagtctggtggtaacggtgttcggctcctttctgttcctgtattttgtggatggcacgatgcaacgggtttcgctggcgtcatttgtgcttgctatggggatgctggttgataatgcgattgttattattgacggtatactggtcgatctgaaagccggcaagagccgtatggaggcaatgaccgctatcgggcggcagactgcgatgcctttgctcggagccactttgattgctatcattgctttcctgcctatcttcatgtctcccgatactgcaggggtgtatacgcgcgacttatttatcgtgctggcggtttcgttactgcttagctgggtactggctctggtgcacgtaccgttgatggccaaccgaattttgcatcccgaagtttcgaaagaagcgtcaactaccggaaaacgggtgtatgaaggaaagatttatgccgtcctacgttccttgctgcggtttagtctggctcatcgctggagttttgtctttgcgatggtagcgttggttgctctttcagctttcagctatcggttcatgaaacagggtttctttccggatatggtgtacgatcagctttatatggaatataaattgccggaaggaacaaattatacccgtgtcacacgtgacttggaagagattgaagcctatctgaaaactcgtccggaagtgacccatgtcacagcttccgtcggtggtacccccggtcgttataatttggtgcgtaacatagccaatccttctttggcatacggtgaattgattatagactttacttctcccgatgcattggtggataatatgcccgagattcagcaatatctttcgtctcgttaccccgatgcctacgtgaaactgaaccgctataacctgatgttcaagaaatatccgatcgaggcacagtttacggggccggacccggttgttttgcatcaattggcagacagtgcccgcagcattatggaaagctgtccggatgtatatctgataactacggactgggagccgcagattcccgtgctgaccattgaatatgaccagccgactgcccgcgctatcggactgagccgtaatgatgtaagcctctcgttgctttcggccaccagtggcattcccatcggttctttccacgaaggaatccatcgggacaatatctatctgcgctgccttgacgaacagggaagaccgattgaggatttggataacacacaaatattttcttctcttccttctttgaatggcttgttgacgcaggagatgatgatgaaactgaaaacgggaacgctttcgaaagacgaactggtagaaaccttgatgggaactactccgttgaaacagatcagcaagcggatcgatgtacagtgggaagatcccgtcgtcccccgctataacgggcagcgtagccagcgtgtacagtgttcgcctgttccgggaatagaaacagagaaggcacgccagtccattgccgcacagatagagcagatcccattgcccgacggttataaactgcaatggcagggtgaaaggaatgccagtacgaaatctatgcagtatttgttcaagaacttcccgtttgccattattctgatgatctcgatactgattatgctgtttaaagactatcgtaagccgattatcattttctgctgcataccgttggtttttgtcggtgtagtcgccgtgatgttgctgaccgggaagacattcaattttgtggcgattgtcggcacattgggattgatcggtatgattataaagaacggaattgtgctgatggatgaaattacgttgcagatcagccagggagtagaaccggtcactgcgttgatcgatagctcccagagtcgtctccgtccggtgatgatggcttcgctgaccactattcttggaatgattccgctgttgcccgatgctatgttcggttcgttggcagcttctatcatgggaggattgctgtttggcacgctcatcacgttgctctttatcccgattctgtatgcattattctttcatatcaaaaagacagacaaatgaaaaaagaatttctcgtagctgttagtgttttgtttggaatggcggcttctctttctgtttcggcacaagagaagctcagcctgaaacaatgccgtgaaatggctctaaaatataacaaggaaatggctgctgccgataaacagacggaggcagcccggctgctgtctctcagctataaagctaacttcttccccaattttacagcaagcggaaccggactgtatagtacggcagacggcagcttgggcattcggggaggaaatctgccggtattcctgcccgatcccgttactggagagttggcaacaagcggttacgcttatttccccggattgaatctggactataaagtcgggaccgtctatacaggcggagtacaagtggaacaaccgctttatatgggcggaaagattcgcgccgcctataaaatgtcattgctcggcaaggaaatggcacatctgaatgaggaactgactgcatccggagtgattctgaatacagacaaggcttatgtgcaactagtgaaagccaaagaaatgaagaaagtagcggagaaatatcatgtgttgctcaatgagctgtttcggaatgtgaagagtgcccaccagcatggcatgaaacctcagaatgatgtgttgaaggtacaagtgaaacttaatgagagtgagctggcattgcgcaaggcggataatgcgctccgtcttgccggcatgaatctttgccattatatcggtcggcctctgacagcggggattgatatctcggatgaatttccggaagtggagcaagagtggaagacacaggttgccgatatcagtgcccgtcccgaatatggtattttgaataaacagatcgccatggccgagcagcaggtaaagctgaatcggagtgaactgctgccacgtgtgggagtgaagggaagttatgactatttccatggattggaaatcaatgacgaaactttgatgaaaaaaggatcattctccgtctttctgaatgtttcagtacctctgtttcattttggcgaacgtatgaataaggtgcgctctgccaaggtaaaactggaacagactcgtcttgaacaggaaaatgccaatgaaaagatgttgcttgaattgacgcaggccactaataatttggatgaggcccgactggaatgcgagctttcagaacgttcgctggaacaggcggaagagaatatgaaagtcagcggcaaacagtatgaggtgggattggaaactctttcggattatctggaagcgcaagttatgtggcaacaggcgtatcagacgaaagtggatgcccattttcagttgtatgtaaactatgtggcttacttgaaagcggcggggcaactgcaataaagttctcaaactattctcatcgccttgagaaaaaattctcaccacagtgagaaaaaatactcatgcctatgagaatattttctcaaaggggtgagaataattctgcttctaccaatcgtatttctcgatgtatatatcgaaggtcggttcgtattttattccgtgttttatgaagatagcggcaatctctttttgatataaagaaatatagagaagatatagtgagtgtatttgagacatatatgtctcgaagataaattcctggttacttgcacttcccgatttattaggttacttttgtagcgtattaaatgaagaaaggagataggtgagtatggcaagaccgattaaagaaactccgatacttttcggagaagatgcacggcggtttgaagagcggatgaaagaaaaacgcagggagacctccgagcagcgggcaaaaagattgaaagactacgaactggcaatgaaaatatttaaaaaatagatatggatcgtcagttaatagagacaacgtatgagatgcgtaaactagatacctcagaaaaaatagaatcgttcgattgcggagataccgacttgaacgattttattttgaatgaatctttcctgtatcgggaagctttgctggctgtcagttatgtacttgagaataaagttaatcagcgatcggttgcttatttcagtcttgccaatgacaggatctctttgtctgattttgaaaataaaactgaattcaatcgtttccgcaaacatcggtttgtgaatgagaagcgtttaaaaagctatcctgctgcaaagatttgtcgtttgggtgttgacttgtctgtaaaaggtcaatcaataggctcattcctattgaattttattaaaagttattttattattgagaataaaacaggttgccgttttttaactgttgatgcgtatgcggctgctgtgcctttttatatgaaaaacggttttgtcccattgaatgatgaagatgtggattctgctacacgtttgctctactttgatctgaatgatattgtgaaataattcagattctgttctacttttatataatataaaatgatggattggtaatgttaattgttacaacatagtcttttgaatttatataatagtgacgattgctttgtttctaattttccccaaacatttattagcctcttttgttattttccgaaaactatttgtaactttgtcatcggaacgtagcataccgtttaaaggtgtgcgattgcgcgtttcctcggctaataggaaattgtaacggatttttttgatgtatgccgggaagacgcctgtacttctatgacttctcatagggtacgggctgtctgcccgtatacatcaggtagccgttactacctcctattagcgggatgtgacagctccgtactcttttataatataaaaggtacggaactaggtaagagtattaacttagttccgtttttttatgtcctattggctcacaacaaaacaaatgtctgaaagacatggcgttcaggaagcaactctgcgaaactgggcgaatctcggttacattaccagttgccggatgggcaaccaactgttcttggatgacgaaagtctgactgcctatctcgaagctcacaaaaggcttggattgcaagcggattatctggcaaagattgtggaagagaaaaagctggaacgcgactttattatttccagatatgatgatctgctatatgtattgcgaacacagaaaacgtgtaaacctctatatgaaattattattcgtgaactttcccaattgattgttcatcccggagcccgtgatattttctactccatctctatgggggagtcaatagagaaagttgccggtcggcatcgaattacttatgacagggcgttacagatttataattctcatctcagaggactgaaagtgagaaagaatgtgttggctacttatcggaaacatatcatagatgcccgttttcagtctttggcggataaaagcaagaatataaatttgaatcaggaagaaagggtactccaattgtctgtcggcaaagtggccgatacgaggctgactaatgtcttgtataaagaagaaatccggacggtagggcaactgctggaattagtatcgggaaagggatggagatggctgctgaaaatggaaggagtagggaggatttcttatgaccgcttgctgtccaatcttcagttggcgggagtggtcgatgaaagtttggagcagatactttccggtcgttctgacagatgatgaggggcaaaagtcaatagtattaggagagttgctactgacttttgacatctcctcgtctctttgtggtgatgattcttccgttttttagggtagactacgcatttgattcttttgattaaaaacgttttatctttataaatttattctggtacccctcaaatatatgctctgacgtttcattttccaatttctcttcaatagcgtttactattgtgaaggggatggtttgcccgtcttcatttaaaatcctgaggttggttctctttccatctatctctctaatgttcagtagtatataaccttcttctttagagggggtacatgaagtcatcaggaaattgtctttctcaaaatggaaggctgagtactctgtgggtttatgattctctgttcctgtcggcattacccgggcatatagaggaatacgtgagctccagccaaacttggtagcaaggttgttagatgggtcaacggaagaggtcagatggtaactccaacggaactctccttcttgggaagctttgaagttggtattccagtaattattcatcacccacgagtagacatgaggcctttcgtattgtttctgatattgaaatttaccgagatttatgtctcctagttgatagagggggatgaggctgcttcctataataatttgcgcctgattattttgtaccgatacaaagttttgaacagtattccagtctgtagatgtcccttccagttgattcttgccagatataactgttccgccctgaacgtcgaatgccagttttccttcgggcagttggaagggaaaagcaacgtatatccctgagggatccgtttccggcagacgcttgattgcgtactccagttctattcgtttggtatcatgatataatttaatttccagattgaccccgaatgcttcgtctgttcccggagattttccctgcaacaggatacgttgataaataggtccattcgaactgtcgatgatccggcactcactcaatcctgttctgttgtaatcatccaggcgatattgggccaattggtcacgattacctaatttctcatagataaaagcacccagttcccatggagacgaactatcgaccagttcacaattcaattctttatcatacaaactttggatcgttcctttgtccgggttgagttgtagtttgtagaaatgattttcgatactggcattgtttattgtaatagttcctgtatcagtagacggttgtttgaagacaatttcaaacgtcttgtatcccataggcggaatatcctctgcgaaaattgcatagtagcacccttctctgcgataacggatcggttgaactttcaacgaatgtccttgaaagtctgttatttcgaagaattggtttcgggggatcacttcaaaatcaatatatacagtcagcatctccgaacgtttccagttcaacgtattgaaaatcgtaagggtcgggttcttgcctctgcggaggtctccttgaagtaaaccgacggaggtttcatacagcatttgtgttcttttgactgcttcccatgcataggctgacttttctccccattgcacctgactgttttcgcacaacggatcactgacgctttcggatgctccgaacgtgtgttcatcatagaatagcaggctttcatgtatgtgctctatttgttgatgagtggcctgtggcaggcatttgtcttttaatacagccatagacagtagcccttctaccgctgtcatatccgaatgagttttgcgtgaagctgctgtttctcttgcggcagaaccgaaaccgtctgtccaccagtctggatatgcggctctgtatgcgggaattttatccccgtatcgctccgttacataatccataaattcggatgcagtggcacttcgtagcttaggatatgcgtacttttcattccattctctgatgagtttgcattcaatgatggagggcggtgaattatccgtgaaataaccggagtattgtacgcctactgcatcaaacggataatgcttacgctccagttctgataaataatgtagtaacttcggttctgtcttttgaatgtctccctgctctattccccagaaattgccagtattataatggtcggcacggtaagtcaggatcggtttacctgacggagattcccattggaagacagtcggcatattaaacggaacctgcgatttgtaatggtgttctcccatccacaggtattttatcccgaggtccggcagataatctgccagacaccatgcaattccgttgacgtcattctgcatggccagcgcagagggaattccatgttttctgaattctttgacaggctgaaggaaagtcttgaaagagttttcgtctacaatctccgacatattgaaatacatggaagcaacttctatttgtccttcggcaatgtatttttttagtttgttcacttgttcttccggtctgtttttcaaatactcgtctacagcccatgccgattcgcaggtccatctgaacttcgcatcatttgtgtagtcttttgtttgttcgcagtattcaatggcataatctatataccggagatgttccgacaggatttcggtttgaggtttggtgtagcctatatctgtgtgagtatgctgaacgagatataccgtccatttcttgacaggagttgccttttcattgattttgctgacggtttttccttgttctttcagtatgatcggtaactcacatggagcggtgacttccggaatggatgtctcaatgttatttattccgggggacaatacgtatctttccggtgggaaattaccgacttgcagttccaccggtctctttttatgatgccagttgactgcttttattttgaccggctgtctcagttcttttttctttccgaccaccaatacaggagagaaggcggaagatacgagactggctttggtcgtaagattgtttgtttgcagaggagagtcagatgtcagctttatctggtcgaatgctacccaactgcctgatatatttcggatcgtgagtgtgttgtttcctgctctgaactcatcagccggaatgtcaagcgtgacggataactcttttgaagttgtttcttttgtgtccagatattcagggtttgtgcctttgggtgtttggatggatttctcgaagctgttgagcctcacctccagtcggggaggtgaggaaggatgagtttctgcaaatagaagtcgtagttgtatttgggttgtcggagaaggagcttcggccaatgaaaagccaataacagcctgccctgatatgccacctgcccaggcatcactaggccccggcagaaagtaaggaaaatcagcagaatgatttctccctacttcgtatagataaacatcattgatgtagttccgataatcgtttttatagaacttgaactctttggcggatttatctttgtttcctatttgccagactgtattttgagaatgagctgtgagagttcccaacaatccgatgatacaaacgatttctttaatttttatctttctcatgtgagttccttttagaaaatgatatgccgttgctatatcttaattagaattcgtatgtatcaggtgaccagctatccagccattgaatagccatgcttccgtcttcacggaactgtataggcaaccagatataggttgagtgaattaggtctgttttattccatttgtcaaacatggctatgtatgcgtctttctttccttgaatcggcagtacatgggtactttgtccatagaaggttttgtcggcatcttttcctacacaaggatttccttttacggtccatggtcctaaaatttgggtagccactgcatattccgcttcattgggactccagccggtacatcccgaactgatgacgtagtatagtccgttgtgtttgaacacagcaggggcttcccggaatttacctgcgaaattgcgtgtgaaagtgccggaaggtttcaggtaatcgtcggacagcaaactgatatataatgtagaattctgttcggaagagtagatatgataagctttgccgtcgtcatctttgaatagggtcatgtcccggctgatttgcccgttcgggtgcatcgaacccagataggtgaaaacaccagtcggtgaatcggaaacagcgactccggcagcagctttattgtagtcgtcactgtccacgtgcagccacattacaaatttcttggttttgtcattgtatataactttaggtctctccagcactttggaaggatggagatcggattgtgtgtcagatatttccggttggagaacgagtccttcatatttccagttgagaaggtccttggaagagtaacaatttactccaccggcttccgtacgataacattcccaaccgggaacattgggattccagtaagtggaatcacttttacattcgccataccagtagtaaattccctcgtgatataatataccgcctccgtgagcatttattttctcgttgttggtgtcgagccattctactcccggagtgatggctgtatacttgtgtgatgtgtcacgtgatgactgacatgataataaaacggctgctgtgataagactgagtaagatctttttcatttgttactattttttttatgatgttatttgattccccaatttttattcggacgatctcccatttcaagttccaatgtgccgcctttgagcagttcttttgccggaaacttgaaagagttcaacttcttgccgtttagtttggcggactggatgtacttattttcccgcgaagtattgctagctttgatgataaattgctttcctctaccgaaatgttttcccaaatctatttttattttttcaaacagaggactccccagttcataaacaggttctgcgttacaacctccgtccgtctggaataatcccaatgcagccatgacaaaccaagcgctcatttgtccttggtcttcgtctcccaaataggcatttgatgtgtcaaagccataatagcggtcgataatggaacggctccaccgttgcgtttgccacggttggcctgcccagttgaatagaaaggcgaagtgcatggattgctggttaccttgtactactggaaagtcccaatactggtctcccggggcattatacctccatggctcactggctttgaatccccatgacagccggtcgatgaagagctctttaccgataatttcggtgagtgcgggaacgttctgaggtacaaaaaaagtaagttgccaggcgtttccctctacataatgatggttagctcctgatttgaacggatcaaagttcttttcccattctccattgctgtagcgcatttgggcataacctgtcgccgggttgattgcgtttttccaccagttgcctctgttggagaatgttcggtaatattcctcttttcccagtgcttttgctagttgagagactgtccagtcgtcataagagtattctaatgtgttagaaaaacgtcctttgtcggcaggtacatattgatgttgcagataagtttccagatctctgttgccggcaaaaccattggctacacgttgggctggggtagtttgcatctttacgattgcccggaacattttttccgcatcgtaattccgtattcccatttggtaagtacttactaaaaggggaatctcatgttcgcccaccatgacaggtatgtatttcattccgctgggaccttttgccagccatccgttggcgtcatacatagccaactgcgattttacccatctggatgaccactcgggagcaatcagattccatacctgattcagattccaaaaagtattccagaaggcatcgcatcccaaagcgacagcatccgggtcgtccagcttttgaatgttgcctgctgcatccacccatctgcggtctgcatcactgaaagtattccggcagaacgcacggtataaattggtgtagaatcttactttttcccgataatcgttgctgtatatccgaaccctgtttaaaatattattccaactatccgactgatgtttgtgtacagcttcaaaattccacccgaatggttccgttatctcattggaaagattgttggaagcccctgccatatctacataagatattccggaacgtaccataacttccggatgatcggtagtatcaaattcggcataacagccgaatcgttgagggtagtgggctgtcatagtgtctgtttcccataaagtatgatcgtgccatcctccaaatttcttgatatctttattgaactcaatcacgaaatagattgtatagttctgatccgcatccgccgaccatacgtttttggatagctgcttactgaatccttcgatccgtcgtgctcctgtttgctttacacttccttcaacaatctggtaatcgtattcactagggattttcaggtcgatcatgacacgggcatccttatcttgcggatatgtataacgctgaaaaccacaccgggaggtggcagtcagttccgccttgatttgataatcggtcaagtctactttataatatccgactttcgtttcttcacttgttttgtcgatggctgaacgatacgaattggcatctttgactaaggaagactggctgcctatctccgtttttaaaggaccgttggcaggcatgatgcccagacccgccatggtccattcgtgtatgtggctaaacgtacctatgctctcgaatgaaggatcatatcccgattgccaaccgctatcctgattgtccggacttaatttgaccatgctgaatggcatccacggacctggtgctatcatccaacgggagtgcgcagttcccattcgtgtatcgatgtaatcggccagtgtgattgtattgtgaggtgcgcgcctgatcattcctttatctaagattgcaccatcggcggatatgatgtaatggcttgtcttgggagacttgacaactggcatcggagcttctagtatgtatcttcctttttccaaacgttgttccagtatcttttttccatctactttcacttcaaggagaggatgcccggaaagatgttctatgtctactaatagtggttgggctacaggactggtggtttgaaagtccgcagctttaacatcccgaagataaacggatttgttgacttcatttagttcggcattatccggccccataagtctgatatcatcgaagagaatccatgaaccttcgagacttgtaagcgcgatggagttgcttccttttctgatcactccggagttcagaggaatttcgatcgtatgcggtttgatttgtgaatagtcaccgtctattgattttccacttcctttgggaagggcatatttccatgattttccgttgatcgttattttaaatagtgccggaagttcgtggtgagtatctaataggtctatgattaatttccatgagtccgtttcggggacttccttcataccaaagagtatgtttaaaacatgagtccgtataccggcagtataacttgttcctccccaatgatcggcaggtcccggcagaacataaggaaaatctttttgaggggaagacaatccaatgatataaaacctgtcctcccaaccaaaatcatttgccagaaactctttgtatttgtcaggggacaatgccaactcactggcactatgatttttctccccgatttgccagacagtcttggtaggtgctgcacataatccggataggaggaataaaaacgtgaataaactcaatggtattcttttcatattaactttcggtcttttggattcaagatacaaatttgttttttacataggaatgtatcattctttttttgtatacactcctatgcaaaaacaaattcaactgttatcactgtaacaaactaacctttttaccccagaacttgatttcgctggcggaaccataggcccccattcctacgtgtggagctgagagtgattctacaatacggtatctgatgtatcttatattttcgtgttctttatcgcaggcgaacttaatactgggttgccaaccggaaacagaaatgttttttgtagtcagctgtttccatccttttgctttcgcactttcttcccaagccgggtttatagatggaacatccggttcatggctttccaggtcttctacatcttcaattccccatatttggaataatcgaggcatccagtctgttctttcatatccggtaaagaacagttcgcattcggtaatcgttgctgtaagtcccatgtcaatggtcagatgatgaggaactccttgattatcgccggcatgataaccgctgtcataattccatgtatcattgttccataacttttctactgaaccgccataaccgtttacaacatctgaaggcatatttgcgttggcaaagttagttctggggatttctacaatcggatcgtcgggcaaagtgtattctgaaatgggcagggatacgatatccaatgcagtttcgctgggtaggattcgtgtttctactgttaatatagaagtagctttccaattaggtaaattggttgaagcagcatctcctttcactgttaaagttagtagttgctcatttgaatcatagtacttaactattgcttccaccacattgtctgcctgattccaaattaagttgagcgagttgtcggcaatgacgaattgtatatcggtaattcgcttgggataataagtcgctatgtgctccgttccgtatacatctacattgtaggtttcggatagtgaggtattaccttctttatcctttgtggttattttaacgtaatagttgccttcttccacatctttgatttcataactgaattcaggttgcgttctgtcaatgtctgttgtgaaaaccttgtcgtaacctacaagttctattatgcaagtctttgctgtggccagatatttcatagacccctttatcatcatgcgctgaaatcccggctgtatatttacatccgccagctttcctacataaatttgttctccgtctttgatatattcagaataggtatcatgaatatctgtgcaggaggtcatacacaggagaatagtagttattatatatattacttttttcatttctgtctattttataaggttattcttcgccttggatatctccccaaagagtgatttctgacataactgacgtttccattcccgaccatgacatcaaactctggaaccggaagtagcgaatgaatggtacatcctggttaagggtaaatacatggcctctttgggcttcctcaatatcttcctgagtaagcgcatcaccaaatgccccgccggatggtttcttcatttctccatcaaataataccacccagttatccggattctgcaaatctttaccctcttcgcagccatataatttgaagtacttgggagctccatgggcatataataagtcttggctgtccagacgttgccagaattggaattggctgagacgtacattgacattcaaatcaatactgaaggcatgcgggaaaggtatcgggtattcggtatgtccccagttccatccacctatttgtccgtcccatagacgggaatgatagccttcgtggtaatcccagctgacatcatccataactttaacaagttggaattttgttttatctaataagctttctttccaaggagtaatttcggcatacaatgtgtcggaagtgttttcccatttatccctaacgaagatggctaatttcaataatttatgttctaagccttttatagtcaggcgaccttcttcctgttgtgaggagtatacgtcatgaatctcgtattcattgtgttcatctacccatttgtaaatgtagaaagataatgcacttcttgctgcattattgaaatcgaggaagaaacctccaaaactttcagtcacttttaatgattcttgtgtctgaacgactgcaggagtcagaggctcaatagtcacgatagccggtgtggaatagttttcgtggcggtctacagagtaaagtttgacctctctcttttgtgtatcccccagcccttctattaccaaagaatctacatacatggaagattttacttcctgctgttctccgcgggtattagtgaagatagctttgacgtataataaatcgacatcatcggaaggagtatatttaataatagctcctccgtttacattcttcaccgatatattagtaatcggtgccggagcttttccatcattcgtaccgcgtggttcggcctcgtaatcaccggcgcagtttgcaaaacaaactgctgcaagtattaaaagtataaaagctatatttttcatctttgtcatttttatgttaaaagttaccattgaggattctgaacaagtttcggatttctgttgatagaattggtcttaataggccataaataatctcttggcatgaattttctcgtgaagagaactcgtacattataaaagtactccgggtcctgctctaacaccgaccagccttttatctgagtattcagatatgtagagcctaacttccatctgcgtacatcatggtaacgatggccttcgaatgcaagctctatcattcgctctttctgtataatttcacgcattcctctttgggtggttggcttatccgggcggttggaatgattacgccatgtatttaccaaagaacctccttcatccagaccggctttattcctgacctgttgtacatagtagtatacatctgtagtcggagtttcattaagctcgttgagagcttctgcatataacaggtatagatcggacaggcgaataatcgggaaagaatatacgtaattgatattggtcgcactggtgtttacgttttgataactaaccaatttctttgtgaaataacctgtcggtgaatatagttcgtctgaaacgccggcaatatctcctttctttgatttgataggataggagctcgtttcattgtcgttacagcattcgatggagaaccattttccaccatcaaaaccaatataggcataaaaacgaggctctctgtttaaatgcatcttgatagttgtgtagtttggtgtaaaatgaataggatcatcttccggagttgttgtcagtttatatctgttttcatattcataatctttatcctcatccatcgggactccgttcgctgtatagaattgttctacaatttctaatgacggcacaagttgtgagcaactacgaatcattctgttccccaatgaatagctggttaaatgcgcttggcatagattctgtattccatctgttgcattggaacctaatgcccatattatttcagaattaaaacgaccggtaattgtgttgcgtagtgtcaactcttgttgtaaagttgatgaaggagtataatttagcttctcatcaaatttgtataaagaagctccggcttcgtgggcagtgttgatggcatccaggcacgctgcggctgccgcctcccatttttcctttttatactcttggtcgaagaaaggtatcccttctgaattgacaaattcagcatacattgtattgccgttgaataaaggactggcagccagtattagtaatttagccttgattgctttcgcaataggtaatgtgatacgccctaattccgtgcgtggagaagtcacattgaatgttaatccggaagggatgttcatggcttcatccaataaatcagttgtataagtgacgatatcatttatcgtttctctctccagttgcatcatatctaagtctgcttctacgctgatgttctctttaagtaaaggaatgggcccatagtgcaacatgagataataaatataatatgctttcagagtcatcacttcggctttccatttatttttctcttccatacgcatgtcaggtacgcgatcgatgttgtctataaaaatattgcattcatggattcctctgaatatgttgtagcctccctgacctccatcccagtaatttagtaaggggtcgttagagttttgcataccacgtgcaatgttgaatgaggttatatttttatagtagtgggactctggtttcagataccacatttctccaccgcagatgaggccggagttgtgatcaagattggctgctgcaggtacgaagttatagcaggtggctaaatatttttcagcattagcccgagtgttgaatgccatttcaagcgttgcgatattatccggcacgatatcaagatagttgcaggatgtgattaatatcgccaataatgtactagtgaataaatgtttgtatttcataatgtaatcagaagcttaagttaataccaaaattgtaaactgcctgaataggatattgcattccgtcgtttccttgttctacatcccataatttaaaacgattccatgcgaaaagatttagtccgctggcatagattctcaaattggacatacctagatggctggtcagccttttaggtaatgtatatccgatttcgactgattttaaacgcaagtaagaaccgtcgcgtaaccaccatgtactgtttctgttattgtttgcaatgtcagtagttgacaatcttgggaaagtagcgtatatattacgattcgattcagaccagtaatcatccgcatatgcttgcatcataccattgaggttgtttcctccgagatccatttgcatgaaaggattcgttgctttggaattaataaagaaagaagatctggctgctccttgaaagaaacaagaaatatcaaaattcttgtatcccatcgacactccgaagccgtatacaatttctggagatttggcaaatccaattggaactatatcttcgtcattaattattccatcattatttatgtccttatattttatgtcaccaggcatatattctccgtatgtctgaacaggtgaatttgcaatatcttcttcatcaataaacagtctttccgctaccagtccataagattgttcgatacgttttccaatgtggctgagccaaggataaggacggtatggctcttctacatactcgtatttgcctgttgcataagtgaaattaccacgtactcccagccagaagtttttgttaaatgcgtggttggcatctacttgtacttcgaatccatgtgaagaagcttctcctttattagcaaaaagaggtgcactgaatcccatttcatacgggatggtttggcgttcgccaaagatgttttttcgatattcggtgaagtaatcgaattgtatgtcaaatatattaaatagcccaacttcgagacctaaattcattttttgagcaatttcccatttgattttgtcatttcgatagcgtatcatgtcgatagtaccgacattccgttcaaaatcttgtccccaactgaaatttgcaccactaccgtttagatttacctcggacatataaaagaatctgtcattccatgcaccaatattgtcgttacctaccaaaccgtaagttccttttagtttcagtttattgataatattcttaaggtcttgattccaaaacttttcttcggagatcatccagcctgctcctatcgaaggaaagagtccgaatcgttcatttttggcaaatctttcggaaccattgtaaccaaagtttgcttcagcaaaatatcgtccgtcgtatgcgtatgtaaaacgacctgataatccaatgttacgggctggtaaagatgtctgtatcgaacttgcgcctccgctcttattctctctcagaactcctactaataatccggtgatattatgcttttcccggaacgtacggttgtagttgagagatgcttcataataatacgaactgctgacttgattcccttctgctgtataatccaaatcttcccgtccaccattagggttcagctcccttaaagtatatgtgtcggttagtttatcataatagctgattgaataataaaagggtgaagtagaacgttgttgtccgctgtatgaatttcgggtagtacttgcgaagactttgatactaagtcctggagttataaaatctaatttctgatttaattccgcctgggcagaaataaccgaattggtgtattgtttgtaaccacgtatcatttccgcatagggattgatgtaattaccatcacctgcgttaccaaataaaatatgtgaagtagatgtatgattttcatcaggcatataatatttggggaataaaacaggacttgttgccattgctcttcggtatagatcattgccgcttacaataggaccggtataatcatcaaaattgccactgaattttacagaaaatgtagtcgtcttggtcacatcaatatcaatgttagaacgtacatagattttttttaaatcaatgttactgttataattgtttcgtttatctaccttcatgataccattgtcatccgatatgcctaaagaaacataatatctggcagtttcactacctccgctcatattgatgttggcacgtgaattaaatacattatcattaaataattcattgtaccagtctaccgccggatatacatagggatttttgccggcttttgttgatgctattttctcatcggtatgaggccggacagctaacggattacgtgtgagtacagcttcattgtggtatttcatatagctgataggatctaccatgtctattctttttgtaggtgctgacaatgaaccttccactctggcactaatttttaccttaccgggtttgccttgcttggtagtaatcaaaatgactccattagctccgcgtgcaccataaatggcagttgctgttgcatctttcattatagagaaagcagcaatgtcatctgcggacagtctggaaagatcagtagtagatgattcgatattatcgattaatatcagtggacttttagagtaaccaaaagttgtcacaccgcgaataaagaattccacattgtcatttccaggttcaccggacaactggtaagatataattccggcaacattaccacctaaggcttgagtcagattactggttggaatttttaatctttcaggttttaaggttgatattgctccaatcacactttcttttttctgtttagcaaaaccaaccacagtaacttcatccaattcatctacctttggcaaaagtttaatggtttgaggtactttatctatcttgtattcaatagattggtatcctaaaaatgagaaaatcaaaatagagcctggttcggatgaaatagtaaataagccatctatatccgaaatggctccttttgttgatcctttcacctgtacagtagctcctgcaataggcaaatctgtttcatccacaattttccctgatattgctttggatgagttgttactactactggtttgagcttgcaaggttacatagctttcaatgattagaaggaaagctatccataatacgaagcgtggtaagttgcataaaagcttcttcatactctgtgattttaaaaagtaagtcataagggttttatattagatttaatgtgatttcttgtatataaaggctgtatattttaatctacatagtattaattgcttatgatatatgtattatataatgtctatatgtatatacatat

SEQ ID NO: 73 - DNA, 37232 bp, Bacteroides thetaiotaomicron
gaaaataagtagttttttttctttaaacaaaaagaataattatatcggctaacaaaattacaatattcaaaacagaatgaaccttctttggcattaaatgaaaagataataaagaaatccctggaactgctgtagacactcagcattccagggactctaacacacaaaagttattattgaaattgaaaacagtttctaattaaaagcgtaaacctaaagtcatcatcactttactacggctatttgtcacatcagtcttttttaaagctccatcatcaaatggatagaaatcttccttataagtactatacatgtaagccaagtctgcgtaaaaagtcgatcctctataaccgatacctaatgtataattattatttgcttttgcattcgcaaaatccgtatccgtattaattgaattgtagctcaaatctttaaaagctgtttttttgaatgctgctgacatataattatagcctaaacgaaaagcaaattgaggaataactttccactcagcaccgatacggaaagtattcacacctttcaacatttcttttgctgtaggattctgccatcccattgcttctccatccgaataactaaaatgcatagcggagtaatcctgatattcatattctgctccaatagcgaaagatgatccataagtatacccaagacttaaattatatttccatggtgtacggaaacggaagtcatatccataatcaacaccattcgtaaaatcataagaatctacaacagcctcacttaattttttagagtcaaaatcaggggtatatgtcactgctctaacattcgttttaattttcaaattataaaatgtaggagtatgaacagaaacaccaatacggaatggagagtcttcaaatggacgcacgatagctccaaacttaaaatccacacctgaaccatctattttattctcagtagtcatttcataacttggagtaccataattcacattttctacaatatattccccatactcctctccataagtagaaatctttgagtaattaacatcgtaagcaccaatggtcaatcctaaataaacacgatcacttatattaaaagcaacattaaaatcatactgattgattcctcctttttcatgtccatcataccatgaatatggttgaggtaaataacctatatagccatttttatcttcattttcattatataaatatccattccagccgatagcagccagccagccagtctgactatcagtaaacagattaatcttatcatcagctaacttactgataaagtcaccattcgctttaatcatagtgttcgcttgattcgtcatttgattagtctgagaaagaattgttcctccaggccccagattaatcaaaccttccattgtcatatacttatcaaatgacttggaacgagtgtaactgaatccaaaattcacataacgcaaagcggtctgatttccaattttagaagaaaacacaaatcctatattatcaaatgatccacgagtcttatcaacattaaactttgatccttcatatttactctccgaaccaaaagaagaaaagccgaaagttcccattatatcattactacgatatataccaataccagccggatttgtccccatagtagaaatatctcctcctagtgcacccattgctcctcccattcctacaaaacgggcagttccattcaaatccttctgcgtaaacttagcaccatcgtatattgtctgggcgcttgcacttgccaccataataagagcaagtgcagctatatttattttctttttcatacgtttccttaaatattattatatgctatagttttatctcctgctaccgcctctagctgaacctccaccaccggaagaacttccacgactactgctactacttccgcctccatacgaagaaccactagaacgagaagaactgctactaggagaataagaactggaactactagaacgactactgctactaggagtatatgttcgagaactactactagaacggttactactgctaggagtatatgttcgagagctactagagcgactaggtgtataactactacttcctcttgaataagttccgctacttctagaagaagatcccctattataagtaccttcacttcttgaagaagaagtacgagtgctactactacgattcatacccgaagatgtgctggtacgagtactgctcggacgagtataggtatctctgcgagaagaactagttcttgtacttactcctgtccgtgtactattctctctggttcctactacacgtcccgaagttgttctattcgaagatgtacgaactgatgaaggacgagaagactgataacggttagaggtatatctggtaccattggtagtacggttaacactcctgttaggagaacgacgattggtgtatagcatgtctctatgaccaccgccccagccccagctaggaccaccaccccagtggtgatgatgtccccaataaccgccgccatagaagccaccccagtagccaccataccagccgccccatgaacccgggtaatatccccaaccatagtaaggacgattccatccccagccatagttccatccccaaccgtaggagttgtaacgccaatcccaccaaagcggattactaaatgtcgggaaagcataagcgtacataccatcagtatatacattccagttccatgaattaggtccgtaaacaacgtcccaatagagtggactgctaatgctgatagcaaaacgtggattacggaaacggataatacgttcagcatattcatagtcctcttgcgaaccatcaaattcaccggttacccattctccttccaagtctggctgagctttctcttttatatataaggtatcgttttccattacgaattcattctcacgagcgtcataacggcggttatattcatccacatcccgtgtttttcccttgcggtcctgaactacaacggtagtgcccggtgatgtatagatgttggtcgtgacttgctttctcggttccttcttttccggagtcgtttctttcttctcctttttgtctttagaaggtacgaaataaaggtcgtcatcaacgctttgtgccatcaagcctatagggaggcataaagcaattagcaagaaataaacaatctttttcatatcatctcggtttatgtaattacttaaacttattcacattacaaagataaggaagagattcgccactctagggagattttccccaaaggataatagggaaatccctatttctaactatctttgcaaaagattcaccaaattaaaaacaactatgaagtattttgagttcacattccatacaagtccatgcacagaaacagtaaatgacgtactggctgccgtattaggtgaagccggatttgaaagttttgttgaaagcgaaggcggactgactgcatacatacaacaggcattatgcgatgaaaatacaataaaaaatgcaataaccgaatttcctctgcccgatacggagatcacttatacatacgttgaagcggaagacaaagactggaacgaagaatgggaaaaaaatttctttcagccgattgtgatcgataaccgatgtgttatccatagtaccttccataaagatgtaccccaggcaacttatgatatcgttatcaatccgcaaatggctttcggcacgggacatcatgaaacgacaagcctcatcatcggggagttactggacaatgagttgaaagataaatcacttctggatatgggctgtggaacttcgatcttagctattctcgcccgcatgcggggagcacgcccatgtatcgctattgacattgacgaatggtgtgtacgaaactctattgagaacattgaattaaaccacgtagacgacatcgccgtttcacaaggagatgcctcatcgcttgttggcaaagggccctttgatatcatcatcgctaatataaaccggaatattctattgaacgacatgaagcaatacgttgcctgcatgcacccgggatcggaactttatatgagtggattttatgtggacgacattcctttcatccgccgggaagcagaaaagaacggactgaccttcgtacatcataaggagaaaaaccgctgggcagcagtgaagttcacatattaagcattaatcttccttatctgtttcaagaagacacagaccacgtatctttaaaagacagcatatatttgtagtagagataagatgtacgagatgctcatctcgtgctgtacggcatgctcatcttgttatacaccagatgctcatccagtagtgtacgagatgagcatctggtacataccatcctttaatgaaaagaatggtatgatataatattccttctgttatgttaccgggaaacagatataaagtattaaggttttgaatcaaactcattctttacctgttcgcaccattccctgattctcttttccgcttgctcggattgattatccaaatcgacgaccaaaccgcaccaccgatcaccacgcaacgctctggaacgttcgaaagtgtatctttcggaagaagtaaaaccgaccagtgtggccccgtctccttcaaatacctcggcaagcagtccgattccgtcagcaaagttttcgggataacgtatctgatctcctaacccgaagacagctacttttttccctttcaagtccaatgtacgaagttccggcaataactcatcccaataggtaggaagttctccgtcaaaccaggtcgaagcacctactattaaacaatcgtaagctgcaaaatcattttgccatgcctgctcaataggcaccacttctatcctatcttttccaaattctttctgaattttctctgccacccaagtagtcttatcagctttggtggcataaaacaaaccaatcttcttcatatactatacctccattttattccattaatattccaatagctttttagctgcctcatagatcttcgcctcatccggcaatatctctttttccagaatcggattgaaaccgacaggagtaaatgtagatccgacacgctgcaccggaccatccagataacggaacatatccgttccgatcatagccgcaagttccgcaccgaaaccggagaataccttgtcttcgtgaacaaccaatgctttactagtctttttcactgattcgaaaatcgcctccttatctaatggtatcaatgagcgaatatcgatcacttcgactttccagccactttctttttccagttgctctgctacgtgcaggcagaaatgggtcgtattgccataagtaataatgctcaaatccgttccttcacgacgaatacgtgcctttccaaaaggaacctcaaaatcttccggaacaacagctgccgcttctaccgaattatatagagctttcggttccaaaaacaaggtaaatccctttgaacgcatactggttcgtaacaatccggctgcatcatctgcaaaagaaggacagacaatacgtgcacccggcaacgttgtcagagcaccctctatattttgggaatgatataatccaccaccgatatatcctccggaagcaagccgtaaagtgatattcggagcaaacttaccgttactgcgccaatattcatgagtacactccacatactgttctacggcaggccagaagtagtctgcaaactcagctccttctatcactacatggattttagggtcaaatcggctcataccattggctgtacctacaatataatcttcggcaatcggtgcgctgaatacacgcgcctcgccaaattcctgctgcatgcctttggtcacattaaagaccccgcctttttctctgtttgccacatcttgtccccagataaaggtatccggattatggcggaattccgctttcaatgtttcattaattgcattgaccaggaaagtcttctctccttcttcctgatgagtaccttctttgtatttttgcggctgataaggttcgggcatcacaaaatcgtaaatgcttttaggatcaggttcaggggcagccagcgccttgcggttggcagcagatagttccttctttgattcagcttcaatttgcagcagttcctcttccgtcaagcgcttatagcgcaataacatccggcggaacttcattagcggatcggcttctttcacatattccagttcgttttcatcccgataaagtgtatgtttatccgaattggaatgagagccgatacgaacgcagttagcctgtacaatcacaggattacgggtactgatcgcatattcgcgtgcctcagtcatggcattcatggaatcgaacacatcttttccattgcagtagataatcttcagattcttgaaaccggagaagttctcggctactttacgattggcagtctgctcggatttaggaacagagatgccatatccgttatcctgtataacgaaaatcactggaagacgttccagactagctccattgatagcctcgtaaacaaagccttcggaagtagcagattctccgtgcgaagtgattgctactcctttatgcccataatataccattgctcttgctacacccgccgcatgcaggtcatgcgttccggtagcagaagatatattttcaatatgccattccggtttggcgaagtgattcgacatatgacgtccgccgctaccgggatcggttgctttcgaaatgccgttcaatataatctcttccgcagtcattcctgcagaaagcacagtcagcatatctctgtaataagggaacaggaaatcttctcccaatgtgaaaacctgaccgacagccagttggataccatcatgccccgcataaggagcatggtatgaccaacccaaggattgcagctggtaagacggcgccttctcgtccaaagcacgccctaatgtcatcagatggtaccactttttcagtgtttcaacatccgtagtctttatatcatatttctttttcatagttaatgaagttcttaatgaatgaaacaatctgttatcagcccttccagttttccaggtaatcggctatgaagtgcaggaagttgcctcccagcataccgtcaactacacgatggtcataagacagggacagatacatcttatgacggatagcaatcgtatcaccttccggtgtctctattacggcaggcttcttctcaatatatcccactcccaaaatggcaacctggggctgattgatcaccggcgtaccgaacaaactcttgaatgtaccgaaattagtaatggtaaacgtacctccgtcaatatcatctggcatcaatttgttatcacgagccttcaatgccagcgagtctatagctacagccaatccattcaagttcagatgatcggcatcgtgtaccacaggaactatcagattgccatcattcaaagaaacagcaataccgatattgatatgtttcttgaaaagaatattatatccgtcaacagatacattgacctgaggatatgctgccaatgcttttgcaacagcttctgttatgacaggcatataggtcagtttcactccctcacggcggaagaaagcgtctttattcttttcacgccagcgtaccagtttggttacgtctacctctactacattggttacgtgtggtgaaaccttcttggacatcaccatatgatccgcaataatccggcggacacgatccatttctttcacttctactcccggaatattagcagctgcaggtgcttgtttagatggagcagacggtgcagcaacaggagtttgcacggaagccgccacaggagaagttgtcatagagccagcccctccagtcgaagaaggcatagaagccgtaagtgcatcaccggtaggtatcgccgccttcgagacttcggaaattccccttttcttcttctcaatataatcctttatatctttcttgcttaaccggccttcgtatcctgtgccttgtatcgaatcaagttcttctttcggaatatttgcacctcgtgccaattgaatcaccacaggagaataccagcgttcctcagcctttgctacctgagaagatactttttctgcatcagaagaagcattctccttactttctggagtttcttttccacttgcagtttcttcatcggatgcctcttcacctcccatatctacaacagcaaccactgtacctacagcgactgtatctccttccttaaacagaatttccactaccttaccagctaccggtgaaggtatttccgcactgactttcgccgtatttacctcgaagagaacatcgtcttcctgaatgacatcccccactttcacagaccaagagacaatcgtcccttcggttatactctcgcccaacttaggcatttttatttcgaatcttgacatagacagtaaatttattattcaaccttgaactattagaacaacccgctgaaaaagaaagttttaagttaaagtatttttaaccggactcaacgactgaagatccagtcttcgcaaatatatttctcagtccgaagtttatggattgcttccaattctttctcactgaaagtatcagcacatcccttctgactaaaatattcgaaaagtatcgctttgaaatgatcaaccgtttccataggtaagtaacgactgatatttgtgacttcactacggacagacggaacagcatacacaggcaatgccacgcccgtctcaatgtccctctccggattcaataccttatttaaagcagcaagattcgtatcatacagcaaagtacaatgataaagcaccctgttcttgtgtacgcactgggcactccccgatattttcagaccatcaagatagatacccagacgttcatctccttttgccggcaatcctatcagttttaagaaatccaatatccgatgaagataaagactgaaatcaggcaagcgggacactgtttcgataaaagttaaattgacattacccaaatcatgatatacagctcccccacccgaaaaccgacgggctatttgaatctgttgttcttccgcccattcccggttcacttccaactgtacagattggtgttttcccatcactacagaaggagtgtcctgccaaagcatgaaaacagaatctgtttcctgcttcagcaaatactcttctgccgccagatgaaaataaatatctgtaaaagtgttatgaaagcacctcatgataaatctctccaaccgtaggatggggaaatacattcttctgaaattcctcaaccgtatagcccttctgaatagctattccggcaatcacaatcaattccgacgcaggatttccaagcatatgacaaccgataatatgatcagcttcatcaagtatcagcttacatattccatttacttgttcgttttccgcaacaaaacgtccggaataagccatcggcaacttcgtaacacgataaggaatgccctgtttggtcagctcttcttctgtcttacctacgccggccacttccggattggtgtagacaactcccggcacactgttataattcatccggtcttccactcctaaaatatgattgattgccacttccgcctcccgaattgccgtatgcgccaataaagaatagcctgtaatatcaccgcacgcatatactccgggatgagaagtctgaagatattcgtctactttaaccccattccgatgaagttctatattcagcttatccaatccgacattggtaatatttgctttacgccccacactgagcaagatcttttccgttttgatagtagaagccttcccatctttctctatgacgactccgtcaggtttcacttctattacttttgtattcaagtagaaagtgactccacgttttgcatattccatacgaagcatactgctggtttccttatccatgactcccagtatctccggcatcatctcgacaacatgcactttcactcccatactgttgaagaaagaagcaaactccattcctatgactccaccacctataacaaccaacgtttcaggaagctctttgatctccaaagcctcttttgacgtccagtaactaacttccgacagtcccggtatcggaggaataaccgtgtcggaaccggtacataccagcagatatttcacttcatatctttctccgtcacagatgatacggatcagcccgttttcttctccttctataaaggcttctttttccacgatcgtcactccgtaagagttcacagtcatctttaccccaccagtcagcattttcaccgttttctctttacggctcattattttagttaaatcaaacgaaggagattcggcagaaatgccatatttggaagcactcttgatgctatccagaattttagcagaatataacaacgttttagtaggaatacatccttcattcagacacaccccacctattgcctttttttcaaacaaaacggctctcagtccgtttgcccctgccctttcggcagctgtgtaaccagcagggccaccaccaataatagctatatcaaagttcataatcgtatctttttagtaataatacgattataacaaatgagagaagagattagttgtatgacagatcaatcatcctacttgatcgtcagctttttgagttcttctaatgtaccgttgaatacattgaggtctacatcttctttaataccgggtacatttccgacatcagtatgttgccagaaatcccacttaccctgatatttcaccgaatcgacataatagtgagcgatccaataaggataagcattgaaaatagaatcgtccagataacgggtcttgaacttataagaggtataaagaatgggcttcaccccataatgggattctatacggtccaaccagcgcttaatgccttgctgcaattcttttttctcttttcgtccggtcacttccacatcgagaaccggaggcaggtcgccggaatccagtttgaccgtacgtataaaaaagtccgcctgtttcaaagcatccgtaccgggaatatagaaatgataagcgccacgaataaagccatgattacgcgcattagcaaaattagtttgaaaggtagtatcgttatgatctcccccttccgtcgctttcataaaaatgaagtgcaaaggagttgccgtctgtttattctgtaaaagtctcccccagtctatttttccttgataatgggaaatatcaatcccatgaatatcatatccggaaggaatacaaactccatattcctttaaaccattacaaggtttccaccgataagcataaggacgtataaagaaataatagaaaaccatagagaaacaaccgacaattgccacagccaatatatttcgaagccaaccgggcatcgaataatgctgcttcaccggtgcctttttcggagcacgggaaggcctggaagaagaaaccgtcctcttttttggggtagtggaagcagttcttttcttttggacagcagaaatcggattattacgtgacgacatttactttgagtgatgaatgtaatatagataggcacggattacacggaatacacggttttaagaaatagtataactaaaaccgcgtcaatccgcgtaatccgtgcctgaaagagctcttcattgcaactgtttcttactacagtccggtgaagttttcttatttagcttgttccaattgcaaagtcttagttgcctggtcgcaaacttctgtaggaccaaagtactgaatcggacctggatatacataatccgtttcaacagcccaacggtcacgctgtgcagcgaatgctttgaaaggagcaccatccaatttcactaatgctttctggatcaccggtttcatttcaccgtggcggcgttccatattcatcatcatggtgataggcacaccacctgcaatccattcggcagcaggagcagttgtgttgcgtacagaagacatataaccggtcttaccgtcagcaatcagcatagaagctgtgtatcccaaagaatagcagtagtcagcatcaaagtttgacggagcagcgcaacgaccttcgtaaccgaagaagtggtgctgtgcagcaaacttacccacatatttgccatcttctttccaagcagccaatttggtagctaccatttcagacaacagtttttctgtttcgatcagtgatacctgaacgtttccgtgcgggtcacgatccagtgtcagctggcgagctacaccttccggcagacttgcatagatagcagagttttccggagacagcttacggatgatgtaatcacgttgatgagacttcttgatctgagagaactcttctgcatttgcagccaggaagtcgttcaattcagcgatcagacgcttcatagccggaataaattccaccaatccttccgggatcaatactgtaccgaagttatttccctgtgcagcacggtcagctaccactttagcgatagatgttactacatcatccagagacatatctttttcttccacttcttcagaaacgatacatacgttaggctgtacctgcaaagcacattccagtgcgatgtgagaagccgaacgacccatcaatttgataaagtgccagtatttacgggctgagttacagtcacgctggatgttaccgattacttctgcataagtcttacaagctgtatcgaaaccgaaagaagtttcaatcatatcgttcttcaagtcaccgtcaatcgtcttcgggcaaccgatcacctgtacaccgtacttcttggcagcatagtattcagccaatacacaagcgtttgtattagagtcatcaccaccgatgataaccagtgctttgatgcccaattctttgatgatctcaaatcccttttcaaactgagcttcagtttccagcttcgtacgtcccgaaccgatgatatcgaaaccacctgtgttacggtattcgtcaatgatgtcagcagtcagttccatatagttgtggtctaccagaccgccaggacccaagataaagccgtacagcttactttcaggattcagctttttgataccgtcgaacaaaccagagattacattgtgtccgcccggagcttgtccgccggaaaggattacacctacgttcatagcaggaagttgaacagcttcacccgcttcgaatgtaatcaacggcattccgtacgtgttagggaataatgctttgatagcttcctgatcggctacagattgagtagcagcacctgctacagctttaacggctcctgttgccaatgctttcggaagtttgggctgataagcagcccttgcgatttgcaatgcacttttagtcattttctttatttttatttaaaggtgttagtaagtttcttgtcaaacttgaaaagcgttgcaaatttcgcatttttcctcgaattatgaaagagaagccctcattttatttcgctgcatagttacagaggctattgcttccagccaccgccaagtgctttatacagttgtactacggtgatcagttcatcacgaatagcgttactcagaccaatttgtgcgtcaaaataaccacgctgggcatcgagaacatccaaataattgatcactccattgatatattgcaactgcgccaaatccatataactcttagccgaacgttccagattggcacgaagtgcgtacacctcttttatcttattaaagttgacaatcgcattacgtgtctctttgaaagccgtcaggactgttttctcataactatgtatttctgcttcataggccgcttttttgcctttcaacgcagcacggttctttccccagccaaatataggagtcaataaagcaccttccataacggcataaggcgattttagaagttctgacaaagacgtgctttcactaccgaaaccacccgtcagtgccagacgaggaaacatattcgtataagccacacctacttttgcattggcagcgatcagcttctgctctgcctgacgtatatcgggacggcgttccagcaaagtggaaggcatccctatcggaagagtttccgggaaattaaactcctgaagcaaacgggaacgggctatgcgattcgggtattctccggccagaaaagcaatatcattctctttcagcgatattttgcgttccagatcaggaaccagagtagctgtacgtgccaactctacctgcgcctgacgataagaagtctccgaagtaagtcctccttcaaaacggatacgtgccagacgaaccccttcttcacgagcttttaaagtctgcttgacgatatccagttccgtatccaaggcaaccagctcataatatgcctgtgccacttccgccacaatcgtcatctgaagcgcacgttgcgcttctactgactgcagatattcggcgatgctggcagaacgtgcccatcgcagatttccccaaagatcgagttcccatgaaacaaggaactgcgcttcaaaagtatccgatttcttaaaagcatctcctccatgattttcaagttcacgctcggcagtcactttacctttaatatcgggaagcagcgcggcagtggatatccgtttctgagctgccatttccttgatgcgggcagccgctatcaacatatctttattatgatccaacgcacggtctataagactgcggagtgtggaatccgtgtagatttcctcccaatcctgatctccaaagctgaccgtatcctgatgctgagccagactatcgggtaaatgaagatcaggacggacgtagctcttgcctactttgcaggaagtcagtattcctgcaaaaagtagtatagcaatatatagtttattcagtttcattatttcttatgttttaagattttcgactttgttttatacaccatcacaaagaagaacggcacgagaatgataccaaatacgatagcgaatatcattccgaagaatacgcccgtaccaatcgcctgtcggctcgccgaacccggaccactcgccagtaccatcggaagcattcccagtacaaatgcaagggaggtcatcagaataggacggaaacgtaatttcgctgcgtagattgccgactgaatcaaatcttcacctctatctacctgcactttggcaaactctacaatcaaaatggcattcttggcggcaagcccgacaagcattaccaatccgatctggaaataaacatcattctccagtccgcacacccagactcccagataggctcccaaagctgctacaggcaaggatagcaatacagcaatcggcactgtccaactttcatattgtgcggcaaggaagaggaagacaaacaagaacaccagtgccatgaccatccccgtctgaccgcctgcctgtttctcctgataagaaagtccgctccactccagtccgatattatccggaagatggtcacgggcgatctgctccataatctccattgcctgaccggaactgtatccctgcgcggcagcaccccggataacggcagtagtaaacatattgaaacgcttgatacttcccggccctgtcgtataagaagcattacccaaagatgtcagcggtaccatagctccattggaagctttcacaaagaacaggttgatattgtctttatgttcccgataaggagcttccgcctgaatatataccttatatatacggttgaacatattaaagtcattcacatacaccgaacctgtatacgctttcatcgtagaaaacacatctgccaagggtactcccagcattttcaccttgtctctgtccacatcaaagtaaagttggggaatctccgactgcaaggaagaagacaaacctgtaagctccttacgtttggaagcataatacatcaacgtatctgccgcatctaccaaattatcgaaagtagcctctccacgagcttccaactgcatttcaaaaccaccggagctgcccagtcccggtatgaccggaggagtagacaggtagactttacattcggggtattctctcaaatgtttttctaccgtatccataattttttcaatactggtgctctttctctcttcccagggtttcagaataacggtcaactcggcacgtccctgattactgcctacacgcggactgcttccggtcacgttctgcacatattctatatatggattcttctccagataagcaatcgcgcgttccgttactacacgggttcgctccaaggtagctccttccggcagttcaagttcaatcttaaagtatccctggtcttctaccggcaagaaactggtcggaataatccggtgaatcaacagaatagcaatcaataccataccaaaagcactcaaaacccgacgaggatgtttgatagtacgggtgacggcagctacatacttattgcttccgatacccagccactcattgatctttctgaatactatatttttcttcttgccactatccggtttcaaaatgagcgaacacatcacagggctcagcgttaaagcaaccacagtagaaatcagtacagataccacgatagttaccgtaaactgacgatacagctgcccggtaattccactcagaaaacttaccggaacaaacacagccgccaataccagtgaagtagcgatcaatgcgcttgataatccgttcatcgctttctttgtcgcctcatagggactcagcttctccgtttccataatatgctctactccttccaccactacaatcgcatcatcgaccacgataccgatggcgagaatcaaaccgagtaaggtcaatatattaatagagaaaccaaaaatcagcatgaatccgaaagtaccaatcagggagataggtaccgctaccaccggaatcaatgtagcacgccagctctgcaaagacagatacactaccaacacaaccagcaccaatgcttcgaacaacgtcttatatacctcatgaatagactcagagatatacgttgtcatatcaaacggaatctcataactcaatccttccggaaaattctcgctgatttcttccatcgccttctttacattctcggctacttccatcgcattggcacccggcaacatgtaaatacccagtaccgctgcattctcaccattgataccactctcggtattgtatgaagaagcctccagagatacacgtgccacatccttcagccggatgatggaaccattggcattggcacgtaccacaatatcctcaaattgccctactgtagaaagacgtccctgagtagtgataggaatcgttatatccagtccctgtaccggctgctgacctaatacaccggctgccgattcacggttctggtctttcaaggcattctgcaagtcctgcacagtcaatccgaagttagccagcttatcaggctctgcccatatctgcatagcatagtaacggctaccaatattggatacacgtcctactcccggaatacggcgaatcacatcgagcacattgatcgtagcaaagttgctcaggtaaatttcgtcaaacttaggatcggtagaagtcagacagagtgtcattaactgactgggtgcctgtttctctacggaaataccattctgaatcacttccgccggaagacgggattcagccagcttcacacggttctgaatttccacagcagccaaatccgggtcagcagatacatcaaaggtaactgttgccgagaagccaccggagttagaactgtttgattccatataaagcataccgggcgtaccattgatttcctgttcaatcggagtagccaccgcctgcgacacggtaagtgcactcgcacccggataagacgcactgatctttaccaccggaggcgtgatctgcggatattgatccaccggaagcatggtcagcccgatgattccgacaatcacaatcacgatggaaatgacagccgaaaataccggcctgtctataaaaaaactaactttcattgattattctccttttgcgttatccttcattcctgttgtagaatcacctgccaccatagtggtatccttcacctccgcttccggctgactgatccgtactttcatgcccggggtcaacttatggaaaccttctacaacaattgtctctcctacagcaagtcctctttccactacgacgttattccccacttcgggtcctaactcaataaaacgtttctctactgtatcatctttacgcattgtataaatataagctccgcctttttcaatggtaacagctttcatcggaacaaggatagctccttcacgcacgtccaaaagtagttttactttggtaaactgtcccggaagcaatacctgtttcgggttaggcatctctgcacgtacggagaaagtacctgtctggggatcgacctgcggttctgcaaaatcgacatatcctttataggggtaaaccgtattatccgccaaagtaatagttatgttcggttgccaggaacgggtagaatcctgttgtccgaggttaatattacgttctttacttttcagataatcaagtgccgtcatactgaaatcgaccaatacggtatcgctttttactactgtagccagcagagactttcctccgggacctaccagcgttcccaagtctacatttctttcactgatatgtccggcaagaggtgaacgaacaatggtatagcctaattcgagttcagcctgcgccaagtccgcctcactcatcgctactgtcgcaacagcgctttcataagctgcttccgcattatccagatccagctggctagcagcattttgttcgtacaacggacggatacgtttcaagtcacgttcagctttcaatgcctgtgcttcgtcctttttcagctgagcccgtgccttgtcggctttcgcacgatattggtcctgattgatcacaaacaagacctgattcttatttacataagtgccttcggcaaaaagcatgttttccagatagccttctaccctggcacgtacttcgacaaattgctgggcacggattcgccccacatattctccgaatatctctacatcatcttttataaccggttcaacaatcactgtcggcatttccggcgcagccttctgaggtcgagtcagtatccaatatactcccaacacaattaccacacatactacagcagcaatgtttctctttctcctcagtttcaactcatgtttcgaaaagaataatctcatatcgaatcttattatttaatttaacttatgtttgttctacactctattatgcaatacacataccaaaatatcctgttttatcttatctgtttattatcaacatattacatttttcctcttgaagacggaagtgtggaaaacatccttaaagtgtagaatttatccacatttccgacttttagaacattttttatagttcttgtttcatcaactaaacaatttatcccctacatttgtagttatattgtacatcaacacaataacatgtctaatgaaaaaacaaatcttttcaacattagtttttgcaatgtgcctgatattacctttttctgtttattcacaggaacaacggaagaaggtcggcgttgtcctcagtggcggcggtgccaaaggagtggcacatatcaaagcattgaaagtcatcgaggaagcaggcattccgatcgattatatagtaggcaccagtatgggatctatagtcggtggactttacgccatcggttatactccggaacaactggacagtatggtacgcaaacaggactggactttccttttgagcgatcgtatcaaacgcagtgccatgtcgctcaccgaacgcgaacgctctgcaaaatacattgtttcgcttcctttcacaaagaacccgaaagctgccatgtccggaggaattatcaaaggacagaatcttgccaatctgttctctgatctgacagtgggctaccatgactcgatcaattttaataagttaccgatccccttcgcctgtgtatcggccaatgtagtcaatggggaccagatcgtattccatgatggcgtactctctactgccatgcgtgccagtatggctatccccggtgtattcacaccggtacgcaaagacagtatggtattggtagacggtggaattgtcaataattatccggcagatgtggccaaagcaatgggggccgatattattatcggagtcgatgttcagaatgcgctgaaaagtgccgacaagctcaacagcgctccggacatattggggcagattgttgatctcacttgccagaccaatcatgaaaagaatgtagaactcactgatacctatatcaaggtaaatgtagacggattttcttccgccagcttcactccggcagccatcgattccctgatgcgtcggggcgaagaagccgcacgtgcacagtggaattccctgattgccttaaaaaaagaaatcggtataccggacaattatgtccccaaacaacatggaccgtactcttctctttccaattcacggacagtatacgtcacagatatatccttctccggcgtagaggctgatgacaaaaaatggctgatgaagaagtgtaatctcaaagagaacagtaacattaccactcagcagatagaacaagctgtgtatcagttgcgtggcagtcattcttactcaagcgccagctacacacttaccgacactcccgaagggtatcaccttaatttcttgttagaagaaaaatatgagaaaagaatcaatctgggcatccgtttcgactcggaagaaatagcatccctgctgattaatgccacagcagatctcaaaactcatattccttcccgattatccctgaccggccgattaggaaagcgatatgccgcccgcatcgattacacactcgaaccgatgcagcaacgcaatttcaatttctcatatatgtttcaatataatgacatcaacatctatgatgaaggtgaacgtgcttacaacactacttacaagtatcatttagctgaatttggtttttcggatgtctggtacaaaaacctccgcttcggactcggacttcgtttcgaatattataaatacaaagattttcttttcaagaaaccggaactcactgggctggatgtagaatccgaacacttcctgagttatttcgctcaggtacactatagtacattcgacaagggatatttcccttccaaaggaaccgaattcaaagctgcctattcgctttataccgataatatggcgcagtataatgatcatgccccattctctgcgttgagcggctcgtggtccagtgtcatacctgttacccgacgtttttccattatcccatccatctatggccgtgttctgattggaaaagacatcgcctatcccttgcaaaatgccattggcggcgaagtatacggactctacattccacagcaactgccgtttgccggtgtgaccaatatggaactgatggacaattcaatcatgattgcatccgtgaagctcagacaacggatgggaagcattcattatctcactctgacaggtaattatggcttgacggacagtcacttcttcgaaatactgaaagggaaacaactgtttggtatcagtgccggatatggtatggacagtatgttcggtccgttggagattacgttcgggtattccaatcagactgacaaaggaagttgttatgtgaatctgggatactacttctaagtcactatttcggttcctgcatacataggactatacttaccatgatgagaaaaagttctcactgcgatgagacttttttctcatcatagtgagaattttttctcatcgcagcaagaaccattgagaatattcagtatcctaatctgctgttatacaaaattttcccttttctgtagatatagtaatccgatcatcatccagactaaactggcggataaaaggaaaatgcggtttttgataaggattccctcccaaataatcggatgaacattatcgggaacacgaaaaggattcagcagaacgttccaaaaagaatccggcttacctaagaacatcaatgcaatgcctataataatcataaatacggcagttccgtttccactccgcgtaatggtagacagcataaaagccatgtttccgaaaaagagtatcgggaacatcaactgtaatgccatctcaagcggattgaccggatacagcaataaaatggctatgtatgaaaagataatcagaataacaaaaattgccacataaatcatcaataaccgcacgccccaaaccttatacttatagtcggggattccaaagagaatctccaatatccggctatcttcatcattctgaatgccgaatacagccggatagaaaataagcagcatagacggaaacatcaggatgctatagatgagtccctcgttaatctcctcccgtttccacgcattctgaaacataaaaagagcaaaaaagccaaatgcagccaacagaaaccagaaaaacttcccggcaaatataatcttcaggttatacctgactactttaggcaacagttgtatcaattgtttgaatgtcatatccttcttttctttttaattcatattcttcagcagacagagataagcgtcttccaaattagcttctacctctacagccccttcataaggctgtccgacagaaagatagcgcacccgaatcgtatcgccttcctgaatatgatgtattaccaacgatttgtccagtactttttcaaattctgtcttatctatattaaactgccatacttttccgttagccatttccaccatatccgaaggatcaccgaaatatttcagttcacctttattgattaccactacctgattacaggaactggatatatcctcaatgatatgagtggagaaaataacgatgcggtctttactcaattccaccagcaaattacggaaacggatacgttcgcgagggtcgagtcccgctgtaggctcatccactaccaggatacgtggtaaatgaagcagaataagcgcaatgccaatacgctgtttcatacctcctgagaaagaaccgatcttttcgtctttccgctcgtacatatgtaccgctttcagcacatagtccagacgctccctgcgcaaatctccatctacgattcctttcaatatggcctgataatccagaaactcccacgaagtcatattctcataagttccgaattcctgcggaaggaaacctatcagactctgtagttcttctctgtagatacgggtatccagaccattgatccagatactaccatagctctgctcaaagataccacagatgacacgcatcaaggtcgatttacctgccccattgggtcccagtagtccgaacatacctgtctgaatctcgaatgacaccccacgcaatgctttgaaaggtttgcgtcgttttccaatcataggaacactcttcaccatgcggaaataggaacggcgaagccctgcaaatcgtccggtgacacgctctatatttacatcgtgatcatacagatactgagaagtgacatagatggcaatacccaccagccataacaatccgatcatgatgaccagcccgttattatccagtttccggaataactgaaacaggataaggggaggaagactccagaatatcacccggtttacgatctttgttacccgattatctccgtatcgataatataaataggaacgtacctttctccacaaatacagtaccgctgcataaatagcgaacgagaacaggaatatccaaagcctgttatgaatgaagaaataggtgaaataaatggcaaacagtaagataccaaactgccatagcacattgataaagtccttcagagaatggtattcattgctcaatcccagacgtttgcgtaattgcaaaccactgttccactgacggctgatgtgtccaggccaatcgtagatcttaaccagattgcggacagaaatacgtatttcttcatccggattgataacctccgccttagctctacggagactggtttgcgcaaagtatgtcatccccggtatgcctgcaatcagtgctaccagatagattgactgccaaagcattccgtcagtgtatagccagatacagattacaccggacacaaaaagaatcaggtgaatggtccatagtttacgggataacgaacggtaccactgaagcacattttccagtcccatacaaactgtcggaattaaaatcagcgtcagcatggcagaaaagaaaagtccgcctatcactgtaatggcaaaaggtgcaccgatagcccctgcatactccgtatctcccatagccaacggaagcatggcagcaatcgtggtgatggaagtaatcagaatgggacgaatacgtgacataccggcagtcatcaacgccctgttccggcggtatccccgtttacgcaaaatgttggcgtaatctatcagaatgattccgttattgacgactactcccaacagaataaggaaccctgtcagtgtattcgcattcatcagactgttgctcgaaagcaataatgccagcaaagaaccgatagcggccaacggaatggtaaaaagcaacacaaaaggcgtcactacagactcgaagactgaagcaaggatcataaatatcaaaagaaaagctgccagaataaggaatttgaaatccccgaattcatcctcctcatggaatacctgcacagcgactccggacggaagattataactggcaatcaactggtcgatatcggaacgatatcctcccaataaatctttcgaagactgaacatctctcggaaaagcatagtatacctcaatctgcttatcttgattgacacggatgatgcgcgaacgcccacgtccataattcagagacgatatatcttctagattgtgcataccgccattggcattttctatccggatagcacgcaagtcatccacagttttctctttctgagctttttcctgtgcctcttcttcagtttccttttccggtatttcgtcacggataataatatcataaatatcctctcccaccttgaaagtagcttcggaagagtattcattattaagcgcagtcaatccggtggtaatattgccacggttaatatcataagcagtcagcagaatagggtcaaagttcagatttatttctgcctgacggggagtatacgaaacatgagtatgctgtacaaaatcctgttcgtccaacaaataacgcacttcctctgccaccatctgcatcatttcgaaatcagatcccctgatcaccacccgttcactgttgtcaccgatacccaacaaacgcatgaatccgcccagactgctcagagccgagttatctcctccgcctcccatagcatcagagacatagatttccgcaccattgatattggcgactttagtctgcacatccgcttttatatcggctattttccgtttggcgatctttgtgtaatcttcctgcaaaacgagtgtcagagtcgcctctttttcccgaatacggcaaatcagatctttcttttccggaaaatcctccagacgttcttccagtacctttacaatcttatccgtattttcaagcgtactcccggtaggcatcacgacactgatgttgaaccggtctgaagcaacttccttcatctgttgcacattcaaggtcaatgacaaaatcaatgttgcaaaaagcaagattacagctccaaagactgtcactcccggattacgcatacaagtcttcaataagaccagatagacctgcatcggacgctgaacgatcgagactttttcataaacgacgctgttcccactcttactcttcaaaagaaggtaagtaatcatcggtataaaaagtaaagctacaaacagcgagatcgtcaaagttgatataatggatactccgatatggtgcccgatcagttttatcaggaaattatcagaaaaaacgaacggcaggaacacagtaatggtagtcagggtagccgccacaatggagcgccacacttcttttgttccctgcgttaccgaacgttcgggcgtatagccgtttcccgacaaacgataaatattctcaagcaccacgacactattatccagcagcattccgatggccaacgccattcctaccaaggtaagactattgatagtgataccaaaagcgtagaagaagttgaaagccgtatagacagaaatcggtatggaaagtgcgataaaaaacaccaaccgcatattcttcaggaaaagccaaagaacgaacacagccaataatccccctaccaatgccagattaataatctggttgatattattttccatggtttcagccttgttctcctgaatgacaatttccagttcgagcggagccagcttctcattcagcttttcaatcacatcggatacacggtgtgaaagttcaatcagattagcctgtgaatcattgatcaaagcaaccgaaacggcttcttttccattcacacgactataggtggtttcatctttcaagtcaaaaaagacggttgccaggtctttcagcagaataggaccaggagcgacaactatattctccaaatcagaaactttggtatacatcgcattgacatggacaaaattcttgctgtcgggttcatctgcgaagcctacaaatgtcttttcctgggtattctgcgagagcaaaccgcttattttggaagcagtgaggttcaaagccttgcaagcctccggattcagacgcacttcaatggctttctgccgtcctccgtagatattgacggaagctaccccatctatattctccagatcggaacgaacatcctcgtctaccagactccggacacggtcggttcctcccgtaccacgcacttgaagcaccatgaagttattattcatctgagcaatatccactttctgtacctgtacggtaaaaccggtcggcagggaggctgcgatttcattcactttctcctgcagtttaagactggtcatcttgaagttgatattctttttaaagtcaatctgtatgctggactgcctcctgtcaatgtaggattgcagtttgtctactccacctatcgcactgaccgctccttcgagtggaataatcacttccgactctacatacgaagggtccatatcctgctgtgacgacacctggacaaacagaaccggaagttctgcgttgggcagcaactccaccggaagttgtttatacgacacatagcccagcaggctgagtgcaataaacagcatacaaatcgttattctcctatttagtaaaaagttcatcttcagctgtttttagttcggcgatttatacgtcttttgatattctccaagacataatagacacaaggaataaccatcaaactcatcagagtagaagttatcaatcctccgatcacagctatagccatcggtgaacgtaaagatgcaccttcaccaaaactgaatgtcatcggaagcatggccagaatcgtagtcaaagtagtcatgatgatcggacggatacgctgttgccctgcttctacaatggcatcagtcaactccattcccgcctgactaagctgattgatacggtctaccagaatgatagagttattgacggcaatacctcccagcatgacaataccgataactcccatcatattgatagtggttccggtaatgaagaaaagtaagatagcacctactacagccagaggaatagtcagcaagatcgtaaacggatgcagcaaggattcaaactgggaagccatcaccatatagacaagtacaacagaaagcatcagagcaaacaacagactgttcattgattcttgccgtttttcttcctctcctgtcactgtaatactgtagttagcaggcaattcaatacctttcaccgtttcacgcacttcggctgctactttatccagtgatttactcgcatccatattagccatcaccttaccgatacggctttgattgcggcgcagaatctccttgggcgcttgtccgtgagtaatggtaacaatctcttgtaatacaaattcctgtgttccacttttgatgacaagagcaccaagagaactcaacgggatatccggcacctttatgacgatatcacgcatctcaccgcgatattccatcttaccgacttccttaccgcttagttgctgcttcaattgttcgattaccatagccacactcaaattattgataccggctattgtacgatcaatcgagatcacaacttccggagcaccgtcttccacggaggtaataacatcatagattccatttacgccaatcatccgttccttcacctcttcagtcaactgagcaatctcatccaactcctctcctttgacctccacaacaataggagccccttcgcttcctaacagtgaactcagagaattctcatcctgctgaatcgtcagttccagtccgtcaggattcttggccgattccacgaaagacgcaatcaccttttccggtgaaagtgtacattccggtgaaaggatcactttcatcattgctgtattttctccttcaaatatcgcattttccgaaccgctcccctctccgatatgactgtataccgtacataaagaatcaccgccaacgatagcatataacaattcttccagattacctacagcagcggaagtgcgttccatctgtgtaccttcgggcattttgattacagccgtaaacgtcttgctttccgcacggggcataaactcagttccgataaacggagtcagcaatccagtcacgataaggagtaacactgccataccgatcaccagccaacgtcgctgaatcagcttgcgaagcactctgctatatcctgtaatacgaatggacttcacttcttccagcttaaccttcttgccggaaagctggatatataacatcggaatcaccaggatagccacaaacaaagaagaaaccagtgagaaagtaaccgtccatgcctgatctttaaacagttcgcccgaagctccgtgaagataaacaatcggcaggaagacgacaatagtcgtcagagtagaagctattaccgcattggcaacttctgccgtcccgttaatagcagcctctttgatactcaatcctttctcctgatttcggaagatactttctatgacgacaatggcattatcgacgagcatacccgccccgagcgccagtcctcccaatgtcataatattcagtgacagtccgttgaagaacatcagattgaaagtagccacaatcgagatgggaatagcaagactgacaatcagtgttgtccccatccggcgaaggaatacaaacaagactacaatagcgagaataacacccagaacagcactgctcttcacttctcctatcgcactttttataaaagtaccctgattggaaatcacctgaaaatgataaccgggcaatgcattctctatcactgccaattggcgggttacctcatccaccacttttacagtattaaagcgcatctccttataaatagacagtccgatactacgcttcccgttaatccgtacaatgttctccggacgagcgttcaaaaactgcacagtagccacttccttcaaaaaaacaggagctttattactgttggcagtcgctgttcccgaagcattgtttccggatgcttcctcttgttgtatcgctttgtatccgacaatcagattctcaaaatcatcttccgaagcaaacaagctcgaacttttcaccagatattgtaatcccagttcactgacccgtccaccggatatactctgattattcgattcgatgcgcgaagcgatatcttctattttcagttgaaaagcatccagtttataaggatcagtctgaatggtaagagtactgacttcttctcccgaaagcgtcacttcagccacgccttccagacgaatcaactcattgcggatatagctttcggcgattttccttaattccgccatatctgtaatactctgatgagacattcccaccaaaactaccggagacaagttcgcatcgtgttgcgtaatcttcagttcagtaatatccttgttctgggcaaacggattcatggctttctgcaaatctagaaaagcctcatccatatcctttgtccaggtatattctacagtaattcgtgccgtcccggctttaatcacggaagagacctgagtaacatcactctgccggatcgccatagactccatatttttaacgaattgcttttcgatctcctcgggagggcgttcacccgcctttaattcaataaacaggcggggattattcagatcgggcaataaatccacactcaactgatcgtatgatacttttcccaacaataagagggcaaatactaccatacaaatcgtaaccggattgcctactgcaaatttgattatattcttcataagtatttcctattttcaaaagatgcgttcatatatcgcatccatgatttacttttggattttgactttggcgtcttctttcagtgtttcaaaacccttcactaccaaattgtcatttacattaagtccggatagaatttcgatattatattcatcctccagacctgtttgcagattgcgtatctttgccgtattcttttcgacgatatatacgtatttccggcgacgattggacaagattacgtctttaggtataatgatagaactatcagctctgtcaacgataatatctgctttggcgaacatacccggacgcaacttcaactggtcattatcaatcagaatctttcctttaaaagtacgtgtctccgtactgattgcaggagacagctcaccgactctcgcttttaaagtatctccagggatggtataatgagtaatatataccggttgcgcttccttgacataacgaatgctgctttccggcagattgatatccatatacattttatcataagccatcagactcaccatagcctttccctgctccactcttgtatcggccgtatagtgaggcaaatcaacaatcacaccatcaaacggagctttcactttcatcttctccagattgagttttgcgttttcataatcgtaacgggcattcgttacttttacttccgtattccgcatttcactcatcgtcacccctcctttttcatagagagctttctgctttgactgttcctgttcagcaatttcaagacttagttttttagcgtcaatagcgattccgttttcatactccttgtcttccagacggattatcagttcccccttacttaccctgtctcccattttgaaaggttttccggttctcggattagtctgaagtttataaaatccgctcatttccgcattctgagatgcaccgtaagtcggctgcactgttcctgttgtatttattaatttactgatagaacctttcttcagctccacgacagataccggagttgcaatattattgggtgcgttttgtggtttgttgccacagccggttaacaataaggttgttaacaaagaagatgcaataaaaatttgatactgtttcatggtctgcttattttttatcaataatgtctttcataggaacaagagggatattcttgtcgaaatcatacaatgaaaggattttaagattaagtaattctattctgtaattaatcaacgcctgcgtataagtaatcttcttattcgaaagctgagtctggaactggctcatttccataccggttatgtcaccttcccggtaacgagtctgattcagatcataggtcaactgtgcattctgtacattttgctcggcgatcttaatctgagtccggaggttttcgaggttacgccatacctgacgaatattcagctcgatatccactttatcctcttgaaactcgagttcattaatccgttgagccatcttttgtgctttaatccttgctttcttttcaccccagtcgaaaatagggacagcaaagctgatggaaaccctcggattctgtgtcggattattatagactttattcaggtggctattatctcctatcaatccgaaagagatggatacatctcctttaaactcgttcagcgcttttgtcttaatcatatcgaactcaagttccttgctctctatttcacgctgacgaagttccagacgcgaacccaatccatgcgatatggcctggtccagatttacctgaatcggtttaatctccacttccgcaaatacgagaatatcttcatccagcctcattccgagagtctgtttgagtttgtctttcgcattctccagattcacctgactttcgtctacagacgaacgtgccgtagccagattcagttccgcttgaaagagttcgtccttcgctgctaaatccgcttctaccttattcttgataatatcataactttgctgggcattaaccagttcttcacgactgatttccagattactctgtgccatatagacagaatagaactgatcggttatacttttctccgtattcagttgctgcaaagcataactgatattggcattttcataatcatattctatttgcttcagttccattttacgcttgttgtatgtaaaaataggctgagtcaattgcagatagaggtcattgctgaatgcccggttactagttttatcgccttctataatggaactgttgtcctgccagccgaaacggttgattaaagaaatagtaccgtctgtccatagaatgggctgatcgacctgaaaggtcccgctggtattgaatgtttcattcgtgtaccattgtgacagacgattatcgaaacgcctgttcttgttatagtccaccgggttcagatttaatgaaaatcgagactttaatgaagccttctgcgccagcagattctgcttatatctctccaaattcatgtaggaacggcgaagagaaggactgttctcctgcgcaatctccattgccttgtcaatcgttaaaggaatttgtccttgtgatgtcagggcaattcccgtaaaagttacgattgtcagcagcattctttttaatagtagtaagtcactttgcatatagtttgctgttttaataattatcgtttcactattttcactgcgtcggctgtcacagagcgcagcttacattcatccgtcagcacgacacgaaccgtatcggcactaaaatagtaagtaccgagttgttcccaaccctcattggcttttctcagattgatataggcatcttccatctcactgtcgtatgccaccctgaaatgatattcaccctgaaggcgatcattccatcgcagttcatcatccttgaatacatgataataaagctcatattgaccggcttccggcacaggaattttccatgtagccgtctgactgccgtctccactcttaatcacataggccgaacggatatatttgccatagtatttagcattggtggtagctgtccattgtaaaggcgcacgccaccaggatatgcccgaatatttaaaggaagtatcctccactttatccagccatttaggcagaagtcctacgacagcaggggtagaaagtacaaagagagtggaatcttcattatccacaataacctctcccggcatttctaaggatgattccggcaaggtatagatagtgtccttgactattttattccgttcttgttttacattaccaatggattgccgtatcatataaggaagattgccggaaaccatcgtattgatttccacatcacgtatctgttcttcccagacagaaacaaattctttgcttgtatgggcagctatctctaccttttttctggctctaggatcttccatcggttgataccaccagccattttgaagaacgttcatctgaatgattccgtcataatccgagttattgctcaccagtactttcaagacaaagaattcttctcctcctttattgacaactttggtcagttcgggctctccgatcgaataaaaaggaagaggcgtcaactgttcccattctttcaaatatgaataaagatccgtccggctcatttctcccagagtatccagcatattttcgaactttatgttcagaaatgtattacgcttcaacatcgcatatagtgaatcccggaaagcatctacgcccatgtttatttctgaccgggcaaaaagacggcttgcctccagtcctacgatattattttgcagattacgctgttccacatcagccagcaactccttgaacgtatgcttttccagcagcaggttggccttttcattgttactaagcccatttatctgacgttcccacccttcattttccgacttcttttgcagatatagctcaatagcacgattggcaacaggccattccgaagagtaaatattgtaccggaaattataaatctgcgggaaaaggaaataaggatttgccgtagacgaaagatttccccgtcctctactacccgacgaaaagttataatcgccttctgtctgcaaaaacatccaggcaaagttactaaaagtccgcatctgggcttcctgcagactgatttcattatttcccgaccaccggatatgattcttcacctgcctcttcacatccagttcccagaatatagctcctttttcggggaacaataccatttcaggttgtactgtctcctgcgcttgcgaccaggcacgttcatagctggcaaattgcacaggaacttctacaatagaaaatcgcttaaaaggataatccagtttatattgccgtgccagttgctctttcacattacgtatcagccagggaatggtatcgtgaatagaatcaaacgaagcagtaaaatagtcatggtcccttaaatgccaaacgctataaagaatgctgtccgcataagcacttttttgctgatagtcacctatgaccaacgatagtgtctgagacggataatctcctttaaacgaatacactccttcttcatcacactttccttccccttgagaaagaggaactaaccccggtagaggcttgaccttcaagcgataattactgaaataagtttgctgccagtcaggatttttatcactatagcttgttcctgcacggggataccaataagtttcaggggtaagcatcagataatttttcgtctgaaaactatactgcttgtctatgttgaacagaaactttttattggaagcttgcagcacttcgggaggaatatccaaataacaaaatgagttatctatctgtccgtcatacctgaatgttgcagagattgtatcgcctttggcatgcttcgtgccgaaatccaccaatactatttgcttgtcacgtttaaacttgagttgctgtccggccgaatgaacggaatgaatggttaatcccggattcaaacagaaggtgaatacggcagatgagtccaatgccactcctttcacagttacttccgacagaaaatcttcaagatgctgctctacagaaagatcatattcatgaatgaacatcttcggagtagaaacatattggttgttgatcttcgtataggtagcgcgtatatcactttgatataaaatcgaatgtatatgccaataaccgcatacgaaagctaacatgagagtacaaaaagaaataaccagccacggataattactgtgcgatgaattcggcagacgcctgaacagggaaatcgtgaaaaagacaaacgccagtccggcaagaaaatagatgccacgatgatttaaaatcacctcccagttggaaaaaccgacaatgctggacttcaccaaaggaagactataagccatataatcgaaaagataataaaacttatcttcaatatagaaaacggtaagtccgatatatcctaacaataaaacgaatgtcagtgcctgatttttcaataccagcatcagaaagatagccaggccaataatgaaaatcagcgtagggacactgatcaacagaaaataaagcaagtaagccatccagtccacttctcccaatgtcaggttgaatgcagccgtaatagccataataatgagattcagcaacaaaaagacgcgcagatttccccaaatcttaccgatgacgtattcagcattacttaatggacggacataaaagacttctgatgtatccagctttttatctcttttcaggaagtcggatgccagaaagatagcaataacagcctgccctgtatttagcaacagtaaaattagataaggaatgttcgatggaatggctgtagcaatccagaagcctccgctatcttccgatacgaacaactggaaattgaaaaaagtaatgatagttacagcgagtaccgtgaatactctgaagaaccagcttctgattaataatttactttcatattttgctaccgattgtatattagatataaaggtcatatcagcatatcgtgtttagtcgtttgtccaaaggtttaattgattctccatataatatacataggcgtgttccagattagggggaaatggttccgcttcgtatccttctacttcatcggcaaccacctgtacttcccagattgtccccgatggaatcgtggagattaccggatattttttatcgatctcatgcaactgatctcccgcagccctaattctccacactttgccctcggctaatttcagcatatcttgcggagaaccgttgaaggaaacttgtccccggttcattaacgccatattattacaagtactggaaatatcaccgacaatgtgagtagacaaaataatagtcacatcattctcgctgacctctgaaagaaggttacggaaacggatacgttcttccgggtcaagtccggtagtaggttcatcaacaatgattaccttaggatgatgtatcagcgcttgtgcaattcctaaccgccgcttcatacctcccgataatttattggcatatcgttcgcgaacatcgaacaacccaacgttttcgagcatttcatccacagcctgttttctctgcctgctatgggtcataccggacaaacgcgccgcgtaatcaagaaactcatacgttttgtatttggcaaaaaaacgaaagtcctgaggaagataccccagaataccgcgtatttctttccgctgtttcatcaaatcataaccgcaaatttctacttgcccggaagttggttccataagggctacaagaatacgcattaaagtagatttgccggcgccattgggtcctaataagccaaacatccctgcaggtatttccagattgacatctttcaaggcatgatttccgtttggatagatcttattaaggttcttaataattatgctcatgacattttatttgtcctatgttgtattgggtgataaagat

SEQ ID NO: 74 - DNA, 36965 bp, Bacteroides thetaiotaomicron
actgataacaatgggttttgcagctatacttgtgcgctatgtcaacaagcggacattgctcgatagtatcaatcacaaatcaaatcttcatctttccggctggttttataaaggtagcattttattccagctttttataagtattggttttgtgttctgcactttggtcatgatgaagcaactcaattttctgcaaaattccaaagaattgggattggagaaacataatgtgggagccattctttctatttatggatttgaaaatactcctttcaaagagatactaaagcagatgcctgatgtaacagaatgtttatgtggtttttccagtcctattcctaaatcgtcattttcttcttatgaattgagggaatgggaaggacagactgataaagaacaacgaatcaaattagagaatgaaacaatcaatcaggattatgttgatttctttcagatagacgttatagaaggtgatatgttggatgaaaaagacggacaaggagtagtggtaatcaatgaagctgccgtaaaagctttcggatggtctcaaccgataggtaaaaagatatatctgaatgaagtttgcacagtgaaaggtgttatcagagatatatattataatgctccgatttatccagtgattccggctgtattctttttgccgaaggataatccgggcaacggaaacagagggccctttctttttaaatttaaagaaggtacatggaagacagtataccaaaaactgcaggaagaggcgcataaggacaatatggatgcggtattgaacttgataaatatggaagatacctataatgaatacatgaagtcagaaaacacattaagcaagttactgagtgttgtttctcttatctgtatcgtgattgccgtatttggcatattctccttagtgacgttatcatgtgaacagcgccggaaagagattgctatccggaaagtaaacggtgcaagtgtaaaggtcattttgaacttattttttaaagagtacttgattttacttgtcatagcgtcattcatggcctttccattaagttatctcatcatgaagtactggctcgaaggatatgtaaagcagacgccgataaacttttggatatatggaggcatatttgcaggtatgttacttataatattccttagcatcatctggagagtatggaaagctgcccgacagaacccggcagaagtaatcaaaagtgaataacgttattatttaataaaagcaatatgaagaaccaattatctgctatcaggactttatcccgtttcagaatatacacgatgatcaatattatcgggcttgcagtcagtgtggctgcaacgttgataattgtacgctatatccatcaggagataacagttgaccatttctgtaaggacctggaccgattgtacttgctgactattcaaaggagtaatggcagcatttcaatcacagataatacagacaggaataatgatcctaattttatagaccctttaaagaatccggaagtagaagcatattcttatagtgtttcttttgacgatgattatattgtagtcgataatcaccgttaccaggccaatgttttggtaactgatagcttgcttttgcagttgatggactatccgatagtttcgggaattaaaactattcagaaaccggatgatgcaattattacccggaaatatgcctggcatatttttggtgacgaagacccgatagggaaacaattaacttcatcgtcaggttctgtacttaccattcgtggcattgtggatgaaccgagtaccaaggcttctttacaattcgacctgatagctccggtgaatcaggggaaatatacagactggagtcggatgggattctgcatggtccggttgacaaacggaacagacctgaaaaagtataatgaaaagatttccaagccgcagtcattaatatgttacagtcattctcccatacagtacgggcttactcccttgaaaggattgtatttcaataagattgtcgaaccttcggcagcttcttttttgcgggggaatatcaatcatgtgacgattctgactgtagtggcttgtatgctgctgttggtgggagtcttcaattttatcaatatctacacggttatcgttctaaagcgggcacgtgagtttggtgttaaaaaagtatatggtgcgagcggctttcagatatttatccagatttatgtagagaatatatatatggtggcagccgccttgcttatcatctggatgctgatcgaaacttcagccgggatattcgcctcggtatatgcaattcctgtaaaaccggatatcgtttttgatctgtcgctgtctctcattttattattcgtattgccgttggtgacgtctgtctttccttttttacgttacaactattcttctccgatcacttctttgcgttctgtaaatgccggaggaaattcaattgtttcccgtgcagtattcttatttattcaatatgtcattacgttcagtctgatagtagtcgcattgttttttgttcgccagttgtacacaatgctgaatgcggatttaggatatcaggcaaagaatatcatttcatgccagttcctgtcattcgagacacaaaacagaagatatgcaaatgatgaagaatggcagaaagaacgtgacttggagcggcataaggtacaggttattaaacagaagatggacgcatgccctttattcatttcatggggatatggggaagcacctatcaatctggaaccatacgtcaatgtggagagtaacggagagaaacataaaatggctatcatgtatgttaataataattacatgaatatgtttggcctgaagctgaaagaaggaagaacgtggaatgataaagaccagtttgcccaatataaaatgatgataaatgaaacagccagaaagctcttccggataaaagatattaatgaagcttcactgcaaaccgaatcccgtctatggtggagtgtggggacagatgagagtaaaaatcctgcttatcaggtagtaggtgtgatagaagacttccggaccggacacttatctatgggggatgcatcactggctattctgtatgatgaaggagaaaaccctaccgaacctttaatggctaaaatagccgaaggtaaacgcaaggaagccattcaattcttgaaggaactacacaacgaagtaatgggtgagggggagttcaattactccttcgtcgaagatgaagttgaaaaactgtacgatgatgacaagagaacaacccacatctacgtcacctttgccggactggctatctgcgtttcctgcctcggattgttcgggctgtcattgtatgacattcgccagcgctacagggagattgcattgcgtaaagtgaacggagctaccggcaaacagatcgctttgttattggtcaggaagtatctttatattttgggagccgcctttgctgtcgctattcctttggtctattatattattaatgactataccaaagactttgcggtgaaagctccgataggagcagggatttttgtgacaggcttcatccttaccttgcttatctcactgggtacattactctggcaggtacgcaaagctgtccgcatcaatccggcattgatcatgaagaacgaataagattaaaaacgactaagattacaacgaatggaacgaactgctatggaaaacctcgtactattaaaacttatattcagaaactggtggcgcaataaactttttgcggtcatctctttggtcagtcttgtggtcggtatttcctgtaccaatcttctgatctcgtttgtcatccatgaatatacgatagaaggggaaaatccaaagaaggaccgtatcctgcgcctgactcagcgactgccatccatgcagagcaccggacaagtatcatttgtctacggaggatcggttgccggaatgatagctccgtttccggagattgaatcttatctccggctgaccgagaaggaggcaactcatattgaaattgagaaccagcgctttcctcaacaggtcattgttgaggccgacagttctttctgccgttttttcccgtaccagatattgtccggcaatatgaaagaagccttgactaagccggactgtattgctttgagtgaagaaaaggccatgcaatacttcgggaagttcgattgtatcgggcgagaactttctgtggtatatggagataaagttgaaatgaaaaaggtatctgccatatataagttttatgcgcagtcagcactccgtattgatttgcttggtaattctcagaacctgcaggaagaaggaacttcctgtatgattcttctcaaagaaaagactgacgtgtcagcctttcgcgagcgttttgagtcaacagaactgcctacagtgacaggtcccggttattataaactccagacattacaagaatcctactttgacacaaaactggctgattccgtgaaaacattcagtcatcggcagatcgctttgttgagtatcggtttattatcagcttttcttgtcttattcatcgcttgcttcaattacgtaaacctaagcttttcgcgcctgctgaaacaagtaaacatgattcatgtagagacattgatgggagcttctcattcatatatttgccggcaactttttattgatacattccttaccgtatttatcgctttcatcctttccattcttgtaatgggggacatactttctcttttcaattatttctttgatgcccgtctgactttcggtttcattctttcatggaaagtctttccatttattcttctgtttgtttctcttttggccattataccggccacctatatgacgaagaaactgaaccgcatttctatcagcggatatcggcaattttttcaagggagaaaaagaagaagactggtagcgacccttgtaggcgtgcaaatggttatctccatcggattgatgactgcctttatgatgatacgtacgcaactttcaaccatagaagggcagggtgaacgctttaaaggagttataatcttaggtaatgagggggctgccttgactatccctttgtataatgacattaaaaacctgcccggtatccaaactgccctgttatccaaagggcggataacgagtccttttaatatcatcattccactaaacaggaatgggcaggaagtaatggtaaataaagttttattgaccgagaactatggactgctggacttattcaacatagaacttctcgaaccggaacgaacggaggatttattttccaaggtagcccatccggtagttgttaatgaagcctttgtacagttctttgtaccgggaggagaagatccggtggggcagaccttaagcaaatatgagcaggacaacgccggtgaaggaactattatcggtgtgtgcaaagatttcagactgacttctttcaactctgccattactccgatgcagattattcttcaagagattccggtcgatcaggcaacctacctgtcttgtcgtatagatgagggcagacgcaatgagatagtaaaaaatctccggttgctgtgggagaaacacgagccgggacattcttttgtttacatagacgcctatcagcaatatatatccaacaatacagatatggtgaatttctcccgattattactggcttatgctataatcagtttgttcctgaccctttttggtatctttggaattacatggtatgcggtagaacaacgaaaaagagaaattgcgattcgtaaagtacacggtgcctcttcccgccaaattctattgttgttgaatcgtccgttcttctattatattctgatagccgacatgatcgctattcctatcgtatatgtcttgatgaaacggtggagggaacagtttgtgtatcctacggattggggaatagaagtatttatagtacctgtcgtcttattgatgcttgtaacgtttgtcacagttgtccttaacggatatcatacggcattaagtaatccggctgagactattaaaacggaatgatcactatgaatatgtagttcttcagtatccagtttctaagaagataaaacgttcttcttttgccgttgactttgaagctaatcaaccgttggaaaaacaggaaaggtggcatcggacaaaataaaagctactctctttgggggaagagagtagcttgacttcaagatacactatagagtgcacttgctataaaatacctatcgaatgctcatgtgtcagttaataatagtgcccttgacatccagttctctgatagcagcgacagtactgtttcctccgtcatcgggaatcgtgagtctgatgtaacgtgctttgatcgattttacataatattccagggcggcatcctgattcgtgaatccgaatctgccgataggagtccagttcacgttatcttcactagctgcaaactcgaccactttgataggattgtttgaacctctgccgcgcggaagcaattccacctgtgctatttgtatgttttgcttcatatctatcacaatatcatacggtagcgggtcgcttccaccttgccatttggcatgccagaatgtttcagtgtctccgtctatcagacatttggctaatccattgccggctccttctcccgaagcttcctgtgtcgtaaaggacagaacttcccagccgctctttgatattttcgttccttcttttatgatgcagaatcctgtgtaggtgtctttatccgcacggatagtggcatcggaagtaacttcgcctatttgcacaggaagcatataatttcccggaagaatgttatctttcagcttgtaactgactgtggtctgatcaactccctgagacaatgacggggattcgggtttggtatagcactctgccggcagaagactgaaataagtctgattggcactgttgtacgtatctactaccgactggttgttgactaatgtacagttgatgttccatttattgctaaaaggtactccaatggtaatcggcaactcttttacattgttgacattgatttcctgtataccatcgtttatgatagttacaatgggttcggaaactttaaatcccagtaggagggtggaacggccggggttcaacttctctcctgtagtgcttgctttgagtgggagaatgtattgaacattgtcatagccgcacaacgcatgaatctttgtcgggtcgtatacgatagtgccttttgccagtctgtcaccggcagatacgttaaccgttgtgttagtcatttgataacaatcttccggaagtatctggtaactggttccgtcggcagtattgagtgagtcgagcaggcttttgtctacggtgaaggtgacggtactgttattcagttccagtcctccgtgttgtatccataagtcagcattgtatttttctcctacattatacgattgcagaatagtcagtccgttttcagacaatgacaaaatcccttcggatgtattgctcgtatcaaaggtttcatcacaaccgataatagatagagtgatgcagcctgatattagtatataacttatttttctcataatgctcattgatttattgtgcttatacaattaccagcccggattctggacgaggttttgtgtctttctcatttcgtgatccggtattggctgtaagtacatctttctgttgaatacaattttttcagtttccactacgcggttgaactcttcggtatcattgatagttccccgaacattcataccgtgtgcatatccgttctggcgtccttcaccgtctttgtcggcaatcatccagcggcgtacatcaaaataacgttgaccttccgttgccagttcaatctgacgttcgcgctgaatggctgctctttgcaattctttattacctacgataccgggattcagtatttctactttcggcaagcctgcccgttcgcgtacgaggttcagataagtcagtacgcgtgagtcgctcggatttacttcgttggcaacttctgcatatatcagatagaaatccgccagacggaagattatggaaggacggttctgactagctacacccggactggttttgctgattgatcggttgaagcgcttgaaaagcatatatccggttgtagtggcttgtccttcctgaacgcctgcattacctccattgtagaactggacttgtttgcaggtgacaggccattggcgtccgttgaagaagacagtgttgtagaaacgtgcttcacgattcagatagcggttactgactgttacgttggtgtagttcttagagtattttccgtcattcttgtccttgtaagttccgtaaccatcttctttataaagtgttgatttcggcagatagtcggtttccttgataggaagtccgtcgttcatatagaaggcgtctacgagttcttgcgttactccggtcgaacccaaaccgttcttttcgcagcgaggaacgattcttcggtcgaatgcgtcaccgtcaagtcctccccagtcgttgttggcggtgccccagatgatttctttattgtatttctgaaagaggttgtaaacggaggcatctacgtctagaatctgttcaccggtgctgcttgttgtatattctttgtataactcgtagcggtttccggtttctgcgtaatcgatgaaatctttgcaggcgtttaatgcagtattccatttgttgtcatcacgatccgggaagagtcttgtaccgtctgggttggtcagagacagcgcttctctgtatcccccgttgagaagggggctggctgcatatagccacaatttggcacgtacggccaaagcgacacctttggttggccatgcgcggtaagattcattttcgtgcatcggttcctgtggcagttcattagctacttcacgtagttcctgatcaatatacgtgataacttcatctaccgtatttctgggaacatcctgagtctctgtcgcctcgtataccttatcttttacgaggataataggaccgtattgttccaatagcagataattgtaaaatgcacgcatgaagcgtacgttggcacgcatctcattcagttcgtcttcttccagtctgtcgccttgcgtaccgctggttgtaatcacatgagctttctctaggaaaatgttagcctgccggatgtatttatagcagtcgccatagcggtgaaaaccagcagtcgccgcattcttgtccgagttgttggccttggcagcatttccataacctactactagttcatcgcagattgcagcccacggatttttaaaggctcctacattcaggctgtttattcccgaataatcggggattcctgcaaagacattggcataccatcgtttggtataggctacgttttcaaatatttgatctgtattttgcaagcctcctgacatctggtccgaaacagccagataatcacatgaactgacggagaagaataatcccatcagcaacatatatatgtgacttttacttttcatatttttatcttttatggtttttagaatgtgaaatcaagaccgattgtataggttcgcggcagcggatagttaagtccggcattcgcatttccggcttccggatcgaaatatttgatatgatcccatactgccaggttatatcccatcagatagatacgggcagcttcgaagccgatcttgcttaagaatttcttaggtatctgatagccgatttctatattcttcaatcggaggaaagagccatcgcgcagccaccatgtactggcaacgctgttattagcattgttcgcattgctcttgtgcagacggggaataattacatcctggctcggattgttctctgtccaacggtttaatgcaaaggtgcgatagttggactggtctacaccccatgagaatgggtaccatccttcggaagtctttccacccaataatacagaagtgttccctgctccctggaagaagatgctggcgtagattcctttatattcggcatttaaaccgaatccgtagataatttccggagtttccggatgaccgattcctcttacacggtcataagagtcgatgattccgtctccattgacgtcggtatatttgatgtcaccgggaccaaggagtccgcctaaggttggttgtggaatttccgaacggagtttataagtcttcagaccgttagcgttggtgcttacggtaaagtcgtcttcggtataaagtcgttctgcgatgtaatagagattatctttatcactgacacgtttgcccgtaatagcttggtagtcatactttggaggaagttcatcatattccagaattttattgcgggtgaatgtgaatgtacctcttgcgctaagttttaccttgcctatattttgatgagcgttcacagacatgtcaacacctctgttgcgaaccttaccgaagttttgccacggatcgtctctcagaccgccaagctggggaacagtctgacgttgcagcagaatctggcttctggtagaatcgaagtaatcaaagataacttcaagacggttgtcaaacaagccgatatcgaaaccgtagttttgtttgtcttctacttcccatcccaagtaaggagctgcaaaacgtccttctatgatgccgttgccgataccgttcagaccgcctccggtatcattgtaaccttgcgtaaaacctccggcatccattttgtaggtcggacggtacaagaaacgggttcctcctgtattgtcgttaccggcacgtccgacagaggctcttaatttgagtttggggacatactttttgattacttccgggtagaaagactcattggaaatgtagtaggcaagacctactgccgggaagaaaccgaaacggttgcccgaagcaaatgcttccgaaccggtgtatccgaagttgccttcaatgaaatagcgtccgccgtaaccgtaagttaaacgtcctaccagaccttgcttacgatagggaagtgctacattgtgatattgggtttccttttgcatgtacaatagcatggcacctacttcgtgctggtcgaacgtacgtttatagttgatggcagcatctatgtaaatcttcttggttgcgcttgtcgcactattcttagggtcctgcaattcagggtttccggatacgactgtggcaaataatagattgccgttttcgtcgcgtcccgtagcatgatatcttgtcggattatattcacggcgaacgatcatttcactatcatagtcataacttgcgttcaggcgtacagacaaacctttggtgataaaatccagtttctggtctacataaactttggattgaatggcagtacggtattctttggcgtatccggagttcatcaataagttgtacgggttgcgcatgttagcgtcacgttcctgtgagtaggttgaaacagtaccatcactgtatacagccggaaatgtataaggaggagtaatcagcatggaacggaatatattggcagttcctgttcccggataattattaaccagatactgaagtgcgaggtcaactcctacagttgtagtgcttgatacgttcatatcaatatttgaacgaagattgatacggtcgatgccgatgtttgtattatattgtttggtaggacttcctttgaaaataccactttcgttgtaatatgctgccgaaacaaagtattttgctttttctgtacctccacgtacattcaaggtatatctgtgtgtgaatgtgtttttacgtaacattttgtcgatccagttggtatttggatataggtccggatcgtcattgttccggtaatgtgcaattaagtcatccgaaaactgcggtaattccccatcattatggagtgcttcgttgaacaggtccagatagtcggccgaaccaacgaattcgggaagacgggtgggggaagaaatggtgtgttctgtcttgaatgaaatctttgccttctctacacgtccgcgtttggtagtgacaagtactacaccattggctccctcggcaccataaatggctgttgcagcggcatccttcaaaaccgaaaacgtttcgatttcgtcgggttcaatatcactcatgcttctgggtacaccgtccacaagtaccagtggagatgtaccacccgcaaaggtacttacgcctcgaatccaaaactctgcgttatcatatccgggttcacccgaacgttgtactgcaatcaaaccggcgacttgtccggcaagactgttattcaggcttcgcgaagggacaacgatatcctttggtttgatggaactcatagaaacgactacgctttcctttttctgctgtccgtagccgactactacaacttcgtccagcgctttggagtcttcgttcagcatcacattgatgttgcggcgcccttttacttttatttcttcggttacgtatccaagatatgatacttgcaaaattgcattgtcggaaggaatcataatctgataacgtccttctacatcggttattgctccgacgtttgattgtccttttactacaacattggctccgatgatagattctcctttgctgtctgttactacacctgttattttaatcttattttgttgcgttgtttctgaactctctatgccattcatcggcttttccgcattgccggcatttatgagtggagaaaaacataaagaaaagaacagaacaccgattcgcgcggttgtgtgcactttgtttgaagtaaataaaatgtttttcataattttgattttaaaataataactagtttaccggttttgtttgtaaacgatagggatggtaaatcataatactgtaatatttccataggcattgattgtgtgttgatttttgattaaaaattaggttgtgaaatatagaatttagtaaactctaaggcggtataagttcatggagaacttggtgggatgagtattatgagtacatattaatttcaaatacctcctgaaatattactttatcagaattataaaaggaaaagatagggtaaacgaagaaataacttttaaaaaaagcatcaatttatagcgtatttctgaaaaatataactatttttgtcgccaacaaagcaaagaaaatcattcaatatttgtaaaccttaaattttcaaaagatgaaagcttatttttctaaaatctgctaccaagttctccatgaacttatctgaatatatccttaatttatctattatttatctgattattaatatattgtatgtttgatcggaatgagctaaaatagtatttaacatattcctgttttgtctgtcttatccttattttacgttttgtataattatatatgtatcattattttgtaatgagcgtgtgccggtatagaaaaacttttaatgccttatttcaattaattttaagcaggttcatgggaaaaacaattttaaaaattacctttgcaatattctaagttttatctcaaataaaaagcatatgaacaaaatgagagtttttttattgtttgctgttttggttggtgtgataagtgcttgtcaatcaaagagcgaacagactgcgggacaagagcaggatactatggatgatagtctggctgttgctcctacagaagatgagaaaacaatcttcggggtagtagaagatgcttcgatgaataattttatgttggttacttcgaaaggagatacagtgttcgtcagtacgatggatcaggagccgagtgaagtcggtggcttcgaactgggagacaccgtacaggtgaattacatagaagaagaggaagagccgggatcgaatacgataccaactgcaaagaaagtgattgtagtagggaagaaggcggatcggactaatgactaattaataatctaatcagaactacagaatgaaaaagaaaatgttggcagcaactctgttgatgggtttattggctgcatgtggaggtaactctgcctcaattgttggctcatgggtagaacctgtgccgggactggaaggacaagtacaaggtattaagatggaagaaggaggcgttgcttcttctgtcaatatggctactttggtttatgaaagctggaaacaggaaggaactaaactgattctgacaggaaaaagtatcggtaatggccagacgattgaatttgtggatacgatggatatcaagagactgacggctgattctttggttctggataaccaaggaatggaaattcgttacgcaaagcagaagtaatttgtttgctgtagaattaaaaaagctactttcctgatgatttgtctttcggaaagtagcttttttatagcttttcagagatgctgcttacaaaaggtctaaagctttgaaagctttcactaacttttctacagcactgtctatttgttctttggtgtgagtagccatcaatgccacgcgtaccaatgtgtcttgcggagcacatgccggcggaataaccggattgatgaatacaccttcgtcgaaagctaacttagtaaccatgaaagtcttctccgtatcgcgtacataaagaggaatgataggagactcagtagcaccgatctcgaagcctgcttcacggaaacgtctcagagcatagttggttgcttcccacagagcgttcagtctttccggttcattctggatgatatgaagcgcttccagagcagctgctgttgcagccggagtgttggatgcactgaaaatataagtacgtgcattgtgtcgcagccagttgatgatagaagaatcagcagcgataaaaccgccgatagaggccagtgacttactgaaagtacccatgatcaggtctacttcgtgtgtcagaccgaaatggtcgcatacaccacgtccctgttttccgaatacacccaaaccgtgagcttcgtctaccatgatagtagcattgtatttatgtttcaggcgaacgatttcgggtaggtttgccaagtcaccttccatagagaatacaccgtctactatgatcagtttcactgaatccggattgcacttctgaagttgcttttccagatccgccatatcgttgtgcttatattttaattgctgtgagaaggagagacgacggccatctacgatagaggcatggtcacggtcatcacatattatataatcatttcggtcggtcaggcatgagataactccggaattaaccgtaaaaccggtagagaagcaaagtgcttcatccttgccaacaaaggctgccagttctttttcaagttgaacatgaagatcgagcgtaccattcagaaaacgtgaaccggcacaaccggaaccgtatttgcgcatggctttgatacctgcttcaatcactctttcatctcccgtaaggccagtgtatgcattggacccgaacattaacacatgttgtccgcccatttctacttctgtaccctgctttccctcaatctcacggaaatatgggtaaacgccctgtgccataaatttctgtggcaggtcgtacttagctaacttctcttgtaataatcccatgaattataatttattatactcatactcagatcattcgctgatgatctaatttccttttatcttaacaagtgtttaaaacagggggcaaagataacaaaatttgcttttatctgttctttttaaaagaaaaaagttgctcccatgagattagaaacctctaatagatcaaaatttaatatatttgtattacttttgtcgtctacaattgacaaagattagcatgaacgaaagaatgaaaagaataatattcgtcgtcaatcctatttcgggaacacaaagtaaagaattgattcttaacttgctggatgaaaaaattgataaggcgagatacacttgggaagtagtgtatacggaaagagccggtcatgcagtagagatagctgccaaagctgcggaagagaaagctgacgtcgttgtggctatcgggggggacggaacaattaatgaaatagctcgttcgctggtacatactgataccgcattgggaattattccctgcggatcggggaatggactggcgcggcatctgcacatacctatggaacctaagaaggcactggaagtgctcaatgagggatgcttggataccatagattatggtaagattaatggtacggactttttctgtacctgtggagtagggtttgatgcatttgtcagtttgaaatttgctcatgccggaaagcgcggactattgacttatctcgaaaagacgttgcaggaaagtcttaaatatcagcccgaaacatatgaactggaaacggaaaacggagtcagcaagtataaagctttccttattgcctgcggaaatgcgtcgcaatatggaaacaatgcatatatagctccacaagccacattgacggatggtttgctggatgtgaccatcctcgagccttttaccgttttggatgtaccctctcttgctttccagttatttaataaaactattgatcagaacagccggatcaagacattccgttgtaagaagttgtgtattcgacgggctgtgccgggagtcgtgcattttgatggtgacccgatggagacggaggcggatgtaaatatcgaacttattaaaagcggattacgcgtagttgtgccgaagacagaagaaaaagatgcggccaacgttcttcaaagagcacaggaatatgtgaacggaataaaactgattaatgaggcgattgtggacaatataacagataaaaacaagaaaatattgaaaaagctgacaaagaaagtctgaaataaatgccgatttctgatttattgtgtacttttgcaagctacttaacgaaaaatatcataaatattagaaaatatgttcagaacgcacacatgtggagaactgagaatctccgatgttaataaacaaatcacgctgtctggatgggtacagcgcagccgtaaaatgggaggtatgactttcattgaccttcgcgaccgttacggtattacccagttggtttttaatgaagaaattaatgctgaactttgcgaccgtgccaataaactgggtcgtgaattcgtgattcagatcacaggaacagtgaatgagcgtttcagcaagaatgcaaacatccctaccggagatattgaaattatcgtttccgaactgaacgttctgaacaccgccatgactcctccgtttacaattgaggataatacggatggtggtgatgatatccgtatgaaataccgttatctggatttgcgtcgtaatgccgtacgctctaatttggaattacgtcataagatgacaatcgaagtacgcaagtatcttgatagcctgggctttatagaggtagaaactcctgtactgatcggttctactccggaaggtgcacgtgacttcgtggtaccttcacgcatgaatccgggacaattctatgcacttccgcaatctccgcagacactgaaacagttactgatggtttccgggttcgaccgttatttccagattgcaaaatgtttccgtgacgaagacttgcgtgccgaccgtcaaccggaatttacacagattgactgtgaaatgagtttcgtagaacaggaagacatcatttctactttcgaaggaatggccaaacatctgttcaagactcttcggggtgttgaactgaccgaaccgttccagcgtatgccttgggctgatgccatgaaatattatggcagcgacaaaccggatttgcgtttcggcatgaagttcgttgaactgatggacatcatgaaaggtcatggtttctctgtattcgataatgccgcatacgttggcggtatctgtgcggaaggggctgcaacttatacccgtaaacaactcgatgccttgactgaattcgtcaagaaaccgcagattggtgcgaaaggtatggtgtatgctcgtgtagaagcagacggtacggtgaaatcaagtgtagacaaattctatacacaggaagtgctgcaacagatgaaggaagcatttggcgctaaaccgggtgatttgattctgattctttccggtgacgacgtgatgaaaacacgtaagcaactttgtgaactccgtttggaaatgggttcccaattgggattgcgtgataagaataagtttgtttgcctttgggtgattgacttcccaatgttcgaatggagtgaggaagaaggccgtctgatggctatgcaccatccgtttacacatccgaaagaagaagatattccattgctggatactgacccggctgctgtgcgtgccgatgcttatgatatggttgtcaacggcgtggaagtcggtggaggatctatccgtattcacgatgctcagttgcaagccagaatgttcgaaatccttggtttcacaccggagaaggcacaggctcagtttggcttcctgatgaatgccttcaagtatggtgcacctcctcacggtggtttggcatacggtcttgaccgttgggtgtctcttttcgccggtctggattctatccgtgactgtatcgcattccccaaaaataactcagggcgcgatgtaatgttggatgcaccgtctgaaattgatcagactcaacttgacgaactcaacctgatcgttgatatcaaagaaaataagtaaacgatgaacaaatatcgttctctttataataccaccctgtcactcataattaatttattattagtgatggggtgctttattctctgtcgtgtcatctttctgatagaaaatttgaaggctttttccgatctttcagccggacgaatctggagaatgttcgagggaggattcctttttgatacttctgccattctttatacgaatcttctgtatattttcctaatgctgattccgcttcattataaggaaaatgtaatatatcagaagattacaaaggggatttttgtgacaaccaacctgattgtcattattatgaacctgatggatacggtttatttccaatatacccatcgaagaacgactgcgtccgtattcagcgaatttaagaatgaagggaatctgggaggtattatagggacagaattattgaatcactggtatctgacgttgtttgccattgcttttggttatgctttatttaagttgtatcgtaagccgaagccggtaaaggtagaacgtatgccagtttattatacggttcatttgcttactttggggcttggagtgtacttgtgtatcggcggaatgcgtggcggatttactggcatggtgcgtccaatcacaatcagcaacgccaataagtatgtagaccggccgatggagacggggatcgtactgaatacccctttttctatcttccgcacgtttggaaagacctcatttgccatacctcagtatttcgataaagagaagatggaagctttgtacacgccggtgcatatgcctgcggatagtgtgcaattcaggccgttgaatgtggttgtttttattctggagagctttagtaaagagagtagcggctttctgaatgaagaattggacaatggaacctataagggatatatgcctttccttgattcgttgatggctgaaggtctgacttttaaatattcattctctaatggtatgaagagtatcgacggaatgccttccgtattgtcgggtatcccgatgtttatagaaccgttctttctgacaccatcttctttgaacacggtatccagtataggcggggagttgggcaaaaaaggatattacaccgctttcttccacggggcggacaatggctctatgggatttgaagcttttgcacgtacggcagggtacaccaattactttggtcgtacggaatataatgaggctaatccgggtaacaaggattttgatgggcattggggaatttgggatgagaaattcttccagttctttggcaatactttatccggttttcagcagccttttgcagctgcgttgttcagcctttcttcccaccatccgtttgcagttccagcagaatacgaaggcgtttttccgaaagggaataaagctattcgtcagtgcatcggatacacggatcatgctttgaagttgttctttgaaaaggtttcgaaagaaccgtggtataaaaatacgctgttcgtatttacagcagatcataccaactcgccggaacgtccggagtatgagacggaaagcgggttgttctctgttcctgtagtgttttatcagccgggaagtaatttgaaaggtttccgtaaagatgtgatagcacaacaaattgatattatgcctactgtattggggtatttagggtatgacaaaccatttgtttcctttgggtgtgatttattgaatacgcctgctgaggatacgtatgccgtaaattatatcaatggaatatatcaattctttaaaggtgactatttattgcagtttgatggccggaacgccgtagccatgtatgcgtttaaaacggataaattgctggaacataatcttctgggtcagattgatgtacaacagtcgatggaagatgaactgaaagcaatcattcagcagtacatgatacgaatgaataacgacgaacttgttgtgaaatgaaagaatcagtgcgcatatttcgctttatagtaatcggaacgatgaatgctttgatcatggcccttgttgtgtggctgatgatgagagaaatgtcattcgaaggtgactatatggtggctaatgtaactgcgtatattatagcccagattcataactttatctggtgcaagtattggatattccccgtagaaaaaagaaagaataatgtctggaaacagatactattcttctgttctgctttcggggttgcttacactgcgcagtttttattccttattttgttggtagaaggtctggatgttaatgaatatctggcccagttccttggattgtttatttacggagctgccaactttattgctaataagaagattactttccaataaaaaaggatataatacggaggtccacaagagttgctattcaggcttttctcttgtggacctcttgtattatttctatcggtgattaattgtgattctgctcgctaatccaaaaaacgtttggtgagtccgtcatattcatcaattcgacggtcacggaggaagggccaccagcggcggacgttctccgaacgttccatgtctatttcaactaccatgttttcaggatgatcgttgcttgcctgtgccaaaaactctccttgcggtccggctacgaaactatttccccaaaactgtatgccgttcgtttgaccggaagggtcgggctcgtgccctacacggttgacagagataaccggaagaccgtttgccactgcatgagcacgttgggagattatccacgcattgagctggcgggctttttcgtcgtccgtatcgctgctttcccagccgatggcggtaggataaattagaagttcagcccctttcagagccatcagacgggcagcttccgggtaccattgatcccagcataccagtactcccagtttgcctaaggatgtctgaatcggttcgaaaccgatatctccgggggtgaaataaaacttttcgtaataggcaggatcatcgggaatgtgcattttccgatattttccggcaatacttccgtcgcggtcgaaaacgacagctgtgttatgatataggcccggtgcgcgtttttcaaagagtgaagcaacaagcactaccttattagccgctgccagttcggagtagaaacctgtagatggtcctgggataggctcggcaaggtcaaacagattcgtattttctgtctggcagaaataaagtgaattgtgcaactcctgcagcacgattagttgtgctccgtgagcagcacaggcttcaatgcttttagcgaggttcatcaggttgacccgaatatctgcggtattggattgttggattaatcctacttttatctttttcatgatgaataattatttaatatgctactgaaatgtccgttattggataacacctgacggatactgcatggtgacgcaatgcagagaaccgtgttgcttgattaatgcccggcaatcaataccgatgacctgatgtttaggaaatgcttgttgcaatacttctcccgctttccggtcattatccggctgttgataggtggggtaaagaattgcatcattcataatcagaaaattggcataggtagcaggcagtcgttcaccgtcttcttctaccttgtctgccattggcaaagccagcaggcgatagggctctcctgccaatgtgcggaatgtttttaattgttcctccatggcatgcagtgcttcataatgttcgtcttcggtattgtcgcatttcacgtaggcaatggtgtcggtggaacagaagcgtgccaaggtgtcgatatgactgtcggtatcatcgccggccagataaccgtgatccagccagaggactttctgcaggtggaaagttgatttgagatattcttctatttctacttgattcagtttcccgttccggtggggggagagcaggcattcggtggtggtaagcagtgtccccataccgtcgctttcgatggaacctccttcgagaacgaagtcaagacagtctatatactggcctttcagcgctccggcttttacagcctgtccggtaatcagattatccagttcggaggcgaacttcaatccccagccgttgaatgtgaagtcgagcagggaagggttgccggtatctatcatggtgatagctccgtggtcgcgtgcccatgtatcgtttgtctcacatctcagaaagcggacattgtccatgtttacggtagccactatctgtttctttacttcttcgggctcgggagtcacgattaataataactcacgtttggctatttctctggctatattgacaaaacattcttgtacttctttcagcatatatgcccaatctgtaccggcatgcggccatgtcaactgtatgccgctttgcagatgccattcggcaggcaggtgaggagctctcatttctacctgtacagtcatattctttccaaagttcaattgcaaatctttttccgagccactggggctgggaagtccaaccatgattcccatcagattatattatatttagttataaaatcagtttataaaatgagcaggtaccagtcttttgacacataccttatgctttggtttcctgtttcggcttccggtcaaagaatggattctttgaagaggcgctcaccggaatagccataaccattttgcagtctttcagccaattgaggcgttgtgctgccaatccggcagagaacatgacacgggtatctacacgcatatcggctgctgtggcacaagcggagccgatggcgatgccaacgtcaatactgttcaatgcacaggggacgtcttccgtgcgtccggcacatgtcgcaaatccgcaatgtccgcaattcaaaccttgtgcctgttcgcgtgttcctatcaatacaacacattcggcactcaagatgttgtcggcatcccgaaggaaaaacttcattccgtgttcttctaccatagctatcattttgtccgacaacagtttaatatcttcatcggtaatcaaggccacttcaatgatatcaatcccttttcctttcggagcagtgcgtgcggcggtcatcatttggcgtgctacctgtaatatatgctcatgacgggcatctctttcgttcagtatcataacttttctcgaattaattaatgaggcaaagataacgtttttcaagaaaatactacctttgccggaaggaaagaattgaaaacgccatgctacatatcaacaatgcttgtatcgcttttgggacagaagtacttttttccggattaaatctgaatctggagagggggaaaaccgcctgtattgtagggcagtccggctgtggaaagacctcattgctaaatgcggtgatgggctttgtgccgttaaaggaggggaccataaaagtaggagataccttgttggataaatcaactatagatataatccggcggcaaattgcatggattccacaagaactggccttgccttttgaatgggtaaaggaaatggtggctcttccgtttgatctgaaagtaaatcgttccgttcctttttcggaagaaaggctctatgaatattttgatgatctggggctggaacatgatttgtatactaaaagggtgaatgaagtctcaggcggacaacgtcagcgtatcatgctggcagtggctgcgatgctcaacaaacctttgatcattattgatgaaccgacatcagcgttggatgccgggtcaacagacaaagtgctggctttcttcaggcggcaggcagagaaaggggcggctgtgttagctgtatcacatgataaagactttgcttcgggctgtcattatttaatagaactataaacaatatttaatactagcataaagggaatttattttgggaaccatcgatatttcatattataatttatttattggcttgctattgcttgccattccgttcttttatctttggaagttcaagacgggtttgctgaaacctgccgtgataggtacgcttcgaatgattatccagctattttttatcggtatatatctgaagtatcttttcttgtggaataatccttggattaatttcctttgggtgattatcatgatatttgttgccggacaaacagcgttggtacgtactcaactgaaacggagcatcttgctgataccgatttctataggttttttgtgcagtgtagtagtggttggattgtactttatcggtgttgtcctccagttagataacattttcagtgctcagtattttattccaatattcggcattttaatggggaatatgctttcaagtaatgtgattgcattgaatacttattatagcggactgaagcgggaacaacaattataccgttatttattaggaaatggagctacacgccaggaagctcaggcaccatttataaaacaggccatcatcaagtcattcagtcctttgattgcgaatattgcagtgatgggattggtggctctgccgggtacgatgatcggacaaattttgggaggaagcagtccgaatgtggcaatcaaatatcagatgatgattatggttattaccttcacggcttccatgctgtcactgatgattactatttcactggcttcccgaagatcatttgatgcatacgggaagttattggaagtaacgaaagaaacgaagaaatgactgttaccgaccggatattccaaaatgtggcggaactgtctgttccgaattttttcattactgtagagttctcggtaatgggaaatgaaatgccggaacatatcgaatctttcgttttggaaaaatatcaagctattcttcatggcgcaaacggacgcaaatttgtctatacagaaggagggtggcgtctttttttcactttctttcctacagacaaagtggtagatgaacggtatgcactaaagaataaggtgcagatgaagtttcacaaataaatatttcttccattcaggaaagagatccggtgagttattgcatagcttgcagtttctccctcatacagcgaagctgaacgaattgttctcctgtttgtatatacccgccttccaacattcgttttgaaatttggaatttatcaagatgatggagtatgtacttttccacacctgatgattgctttttggtgaaagacaggaagtcaacctttccattttcgtgaataaatactttcgctttaatcgtacggagccccgaatctttgcaatgtttggcttctgctttatctatccaaaagatagctgtagcttttacggtatctaccatacaagtttctgtattatcaacgctcatgttttcatcgattgactcatcggaattctgattctgtttcatttggcaggaaacagccagaataattactaaacagcaggatagaattgttttcatcgtgttctaattttaaggatatgcgacaaatttactaaaaaaacgataagatgggagcttattcctattttatttgctatatttgcaaccaaattttctctaaataatgaaaattaaggaaatagtaagcgcccttgaacgattcgcgcctctgccattgcaagacggttttgataatgccggcctgcaaatcggattgacagatgcggaagcaacaggggctttgttgtgtcttgacgttactgaagctatcttagatgaagctatcgcgctggggtataacctcgtcatatcgcatcatcctttgatatttaaaggttataaatccattactggcaaagattatgtggaacgctgtatgctgaaagcaataaaaaatgatattgtgatctattcagcacacactaatcttgataatgcacagggaggggtaaattataagatagccgaaaaaatcggattgaaacatctgaaagtgcttgaaccaaaagaaaatagcctgatgaagctggtgacttttgtccccattgctcaggcggatattgtaaggaacgcactttttgctgccggttgcggtaatattggtaactatgattcatgtagttacaatctggaaggggaagggacattccgtgccaaagaaggaacacatcctttctgtggagtgattggagaactccatcgggaaggagaggtgagaattgaaacaattcttcctgcattcaaaaagtcggaagtagtcagggcactattgtctgttcatccttatgaggaacctgcattcgacttgtatccgctacaaaatgagtgggcacaggcaggatcgggaatcgttggcgaactggaagagccggaaacggagatggaattcttgaaacgtataaagaaaacgtttgaagtagagtgtctgcgtcataacaaactgacagggagagaaatacagacagtggcattgtgcggaggtgccggagcatttttgcttccgcaggcaatccggtcgggagccgatgtttttattacaggtgagattaagtatcatgattattttggtcacgaaggagatatcctgatggcagaaatcggtcattacgaaagcgaacaatatacaaaagaaattttttattccataatccgggatttatttcctaattttacgctccaattgagtaaaataaatacgaatcccataaaatatttgtaagtaaaatggctagagaagcaaaaaaagatccgaatgagttgacggtggaacagaagttgaaaacactgttccagctgcaaactatgttgtctaagattgatgaaatcaagacattgagaggtgaacttccattggaagtgcaggaccttgaagatgaaatcgctggtttgagtacccgtatcgacaagatcaaagctgaagtggatgaactgaaatctgctattgcaggtaagagagtagaaattgaaacggcaaaagcttcagtagaaaaatataagtcacaacaagacaacgtccgcaacaaccgtgaatatgatttcttgacgaaggaaattgaattccagagcctggaaatcgaactttgcgaaaaaagaatcaaagaattcagtgcggacagagaagaaaaagaagctgaagtagtaaagaatgaacaaatactcagcgaaagacaaaaagacctcgaacagaagaagggcgaactagatgaaattatctctgaaactaaacaggaagaagagaagctaagagataaagccaaagatctggaaactaagattgaaccgcgtttgttgcagtcattcaaacgtatccgtaagaactcccgcaatggattgggcgttgtatatgtacaacgtgacgcgtgcggtggttgctttaacaagattccgcctcagagacagttggacatccgttcccgtaagaaagtgatcgtttgcgaatattgcggacgtatcatgatcgacccggaattggctggtgtacaaattgagcataaagtagaggaagctccggctactactaccaaaagagcaatcagaagaaaaactgctgaataaggtaccatatttgaatatgtattcgaaagcctcgcattattgcggggctttttttatttcttctaactttactacccctttaaacaaacctaaccttgaattgttatcttttcatttcataaaaacctgaaccgaatatgaatgtacgagcgtggagcgtatcgctccttttgtttctttcaactgtaactgcggttggacagacagtgaaccgctatttgaatactcctcttcctaaagaatgggaagagagtggagaagtgtttcaacagactcttccagtggacgaccactggtggaagtcttttcaggacaccagactggactctttgattgctttggcagtagatcgcaattattccgtagcgatggcaattaatcgtatagctgctgcacgtgccaatctttgggcagaacgtggaaatttctttccatctatcggactgaatgctggatggacccgacaggaaaccagtggaaataccagtaccttacctcagtctacagatcattattacgatgctgcactcagtatgagttgggaaatcgatgtcttcggcagtatccgtaaacgggtaaaggcgcagaaagaaaactttgccgccagcaaagaggaatatgcggcggttatggtttctctggcatcagaggtagcctcagcttatattaacctgcgggaattgcagcaggaacttgaagtggtaaataagaatgtagcttctcaggaagaagttttgaaaatcacggaagtacggtataataccggacttgttgccaagctggatgtggcacaggccaaatccgttttatacagtactaaagcctctataccacaattagaggcaggtatcaatcaatatattacgacactggctgttttgctgggtatgtatccgcaagaaatacgtcctgtattggaaactactggaacattacctgattatatggaaccgatcggagtaggtatgccggttgatttattactgagaagaccggatgtacgaagtgcggagagaagtgtgaatgcccaagctgcattacttggcgcttccaagtccgattggctgccgaagatctttctgaaaggttcgtttggctatgcagcccgtgatttgaatgatctggtgaaaagtaaaagtatgacctatgagattgctccgtcattgagttggactatttttagtggaggacaattagtgaatgcaacaagactggctaaggcacagttggatgaatctatcaatcaatttaatcagacagttctgactgcggtacaggaaacggataacgccatgaactcctaccggaactcgatcaagcagattgtagctttgagggaagtgcgtaatcaaggtgtcgaaactctgaaactttcactggaactttataaacaagggctttctccttttcagaatgtgcttgatgcacaacggtctttgttatcttatgagaatcaactggtacaggcgcagggtagctcgttactgcaactgataagtctttataaagcgctgggaggcggttggagagaataaaagaatctataaataaaatataacctaacggatatgaaaaaactaatgtatatttttcttgtgttgtcggtattgactggttgcaaggagaaaaaagacaccggagcaatgaagggaatgccgactctggcaattagcgtagcgaaacctatagtgaaggacatcactttgacgaaagattatccgggctatctgacaacggagaaaactgtaaatcttgtggccagagtgaacggaacattacagtctgtctcttacgcaccgggcggacgggtaaaaaaagggcagttgctgtttgtaatagaacctaccttatataatgataaggtggcacaagcggaagctgaactgaaaactgctcaggcacaattggaatatgcccgtaataattatagccgtatgaaggaggctgtgaaaagtgatgctgtgagtcagatacaggtgttgcagtcggaatcgtctgtgacagaaggagtagcagctgtcagcaatgcggaagctgctttgagtacagcgcgtacaaatttaggatattgttatgttcgtgccccttttgacgggacaatcagcaagtcgacagtggatatcggcagttatgtcggtggttctttgcagccggttacgctggctactatttataaggacgatcagatgtatgcgtattttaatgttgctgataatcaatggctggagatgtcgatgaacaatcagcagccaacgaaggatcttccgaaaaagatcatggttcagctggggaaagaaggtaccgaatcctatccggcaacactggattatctgtcaccgaacgtagacctgaatacaggaactctgatggtacgtgccaattttgataatccgcagggagtactgaagagtggattgtacgtcagcattaccttaccttatggagaggccgatcatgcaattcttgtgaaagaggcttccatcggaaccgatcagctcggtaaattcctgtatgccgtcaatgattcggacatagtacactatcggcatattgaaataggacaactgattaatgataccttacggcaggtgttgggaggactctcaccacaggaacgatatgttacagaagctctgatgaaggtcagagatggaatgaagataaagccgataccctgatgcggtcggcttgttggttatcttcagacgatgcaggtaactgtttgtccttatataaatattaatcgtaaacttatatattatgttttctaagtttttcattaaccgaccaatttttgctaccgtacttgccctgctcattgtggtagccggtttggtcgcacttaatatattgcctgtggcgcaatttccggagattacacctccgacggttcaggtatcggctgtctatcccggtgcgaatgctgaaactgtagctcaaacggtaggactccccatcgaacagcaggtgaatggggtggacggtatgctctatatgtcttcaaattcttcctcttcgggagcatattctctgacaattacatttgccgtcggtacagatatcgatatggctactgtacaagtccagaacagggtaagtgttgctcaatcatccttgccggaaccggtagtggtacagggggtgactgtgcagaaacagtcttcgaacattgtcatgttcctgacaatgacttcgaaagactctgtatacaacagtctctatctgactaactatgccaaattgaatttggtcgatcagttatcacgtgtgcctggtgtaggagctgttaatgtcatgggagcaggtgattattccatgcgtatctggctggatcctgaagctatgcgtatccggaacatttctccggcacaagtatatcagtccattcagtctcagaatatggaagtgtccgccggctatatcggtcaaccgatcggacaggacaataaaaatgcctttcaatatacacttaatgtacaggggcgacttatttctccggagcaattcgggaatattatcattcgtcgggaacaggatggggcaatgcttcgcctgaaagatattgcgcgaatagatttggggtctgcttcttatagtgtagtatcacgattgaaggggatgcctaccgcagcgattgctatctatcagcagccgggctccaattcgctggacgtttcaaaaggagtgaaggctaagatggaggaactggcgaccagttttcctacaggagtagcctataacgtaactttggatacaacggatgtaattcatgcttctattgatgaagtaatggtgacattttttgagacaacgctgctggtagtactggttattttcctgtttttgcagaactggagagcggttattattccttgtatcacaattcctgtatcgctgatcggtacattggcagttatggcggcatttggtttttcgatcaatacgctgactctgttcggattgattctggcagttgccattgtagtggatgatgctattgtggtggttgagaatgcttcaagattgctggagaccggacaatattcaactcgtgaagcagtcacaaaagctatgggggaaattacggggccgattgtcggagtggtgcttgttttgcttgccgtgtttattccgacgatgatgatcagcggtatttcggggcagttgtataagcagtttgcactgacaattgctgcttctactgtattaagcggttttaactcactgacactgacgcctgctctttgtgctctattcctcaaaaagagcaaaccgtctaacttctttatatacaaaggatttaataaagcgtatgataagacacagggagtctacgatagtacggtgaaatggttgcttcaacgtccgcttatctcttttgtatcttttgctattctgacagtgattgccgtaatactctttatgcgttggccgtcgacatttattccggatgaagatgatggttattttattgcagttgttcagcttcctccggcagccagcttggaacgtacacaagctgtcggggataaaatcaatgctattttggattcttatccggaagtggagaattacattggaatcactggtttctccgtgatgggcggaggtgagcaaagtaactccgcaacctattttgttgtcctgaaaaactgggacgaaaggaaagggaaggagcatacggctgctgccgttgtcgaccgttttaatggcgaagcgtatatggagatacaggcaggacaagcatttgctatggttcctccggctattccaggattgggtgcttccggtggcttgcaacttcaattggaagaccggaggaatctgggaccgacagaaatgcagcaggctattgacgcattgcttgcttcttctcattccaaaccggccttagcttctgtatccagtcagtatcaggcaaatgtccctcaatattttctgaatatcgatcgtgataaggtgcaatttatgggcattgctctgaatgatgtattttctacattaagctattatatgggggcggcatacgttaatgattttgttgaattcggtcatatttatcaggtaaagatcgaagcgcgtgatcaggcacaacgggtcattgatgatgtcttaaaactcagtgtggctaattcggcaggagagatggtccccctttcttctttcaccaaagtggaagagcagttggggcaggatcagatcaatcgttacaatatgtattcaacagctgccctgacttgtaatgtagcgcccggaagcagttccggacaggctattcaagaaatggaaactttgtttaaagaacagctgggagatgaattcggctatgaatggacgtcggttgcctatcaggaaacgcaggcgggaaatacgaccaccattgttttggtcatggccttgattgtagcattccttgttttggctgcgcaatatgaaagctggaccagtccggtggctgccgtgataggtttgccggtggccttgttgggagcaatgataggatgtatgataatgggaactccggtcagcgtatatacacagattggtattatcctgcttgttgcactttcggcaaagaatggtattctgattgtagagtttgcccgtgatttccgtgctgagggaaactcaattcgtgaggctgcatacgaagcaggacacgtccgcttacgtccgattttgatgacttcttttgcttttgtattgggggtaatgcctttgctgtttgctaccggggctggtgcgcagagtcgtatagcgttgggtactgcggttgttttcggtatggcgatgaatactttattagcgacagtctatattcctaatttctatgaattgatgcagaaactgcaagagaagtttagcaggaagaaagatgacgatgtgaaaaaagatacgaatatgtaaaaatagaatatcgttttcagagcctccggaggcaagacaaagatggtgtcactatgtgcttgggatacttacactatgtgtgtggtatagtgtaagtatcctgaccttatagtgacactatctttatagggcattataatcgggaatatcctgaagaaaggtatagctctgatgtgcataatccatccggcaacaataatgctgcattccattacttactatcagataatcaactttcaacaccatattatagcgggttatctgatcgaataccgcttgtgtgatttcgatgtgcggagctttgtattctacgatcattcgtgctgaaaggtctctccggtaaagcaccgtatcacatcttttagttgtgccgttcagctttaccattacttcgttggcaaggagtgcgttcggatatcctttgtgtgcaataagaaagtgaacaaagtgttgccgtacccattcttccggggtaagtgcgacatatcgtttgcgaatcacgtcgaaaattacattttttccgtttcgtacgtttattttagtgtcgaatactggtaggtttaacgataacatttattatttttgtaagttaaataacggtttccattattggaaccacaaatttaatagataattatgaaaacgaaagaagaaatcgtagctaattggctgccccgttacacaaaacgtaacctggaagattttggagagtatattctgttgactaacttcaacaagtacgtagagattttcgcaaatcaatttgatgttcctattttgggtagagatgccaatatgatttccgccacagccgaaggcattacaatgatcaatttcggtatggggagtcctaatgccgctattatcatggatttattgggagctattcatcctaaagcctgcttatttttaggtaaatgtggtggtatcgacaagaaaaatcaaattggcgatttaattcttcctattgccgctattcgtggtgaaggaacatccaatgattattttccacctgaagttcccgctttgcctgcatttatgttgcagcgtgctgtttcttcgtccattcgtgactatggccgtgattattggacgggtaccgtctacaccaccaatcgccgtatttgggagcatgacgaagcattcaaggagtatctgaaaaagacacgtgcgatggcggttgatatggaaacggccactttgttcagctgtggctttgccaatcatattccgacaggagcattgttattggtatctgaccagcctatgactccggatggagtgaaaactgataaaagcgataatttggttaccaagaactatgtagaagagcatgttgagattggtatcgcttctctgcgtatgattattgatgcaaagaaaactgtaaaacacttgaaattcgactggtaactgccagtcttcctaaaaaatatatatggcaaaacaagagctgacctgtgatgacatcctcaaagaactgagggcaaagcagtatcgtcccatctactatttgatgggagaagaatcgtattatatcgatttgattgccgattacattactgataatgtcttgaacgaaacggaaaaagagttcaacctgactgtagtgtacggtgctgatgtggatgtggcgacaatcataaatgctgcaaaacgctatcctatgatgtccgaacatcaagtggtggtagtcaaagaagcgcaagcggtccggaacatcgaagaattatcgtactatcttcaaaaaccgcttcattccactattttggtgatatgccataaacatggaacattggaccgcaggaaaaagctggctgctgaggtagaaaagaccggtgttttgttcgaatccaagaagataaaagatgcccagcttccggcctttatagcttcctacatgaaaagaaaaggaatagatatggagcctaaggcaacggctatgctggctgattttgtcggctcggatttaagtcgtttgacaggtgaattagaaaagctgattatcactttgcctacgggacagaaacgtgttactcccgaacaaattgagaagaacataggcataagcaaagattataataactttgaattgcggagtgctctggttgaaaaagacattctgaaagcaaataaaataataaaatattttgaggaaaatcctaaaacgaatccaattcaaatgacattgtctttgttgtttagcttttattcaaacttgatgttagcatattatgcgcctgataaatcggagcagggtattgctaatatgctagggttaagaactacttggcaagctcgggactacgcaattgcgatgcgcaaatatagtggagtaaagacaatgcagattgttggtgaaatacgatatgccgatgcaaaatcaaaaggagtgaaaaatagttcaatgtctgacggagatattcttcgtgaattagtgtttaaaattttgcattagtaaaactgaatactctaaataaacaaaaggcatatacttttactgtaaaacagattaagtatatgccttctttatatatagcaaattagttgtgtcaaactcataaccaaatcttcttttatagacgaatattttacaatggatctgttgttctctttttcctgacttttatgaatggaaaggagtttgaagatcttttgcttcccttctttaaattcaattttggtaatttctctcttttctagtttttgaagttatattatattcattttcaaaattgaaaaaatctgatttaattcagactataaatatagaatggtaaatcgtattagcataaatggttttgcataaattggagggatcatctttcttttcctgaactgataaaatgtcattttgataatttgtgggataattgggatatttttctgttatttttctagttgatcttaatttgggtattgataaaacaggtatattttattataagacaggaatttaattcaattttatagcttctagaattgaaaaaaaacaattgatcgactgaatgtgcggaaatatagcaaggatttacgatttgcgagatacttcagaagaaaatgtaaaagaagatttgaagagttctcaatatacataag

SEQ ID NO: 75 - DNA, 36289 bp, Bacteroides thetaiotaomicron
tatttgcgttgctataacacagcaaaagcagataatagggttaatttatgaaacaaatcagatacctcttcggaggattactatttttgtttgcctccatcggaagcgtaactgcgcaagaggtaagcgattactcaaaactacaaccaagtgattattccagcattacacttccaccgctggatcttcttttcgagaacgcaaaaagcgctccgacctatgaattagctacagtaaaagaacaaattgaacggaagcttctggcaaaagagaagcgtgccttcttaggctttttcagtttacggggcagctaccagtatggtatgttcggtaacgagtctacttatacagatgtagcaattgcaccttacctgacctatgcaacacaggcacagaacggatatacagtaggtgcaggagtcaacattcctttggacggtctctttgacttgacagcgcgggtaaaacgccaaaaactgaatgtacgtaccgcccaacttgaaagagaagttaagtttgaggaaatgaaaaaggaaattatccttctatacgcaactgcgacctcccaattaaacattcttaaacttaatgccgaagccctcatgcttgctaatgtacaatatagtatagctgaaaaggatttctcgaatggagctattgattcgggaactttatcatctgaaaaatctcgccaatctgacgcacaagagaaattcgaaaacagcaaattcgagctaagcaagagtttaatgatacttgagttagtcacccacactcccattttaagaaacaaataaacatacatttatggaatacatcctttatatcagcagattcctatatcgtatccgttggtggttacttattggaacagccattataacatttgctgtttactattttgggaaacgcatgataggcaaaacatataacgtagaggcaaccctctacactggtgctgcttccggctacaatctagaaggtggaaataacaaagtggattgggcgacaactcagaacgctatggataacctaatgaacattatcaaggctgaaagtacactcaaacgggtatctatccgattatatgcccgaagtctgatcaaaggtaatccaaaagaagacaatgaattcatcaaagccagcaattacaacagaatatatgaacacctaaagaatagtccgaacgggaaagaaatactgtcattaatagataaaaacagcgaagataaaacggtagccaactttttcaattacttgagaccgacccaagcaaactatctctatggagtattctattataatttgccctattactcttataatgatctcagagcaatcagagtagcgcgtaaaggtgccagcgatctgattgaaataagttatacggcaagtgatccgggtatcgcttataataccattgacatcctgaccaaagaatttgtaaacgaatacagtgcaatccgttatggtgaaacagataaagttatcgaatattttaaaagcgaacttcaacgcatcggaaaggaacttcgacttaaagaagactcactaacgcaatataacgtagaaaaacgtgttattaattattacgatgagaccaaagaaatcgctgccatcaacaaagagtttgagttacgtgaacaaaacgtactgattgcatacaatagcgccaaagcaatgttaaacgaactggaaaagcaaatgggcagcaatgccaaacatgtaatcaacaatcttcagttcttggataaactaaatgaagccgcttcgcttacaggaaaaatctcagaaatggaaacaatttcaagtgatcatcagaatcaagaagcctcattacaggaatataagaatcgcttaaatcaaacgcgcaaggagctttccgagctttcaaataaatatgtagagaacaaatataccaaagaaggaatagctaaagagaacatcatagaacagtggcttgaagtaaccatgcaatacgaaaaagccaaatcagacttacaaattatacagcaaagccgtatagacctcaacgagaaatacagacagtttgcaccagtaggttccactatcaaacgtcaagagcgtaacataacttttatagagcaaaattacttgtctgtattgaaaagctacaatgatgccctcatgcgtagaaaaaatttggaaatgacctccgctgcattaaaagtgttgaatgctccggcatatccgatcagtgccatgcccactcctttgaaaaaaatggtaatggcagcgtgtgccggtaccttcttatttattttgggattcttcttaattcttgaattattagaccgtactctacgcgattctattcgtacacgtcgtttgattggacttccgatgttaggcgcctttcccaaagactctattttagagtatcacaatcatgttgaagaatcaaaaagtatagctacaaaacagttaagcaatagtatccttcgtttctgtcagcaaaagaaagaaggattgccctacattatcaattttattagcacagaaggcggggaaggcaaaagttatgtgatcgaagccctaaaaaaatattggaacagtatcggacttaaaacaaaagtaataacatggaagtcagacttcagaattgattcacgagaatacaacctggccaaaagcattaccgatctatacacatcagaggaagaagatattctcatcgttgaatatcccaatctgcgggaagctagcatatcgctggaattactacaagaagctaatctaaatatactcgtagcccgtgctgaccgtggttggaaagagaccgataagctcttgtcagaaaagctaagtcaacaagtaggtaaaactccactttatgtttacttgacacacgcatcccgcaatgtggttgaagactacactggtatgcttccaccatatacactttggaggaaaatagtataccgactgtcacaattagcattgacagaaagtatatttacgttcacaaaaagaaagaagcagccggcaacatcaggagatgaagatgacgaatgataaaggaaaatacagtcaatacttaacagtagccggtaactattttgccaataaaggatgggtacatttactattggcaggaggattgtatatattatacaaaatgttctttcgtacttcccttcctttctttctgacgattagttcattacctttaatgacagttattttcttattaattatcaaatattcaaagcaaagtttctatacacttttcattctccaattcctgctggcagcagcttatgcagtgacagacataccattgggagtagcaacattaatgtgtacattgtttgccgttgttttgctctttgcgtacggaatgcatgaaaaaattgactggtcggaaagtcgtaatggtatgcttatgctttttctgatatggggagtttattgcatattagagatagctaatccgaacaatgttcaggcagcatggaatatctccatcacccattatctcatatatcctattgtatgtgctgtcatcgtaccgttagcaatccgtaacatcaaggggattcagtggcttctaattatatggtctcttttcatcctcttggcagcagccaaaggatattggcaaaaaaactgtggttttaatgaacgtgagcagtattttttatacgttttgggaggagcaagaactcatattatttggtccggtattcgttatttctcattcttcagtgatgcagcgaacttcggcgtacacatggctatgggtgtttcactttttggaatttcacttttttatataaaaggtgtatggctgaaaatctattttataattgtcattattgccgccatttacggaatgggaatttctggaacacgggctgcgatagctctgcctatcggtgctttagggagtttcattattctttcacgcaatcgcaaagcatgtattacaggtatttcagttcttgccttgttattcttgttttttgtatgtaccaatataggagatgacaatcaatatatccgcaagatgcgttctgcatttcgtcctagccaagacgcttcctatcaattacgtgtagacaatcgaaagaaaatgagagaattgatgattcacaagccttttggatatgggatagggttatccaaaggcgaccgtttctatcccaaagaacgtatgctctatccaccggattcctggttagtctcagtatgggtagaaaccggaatcatcggtctagttctctacctggctgttcacggagtcctttttgcatggtgcggatggatactgatgttcaagatcatgaacaaacgcctgcgaggcttacttactgcctggctctgtaccgctgccggattctatctggcagcctatgccaacgacgtgatgcaatatcccaactccatccccatatacacagcctttgccctctgcttcgcaggaccgtacattgacaagcggatgcagcaaagtaaagaaacagaactgaaaaacgaacaatagattatgatgaacgaacctcaagtctcctttatcacagtttgctacaacggctttaaagacacttgcgaattaatagaatcgctgcaaacacatgtacattccgtgagctatgaaatcatcgtcgtagacaatgcttcgcgcgaagacgaagcgactaaaatcaaggagctatattccgatatagtcaccctgcggagcgagtctaacctaggcttctctggcggaaataatctggggatcagagtagccaaaggagcctatatctttctgataaacaatgacacttatgttgaatcagacggattccactacctgacagagcgactggaaagtcagaaaaacatcggagccgtctctccgaagatacgctttgcctttcctccgcaaaacatacagtttgccggattcacctccctgtcggcaatcactatacgcaacgaaatgacaggtttcggctgtccggacgacggcacgttcgacaccccgcacacgaccccctacctgcatggggcggcactcatggtaaaacgtgaagtcattgagaaagtaggagaaatgccggaaatattcttcctgtattatgaagaaatggactggtgtacacagatgacaaatgccggttacgaactatggtatgagcctcgttgcaccgtcttccacaaagaaagccagagcaccggacagttcagcaagctacgtaccttctacatgacgcgcaaccgtttgctctacacccgccgcaaccggaaaggtgctcaacggctgctctccattctttatcaatctaccatagctgccggaaaaaatagccttcagtttgccgtgaaaggtcgtttcgatttatttgccgcagtatggaaaggcgttgtcagaagcttttctgtcacctctcctatccgataacccttaaaaatgaaagaccatgtacacctttattgactggattctctttattcttctggcactttgtgtcggttatctgctgttctacgccattgcctccaaattctatcgtccgcgaaaactttccgaagcacgtatcctgcgtcgttttcttgtactcttccctgcatacaaggaagacagggtgatcgtctccactatccgtaatttcctcgaacaggaataccccaaagaaatgtacgacgttcttgtcatctccgatcagatgcagccggacacgaatgctgccctacaaacactccccatctgtttgcaagtagccgactataccaatagttccaaagccaaagcccttacgctggcaatgaacgtcactgccaacgaatcttatgacgtagtagtgatcatggatgccgacaatgtaacgactcccaatttcctcgcagaaatcaaccgtgcttttgagtccggcctgcatgccgtacaagcccaccgcacaggaaaaaacatgaatacagacatcgctgttctggatgcgatcagcgaagaaataaacaacggattcttccgtagcgggcacaacgcgataggattgtcagccggattagccggttccggaatggcattcgacgttcattggttccgccgaaatgtaggacatctgcaaacatcgggcgaagacaaggagctggaagccctgttgctaaaacaacgcattcatatcgaatatctggaacaactgcctgtatacgatgaaaaaacacagaaaaaagaaggtatcaaaaatcagcgtaaacgatggattgcagcacaatacggtgcattgcgggcttccttgcccgatttcccgaaagcactgattcagggaaatatcgactactgcgacaagattcttcaatggatgctgcctccccgtctgatacaactggcgggagttttcggtttcactttactctttaccgcaatcggcttactaatgagtctgcaaagcggaggatatgaatggtatacagccatcaaatggtggatactgtcagccgctcaagttgccgccatgatcatacctgtgccgggaaagttgctaaaccggaaattaggaaaagcaatcctgcagattccgacactggcactggcaatgatagccaatatgttccgactgaaaggaacgaacaaaaagtttattcataccgagcacggagaagaataaagcctcaccgtgaaagaaaagaaaaggcacagatgacacgaattaacacggatttggctgcgcagcctctcaaatccgtgttggcgtccgtatcatccgtgcctaaaatttccctatgaaaaccgtgcctgaatcatattcattagcaagtttcgtcaagcccactcctcctccgcatcaaagcacggacaagccttcacccattcctccggctcgatctccccgttcccgttcagatcagggctcaggtcacgatgtccgcacacccggcaaccgggataatcacgtaacaacgtaagcacaagcacatgcatcgagtgtatctgccattcggtacgggtatcggcaggccgcccgtgacagtcaagtccgccctcatagcaaataccgatacttgtctgattaaagcctttcgcatgagctcctatccgttcaatggggcgggtagtcttgatgtcgccatttttccggatataaaagtgatagccgatcccgttaaatccccgccggcggtggcacacttcaaggtctgtttccgtgaaatccctgtccgccctagaggcggaacagtggatcacaatcaggtcaatcttcctcatcgacctgccctttcgttcgttttccttttctcttcctgcggaagaaaaacaggatctccaatgcaatctccaaaatcttgtcaatcataacttttcatttttacaggttattcatttacaggtatcacacattaatgatgctgatgtacttaccggattaaacggtaggatcgggagcttcctcctcccctccatcgccaccggaaccggaaccgccaccggaaccgccgccactaccggagcctccgccatcaccgcttcctcccgaagccggcgcattcttggagatgagttcgaagaccatgttattgtccccgccacgtgtggtagccgtgctgtcgttggcaagccgcagagaattatcgaccttgaaacgaaggttgacacgagtaatattcctcaccgtacagtccttttcctgttccacaccgggacaagtaagcgtggtatagaaaatccccaagccgtcaaccttcaccttattccctgctacgagcaccttcttcatcgagcggacaaaggattgcatcacatgctccacatcttccaccgaaagcgaaccgatcgactcgatctcacgcgccagcgactcgatagaataaagtttcgattcccccggcttgggtttgagcacatacaccatcggcgatttgtcatcaccaatcttttttttgcgctgatagcgcaccacagacactgttgccatactgaatttgtattaaagaaaagaaggacattctccctttctgttggtgaaacaaagatacggcagtgcaccggcaatttcccggattacgacggactgtgccggactatgacgggataaaacggattaagacggattaagacagcataaagcagaataaagtgaattagaaacagattgaaagcatactaaaaagcgaatacaaagtaaccataaagcagataaaagctgaaaaaactcccaaccaaccccgaatacccccccaaaaaaagacaagcagacaacgtgaataacaactaaataatacaagcataaaagcaacactttcatgagcaacaaatttgctaaatccagtaaaaaacagtaactttagacccattacaacaccctacaattaaatcaaaaatgaaagcaaatacagataccctgcaaaaacaggaagaagaaaaatccttccaataccgcagctacggaaaaggagaactcgccatgctatatatccccaacgtccagcaacaaagcgcagtagaccgcttcaacgaatggatcgaagccgcacccggactaaaagaacgcctgctatccaccggcatgaatccccgaagcagacactacacacccgcacaagtacggctgatcgtagaagtgctgcaggagccttgaagataagtattaagtattggtgccaatcagcagttaaaacaaaataagaatagttccggacaagataccaaattaacgtataaagctgtccgaaaagtagataaatactatcaatctatcattcagcacacggagaagaatctcttctttgactaatataaagagctgattcttcggcagacttagggtgacagagcaaaacgatagcagacgttctcttttcggacagccccattcaatatcattttccggctcactcggatgagcgcgttgcttttcagccgtgtctcttaatgaaatttctgatcttcttcgataagttcctggctaaatttctccggtgccaaaggggtaaagagttctataagattttcttcgggatcgcgcaggtacagggtacgcatcccccaatcgggcatatccgtaggctcactgataaatgtcacgccttttgctttcagtgcgacaaaggtttcgtccacgttatccacactgaatgagatcattaatttttcacgcatcccaacaggctgctgcttatctgcattacctgccgaaggcgccatccagtcggatacaaaaagggcgagaccttctattccgtcggctactttaaaactggcgtatccgctattctcatctccccaggctggctctaatccgagttgttcggtatagaatttgaagcatccggcgaagtcctttactaataatcttacgttactaaatctcattgtttacagattaatggtttattatttgtttcttagaatcgaaatgcaaatataatcattctatcggatgacgtttcatgaatccgtatttacctcaaaactgtgcgaaaataaagtaaaccggtatcaaaatgaatcaccattcaaccagtgatccgcaccgttactcatcccccgtgacctgttacccaccaccctcaccaactacgattattacctattacttattacctaatacttaatacttaatacctaatacttattacctattacctattcaaacagctccttctccggcaaccagcacgagctatcattgacagtgtttctgacccgttgttccggtgggacggacgggtcttgggactcttcgcaggggaggtaacgtccgctgacgggatcgtagacaaaagtagccacaccacccgttccgagatgtttgaacttcactttttcgacatagacacgtgtcactccgacctccttgtcacgctccactaccaagccgtaatccgccttgttgaagaaatcggcagacccgtttacgtcgtacatatccggacgcggagtatggtttgtcaccggattgcggttcatctttcgggggtgcgccacaagaatcaccagacagttatattgcgtggcaaactccgtaaacagattcagaaaattggaaagatactgcgtttccgattgccccggtgctggggtatgctcaaaacggttgaccgggtcgaagacgaagatgcggcatccccgacgcaggacaagttcacgggctttggcaagcacccgttccggagtggcgctgcctttgagggcgatgtgacagacgttttcggcaagaaactcttccgaacggagcagaagtccttccgtcatgccgcaaccgttttgaaaacggcgtccggtcagtttctcgatcaacttgcggagatggtagacgataggattattctccggactgaaaaacgctatcttccactgatggcgcatacagaggcgcaacaccagttcgtccagccattccgattttccggcccccggtatgcccgtaacgatgaccagccgcctacgttcgtacgtacaaatcttatccatctcctcccagcccgtctccgctccgggaccgaagccgttgtcgaacaatgcccgcaggtcttcgtgcagatcggcggcggtgaagatgccttcaagagggatttcttccgcctgctcgatggcgatgcgaaggctgtcgatcccatatttgacaagatgttcattggcatccttacaccccggtccgtagacggccacacggcagcgttcggcacccagacggttgaccagttcgtcacgcagtttaagcccggcagagtcggtgtcaacggctatgatgatgtctttcagattctcgaagtgcgactccatgaagcggtcgagccacgaaaggttcgcgttagctccggcaggtacggagatcacgcttttgaatccggtggcaagggaggacgcggcatccagttcgccttcgtggatgatgcaggtgtcctgtcccagcacggaatcgatattgtagggaatcagttcggctccctgcaccattttgaaatttttggcaccgctgcggaacttggtgttgacgagtttcccgtcctcaaaatagttgaaacagacgcaccgctctttcgtgccggattgcgacatgaactcttcctgctccgtgatgcgcagaccggcgatgacggactgcggaatgcaacgcgtctctaccagccaacgctccgtagcttcggaaagcgtcgtcttcgaagcgtcgaacaccggacggtggaaatgctggggaacggcagatgccgcacgacgtttacgggcagcctgtcgctcggctttcgcacgctcttcggcatcgtcggggacgtagaagtcggctccgcaatggtagcaatggcaatgtcctgtgtcgatattgacccgcagcgaacggtcacgcttgttgtgcctcgtcgggaggcattgctcgcaaatggttttaacgacaccgctggtatgcctgcggacatcgacatgataattagcaaaatttctcatatttcttgtttctattcctcccttccgaaaaggagattttaagtttgtattaataatttttctatcagttcccaatgcagacagaaagctaagcatcaatgggcaccgggctaaacaccaataagcagcgagctgaacatgaatgagcagcgaggcgagcatgaacgagcaccgagctgagcatgaatgagcaccgagccgagaatgaacgaacattgagctgaaaggcaacgctcacgtagccggatgtcagagaaatccggagctaatttccccacttccaatgcacttcatcccacacggcagacctgtccggtcttggaggcgcatccttcggaatcggatgcccaagatacgtccgttgcccgccaatgagttgttcaaagcgatacagttcttcctcagccgattgccggcaactgccgagcagccttttcttcagctcctgagccggacgtccgcccggagagaggtaattgccgaaatacaatttcacatccctcaaaaacagcaagccatcttccctgccaaagcgtcggatatgctctttaaaagcagcgatcacctcctcctgccgctccacgaaaagtttgcccatacaggagtgcatagccatcgactccatgtaactttccgattcggccatctgatccaccagcatctcccacggaagaaccggctgtaggggcaactgtcccctatcctccggtggagaaacgatctgaagtctgtcagaagcggcggcagaattttctttctctgtcttttcttcgttactactgttgttgtctttgacaacagtagtaactcttctctcctcttctctactcttctggttttgattcggtttttcgcctttatccatcggtgtttccggcgtgctctccatgcgtttcggacgacctccttttttgccgttcgccacattaatcatccgtctttcttcgagcctcgccatcaccctgtccagataaggcgaccggaacatttgccgttcttcgtcgagcacaaaaaggtcgaactcacggagaaccctttgcaacacaccggcatccaaatcatacattcgtgcgaaagcccccatacaaagcggacaacaggacgcttcataattgtccgctttgcgcagatgcgtaagaagcatcatatagattccgagcgattgcgcagcgtcaagttccatcatcatcctgacaatattgtcattactcaaaaaatttacctctaaattgaaatactgatctttcttcatatcttacaattaaatgactgtgattcagaacatcccgaattcgctctgcaaaggtctaaatactttttcgaaaaactacttgcagaactgcaaacgatgtttgacatttttctatgaactttgcggcattatttgtaaaaagatagaaattatgaaaggatacgaaagagcaactaaagaagaaattaacgaccggctgcgtattgaagaaaactgtcatgcacaagttgaacgaatcatctacatacgtcacctatgtaatctgaaccttgaagaggcggcagatgtaaccaatctcagcatatctaccctgagccggtacgaaaacgaagtgaccaaatgcagcgtacagagcctcataacgatatactaccactatcagaaatacctctacgagcagcatatccccttcgacaagaacctgtttctcatagatatgaactcgtttcacaactaaagagtgacagagagataaaacggacgcacaaggaataaaggcacaacaccgaaaaaaagcaaaaaagatgaaaagtatcatatcttttattacctttgtatgtggcaaaagcccaccaaaaacaaagaatcaagcatgaacgacaatgaaataggcaatccaccgataaaagcattaatcgttttcagagagaatggagatacggacaatctttttgtccccattttatgcgatgctatcaggacgacggggattgacgtacgatgttccacgaatgagttctggaactcggatacaccttacgacatcatccacttccaatggcccgaagaggtgatggaagggaattgtgacgatccggacaggatttgccgcctgaaggagtgtatcgcttttttccggtcccgtggggcccggttcgtgtatacgcgccacaatgtccgtccgcatgatgcgaacgaggtgatcggccgtgcttatgacattatcgaagaacaaagcgatgtggtggtgcacatgggacgttacagtctcgacgaatttgcagccaaacacgcggacagccggaatgtcatcattcctcatcctatttatcagtacacatacaaggaggacatcagcgtggaacgtgcgcgccagtatcttaatctgccgcaggaggcgtttatcgtcacgtcgttcggaaagttccggaatcgtgaagagaggcggatggtgaccggagcgttccgaaaatgggatgaagcaaagaagttcctgcttgctccacggctgtacccgttttcgagattcaacaggtatggcagcaacttcttcaagcgctggacatcccgggcaggatattacctgcttatacccttgctcaaccgcctgcgcagaatgcacgccggagccagcgacgaacctatagacaactgcgacctgccttactacatggccgcttcggatgtaatattcatccaacgaaaagatattctgaactctgccagtatacctctcgccttcctttttcacaaagtggtcataggtcccaatatcgggaatataggagaaatcctccaagatacgggcaaccccgtcttccaccccgacaaccaatttgatatcatacgagcactggaggcagcccgccaactgtccgcccgaaggaagggagaagacaactatgcgtatgccattgaaaacatgaacagcggaaaaataggaaaagaatatgcggagctttacagaaacctagccaatctctctctttaaacgatctcaaaaacaaacaacaatagagtagccatacacagtatttatggaaaatgaagaaataaaagtcagtgtcgtcatacctgtctataacaccgaaaaatatgttcgggaggcagtagaaagcattatgaatcagacactgcgggaattggaaatcatcatcatcaatgacggctccacagataacagtctgcaagttgtagaagaactggctgcggcagacagtcggatacaggtgtattcgcaaagcaatcagggattgtcaatggcacgcaatgccggcatcacgcatgcccacggaagatacatctatttcatggatagtgatgatctgttggaaaaggatgcaatggaactgtgctacagcaaatgcgaagaaaaagaactggatttcgttttctttgatgctcagagcttttttgaagaggatattcgcaatgctcccgtactaaattatcaacgtaccgataagttagaaaacaaggtttatacaggtcccgaagcaatcaacatacaattgcagcacaaaacgtacaccccatccgcctgcctgaacgttatccgcacagcttttttggaagaacgacagctcctcttttatccggatattgtacacgaagatcagctattcacgaccttactttatctgcaagcccgaagaacaagctgtatccaacgatcgttctttcaccggcgcatacgtaaaaattcaattatgacatgcgatttttcactcaaaaatttaaaaggatatctcactgttactcaagagatagtcaaattcaagcaacaaacctctgaaaacaaaatcaaagatactattgatttatatctgtcgcaaatgctgaatgctgtcatttggcaagcccatgtgcttccttacccatatcggcttcggctggcgtggcggtgtctgtttagatacaaaaaacttatatctataagaagcatcggagtcttgttattcaaatccatcattcacaagtagatcagaaaagaatcattcaggcaatggcaaacaatattaaacatcagttattttccggagttttctacacggcactagccaaatacagcggaatcattatatcactcgtcgtggcagggattcttgcgcggttgctctctccggatgacttcggagtagtggcaatcgctacggtcattattgcatttttcaatctctttacggatatgggaatatcgcctgctatcgtacaacataaatcattgactaaagaagaactatcggacatcttctcattcaccgtatggacaggcatcggaatcagtatactcttttttgccgcttcctggctgatcgccgattactacgaaagtgggatcttacggacgttgtgccagctcctgtccgtcaacctgttcttcgcctctgccaacatcgtgccgggagccttgttctaccgcaacaaagagttcaagtttattgctgtccgaagctttatcatccagatagccggaggtgccggagcaataactgccgcgctttgcggagccggcttatatgcgctgatcatcaatcctatactttccagcatactgatattcgttatttcctatcaacgctatccgcaacggctgcgtttcacgttaggactgaaagtactccgaaagatattctcctattcggcctatcaattcttgtttaacgtgattaactatttcagccgcaatctggataaactgctgattggtaaatatatgagtatgtctgatttaggatactatgaaaagtcctaccgcttgatgatgctccctctgcagaatattacgcaagtcatcacaccggtcatgcaccccatcttcagcgatttccagaatgacaaggaaaagctggcaacatcctacgaacgcattgtccgttttctgtcattcatcggtctgccactcagcgtactgtttttctttacggcggaagaggtaacactgattatttttggtgatcaatggctgccttcggttccagtattccggatactttcactttcagtcggtattcagatcatactctcctcttcaggctctatttttcaggcagcaggtgatacaaggagcctttttgtctgcggactcttttcgtccatacttaatgtgaccggaatgctgacagggatattttatttcggtacactgacagctgtagccatatgtatcgtgataacttttactatcaatttcgtacaatgctattggatgatgtatcgagttacattccaaagaaacgcatggatatttatcagacaacttctttctccactccttgtcagcctactaataacagcattcctcacgcctatatattatatgatggaaaatatgaatattttcgtaacacttattgcaaaaagtttcgtaagttttattatctttgggacatatatgcaagtaacacacacctatgatatcacaggcaaagtgaagactcttgtaagaaatagaaagttagtacaaaagaacaaacaatgaaaggattattcctcatattccatggtttcgaagcattcaacggaatcagtaaaaagatacgttatcaagtaaaagccctcaaagaatgcggactagaaatgcatacgtgttggctagacgatacggacaaccataaacgccgtatggtagatgaatcgataatcgccgactatggtttcgggatcaaaggaaaaatcctaaaaagaatcgaatttgacagtatcgtacattatgtacagaaagaaaacatagactttatctatgtacgctatgtccataatgccagccctttcagcatacggctgatgaaactactaaaaaagaccggagcacgtatagtgatggaaatcccgacatatccatacgaccaagaatataagggactcccattcgtataccaacgaatcctatttatagacaaatgtttccgacagcatctggcacgctatgttgacaagatcgtcactttttcggactatgacattatttggaatcgccccaccatccgcatctcaaatggaattgatttcagcgaaatccctttaagaggtccaaagaatgataccgcacattctctacaactgattgccgtagcgacaatgcacccatggcatggtttcgacagagttatagccggcatggcaaattactatcgtacacataccgacactcatgattataaagtatatctcaatatcgtaggcttcggggttcccgaactggtggacagctataaaaaagatgtagccaaacatcagttagagaaatatatcatctttcatagtgccttatacggcaaagaactggatgccgtgttcgagcagtcggacatgggaataggcagtctggctcgccatcgtagcggtattgacaaaatcaagaccttaaaaaaccgtgaatatgcagcaagaggcattccttttgtttattcagaaacggatgatgactttgagcatcaaccatacatacttaaggcagcaccggacgattcgccccttgacatcgaaaaagtaattcgcttttatcaatcattgaaaacaacgccgctccaaatacggatgtctatagagcaatcactttcatggaaagcccagatgcaaattgttattaatgaaacctttgaataaaactatatcactatgaatatacagccactgatcaatgctatccgctataaattgcgttatggcattactgtagaatggtacaatttctggtacatggctctcagatgccatcagaaaataactccgcaggtagcttccattgatgagaccattcggataatcatagaagaccaatgttccgtgagccgtttcggcgatggtgagatgctgcttaccaacccggacaaggaaataggattccaaaaaggaaatgtactcttggctcagcgtctcaaggaagtattgacaagccatgaagaaggacatttggtttgtatctccgatactttcgaaaacatttatcgctataaccgcaaagcacgccgattctggagaactcacttctttctgtatggcagttggtgggaccgcttgctgttgcccgacaggctatactacaatacattcatcacccgtccctacatggacttcgcttccaaagaagactgcccacggtggtttcaccagatgaaagctatctggaaagacagggatgtcgtattcattgaaggcgaaaaaagccgtttgggggtaggcaacgacctctttgacaatgtaaaaagcatcagacgtattctttgtccgccccgtgacgcatttgaccgctacgaagaaatactgaatgaagcgcaaaaactcgagaaaaccgctctcttcctgattgctttaggacctacggctactgtactggcttacgatttattcaagtccggttatcaggcaattgacgcagggcacgtggacgtagaatatgaatggtggcgaatgggagccaaacggaaagtaaagctggaacgaaaatatgtaaacgaagccgccaacggaaaacaagtgtccgacgccggagaattttatcggaaacaaatcattgctaaaatctattaaatcatgaagatagcctattacctgccctcactacaggcacctggcggaatagaacggatagttacattcaaagccaattattttgcagaacattttgaaggatacgacatcaccatcattacatccgaacaaatgggtaaagcaccacactttccattatcccccaaagtaaagcatatcgacttaggagtatctttcgacctgccctactctcaatccatagtaagtaaagtgctgaagtatccgttccgctactatcggtttaaacaacgactatcgaatctattgaacgaactgaaaccggacattactatctcaaccatgcgccgggaactgaactttatcactaaattgaaagacggtagcctgaaaatcggagagtttcacgtcagccgctacgcctatggcgcagaagcactgaaacgtaaaagcccgattgtcaacatgataaagaaaagatgggcaaacagatttgtcaaaaacctgtctaaactgtccagagtgattatacttacaagtgaaggagctaaagactggccggaactgactaatatcagcatcatccctaatcctatttctactcctgtagaaggaaaacaaacagatattctgtcacataatgctattgctgtagggcgatatgcgccccaaaaaggatttgatatgctaatccccgcctggagcattgtcgcccaaagacatccggactggaaactacatatttatggagaaggcgacctgaaagagaagttcaccaaactaatagatgaactacaactaaataataattgtctgcttcatcacactgtatcgaatatagccgaaaaatactgtatgagttcgatatttgtcttatcaagccgatacgaaggttttggactcgttttggcagaagcaatgtcatgtggtataccctgtgtctcatttgactgtccgcatggtccttcgaatattataaaagaccatgaagacggtctactagtggagaaagaaaatatcaaggaacttgcagacaaaatctgctatctgattgagaatgaaaatgtacgcatcaagatgggacacaaagccagggaaaacgtaaaacgctttctgccggaaaatgtgatgccacaatggaaaaacttattcgaatcattaacttattcttctaaataacagaacaacatatggtaaagtggtataaaacttatctggaagtatacgggaaatcttttgatgagatttctgacgatagtatccgcaaagtcaaaagacaactcaaagaacgtcaaaacgattctccactggtatcggttgtactcattgcacacaatgaggaacgtcatctgataagttgtatctggtcactctccgagaatcattgccatttccccattgaaataatagccgttaacaacaattcaacggataaaacggaagaaatattaaaatcattgggagttacctattataacgaaacgaagaaaggtccgggatatgcccgccaatgcggattggaccatgcaaaaggaaaatatcatatttgtattgatgcagatactttatatccaccgcattacattgaaacgcatgtaaaatatctaatgaatccgaaggttgcatgtacattcagtttatggagttttatggttgacgaaagacattcccgattcggactatggtgctacgaaggcctgcgcgatatatacctccgcttacaagccatccagcgtcctgaactctgtgtgcgaggtatggctttcagttttaatacggaaataggacgtcggtttggatttcgtacagatattatccgcggagaagacggttcgttagcattagctatgaaaccgtatggaaaaatcgtatttattacaagtcgcaaagcacgagtgcttacaagtaatggaaccctaaattctgaaggatcactgattgataatatatggatacgggtaatcaaagcactgaaagaaatcaccggactctttatcaaaaagacggcatacaaagataaagactctaatctcatcaaataaggtctcatcaaaatcattatggatatggcaaaatatatagtaaatatcatcttagtaacagcttgtcttttcacctatacttcctgtataagaaaaatgaatctatacgatgagaatagaaatacaggacaagacaataacgaaaaagatacagattctactcccgtctatatgtatcctttcgacaaagaaacagcaaacgttacagcagaaatcattatccacacaaaaaaagaaatacagaccaaagatattaatgtcgaaatccctcatttaaaatacaataagacatggatgttgatgctaacacaagacgactgcatgcaggctgctttttgccgtacgtgggctgcaataaacggtaaaccgatctcaagttcaataccttatcctactccaactcccactgatcagaatatgaaacatcaattatattttgacatcaaacatttgcaaaaaggggatcttctccctactattatttccgccaaccaatctttgggatgtacagacggagcaggaaatgaagttcggtttgctattactaccactcttgcccctgaagaaaaatggatggatgctgaaacaaacgtactgccggggtttactgcaaactattatcgtttttatatgaaatccggacttatatgggataacatacgagagatgttgaactatggaacaggcattgccctccatgatgtaatgacaaaagatgctaatgatccaatacaaatattggaacattttgatattgcccaaaacattattgtagagaaactcacaggaaggggatgtaaatttcttgctgaacccaatggaaataaaacatacgtaactgctgctcttcaatgtccggaaattcaaacgatgaccgcacaagcaggagcaattaccctatatccgtatcaagtgtctgaaactttacaaaaatctctgatagaacgggagtttaacgattcaccagcatattttaaacaacagattactgacctgctaaaattacccaaagaagaacgtaaagcaatctgcataggtgttcatggtacggacaacaattggatcgactttttattatggttaaatagtaattatggtaaagatggggatgattcgttatggtttccaagccaggaagaatattatgaatataactattatcgtttaaacagccatattagtatagcacaaatagacgcaagttctttcaaattaacagtaaatttaccgggagaaaagttcttctactatccttctaccactatcaatttgccgggaattagcatgtatgacattgtttctatcgaaggaaatgatgcattgaccggactatcttatgctgactacaaagacggtatcatgctcaatatcgactgtcggaaatacctgtttgaacacgccgagaatttcgtaaaacgatatgaggccaatccttccgatgcttccaacaaagcagacgccctctactttgtaaacatactgaaagaatcggctaaaaaagaggcactaaaaaaacgacttcaataagtaaatcaacaaacatctattaaacgagaatatagctatgaacgaaaccctcatcctcgaaatcatcttctggtccgccctgttcatggtgttctacacctatctgggctacggtatcgtcctctacgccctcgtcaagctgaaagagcttttcgtgaaacccgtgaaacgggtgctgccaccggacagtgacctgccggaagtaaccctcttcatcaccgccttcaacgaagaagacgtggtggacgaaaagatggagaacagcctcgccctggactaccctgcggacaaactccgcatcgtctgggtgacggacggaagcgatgacggcacaaacgaccgtctccaaactcgctggaacggaaaagcaaccgtctacttccagccgaaacggcagggaaagacagccgccatgacacgaggaatgacactcgtccggaccccgcttgtcgtctttacggacgccaacacgatggtcaacagcgaggcaatccatgaaatcgtactggcttttcaaaacccgaaagtaggctgcgtggcaggagaaaaacgcatagccgtacagacgaaagacggagcagccgccggaggcgaaggcatctactggaaatacgaatcgacactgaaagcgctcgactcccgcctctactcggctgtaggcgctgccggagaactgtttgccgtccgccgcgaactcttcgaaccgatggaaccggatacgttgctcgacgacttcatcctctctctccgcatcgccatgaaaggatacaccatcgcctactgcaccaatgcctacgccatcgaaagcggatcggcagatatgggtgaagaggaaaaacgaaaagtgcgcatcgctgccggagggttacagtcgatctggcgtctgcgcccgttgctgaatcctttccattacggaatcctgagttttcagtacacgtcgcaccgggtattgcgctggtctgtcactccattcctgctgtttgcgctgttgccactgaatatagtcgttttgctattgggcgaatctcccctgttttatggcaccctgctggggttacagattcttttctacggaatgggatactggggatattacctctctaccagacaaataaagaataaagtactgtttattccctattatttcttattcatgaacgtgaatgtgctcaaaggaatcggctatctgaaaagaaaaaaaggaagcggcgcctgggaaaaagcaaaacgtgccgaaaaataagaacagagaatcaaatattttgctatctttgcatgaaacagaatcttataaatctaatcggacaagcatgaacagaacattacatgaggcagataatgcgcaaagaatactgaagttgaccgccgacaccatgctattagtcgatagaaatggcatttgcattgatattgatattcatagcaatttatggtttttacaagaagagaggcttttaggaaaaaatatattcgaacgtatgcccgagcatacccgtgagaaggtttacagcaccttccagaccgtgcttcgggaacagcgaagcatcagcaagaactacaagctggaactggaggataatacctattatttcaagtgtatcatgtatccttacgatgacatggtgctctgccaatatcgggacatcacccagcgaagcaacgtgaaacgccagctggaacaggtaaaccgaaatctgagggagatacagaaagtggctcagatcggacagtggatgtacaacacccgcgacaatgtcttccattacatgggctacaccggagtattgtgcgaggaatcttccagaagtatctctctggagaaatatcaggaatttatcgtcgaagaagaccgcctgagcttcaccagctggtgccggaagaatgaggaaggactcaacgaagaaagtatcagctatcgggtccgtgtcgccggagagatttactatatgcgccttcaggcttatctgcgagacgaactaccgaacggcagctgcaacatcgaaggttacatccagaacatcaccgacatacagcgtcgcagaaacgacatcaacacgctgacgcacgccatcaacaacgcaaaggagagcatcttcgccgccaaagaggacggtacgctgatcttcgccaaccgccagttcctccacaaccacggcatcccggaaagtgaggagatcggcaaactgaaaatctatgaaatcgccggcgatatgaacacgcaggaagactggcatgaacgctgcaaggatatcctgcacggaggaagcagaagtttcgtcgcccatcatccttcgaaggtcagcaagaatatattggcttacgagggaatcatgtacaacgtcaccaatgactccggtgaagaaagttactggtcattctcccacgacatatccgagcgactgcactacgaagcgcaaatcaaacgactcaacctgatcatggatactaccatcgacaacctccccgccggaattgtcgtcaaggagatcaacaacgatttccgatatatctaccgcaaccgggaatcgtacaaccggaatctgtgcatcggcgaatctatcggcaagaatgacttcgactactatccccccgaagtggcagaaaagaaaagggaggaagatacactagttgccaccaccggacggggactgcactggacaaccgaagggaaagacaaaaacggaaacgagatcatcctcgacaaacggaaaatacgggtggacggagacgaactttcctcccccatcatcgtcagcatcgaatgggacatcacggagctggaaaaaatcaaacgggaacttcagacatccaaagagaaagccgaaatgtcggacaaactgaagtctgctttcctcgccaacatgagtcatgaaatacgcacacctctgaatgccatcgtcggcttctcacatctgatagccgaaagtgaaaataaggaagaacgtaaaacattttatgagatcgtcgaagccaacaacgaacgtctgctgcaactgatcaacgaaattcttgatctttcgaagatcgaatcgggcattatcgagttcaccagcgcaccgataaatatcaacagtctgtgtaaagaagtacatgacgctcacgtatttcgcacgccgcaaggggtacaactgatctacgagccatccgaaaacggactggtgatagagactgacaagaaccgggtgttccaggtgttctcgaatctgataggtaacgcattcaaattcacgaaagcaggcagcattagttacggatataaactggtaggtaatcagatcgttttccacgtgactgataccggtacgggcatcgaaccggagaagataggacgtgtgttcgaacgtttcgccaagttgaacaactatgcgcaggggacggggctcggactgtctatctgtaaaacaattgtcgaacggctgggaggtgaaatctccgtttcttcggtggtaggtcaagggacgactttcacgttcaccctgccttacgagtcggaacaatcgaccgaaaatacgaaggaggaaaaacggcaggaagggaatgcaaatgaaaatccgaccggcacgggttcgatgaagattgacccggcttctacggagacgccagcagaaacgtctgtcaaggaggattccgaaaagacttccggaagtacggacgatgatagttccggtagtatttccgccaatgcctctccaagccagcggactattctgatagcggaagatgaggacagtaacttcgacttgctgaaggctattcttggaagaaagtacaggcttatacgtgcacgggacggtatggaggccgttacctcatacgatgaagcgaagcctgaccttattctgatggatatcaaaatgcctaatctcgacggtctggaggctacgaagatcattcgtgagctttctcatactgtgcccattatcgcacaaagtgcttatgcttatcaacaggatcagatagctgcaatggatgccggatgcagcgacttcatcgccaagccgatctctcaagcgaagctcaaggatatgattaataaatggttaccataaaatgaaagccttatatagattactttactacctgtctatcctgctgacgagcattctggcaggtttcacattagccggagccttcgccggagatgcttcgccgggcggctttaagctgatgccctttatcggattggttctgccgatgcttttgctggctaatgtcgtctctgccatctattggacggttcgctggcgatgctgggttttcattcctttaatcgccatactgggaaatttggggtatctgacccgtgtcctccagtccccgcttttcgattcggcttcccaaccgaatactgaatctctgaagaaaaacgaaagggccaccgaatcagcactgactattgccacctataacgttaacagctttaatcacgagcacacaggtttctcatgcaaggaaatcgctgcttacatgaaggagctcggtgtagatatcttctgttttcaagagtttgggatcaatcatgaatttggtactgacagtcttcgcaccgttctttccgaatggccgtattactatgtaccttcttctcctgccggagagagtcttttgcaactggctgtgttcagccgttatcctatcaaggagaagcagctcgtcacctacccaaattccaacaactgcagcctgtggtgtgatatcgacattaacggccaaacaatccgtctgttcaacaatcatctgcagactacggaagtcagccgcaacaagcgcaaactggaaaaagaacttcgtgcagacgataccgaccgtgcggaacgtgccgctctcacccttgccgatggtctgcatgagaacttcaagaaacgtgccgcacaagctgaacatatcaatcaattgatttccgattctccctatcccaccctggtatgcggtgacttcaactctctcccttcttcatatgtatatcaaactgtaaaaggagaaaagatgaatgatggctttcagacctgcggacatgggtatatgtacactttccgatatttcaagcatctgctgagaatcgactatatcctccattcgtctgagtttcaaggggtagattacttctctccggatttggagtatagtgatcataatccggtggtgatgagaatgaggttataaaccttacgctgtatatcactatatagaaaggctacaaaaaagccagttaactcattatgaattaactggcttcccattaaaataaaatccttctttttaattttaaaacttgtattagaaagtaacttttactcctaattgcatagaccatgcactaccaatggtattggtatattgccatgatgatctttctttaaaagcttcacgtgaattagcatttatctggtaagtcaagggttcaccaactttgctagcagtttttaataactgtacattgtcataactcttgagaccacaagattgatatgctccccattttgaattaatcatatttcctacattcagcatatcaaggctaacctgtattccatatttacgcccacctaaagttgcataaaaatcctgagcaattttaaaatcaaagcgattaatccaaggtgttaaagatccattacgttccacatattttcccttacgatctttaagataagaatcattgttcacaaaatcccaaaaatctttagcttgatctacagcagaataagtaatagcaccacttttatctgtaatatcaacaaaggtcatttcatcctgagagttaggcacgtatattaaatccgaataattgccatcaccattcatatcattataatatgtataggaataacgtcctgtatgatatcctgaataaaataacgagaatgttgtctttaagcatttagcataattaatttcataagaagcattagcaataatacgatggggcgtagaaaataaagaataagatactccaggatcattcaatgaatttactgccacattattttgccatgctgaattaggtgctgacccaggatttgcagtcagatctttagccattgtataagtatagccgatagaccctgtaaaaccaaaatcgtatttctttgtcaaaatagcattaaaagaatattgatatcctttatcttctccattagaaagttttactactacattcttaccattagtataatcattatactcgtatttttttgaagcccaataaatacgatccggttgttcattatacacacccgtaggctcagcctcattcatattgatctgcgcaacattataaatatctcttgtatacattgctccaacagataacataaaatcatacggcagttgaatatccacattcaaattactacgccaaacttgcggcatcttaaacttaggatctacatatgctataacatcaggtgcttgctctgaaggtgtagaaggaaataaactgggatatttctgcagagtttctctataattaggattaaaaccaaagtcagcaggtaaagagcccggatttttttgtgtattatactctaccatattttggtataagcccgaattacttggttgattagtgaaccatacaaaaggtaacaatccagtaaagattcctgtacctcctgatacaattacggagcgatcaccttttacatcccaattaaaaccgactcttggcgaaaacaagacttgcgtcttcggccacttagaaatatcgacatgagtattatttacaaaagctaattcctctattgacttgttagaatccaatgaattcatatatattggcatatccagacgtaagccataagtcaaacgaaaattaggagtaagagaccatacgtcttgggcatacacaccagccattccgaatgtcaactcagaacctggagcatcattaccattatacccatatgtaataccataaatggtaggtacttttccctgcataaaatcatccattgaatcataacgataatatccgtaagggcctctcaaataagagtttttaaaatattggcgttcaaaagaaacgccagcaagcaattcatgttttcctaatgatatactcacattatcaacaagactaaatacattattgataacctgattattaggagtaaacacttctgtacctaaagttatatattgctttccgtccttatatatatcgacaaaaggaaaatcagagcctttctgctcgcgtgtatcactaatatgagtatatgtggctaacagtttattctgaacattattcgagaaacgactatttaactcgcctgttatcgatgttactacgtttttcatcttatagtttgaattaccaaaagaaaaggcatccaaaccataacgattagaattagtactagttataatagtggacttagcgcttacttctctgtcatcttctgaggaaacagaattaaaacgcactgtcaacttatggttctgatgtatattccaatcaatacgagccattaacttccaattatcactttggaaattattgaagttctcatactgtccggggtcataatcatatttagttttaacaaagtcactgatagtacgcatatcacccacccaagtacgtgagatacgttttccgctatcccctgttccattttgatcttgattaggaagccaagttacccccggagtttccttattttcaatttcagcattcaagaagaagaaaagcttattcttaatgattggacctccaaaagttacaccatatgaatgagagttgtattcttttgctttaagaatatcctcaccgtcaatagagctccctgcaaatcctcttggtttatgataggtatatgcagtacccgaaaatgagtttgttccactttttgttacagcattaatagaagcacctgtgaagttggaatatttaacatcgtaaggagagacatttacagtaatctcatcgattgcatctaaagatatgggttgagaatctcctccaggtaaattattagaacttaatccgaaactattattaaacgaagcaccatcaatcgttatattgttataacgtccatcacgccccgcaaaagaactgcttccacctgcataaggagagagctttgtgaaatctgttatacttctgttaatagtaggtaaagtgttcatctgacgttcacttacattagtaacagtacctattttttcgatagtttttggtgctgttactactacttcatccaacaactctgaactttctttcaaagaaacattcaatacgtagttttctcctaatgacaactggatgcccttgtaaatggctgactgatagccgacataggtgatttcgactttgtaaggaccgcctgtacgcataccttgcagattgaattgcccactgacattggtcactgtaccatagcgggtaccggagggctcgtgaatagcaacgatcgttgctccaataataggttcatcttgtgctgttactttaccactcatacttgctgtggtaacttgcgcactcatcgtagcagtaatcagtaacattacgaccactaaaaaagaccgcattctcttcaacataatgtaatttattagttaatactaattgtttgtttcattgaaactgtgcacaaagataattaatattatttagacttagatgacaattatgctacattcttttaagagagataaacattttattgctttcgaaaacaataaaggccctgcaatgtttgcagagcctttcactttcgtatattaagtgagatttaacttgtaatctgtcagcaaatactagtcagtcattaggtttctataacgaacacgcttcggctcttcattgcctagacgcttcaatttgttttcctcatattctgaataggaaccttcaaagtagaatacattagagtctccttcaaaagcgaggatatgcgtacagatacgatcaaggaaccaacggtcgtgagagatgactaccgcacaccctgcaaagtcttccaaaccttcctccaaagcacgaagggtgttcacgtcaatgtcattggtcggctcatcgagcagcagaacgttaccttcttctttcagagcgatcgccagatgcagacggtttctttcaccaccggaaagaacaccacaaagtttttcctgatcggcaccggcaaagttgaaacgggacaggtacgcacgtgcattgatatcacgtccacccatacggatcaaatcattaccaccggagattacctgatagacgctcttgttcgggtcaatgtctttatgctgctggtctacataggatacctttacggtctctcctacttcaaactcacctttatctaccgtttccaatcccataatcagacggaaaagagttgtttttcctgcaccgttaggaccgatgacaccgacaataccgttaggaggaagcataaagttcagatcatcgaacagcagtttgtcgccgtatgccttcgctacgtgttttgcctcgattaccttattacccagacggggaccattcgggataaagatttccagcttctcttctttctccttcaagtcttcattcagcaacttgtcgtatgaattaagacgggcttttcctttcgcctgacgagctttcggagccatgcgcacccattccaactcacgttccagtgttttacgacgcttgctggcggtcttttcttccatttccatccgtttggtcttctgttccagccaggatgagtagtttcccttccaagggataccttcgccacggtcgagttcgagaatccatccggcaacgtgatcaaggaagtaacggtcgtgagttacggcgataactgtaccttcgtattgctgcaaatgttgttccagccagtcgatagattcagcatccaagtggttggtaggctcatcgagcaacaggatgtccggtttctgcaacaacaaacggcaaagagcgacacgacggcgttcacctccggagagattcaccaccggctgatcttcgggcggacaacggagcgcatccatcgcacgttccagtttactgtccagattccatgcatcagttgcgtcgatgatatcttgcaattctccctgacgggcgaaaagtatatccatcttgtcctgatcttcataatactcgggcaaaccgaatttctgattgatttcttcgtattctgccagtgcgtcaacgatcggttgcacaccttccattactacttcttttactgtctttgtgtcgtccagataaggttcttgtgccaaatagcccacagaatatcccggagagaagaccacttctccctgataggatttctccagccccgcgataatcttcaataaggtagatttaccggaaccgttcagaccgataataccaatcttcgctccatagaagaacgacaggtaaatgtctttcagtacatttttatttggttggaaagctttgctcactcccaccattgagaagatgatttttttatcgtcagccatatattaatgattgtatattgttgataatggcacaaagataagaaaaatgtttgaaatgctttggagttctaaaaaaatgttctacctttgcacccgcaattcgaaagaaagcataaaggattgattcagtagctcagcaggtagagcacaacacttttaatgttggggtcctgggttcgagccccagctggatcacggagtaaaaaacctctgataatcattgattatcagaggtttttttattaatatacacagaacatagatataagactctacataaagcccaaaacatatccaatatcgaatcgatgacaaacagacctacaccaaacaatcggctcatagaatgataaacttctttttccagttattgtttccatctttaccttatatattataaaagcgcggcaaagatacaactttaagaaatagcggaaatgaacatttgttaataaaaagatggctattccggacaactgtttactgaaaaaatagcttatttttgcaaagaatgcaagattagtcaaatggttgaatcagaaataaataaaagatattgccaaagctgcggaatgccgctccgcttcgacgtggaggaatatttaggcaccaactctgacggttcgaggagtgatgagttttgttattactgcctgaaggatgggaaatacattgttgatatatccatgtgggaaatgatcgacatctggataaaatatacagataaatataatgaatacgcagacacggactattctccgaaagagctgagggagatactggacaaacgccttcccacactgaacagatggcggcaaaagcaagagacaagcagccttcatcataagatgattcagaacataatagtgtacatcaacggtcatctgacggaggtactgaataccgacacgctgagttcgatgagcggactgtccaaatttcatttcagaagagtgttccgcaccgctaccggagagaatatcggcagttacatacagcgtttgcgcatggaacacgttgcacatctgctgatctctacggactatacgctaaagcaaatcatagagcaaacgagttatcagactaaatacagtatcgccaaagcttttaagaaacattttggtatatcaacttctcaatacagagagaagcacagaccgaacggtgaaaatccggcaacaaacataaaaccggagataaaagtgatcagcccgataaagatattctgcatcgaagtgggtgaagcgtataaaaacaaactaaaatacagattactttggaataaactactgcatcatgccgaacagtatgaagcagacccacgatatgacaagtttatcagccttagcatggacgatccgtcgattacgcctacggagaagtgccggttctatctaggcatcacccttcgcgatgatactaaagcgagaccggtaccgggaatcatgcaaattcccggagggcgatatgccgtgttcagacatacggggagctattcttctttacacaaagtgtacaggagcatttatgaggaatggtttccgaaaagtaaataccatccccaaagcacattcagctttgagatgtatatgaatcatccgtccaccacggaaacgtcggaattactaacagaaatatatataccggtcatacggaaataatcaccattaaaacagaatctatggcaaagatatcagaaatcatgcttttacagcagccggaacagcccgctttggctattgaagtacaaacctacatgaaaggtatgtcacaggctatcggagagaattttgtaagaatagactctttattcaagaaacagggagaagtaaccacggatatccccttcgtagagtaccccgacttcgaaagcctgaccgaagatcgtataaaaatgattatcggactgaaatcttcgaaacctttacaaggtgacgaaaaaatacaatctgtcatcctccccgccagaagaatagtcgtatgtctgcacagaggaaattacaatgaactggcacagctgtacaatgagatgaccgaatggataaaaacaaatggctacaaggcctcgggaacatcaatagagtattattacagcaatccggatgtacccgaagaggaacatgtcacaagagttgaaatgcctttactctaaaagcaagagaatagttgccgtaaactcttaccaaacaataagaagcagagaagccgtcatacagtatcaccttgtctgataaagtaccggcattccctgcttcaatagttctttagaaattagccttgcgtttcttcacttcttctacgagtttcgtaaaggatttctcctttttacgtttttcatgttcggaagcggagaagtgccatgcttctcgtctgagtttcagataactctcatataccttatgatctaacgtaccattatgtaccgcctctaaaacagcacaacccggctcgtcgatatgtttacaatcgctgaaacggcatgattccgcatagtcggatatttcaaacatttcggtgagcgaatcgggattgtcaatcgccaaaccaaattcccgaacacccggagtgtcgattaaaacacctgagccatccatcaataccatttcccgacgagtcgaagtatgccgccccttccctgtagacaggcttatatcagaagtattcaataccgatttcccgcaaagggcattcaccaaagaactcttgccgacacccgaagagccgacaaacacaactgtttcgccttttgttatggattcccgcaaccgaagaatcgtttgaggttgacgaatacttgtgataaatacaggaaactgacgggcaatgtgtttgatcgcttcatctattttctgtctgtcacaacctaaatcggctttattgagcactaataccggtttgattttttcttccattacctgggcaatgaaacgttccgccctgcgaacattgaaattatcatcaaggctttgcacaataaatgccttatcgacgtaagaagcaatggcctgccggtcggctacccttccgttcttctttcgatacaacgcccgttcacggggcaatatatcaactataatccctttgtttgcatcgaatggctgaaaaatcacccaatcgcccgtacaaggatattcatcaggcactctgccataaatcatatttcctgttaactcgcacaaatatacaccatcctctgcaactacttcataacaggttttatgtgtcacgatgattcgtccatgagacatatctttatattgtgagatttgtttttgccggaatagattatcactccaaccatataatgacagattattattttcgttactcattattttaatgtatatagcatacacgtaaaagcacaacaatgctttcgctattgtatgc

SEQ ID NO: 76 - DNA, 36285 bp, Bacteroides thetaiotaomicron
attgataatataaacatacagttctattatttcatccacacaatcggataacctaaatctcttttgatagcttccatactctttcaccaaccggtttatatccatctccatcacaaagcaaatactaaaatgtctttttcagatataccatatccaccagttgcttgccgtcttcgtacataggatggtcgtaattgtcggtaaagaaattctttagccgatgggaaatggtgaagccacaatgttcgtagaaagaaagcgtagaaggtacatcgcctgtaccgaccagcaattctgagcatttcccccgataatgatcaaataaaaattgaatcaagcgttttccatatccctgccgctggaaaaaagagatcgtagctatgttcttgatttcataaattccttccccttcacgggttacgacacagcacgctttcaatccgttatcatacaagacaaacatatcgccacgttccagatagcggtcgatcatactctcctgttcatcagccaaaagcaacagttccaagaactcttttttatccgaaattactttttttatctccatattttaaaactttgaacctttcatcagtatcttgcaaaggtataaaaattcacctgataaacaatttcccgaaagtatatcttgaaaaaccggctcagcaatctcgcactatcaatacaaacgctgaactttaagggcatattcttgttaacttgtcactatcgtgactgatagttctgtgacagaattccgaacaggttgcatctcacagatgaataaccaataataaacctataactaaaaatcgaaattatgtgtacgagagtcgtttattcaggaagcaatggtatggtagcaaccggtcgttctatggactggaaaacagatatgcacagcaacctttgggtgtttcccagagggatgaaacggaacggagaaaccggagagaactcgctggaatggacttccagatacggtagcgtagtgacttccgctttcgagatcgccagtacggacggtatgaatgagaaaggattggtcgccaatctgctttggttgcccgaaaccgaataccccgtaagagataagaataaaccgggacttgccattacagcctgggtgcaatatatgctggacaattttgccaccgtagaagaagccgtagcatacattgacgaagatacctttcaggtcgtttcggatatgatgccagacggttcccggttggctactttacatttatctatttcggatgctacaggtgactgtgccatttttgaatatatcggtgggaaactcacggtatatcatagtaaggaatacaaggttatgaccaactctcctacttacaacaagcaactggcacttagcgaatactggaaatcgataggaggactgagctttctgcccggtacgaatcgcgctgccgaccgctttgccagagccagcttctacatcaacgcattgcccgagaccgatgatgaaagaatagctgttgccagtgtattcagtgttgtacgcaatgcttctgttccttacgggatatccactcccgaaagtcccgagatttccactacgcaatggagaaccgtttcggagagcaagaacctgagatactttttcgaatcaagtctgactccgaataccttttgggtaaatctgaaagatttcgatttatcggaaggggctccggtgttcaaactgtctattgccaatggagaaatgtatcatggaaatacagccaagaattttaaaacagcgttgcctttcaaatttatgggcgtaaagggataaattgatagcagcttgctgcatcacatatatcagagaagtattttctccacgtcttcgggaacatatactgttcccgaaaactcctgagcagcttcttccgtataatacaacaaaatatttccgaatactattcacgcaccacaccactgacttccatttcaaggaagtagtcattctccaatttaaaggtgtactaaagaatcaaacaatcatccaaatcaatagaaaaataatacaatgcacttgttttctcttattattatcgtttactttgttggcaaaaattaattaacgagccatgaaaaacctactattagcagccatgcttttctgcacaaacatagccatcgcacaaggtactatagaagattaccgtcgtgcttactcagcaggagaaaaattcagtgcaaacaaagtatcctattccaatgtcaatccggagtggattggtaaaacgcattatttctggtatgtacgaaatactcccgacggacgtatctatgtattagtggatgccgacactcaaaacagaaaagacttgtttgaccacaaactcgtggcagcagctttaagtgaggcatcgggacgcaaaatagaagccacttctctttatctggatcgtctgtctgtcaacaacggactggatacgctacatttcgttttcaacaatcatcgctggatgtatgtcatcgacaaaaatcagctgacagatgaaggtgctctgcccactccacgcaaacaacgccactggatggaaacagatgatgaaaagacggctgctcccgtcacctctcctgacaagaaatatacagcattcattaagaatcataatatatatgtaaaagaaacagctaccggaaaagaaaaacagctaagtctggacggtactttgggaaattattactcagcctatatccgctggtctcccgacagcaaaaaagtcgcttcctgcaagattcgtccggtagaaaaacgctatgtatattatgtggaatcctccccaagcgatcagcttcaacccaaactccacaaacaagagtatgccaaaccgggcgatgaacttccgtttaagataccctgcatatacgatgtggaaacaggacacagtgtgattccatcgacagatttattctctcaacaatattacattacggcccccgaatggaacagcgacagtcaagccatcactttcgaatacaatcagcgcggacatcaggtctaccgggtattggaattttctgccgcaacaggaaaggtacgcccgttaatagaagagacaagcgacaaatacgttaattattcccgtcgtttccgacatgatttacaaaatggaaaacgaatgatatggatgagtgaacgtgacaactggaatcacctgtatatgtatgaccgtactacagcccagcctattcgtcagataaccaaaggcgaatggtacgtacgtgatatcctccgggtagatgaaaccaaccaacttatttatttctcggcaaatggcgtacaagctaaagaagatccctacctgatccgttattatcgtatcggcttcgacggtaagaatctcacttgtctcactccggcagaaggaatgcataatgcatggttctcaaaagatatgcaatatttagttgatgtatattctatggtagacaaagctcctgtagccgtactccgggatgccaaaaacggaaaagtcatcatgccacttgaaacggctgatatcagtcgtctggaagctgaaggctggaaagctcccgaagtattcaccgccaaaggtcgtgacggaaaaacggatatgtggggaatcatcattcgtcccagcaattttgatcctgacaaaaaataccccgttttggagtatatctatcaaggaccgggtaatcaatacgtacccaaaacctttattccttataactactttatgagtggtattgccgaactcggttttattgttgtcatggtagatgggatgggaacttctttccgttcacgcactttcgaaaacgtatgttacaagaatctgaaagatgccggattgcccgatcatattgcctggataaaatccgctgcccaaaagtacccttatatggacatagatcgtgtcggaatttatggttgttccgcaggtggacaggaatcaatgacagcagtactgtttcatcccgaattttataaagcagcatattctgcctgtggctgccatgacaatcgtatggataagatatggtggaatgaacaatggctgggttatccggttggtgaacaatataaagaaggatcgaatgttgagaatgctcacttactcagtcgcccgttaatgctggtagtaggtgaaatggatgataacgtagatccggcttctaccatgcaggtagcaaatgcgttgatcaaagccaataaagattttgagttagtggttattcccggtgctcaccacactatgggagaaagtttcggtgaacataaacgctacgacttcttcgtgcgcaatctattaaatacaactccgccgaaatggaatgaaataaaatagtgaatactttgtagaacagtatccactactttattcataatccggtcagttactttttctatgctccagaatcgtatccatattttccaaagcccagcccactaatccttcaatatgcggaatcaaagttcctcctgtatctgtcagataatactctacacggggaggtacttccgcatatattttccgttcaatcaaaccgtcagattcgagcgtacgaagagtaacagtcagcatccgctgtgaaatatcctctatcgttttatgaatatcgctaaaacgcatcgtaccattcgcattcaaagttatcagtaccagcatcgaccatttgtctcccaagcggcttatgacatctcttacagggcaattccctgtcgggtgaaagtttttcatctttttaacgttttgtattatactgagtttcaacaatagttacttccatgtaactaccttattctgaggttcgttcttgtatttttcaattaaggtagatacatttgcatcacaaaagtaataaacttactaaaaataactattgtttcatttaaataattatgattatggcaaagaaagtagcagttttagcagtgaatccggtaaatggttgtggtttattccaatacttggaagcctttttcgaaaatggcatttcctataaagtatttgccgtatcggatacgaaagagatcaaaaccaattcaggaatggtcctaatagtagatgatgtgattgctaatctaaaagggcatgaagacgaatttgatgcacttgtattctcctgtggagatgcagtacctgtattccagcagtatgcaaaccagccatacaatgtggacttgatggaagtcatcaagactttcggagaaaaaggaaagatgatgatcggacactgtgccggtgcaatgatgtttgactttacaggtataacaaaaggtaaaaaagtcgctgtccatccgctggccaaacctgccattcaaaacggaattgccacggatgaaaaatctgagatagatggcaacttctttactgcacaagatgagaatacgatctggacaatgttgccgaaagtcatagaagcattgaaataatgccggaagtatagaaaggaataaatccacacacaaaaagaattattcatacaattgaataataaactcattctttcctttaaaaccaacggcccgttcctcggtgtgcaacgggtccttcctttaaaaccaacgagccgttggttttaaaggaaaaacagtcacccatacaacattcataatcaacaatttacgcattctgcttttaacaagcaaatattgcagcttcattcatcaataaaaacagacaacaataggctaattattgataaaaacaagtgcatcctttttcgtacacctacatatttttggtttacacatccgcataaggtcggattcgaaattccttgaacaatacatctactttattattttttaattggatgccatcgtttttcagattgtttttagtacttttgcccgtatcaaatcaataaataatatatcgaacacaaacatcatactctcatgaatatgaaaaaatatgtgctagcattttttctatgtttcatatctattactcctattttagcacaaagagaccacatagatatttcaaactatattttatgcatcaattcctatgcagaatcttctccttggagtaacaggatgatttcaaccgtatcggagtacgttcaaaagaacccaaaactggcattatatgcggaacatatgaatactttaatgatcgataacgatacgattttaggagaattcaagaatatgatctctcagaaatacgagcatcatcgcccacggctgctaatattattgggaaacccttctctattactacgtgatgaatatagagagctttggggagacattcctattgtactctgttcggaagaaaagtttataggtcctaaagacacctacatctacaaacagccagttacacaagcggagcgtgttccgatctcccaacttgccgatccctacaatctggtacttttatattcaaacctttatttacgggaaaatatccaactgatttctcacataatccctgatatgaagaaattcatatttatcggtgacgagcgagaagtcaatcagaccaataatcaggaaatacagacaaagttaaaaaccataaatcctaatattgaataccagtacatcacgccacaaaaaatgacaacgaaccaattattggattcattgtatcatgttgatccgaatacaaccggaattttatttgcttcctggttctacaaaacgacatttgcaggtaatacttcattggttaccaatgctcacaaacttatcgtaacaactacagctccaattttcacccttaatatggctgatataacagaagaaaacggtggcatgataggtggttatacttatgaccaaaaacactataaccagcaattaattcataccatttcagaaatacttacaggaaagccggctagagaaattcccttttatatgccatcagatggcgcacctattatcaactatacgatattactccgtaaaggattctctccttccatgtgtcctccaaacacacattttctgaataaaccgcttggattctggaaacagaacaaatatttcattatgggtaccttgtcttttatgatattactggcaatcgtattcttttatcgtatccatagcctgaatagcatcaaaaaagcacagcaaaaagaaattgacgcaatgacaaattataagaatctggttaataacatgcccattctctatatgcaggaagaagtgcttgctgataaaaatggcattcccgtagaactgatttaccgcaatgtgaatgcgcattttgagaaaaactttttccgcaaagaagaagttgtcgggaaaaaagcgagtgaaatatttccagaatcaatgccggacttcctgcacttcactcaaatagccttatcagaaaataaagtaataacattcccctactatttcaaaaaaatagataccttctacgatatagtacttaaagcaaaccggcaaaataatatgattgatgtattttgcctgaacagcacagagctccataaggcacaacaaaagctaagtactatcaacaacaaactcgccatgtcacttgacgtagctaatatcgtgccatggaaatgggatttgcgaagtaaaacaattttatgcgacatcaacaaaccgatagaacttagcacacaaggaaaagacgttgccgaagaacaactggcagtacccgactatcactatttttccaagatatttaaggaagaccggaaacgggtagaacaggcttatcagaacttaatagacggtcattcggaaaaagtaaaagaagaatatcgcgtagtcagcacacaaaaaggatttcataggatagaatgggtggaagcccaagcagccgttgaaacgcgggatgagaatggcaaaccattgactcttgttggctcctcactcgttatcactgaacgaaaaaaaatggagatggaactgattaatgccaaaaaccgtgccgaagagtccaatcggctgaagtctgctttccttgccaacatgagtcatgaaattcgtactcctctaaatgctatcgtcggtttctccggtatattggcatccaccgaagaagaagaggaaaaacaagaatatgtcagtatcattgaaaacaataatacgttattattgcagctcatcagtgatatccttgatttatcaaaaatagaagcaggaacattggacctgcactattccaatgttgaaatcaatgatttaatgaaagacctggaaaacatgtgtcaactgaaacttaagtcggatgctgtcaaactggaattcgtagctcctgaagaaccatgtttcgcacatatagaaaagaacaggttatctcagttaattattaacctggtgacgaatgccataaaattcaccattcaaggtagtatccgatttggatacaaacgtcagaacaatgaattatatttctatgtggctgatacaggttgcggcattcctcaagataagcaaaaaagtatttttggacgtttcgtcaaattaaattcatttgcacaaggtacgggtttaggactctcaatctgccagacacttgtcgaacacatgggaggtaaaatcggggtagaatcagaagaaggaaacggctctacattctggttcactttgccttacaagcaagcagagactgttaagaagagccttccaaaggacatacaacctattgccatagaaaaggataagctggtaattttgattgctgaagataatgaaagcaattataagttgttcgaatctattctaaaatatgattatcatctgcttcatgcctgggatggtcaggaagctgtaaacatgttcaaggagcataatccacaaattatattaatggatatcaatatgcctgtcctggatggatatgaagcaaccaaagaaatccgcaagtactctgccaaagtaccgattatcgccattacggcttttgcatatgcttcagacgagcaacgggtgatggaaagtggttttgacgggtatatgccgaaacctatcaatgcccgtcagttgaaggcgcaactgacagatatcatgcaaaaacgtattgtattgctataggggaaatcaattcccttttggaagataacaaaacagctaataattcagccacattctgaatgaagccatcttgtctttacttatcattatcttatctttgaaaggtggttgtacatgaacgattgcctttcctaagaaataggattcaatacgctgaatggcatcaatacagactaatgtctgacgattcgtccggaaaaagtgatccggatcgagttgttcactcaatcggtctagtgccagatcaatgagatactcacgattcttatgggttacggcaaaggtgagcttattttccgaataaaagtaagcgatatcactcacctgtaaggtgaatagtttctcgccactagaaataaggaaacgagtacgatactttttctgcacagagacagaggtctcatgcgcagcagaaagttgctgcaatatttccagcatccggctttcctgattgaaatcatggatgtagttctttgtcaatccttcaaaacgttgaatggtctgcatcaggcggtcttcatgaatcggcttcaaaagatagtcaatgctattcactgagaaagcacgcacagcatattcgtcataagtagtagtaaatacaatcatactctccggatgcgcctgttctataaaaagaaaagaattgccatccgttagctgaatatccagaaacaggatatccggatgaggatgctgcccgaaccactctactgcctcttcaatattaccgggcaataactgtacctcccaatcgggacgaagagacaataacgtatccctcagcagacgggctgccggaatttcatcttctatgatggctgcttttatcttattcatagagcaaaggtatttttacggtaaactctttccggtcattttctaccacaatgtcacggttgcacaacaacatatatcgggcagaaaggttcttaagtcccattccggaagttaccactgtttttttagtttgtatccggtttctgacgatcagttcccgttccttttccatataaagaagttcgatagtcatcggttttcccgtatgaatgacattatgtttgattacattctccgctaacaattgaatagtaagcggaggcaactgagcctccatacaagtcttcggaatacggttgtcaatatgaatgcaatcgcccaaacgaaccctatgcagaaaaatataagagttcagaaaatccatttcctctcgcagtgttgtcagcctttgattctgacactgaagaatatagcgatacacatccgaaagatgctgggtgaacaattccgcattagccggattgtagcgaatctcagaaatcaaggtattcagactgttaaacaagaaatgaggattcaactgattctgtagagctgtatagcgtgccgtattattctctttttgcaaggcagccgctttctgttgtaatcttaacgtattacgcatggaacgattggccagcaacaatccaaggatgacgagctctaccagccatacagttataagaatccgccagcctccgttgggaaacgtaaacggataagaagctcctgccaacaacttggcagttaccattaaaccgtagttcagcaaaagaaacatccccattacgataatatagactgaaaccagcttccaacgccgatgcagattcaacgcatactgattatcaatccatgaactcagcctgatggtagtatatcccagcacattaaaagccagtatgaagaaccccagtgtactgactgaatgtagcatatcggcaacccgatcagagaaggttgcataatttatcagtaacaggaaagagaatatacccaatcctgaaaacagcgctatatacaataaggtgttcaactttacattcatacagttggctcttttcatacaaagttagtgctttttatcgacaatcatatccgtggagcgcttttattaactccgaatagtgtccttgtgccgcagctttggcttgtacataattcacctgcgatgtctgccgataggtttgcgcgtcaatcacttccaccactgacacttttccttcattataacgttctattgctttcgcttcattctcttctgccttcgccagtgaattttcgctcaaacgaacccgttccattgcttgtgacagcgctttacgtgccactcctatttccagttcaacctgatccatcactttattcagattatcctctgccatacctacccgaaaggaggaagcacgcttctcacttttacgcttcccccactcaaaaataggtactgagacttttgcataaacagcataattgggatccagatctttcttgaaattatatccgggagaagagtaactcccgtctattcccacataaaactgaggtttgaactgcgaatcattcaactttttcgtactctcggccatacgaatccggtcataagccatctgaatttcaggacgtgccataccggtagacaaccatgtagaatcatcgacaaccaccaccggtatctgtgaatccagttccgtatgatgttccagccggacaccaatcatagaattcaatgccatccgccctgtttcaaaattactttgtgcctggagcaactggtactccgcttcgttcagttttacttccgccatcagtaaatcctgcggatcaaccagccccacctctaccctttctttaattgttttaaccaaagcggctattgagttacgaaaatcttcggcaacagtcacaatctcctgccgggctacggcactccagtattgaatatccgtttgatagcaaacagcatcattcaatgcctttgcctgattggcagcaaatgattgctgatgttgtgccatacggatggattccagtactcgtccgcctgtatagaccggttgcagaatggaaagagaaccaccatagttcagttgtttcccttccactgttcttgataatcctaaagaagggacatccagagtcaattccaacggattctccgtatactgaaagttggctgttccggaaagtttcggtttcaaatctgcccgtgccgatttttccacttccatactggcagctatattcttctcagccgctttcaagtcgtgattgtaatccaatgccatagtccggtacttttcaagaagaggactttgctgggctaaagcagacaaagaccctaaagcaaaaccacataacaacaagctatatatccttattttcatctttattttccttttactttataaaacattgaatataatgcaggcgtgacaaacaaggtcaatcccgtggcaaacgtcagtccgaaaataatagtcgcagccattccgccgaaagcgacatcaaacaatagcgggaccataccgaagatggtagtggttgccgccatcaataccggacgggttcgggaaaccgtagcctcaacaatagaggtatacagatcaattccactacgatgctgcacattgatttcatcaatcagtacaatcacattcttgatgatcattccaagcaaccccagccaaccggctatcggaaagaaaccgaagtcaaagccggtcaagagcatccccaccgcaatacctatcaaagacaaaggcaggacacaaagaatgatgaccggttcacggaaattaccgaacagccctaccaggataaccactaatgcaaggaatgccaacgggaaatatttagcaatggcctgcatcgcctcaccctgatctttatactgggcatcccaaaagaaagtatatccttcgggaagctggatgttctctatttctttccggatttctccatgtacttccgccatcgtatgccccggtttcacgccacacattgcagccattgacaactgacggttataagttctcacctgtggaaactcccaggttgtctctatccgttccgttacctgtgaaagcggagccgacctttctccattccatatcgaaaagtctcccaaagaatgggcgtccgttatatccacattacccgatttcaaaagaacgggaacttttttctcattatcccgatagacaccgacaggcaaaccatcattaatcgatttcaccgattccatcatcgaagcttttgtaatccctaatgctccggccttcaccggatcatataccggacggataaccatcgacatattcccccattcgttccgggcatccgaaactttaggattttgtcgcataatctcaatggcctgccctaccaaagaatcaagtacagcagggtccggtccgaggaaacgagcctcgatcaccgcttccgtcaacgggctcaactcgaatttatttactttaatcaacggttcgggaaacctcaacgaaacagaatcctgcaaacgggcatgcagctgacgggaaagtttcgaagttttgcatttcatcaaaatttgtgcatagttggattgaggtccaaaggaaacgtttgacaagtaataacgcggcggagtccgtcctatataagtagataccatttccgtttcttcctgtccgcggatatactccgccatatccatcaccatcttatctgtttcttcaatccgtgtcccttcgggcaaccacatatccaatgtaaaatactgcttatccaatgcgggaacaaagaccttaggaatgaacttgaaactccatgccgacaataccagcataatgaccatacacccaatcgttgcatatcggtgacgaatcacccacctcaatgcagaacgaaatttatcgtaatacttgcctgcaaaaagagccgccttaagttcgttgggtcttggccgacggacaaactcctgaataaagaaaggagtctgcgtcagcgcaaagacccaactgaacatcagcgaaacgccgataactacaactaaggatgacagtaactcgccggtaatatgcggcgaataatatataggtaaaaaagttagaatcgcaatgactgtcgccgccaataagggcaacgaagttgaagaacaggcccgcaatatggctacccgtttccgcattccccgctgcatattgaccaatgccgaatcggagaccacaatggcattatctaccaacattcccatagcaatgataatggcagcaagtgacatacgttgcaaggcaattccttgtgaaagcatcacaatcaaggtcgcaaagatggaaaacaccaatccgctgccaatcagaataccattcttaaatccaataaaaaacaacagaatagccactaccgttaccacagatatgatcaggttcagaataaatccttgattggccactgccgattcataaccctgatcataaatcgtctgcaactcaaaaccttcgggcatggtctctgcaaaatggtcaatctcctgttttactgcctctgccatatcgacaacatttcctgtgggtatcgtagaaatagcaatacctaccgcaggtttcccgtcaatccgcattttattacttggaggcgtctgataactctcctcaatctctgcaatatcagccagccggaaatgctctcctgtacgtgatacaatagtcatattccggatgtcatccagagaataaaaattaccggtagattcaattcgtatcctgttcacgcaggcatcaattcctccggcatccactaccctgttctgtgcatcgaaggcacgtgaaatatccgtagtcgtaattccactccgtgccataacggaaggattaagaatgacgtcaatcgttggggactgtacaccataaatctccacttttgccacatccttcaccctgagcagtacattcttgataagcttcgcctgattttccagttcccgatatgaatatccttcacctgtcagaccatagaagacacccagcacatcaccgaaatcatcattcaccactgaaggaccggctcctgcaggaagtttcgactgtacatcattgaccttccgacgaagtttatcccacaactgctgcatctcatccgcccggatttctttctttacatacaccgtgatcttggataagcctgcccgattttcagttttcagataatataattcgcctaatgactgtatcgattcctccaatacatccgtcacctgagattgtacttcggaaggggaagcacccggatatggagtcatcaccaatgcctgtttgatagtaaacggagcatcttccagtttccccatcttgatataagaaaacaatcctcctcccagcactaatatcaacagcagaatagtcaccgacttcttctgcaagaaatattttaccaacttcatattcttctacttacttttgagcggtaaccgcccttttttctttctgagaaataatatctacaggcattccgtccgaaagaaaacgtaatttactcaccgctactttatctcctgcctgcaatccgtctttcacttctacttttccattgggaagcaattcgcctaaaatgacttttctctttacgacttgtcctgtcgtttgatccaccatccatacatagtctccttcagtgggacgatgattaagagccgtttgcggaacggtcaccataggaacagatgatgtagcaggaaggtccaacaacatttttcctgagataccggccggccattctccttgtttattgggcagcaatgccgtcatcaggaaagaaagattattgcgcgtcgtactctttgaaacctctaccactttagccggatatactgcttcgggacgaacatcaaaacgaatccccacttccttgatttccttcgcttgaaatgcgatctcctgagtaacatacgcttctatcttcaactgagtgatatcgataaaagaaacgacagactgagtcgctttcacatcctgatatttttcaatgtagacttcccctatatatccgtcaaaaggagcaataagtttcgtatcttcaagttcatttacggctgtttcataagcagttttggcagaagtatagtctgcacgtgctttttcataggcactggcagacaggttgtttttctcatacaacactttgattcgctcaaactcagcttttgcctgatgataaatagcttccgcccgttccttacgaatacgaaaatcacgggaatcaatttcagctatgatatctccccgatgatagtaattccccgcatacacttcgaaatggtcaatcggtccgcccacccgaaaagagagttcggtctccttgaatggtttggcaataaacgaaaattcacgctcggcagaaggaaccagcatttccgcttccgccacttttacccgtacaggctcgtttgttttcttctcacccttaccacacgatgtgagtaggcaaagacaaaaaatacacaatgaaaaattagtcgttgtcattctattctacattagttacgttgtcaacggcacgaaagtaacggaaagaagaaaaaagaaccggaatttaatttccgaagcggaaaaagaaagagctaaaacggaaaaagaaaagatgaaaatttgagccttttatcgtacttatgtgtttccttactatctttgcagttcgaatatataccacaatatcaatttatgactgaagaaaaaatacatatagaacgtcatggcagctggtgggcactgagtccgttactcgtctttctctgcctttatctggtaacttccattcttgttaatgacttttataaagtacccatcactgtggctttcctcgtgtcttcctgttacgcaattgccattacgcgggggttgaagctcgaccagcgaatctaccagttctccgtaggagccgccaacaagaatattcttctgatgatatggatattcatccttgccggagctttcgcacaaagcgccaagcagatgggagctattgatgcaaccgtcaatctgacactgcatatcctccctgataatctgctattggccgggatattcattgccgcctgttttatctcattatccatcggaaccagtgtagggacgattgtagcccttactccggttgctgtcggtctggccgaaaagacagagatcgcccttccgtttatggtagcagtcgttgtcggaggttctttctttggagataacctgtcgtttatatccgataccaccattgcctcaaccaaaactcaggaatgcgtgatgcgtgataagtttcgggtaaattccatgattgtagttccggcagcgattatcgtactgggaatctatatttttcaaggactatccatcactgcacccgcgcaagtacagactatcgaatggataaaagtcataccttatataatagtactgggaacagccattgccggaatgaacgtgatgctggtattaataataggtatcctgaccagcggtatcatcggcatagctaccgggagttttgacgtattcgattggtttggagcaatgggtacgggtatcacaggcatgggtgaattgattattatcacattactggcaggcggtatgctcgaaacaatccgttataacggaggtatcgatttcatcatcaaaaaactgacccgtcacgtcaacagcaagcgtggtgcggaactgagtatcgctgctctggtaagtatcgccaacctatgcactgccaacaatacgattgccatcatcaccacagggccgattgcaaaggatattgcaaagagattccatctcgaccggagaaaaacagccagtatcctggatacattctcctgtctgatacaaggcatcataccctatggggcacaaatgctgatcgctgccggattggccaacatctctcctatcagtattatcggcaatctctattatccgtttacgatgggagtctgtgccctgctcgctatcctgttccgatatccgaggaggtattcataagaaaaagaaaggaaatatttgtcaatcaaaagaaaagctgtatctttgcgcccgctattacgagttagtagcataattcaaatcattaattaaaaacaattattaaaaatggcaactagaatcagattgcaaagacacggacgtaaaagttacgcgttttattcaattgtaattgcagacagcagagcaccacgtgatggtaaatttattgagaagattggtacttacaacccgaacaccaatcctgctacagtagatttgaatttcgacgctgcattggcatgggtactgaaaggtgcacaaccaagtgacactgtacgtaatatcctttctcgtgaaggtgtttacatgaagaaacatcttcttggcggtgttgcaaaaggcgcattcggagaagcagaagcagaagctaaattcgaagcttggaagaacaacaaacagtcaggtctggctgctttgaaagctaagcaagacgaagaaaagaaagctgaagctaaagcacgtctggaagcagaaaagaagatcaacgaagtgaaagcaaaagcactcgctgaaaagaaagctgctgaagctgctgaaaaagctgctgctgaagcacctgcagaagaagcaactgaagctccggctgaagaagctgctgcaacagaagctgctgctgaataaatttcggcaggttcctaacaagacatttggaaaaagctataaatcctcttcggttcgccgaaggggattttttttatttcctgctatagaacatattaaaacagttctctacttctgaataaatttcttttctttgcaacagcatagctcagcacagtcatttatcttataacagtatgagacgaactgataaaaagaaaacattcggtcaacagtccagcaaagttacgcaattagcggatacattaagccaggcgatttccatgaaaaaatttcgtgaaggagattctttgccttccatcaatcagttaagtgcagaatatggagtatcacgcgataccgttttcaaggcctttcttgatttgcgcgaacggggactgatcgattccactccgggaaaaggatattatgtaaccagtcaggtgaccaatgtcctgctcctgctcgaccagtacactctttttaaagaagccctttacaatagtttcgtcaaacatctgcctattaattacaaagtagacttgctgtttcatcaatataatgaacggcttttcaataccattatccgcgaatctgtcggaaaatataataaatacatagtgatgaatttcgataatgagaaattcagtatggttctcaataagattcatccaacaaaattattgcttcttgacttcggtaaattcgagaaagaaaagtattcttatatctgtcaggattttgatgaagctttctatcaggcattactcatgctgaaggagaaactacggcactacccacaacttgttctgttattctctaaaaatctgaagcatccccaaagcagtaaagagtattttacccgtttttgtgaggaacaaggatttttatgcgaaattcaggaagatatcgagaatctgaccgtacgcaaaggagtagtctacatagccatcaagcaacaagatgtagtgaaggttgtgaaacaaggaagactggaaggactgaaatgcggaaaagatttcggtctgttggcatacaatgatattccttcctacgaagtgatcgacgaaggaattacttcattgagtattgattgggagatgatgggaaatgaagcggcaaactttgtcctgaacaatgtcccgatacaaaagtacctgcctaccgaagtaagactccgaaagtccctgtgattttttttgctgtatttacagcacagttcagcacagatattaaccactaaataacaaaaaaattaagaaaccatgaaaaagtatccgaaaatcgggattcgtcccactatcgacggtcgccagggcggtgttcgtgaaagccttgaagaaaagacaatgaaccttgccaaagcagtagctgagttaatcagcaataatctgaagaacggtgacggaagtcctgtagaatgtattattgcagacaatactatcggacgtgtagccgaaagcgctgcttgcgcagagaaattcgaaagagaaggcgttgggtctactatcactgttacctcctgctggtgctatggtgcggagacaatggatatgaatcctcattacccgaaagctgtctggggcttcaacggaaccgagcgtccgggagcagtataccttgcagccgtattggcaggacacgcacaaaaaggactccctgcattcggtatttacggacgcgatgtgcaagacctcgacgataatacaattcctgaagacgtagcggaaaaaattcttcgttttgcacgtgccgcacaggcagtagcaacgatgagaggcaaatcttatctgtcaatgggtagtgtatcaatgggtatcgccggctctattgtcaaccccgacttcttccaggaatatctgggaatgcgcaatgagtcaattgacctgacggaaatcatccgccgcatggaagaaggtatctatgaccacgaagaatatgccaaagcaatggcatggactgaaaaatactgcaaagtaaatgaaggagaagacttcaagaaccgcccggagaaacgcaaaaagcgcgaacaaaaagatgctgactgggaatttgtcgtgaagatgatgatcatcatgcgtgacctgatgaccggaaacccgaaactgaaagaaatgggattcaaggaagaagctttgggacacaatgctatcgctgccggcttccagggacaacgccaatggacagacttttatcctaacggtgactatccggaagcattgctcaacacttctttcgactggaacggtattcgtgaagcattcgtagtggctaccgaaaacgatgcttgtaacggtgtagcaatgctgttcggacacttgctgaccaatcgtgcacaaatattctctgatgtacgtacgtactggagccctgaagccgtgaaacgtgtaaccggtaaagaactgaccggcttggcagccaacggtatcatccacctgatcaactctggtgcaacaacactcgacggttccggccagtcattagacgcagaaggaaatcctgtcatgaaagaaccatggaatctgactgatgcagacgtggaaaactgcctcaaagcaacgacctggtatccggcagaccgcgattacttccgtggcggcggcttctcgtccaactttctttcaaaaggtggaatgcctgttactatgatgcgtctgaacctgatcaaaggcttgggccctgtcctgcaaatcgcagaaggatggaccgttgagattgatccggaaatccatcagaaactgaatatgcgtaccgacccgacatggccgactacgtggttcgttcctcgtctgtgtgataaatccgctttcaaagatgtatattctgtaatgaacaactggggcgctaaccacggagccatcagctacggtcacatcggacaagacctgattacgcttgcctctatgcttcgcatccctgtttgcatgcacaatgtagatgaaaacgaaattttccgtccgactgcatggaacgcattcggtatggacaaagaaggagcagattacagagcttgtacaacttacggtcctatctataaataaacaagaatctttcgtcctatttgatttaataatttaactttgccgtatcatagtggaagctgtcttcaaacacaagcttccactatatgacggcttaaataaaaacactatgataactgacgaacacatcgaactgtttctggcacaggcacaccgctatggagacgcaaaattaatgctttgcagcagcggtaatctttcctggagaatcggagaagaagcactgatttcgggtacaggttcatgggtccctacccttgccaaagaaaaagtttctatctgtaatatagccagcggtacaccgacgaatggcgtaaaaccatctatggaaagtacattccatcttggcgttctccgcgaacggccggatgtaaatgtagtactccatttccagtcggaatatgccactgccatctcttgcatgaaaaacaaaccgacaaatttcaacgtaacggcagaaataccttgtcatgtcgggtcggaaattcccgtaattccttactatcggccgggatctcccgaattggccaaagcggtagtagaagcaatgctgaagcataattccgtcttactgaccaatcacggacaagtagtatgcggaaaagacttcgaccaagtttacgaacgggctaccttcttcgaaatggcttgccgcatcatagttcagtccggcggcgattactccgtactgacaccggaagaaatagaagacctggaaatatacgtattaggaaagaaaaccaaataagtatccgggaataccatgaaagataccacaagaaacacatatttggcagtagactttggaggaggaagcggtcgggtcatcgccggctcccttctccagggaaagctggaattagaagaaatacaccgctttaccaaccggcaggttaaactcgggaatcatgtttactgggactttcccgccctgttcgaagatatgaaaaccggactgaaacttgctgcacaaaaaggatatcatgtcaaaggaatcggcatagatacctggggagtagacttcggcctgattgacaaaaaaggaaatttactgggcaaccccgtctgctatcgggatgctcgaacagacggaatgccggacaaggtatttcaaatactggatgcacaaaagcattacgcctgcacaggcatacaagtaatgcctatcaatacactgtttcagctttacagcatgcaacagaatcaggacgtactgctagaagttgcacagcggcttctctttatgcccgacctcttcagctattacctgacgggagtagccaataatgaatattgcatagcttccacctccgaactgctcgatgcacgccaacgaaactggtcgatggataccatccgtgctttgggactccccgaacacttattcggagaaattattctgccgggaactgtcagaggaacacttaaagaagagataggccgtgaaacaggattaggtcctgtcgacattatcgctgtcggctcgcatgacacagccagtgccgttgctgccgttccggcaaccgaaggtcaagtagcctttctcagttccggcacctggtcattgttgggagtcgaagtggatgaacccatattgacggaagaagcgagattggctcaatttaccaatgaaggaggcgtaggtggtcacatccgattcctgcaaaacattaccggactgtggattctgcaacgcttgatgagcgaatggaagctacgtggcgaagaacaaagttatgatacgattcttccgcaagctgcggacgcagaaattgacacgattattcctgtggacgatgcagagttcatgaaccccgaaaatatggaaacagcccttctgaactactgccggaatcattcacttaaagttcccggaaacaaggcagaaatggtgaaatgcgtactacagtcactggccttcaaatatcgcgaggcggtagcacagctcaatcgttgcctcccctctccgattcaccggctaaacattatcggaggaggctcacaaaataaactgctcaaccaacttactgccaacgcactcggcatccctgtttatgccggaccggtagaagccacagcaatggggaatatcctgactcaggcaatggcgaaaggagaaatatccagcctccgggaaatcagagaagtagtaagccacagtgttacaccacaagtatattaccctgaaaaataagaaagatatggaaacacctcaaactggctatcaagtaaaaacctacaacgtccctgtcaagcgatattgccagactcttgatctacgggattcaccggagttaatagctgagtatcggaaaagacacagtcaggcagaagtatggcccgaaatccttgcaggaatccgtgaagtaggtatccttgagatggaaatctacattctcggtacccgtctgttcatgatcgtcgaaacacccgtcgactttgactgggacacagccatggcacgtctgaacactctcccccggcaacaagaatgggaagaatacatgtccatcctccagcaggccgctccgggaatgagttccgctgagaaatggatccccatggagagaatgttccatttatataatacctaaaataacaagaaattaccatgaaacacactaagcagtctattatctcaaaggatggcgtcagctatcttattccattcatacttattacctcctgctttgcactgtggggatttgcgaacgatattaccaacccgatggtaaaggcattctccaaaattttccggatgagtgctaccgacggggcactggttcaggtagccttctacggtggatattttgccatggctttccctgccgccatgttcatccgcaaattctcctataaagccggagtattgttaggactcggcctgtatgctttcggagccttcttattctttcccgccaagatgacaggagagtattacccgtttctgatcgcttactttattctgacctgcggactctccttcctggaaaccagttgcaacccctatatactttctatgggaacggaagagacagctacaagacgtctgaaccttgcccagtctttcaatccgatgggatcgctgctcggaatgtacgtagcgatgcaatttattcaggctaaactgcacccgatgggcactgatgaacgcgctttactgaacgacagtgagtttcaggccatcaaggaaagcgatcttgccgtgctgatagctccttatctcattatcggactcgttattctggcgatgctgcttctgatacgatttgtaaaaatgcccaagaatggagatcagaatcacaaaatagatttctttcccacgctaaaacgtattttcacccagacacgctatcgggaaggtgtaatagcacaattcttctatgtgggtgttcagattatgtgctggacctttatcattcagtatggtacacgcctgtttatgtcgccggaatatggcatggatgaaaaaagtgcggaagtactgtcccagcaatacaatatcgtagcgatggttattttctgtatcagccgctttatctgtactttcattctgcgctatctcaatgcaggaaagttgctcatgatccttgccatcttcggaggcattttcacattaggaacgatcttccttcagaatatcttcggactatattgtctggtagcagtttctgcctgtatgtctttgatgttccctaccatttacggaattgcactgaaaggtatgggagacgatgccaagttcggagcagccggtctgattatggctattttgggaggttccgtgctccctccgttgcaagcaagtattattgacatgaaagaaatagcttccatgccggctgtcaatgtatcattcattttgccgctcacttgcttcctggtaatcatcggttatggctaccgtacagtgaaaagaaactggtaaaaactaactttaagatagtgacactatcctgttgcgatagtgtcagcatcccactcatatagtgacactatccggaccggatggtgtcactatcttttttcttttttataaactattccttttttcttcgtatcttaatttaatttgtttacatttgtctttcgatttcaataatctgttaacccgatgaccccaaaccaagacgaaagacttttagcgcaacaattcgaaacaatattcacgaaatattattcggtagtgaaatatttcgccctaatgctgcttaaatccgaagaagacgcaaaggatattacccaagatgttttcactaaactatggactaagcctgaattatggacggaagttcctaatccgactccttatatctatacccttactaaaagtacaactctcaattttatcaaacacaaaaaagtagaattggcttatcaggagaaaattatagaaaagtctctcatcgacgaacttttccaatcagaagatacactcaatcccatctattataaagaggctcaactaatcatcaaattagttctcgaacgccttccggagcaacgcagaatgattttcgaaatgagtcgtttcaagcatatgagcaatcttgagatagccgagaaactaaatatttcgaaacgaacagtggaacatcacatctacttaactctgcttgaaatgaaaaaaatcatcttttttgcattttttttgctgttcccttaagtaagctgccttagttaattgaagtattaatataacagttataatattaatacctcaatatgaagaattactttcagaaaataataacattattcaccggaaacgactatccggaatcgacccagcaagatttctacaagtggctggtagatgaagagcatacttccgaaaaagacgaagcattacaaaaattatgggatgaggctcataaacagagaactgcaaccgacatgcaggaggcttatgaacttttgaaaaagaatgccggaatacctcccatacaacgaaaaagaacaatccgaccgattcatatatggcagactgtcgctgcagttttatttatagtagcggcttcttccgtttacctttctacaatcggtaaagatgcagaagaaaaccttattcaacaatatattcctactgctgaaattaggactctcactctacccgatggaactcaggtacaactgaactcacaaagtacacttttatatccgcaaaactttaccggtaaagatcgtagtgtatttttgattggtgaagccaactttaaagttaaaccggataaaaaacatccgttcatcgtcaagtccaatgattttcaggtgacggcgttgggtacggagttcaacgtttcggcttatccggaaaatccggtgttggcagccacattgatttcaggaagcgtattggtagaatacaatgatttaaaatcgcaggtgattctaaaaccgaatgagcagctggcttataacaaaaatactcattaccatagcctggaccatccggatatgaaagaagttaccgcctggcaacgtggagaacttgtgttcagagaaatgtccgtcaaagatatcatcacaatccttgaacgtaaatatccttatacattcgagtatcagctcaaaacgctgaaagacgacagatacagtttccggtttaaagaccaggcaccactatctgaggtaatggatgtgatagtaaatgtagtaggtcaaatgaactataagataaaaggagaccgctgctacttaatcccaaagtaatgggtatcatcccaaaagaaaaacagtaaaaaaacaacaatataataacctttttaaccactaaagattcatgcaaaaaagtatccggaacggagccctaactctatcccggatatgaaatcaagattctcaatattagagttttactctattcaattaccgtgaaataatttagttaataacctaatactaagaaaatgctacaaatttatgaatttatagtagatcaaaccgcaaagggaagaagttttttactttttttctgtttgttgatgatgcaaacaccctcctttgcacaaaatagtgccaagatcacgattcagaagaaaaatatatctgttatcgaggcacttaaggaaatagaaaaacaatccgattattctgtcggatacaatgattcgcaactgaaaaacaagcctgttttaaatcttgacctaaaagcagcgacacttgaatatgccctttcgcaaatccttcggggaagtggatttacttatcagttcaaagataagtatatcatgattattcccgacaagaaacttaaagaaactcctacaaaaaaagtaagtggaatagtaatcgatgaaaataatgagccactgatcggagtgaatattaaagtagaaggaagctctgaaggtgcaatcaccgacattgatggtaatttcaatataatggctcctcaaggcagcacattaagcttcacttacgtgggatatacacctcaaactgtaaaaataacagataagaatatctacgaaataagattggcaagtgatactaaacaactgaacgaagtggtagtcaccgctttaggtatcaaacgcgaacaaaaagcgttaagttacaatgtacaacaagtcaagagcgatcaattgactacaatcaaagacgccaacttcgtcaacagcttgagtggcaaggtagcaggtgtcattatcaatagcagttcttccggtgtcggcggtgccagcaaagtagtgatgcgcggtacaaaatccatcgaaaagagtaataatgcactttatgtaatcgacggtatacctatgtataacttcggaggtggtggcagcacagaatttggttcaaaaggagagacggaaagtattgccgacctcaatccggatgacatcgaaagtctgtccgttcttacgggagcagccgcagccgccctttatggtagcaatgctgcaaatggagctattattgtcactacaaaaaaagggaaaatagggaaattacaggccagtgtttctaccggcatcgactggttgaaaccattcgtaatgcctaagtttcaaaaccgttacgggacaggaagtaacggtaaatctgacggttccaccgtatggagctggggaccgaagatgggaaacagtcctggctacgaccccaacgactttctaaaaacaggagctgtttacaacaattcagtcactttatccaccggtacggaaaagaaccagactttcttctctgccgctgcgctgaactccgacggaatgattcccaacaataggtataacagatataattttactttccgcaacactacaagtttcctcaatgacaagatgaaactagacgtaggagccagctacatcctgcaaaacgaccgtaatatgactaatcagggacagtattccaatcctttagttcctgcttacctttatccgcgtggtgataatttctctacagtcaaggtctttgaacgctacaacgaagctcgcaaaatcaacgaacagttctggccatcgggcgaaggtgacctccgcatgcagaatccttattggatagcctatcgtaatctacgtgaaaacagtaaaaaacgttatatgctctctgcaggattaacttacgacgtactcgactggctaagtttatcaggacgcatccgcatagataattcaaacaacacgtatgagcaaaaatactatgcaagtaccatcactacacttaccgaaggtagcgaacaaggatactacggcatagaaaagagtggaaacagccagacgtacgctgactttcttgtaaatattaacaagagagtgggcgacttcactatcgtagccaatattggtacatcattaagcgacaacagctatgatatgctaggctacaacggtccgatacaggaaaaaggaatacctaatgtattcaacgtattcgaccttgataacacaaagaaacgcgccacacaagaaggatgggaagaaatgacccaatccatatttgcaagtgcggaagtgggatggaagagtatgctctatcttactttaacaggacgtaacgactgggcttcacaattactgggttcgtcacaaacctctttcttctatccctccgtcggactttccggcgtgatcagcgaaatggtcaagctccccgaatggattgattatttgaaagtacgcggatcattcagttccgtaggtatgccctaccctcgattcctgactatcccaacttataaatatgataccacgatattaggatggctacccaaaacacattatcctatcggtaagctttatccggaacgtacggattcatgggaagccggcttagacgccactttcttcaaagaccttcgcctaagtgcttcattctactatgccaatacttataaccaaaccttcgaccccaaaatatccgcttccttcggatactccaaattctacgttcaaacaggttacgttcgcaatatgggtatggaaggaatgttgagctacggacaccgctggaatgaatttggctggaatagcaattttactttctcatggaataaaaacaagattattgaattagtaaaagacttccatcaccccgagacaggcaagatactcaatatacccgaacttgaaatgaatggcttgggctattcacgtttcatcttgaaagaaggcggaactttgggcgacctctactctaaagccgaccttgtacgtaatgacaaaggttatattgagatggacgccaatggtgctttggccaaagatgccaacgtagaaccgatcaaattgggaagcgtgttacctaaagccaactttgctttcagtaacgagttcacatacaaaggtgtttctgccggcttcctgctttcctgccggttgggaggtatcgtttattctgccacgcaagcagctctcgaccaatacggagtatctgaagccagtgcaaaagcccgcgacgcaggtggtgtagttatcaacggacgcactatgatcaatgcccagcaatggtacgagacaattggtagttccagcggactcccgcaatactatacttacagcgcgactaatattcgcctgcaagaagcacatatcggatatactattccccgccgttggttgaaaaacatatgtgatatcaacgtgtctttggtaggacgtaatctctggatgatttattgcaaagcacctttcgatcccgaatcagtcgctactaccagcaactattatcaagggatagattacttcatgatgccgagcacccgcaacatcgggtttaatgttaagtttaacttctaaaaccatgaaatttatgaaaaacctgcgatatatgctgatagcagcatgttcagcctgcctgcttctacctttgggaagttgcatggatacggacatgaaccgtaataaatacgaagtggacagcgaagaaatcggccgtgaaaactacgacctcggctccactatcagaggcctgcaaggcttagtaatacctgcacaagagcatctttaccaattcatggaagccatgtgtggtggttcttatgcaggatatttcggtgaaacacgtaccggatggctggagaaatactctacctataatcctaaaaccgactggttgaaggcaccatttacagatgttatatcagaaacatatcctaaatattatgcagttttacaacatgaagatgcccctgtagcccttgcattagccaaactgctacgagtaactatcatgcaacgcgtgacggacatttacggccctatcccctatagcaaagtgttagtatccggagaaggttctgaaagcgatggactgaatgcggcttacgattcacagaaagatgtctacatgcgtatgtttcaagaacttgaagaagccgatcaggcacttgaagacaacatgacagaaggcaatagcggatttgaaaagctggatgatgtctactacggaaaactacaacaatggcgcctttttctccattcactacaactacgcatggctatgcgcctatgctacaccgatatggctgccgaagcccaaagcattgccgagaaagccgtaacggcaggagtgatcgaaaagaacgacgacaatgccttattccatgtagcagaaaatcgctcagcactctgcttcaacgattggaaagactatcgtgtaggagccgatatcatctgttacatgaatggttatgcagacccacgtcgggataaatattttaccaaggtgaagaataacgaccaggaaggttattacggcatgcgtatcggcataaattcaccattttctgatgacgacatgataacatcgtactccaatcgtttgatgaccgccagcgatccttatgtatggatgactgcctccgaagtagcattcctgcgagccgaaggagcattacgcaaatggaatatgggcggtgaagccaaagatttctacgaaacaggggttaagctttcttttgaagaacatggagccagcggagcggaagactacctgaattcaatagcctctccaagtggctatactgacccgctaggttcgtatagcacaggtagccccgccaacattacagtaaaatggaatgaaatgggagaacaggcattcgaagagaatttggaacgtatcattacccaaaagtggattgcacttttccccaacggcattgaatcatggagtgaacacaggcgtaccggatatcccaaattattgcctgttgtcgtgaacaaaggccgcaatgttagtaccgaagccggcatgcgccgactcatgtatcccaacgaagaatacacccagaattctttccaccttaacaatgccattaatgtattgataaaggaaagtagtaataatcaggggggagataccggtggtacccatgtatggtgggatcgtaaagcaaacaagtaagaatctttaaaaactaagataatatgaaaaataaaaaccttatattcagtttcctaactgtcgttactctcacgattggtgcaggctgtctgtggacatcgtgtgacgattggaccgaaacggaacaggtggattacggagtaactacccccgatggtcagaaccctgaactatatgcccgctacacacaagctgttcgcaactataaaagtcgcaaacactatgccgtatgtgtacgcttcgacaatggacatagcggagacggagaaaaagactttcttcgttcgatgccggatagcattgatgccgtcattctggaaaatgcggcaacacttaattcagccgatctggaagacattcctgtattgcagactaattttgcaacaaaggttctttttagtttcaatctgaccagtatcaaagagaacgcagaaagttcgggacaagaaatcaaaacacttctggctcccgctttagagcaaatggtatccgccattaccgacaatgggcttgacggagcttcaatctcctacaccggtgacatcggacttggtaataacgcagcagtcaatgcaagtataactgagatgcgtcagttactgcttgacaagattacaccgttagcaaaaaatgggaaaatcttttttctggaaagtaatccactttttattcccgaagcgaaccgggatgtattcacccgctacgtactcaatactacgtcctctaaaaatgccagccagttacgtcttctgattaatgaagctatctattatgcaggtattccctcagacaagctgctcattaccggcgatccggagctaatgactacggacaataatgacgggcttgtctcacaagtgcctttcttcgccatacaggtaatagattgcgggcctatcggcggcttaatgatacagaatgtcgctgcagactattcgcacgctaacatcacttataaggagacacgtggtgccatacagactttaaacccttcacctttaaaataaacacaggaggaatctaagatgaaaaagcaaaaaatacgattcgcaattttcatgttgttacttgctgtcactgcttgcgacaatgccgattatagtaaaagtgctcctttcgacaacggtgtctatttaagtgtagccgaaagcaaaacatcggagactatgacattcaacaaaacgattattcagcgcgaaaagagcttcacagcccggctggcatatcctgctggtactgatgttacggtcaacgtaacagttgacccttcacaagtagaagcctacaactcacgcaataataccagctatgatatattgccggccaaacattaccgattggagagcaacgaaatgacaatacgcgcaggcaaaatcaattcagctccgttacatatttattttgaaaacctgacagaattggagattgataaagcatatctctgcccagtgtctcttaattccgcacaaggtgtaggcctattggatggctcaaccacctactggtatatagtgaaacgctccagcgccatcactaccgctgttgacttacgctattgctacgtcgaagttcccggattctatgtacccaaatggggaacagagcctgccggcaatgctgctcatctgaacaatttgaaggctgtcacctttgaaataatcacccgtatatccaatttcgacgaagccaatacagacatttccagtctgatgggcatcgagcaatatttctgtttccgggcaggcgatgcaggcttcccacgtcaacagttgcagatacagactccggcaggaaagttccccgaagccaacaaagccaaattactgaaagaaaatgaatggtaccatctcgcactaacgtacgacattgccaccaaaacaattattttctacgtcaatggaaaagaacaaagccgaagcactaactatggcaacagcgaattctccgaaataaaacttgccaaccgcaaacaggaaagttttcccggtgcaagcgatggtgactggcttttctacataggacgttcttataatgaccgctggcttatcgaccgtcaacttaacggtaatgtctgtgaggcacgtatctgggatgtagcacgtacacaacaggaaatctggaaaaacatgtacgacattgaagatccggaaaatgaagcacacctcgctgcttactggaaattcaatgaaggaagcagcaatgatatcaaggattactccaaatatcataacgatgcacacattgttcgttattggaaagatttcaatagcaaagaagaatatgacgtaaaaaatgaggaactatggccaagcggcatagaagttccgcaagtgaatagggaagattagaaatgagaaacttataaaaatcaaaatatgaaacaaatattgaaacatatactgattctggcatttgcggcaggttttattgggactgcctgcgaaaataacgatcttaatatcgatgccggtacattccccgaaaccggaggtataggtctttctatgggtatattacaaagcgataattatgcgatggaaaacccacagataaacatggaccatgccagtttgagcgatcaatttcacatcagcttaacagaaccggcttcacaaacaggaaattataccgtaaaagtagacgaatccaaagtactggacttcaattcgaagcacggaacgagttaccctctgtatcctacagaatacatagatttaggtaacagtggaaaaatgacaatagagaaaggagaacagcagtcaaactctgtctctattgccttcaaatatgatgaagccatagaagattctgttatttatgtactccctctgacagtggaagagaacaatagttccccggccatgtctagtgaacgcaaaacattatattatataattaatgtatggggaatggctcctgccgaatataacgctataaagaaaaacttcattcagatagcaggggtagatcccgaattcaccaatcctctactgctcaacaaactctattttgagtctatgtctctttcatcaccagaagtagattactacaatccattcgacataatcaacctacagttcgctaccgtcaaggcagacgataatctgttgccatctttatatctaaaagatgatctggcatacgtactaaagaaacgtgaaaagtacatcgttccattgcaacagttagaccacaaagtttgccttgccattaagggagcgggagaaggaattggtttttccaatctgggagaaaaagaaatgatgatatttgtagaaagaataaaacaaatgattgatatatatcatttagatggagtcaatctatatgatgctaatttttcctatgaagaaagtaatgaaaacattaattactcaaacaatctatgcaaattcgtagcatctttacgagataagctaggaaacaagatcataacctatacacaaacttctgaatctccggaagggatcactaatgacgctaatttgaaattaggagaacttttagattatgcttggtgtgatcaattgaacacaattattgatccttggagtactcctgaaaaatggacacgtcctattgcaggattaaacaaagaaaaatggggagctttaaatactgatatacatatgtcaagtgagcaagcaaatattttagatcaagtgatagaaatgtttactcaaccctcactaatgataaccgctggaataaatcatgtatttgtagtaaatagagtagactatgttagtgcaggaacggaatcttatgcaccgacttatatggcttatggtgctatctgtaacttatgtgatatggaaaaagaatattttgtaacaggtattaactctccaaataatcaatacctcaacattcatgatcttctcatgcctaaagattattaagatataacattcatatttat

SEQ ID NO: 77 - DNA, 34900 bp, Bacteroides thetaiotaomicron
gcatttggcataatacattgcaagtattataataataaatatttaaaagattaaagacatggagataacactatcatttgttttttgcctcttgagcggctttgcctgcttctggctattttggaaatgcgtagactggtttgaaaagatctagaagaggaaaggagaattaattatgtacacaacactatttgtattaggtattgcaatcttcggttatttgatgtatgtactcatcagacccgaaaagttttaaagttatacagtttaaggtaaaagtatgaatacagaaattttaggtgtggtcgcacaagttgccttgatggtgattttggcttatccactaggaagatacattgccaaggtttataaaggagagaaaacctggtcggatttcatggctcctattgaaagagtcatttataaagtatgcggaattgaccctaaagaagaaatgaactggaaacagttcctgaaagcattattgatattgaatgcattttggttcgtatggggaatggtattgctggtttcgcaaggatggttacctttaaatccggatggcaacggtccccaaacgccggatcaggcttttaatacctgtatcagttttatggtcaactgtaacttgcagcactatagtggtgaaagcggattgacttatttcacacagctgtttgtcattatgctcttccagtttattaccgctgcaaccggtatggctgctatggctggtattatgaagagtatggctgccaagacaacaaaaacaatcggtaacttctggcattttttggtagtgagctgtacacgtatcctgttaccgctttctttgattgtaggtttcatcctgattcttcagggaaccccgatgggattcgacggaaaaatgaaggtcactaccctcgaaggacaggaacagatggtttcgcaaggacctgcggctgccattgtgcccattaaacaattaggaacgaatggaggcggttactttggtgtgaactcttctcatccgttggaaaatccgacttatcttaccaatatggtggagtgctggtctatcttgattattccgatggcaatggtacttgcattagggttttatactcgtagaaagaaactggcttatagtattttcggagtgatgctctttgctttcctggtaggcgtctgtatcaatgtcagtcaggaaatgggtggaaatccccgtatcgatgaactgggaattgcgcaggataacggtgcgatggaaggtaaggaagttcgtttgggtgccggagctacagcactttggagcattgtgactactgttacttccaatggttcggtgaatggtatgcatgattctactatgccgttgtcaggtatgatggagatgctgaatatgcagattaatacttggttcggcggtgtaggcgtaggttggatgaattattatacgttcattattatcgcggtatttatcagcggtttgatggtaggtcgtaccccggaatttctcggaaagaaagtagaagcccgtgaaatgaaaatagctacgatagtagcactgcttcatccatttgtcatattagtgttcacagcaatctcaagttatatatatgtatatcatcctgactttgtggaaagcgagggcggttggctgaacaatcttggattccacggcttgagtgagcagctttatgagtatacatcttgtgccgctaacaatggttccggctttgaaggactgggagataatacttatttctggaactggacctgtggtattgtacttattcttagccgattcctgcctattatcggacaagttgccattgccggcctgctggctcagaagaagttcattcccgagagtgccggaacactgaagactgatacgctgactttcggaataatgacgtttgtcgttatcttcattgtggctgctctgtccttcttcccggtacacgctttgagtacaattgccgaacatttaagtttgtaattctgaattagagaagatatgaaaaatatgaaatcagcttctttgtttcaaaaggagcaagttatagaaagcctgaaacaatcattcgtgaagctaaacccgcgactgatgataaagaacccgatcatgtatacggtagaggtggctacagtggtcatgttgtttgtgacactttactccatcatcaatccctctcagggttcgtttgcctacaacatagctgtgtttatcattctgtttattacactgctgtttgccaattttgccgaagcgattgccgaagcacggggaaaagcgcaagccgacagcctgcgtaaaacacgggaagagacacctgccaaaaaggtggaaggtaatcaaatagtgactgtaagttcttcacagctaaagaaaggagatgtgtttgtctgtgaagccggagacgtgattccgtccgatggggaaataatcgaaggattggcctctatcgatgaaagtgcgattacaggtgagtctgctccggtgatccgggaggcaggcggcgataaaagctcagtgacgggaggtacgaaagtattgtccgatcatataaaagtaatggtgaccacccaaccgggagaaagttttctggataaaatgattgcactggtagaaggtgcgtctcgtcagaaaactccgaatgagatagcactgactattctgctggctggttttacacttgtctttgtcattgtgtgtgtgacgttaaaaccgtttgccgattacagcaatactgtcattaccattgcttcacttatttctttgtttgtgtgtctgattccgacaacaatcggaggacttctttctgccatcggtattgccggtatggaccgtgcactacgtgcgaatgtgataacaaaatcgggtaaggcagtggaaactgccggcgatattgataccttgttgctggataagaccggaactatcaccatcggtaatcgtaaagctacccattttcacactgcgccgggcattgatctgcacgcttttgtagaaaactgtctgctttcttctctgtccgatgaaactccggaaggcaaatcaatcgtagaactgggacgtgaatcaggtatccgtatgcgcagcttgaatacgacaggcgcacgaatgattaagtttacagccgaaaccaaatgctcgggtgtcgatttgccggacggaactcagattcgtaaaggggcttttgatgctatccgtaagattgtggaaactgccggaaataaattccccgaagaagtggaaaaggtgatcgctgctatttcaagcaatggtggtacgccgttggtggtatgtgttaatcggaaagtgacgggtgttatcgaattgcaggatatcatcaagccgggtattcaggaacgtttcgaacgcttgcgcaaaatgggagtgaagacagtgatggtgaccggtgataacccgctgactgccaaatatattgcagaaaaggcaggtgtcgatgattttattgccgaagcgaagccggaagataaaatggaatatatcaagaaggaacaacagtccggcaaactggtggcaatgatgggggacggtacgaatgatgctcccgctttggctcaggcgaatgtcggagtagcaatgaacagtggtacgcaggctgcaaaggaagccggcaatatggtagatctggataatgatcctaccaaactgatcgagattgtggaaatcggtaagcagttgctgatgacccgtggaacactgactactttctctatcgccaacgatgtggctaaatattttgccattgtccccgccttgtttatggtggctatccccgaactggcggcgttgaatatcatgcagttgcatagtcctgagagtgcgatcctttcggcagtcatcttcaatgcgattattattccgatcttgattccgttggctttgcgtggcgttcagtacaagccgataggtgcaagtgctttgcttcgccggaatctgctgatttacggtgtaggtggtgtgattgctccgtttatcggaattaaactgattgatttattagtaggtttattcttttaattaaaaaacaatagcgatgaaaactttatttaaatcactaaagataactcttgttttctgtgtctttttctccgtattctatattcttattttgtggttgtttgcacaagtggcaggacctaataagggaaatgctgaagttgccacactggatggaaaagtggtgggtgcggccaatgtcggtcagatgtttacaaaagatatttatttctggggacgtccttcgtgtgccggagacggttatgatgcttctagttcgtccggcagcaacaaaggacccacgaatcccgaatatctggctgaagtggaagcgcgtatcgatacgttccttgtacatcatccctatctgagccgtaaagatgttccggcggagatggtaacggcgagtgcctccggtctcgaccctaatattactccgcaatgtgcatatgtgcaggtaaagagagtggcacaggcacgtggactgactgaaaatcaagtgaaagaaatcgttgatcaaagtgtggagaagcctttactcggaattttcggaacggagaaaataaatgtgctgaagctgaatatagcacttgaagagaataaataaccaaacactgggcggcgtgcctgtccgaatcgttttagttatttattgcggttcaaataaacagggctggacagggcgctgctcttttttagaaacataaaataaaaagataaatatgaagagtttttttagtaagaagattgttgtaggagcattggttgcggcaactgtatgcgtatcgggtataacggatgcaaaagcacaggaatttgctgtgcagggagatattgtcagttcctatgtctggcggggaatgtaccagggtggaggtgcggcttttcaacccacgctggggtttgggttcgataatttttctgttaccgcatggggatctactaatttcagtggagggaataaagaactggatctgactcttgcctataagtttggtaaggcgggacctacgctgacggttgccgatttgtggtgggaaggtgaaggggcatataaatattttaattttaagagccacgagacgggacatcattttgaggcgggattggcttatacgttgcccgtagagaagtttcccctgtccgtagcgtggtatacgatgtttgccggaaaagacaagaagctgaatgatagcggagaactgaagcagaattattcctcctatctggaactgaactatcctttcagtgtgaaaaatgtcgatttaaatgtaacttgcggcgcagtgccgtataaggcggagggtatctacacgaatagtggcttcgccgtgactaatgtagctttaaaaggaatgacagagataaaaattaatgataagttttcattgccgatatttgcacaggctatatggaatccatgtgttgaagatgcttttttggtttttggcgtaactttaagaccatagatataaactcatgaatttttattatgcagaaacccgtggtgatcgtgatgattactacgggttgaaatagtttataaacagcaattaatgaaatggatatggatagagaacagagtgtacaacattttttggatctgatcaagaagtctcatcgaggcaagtttaaaatctatatcggcatgatagccggtgtagggaagtcttaccgtatgcttcaggaggctcatgaactgctggagaatggggtggatgtacaaatcggctatattgaaactcacggacgtgccggaacggaggctctgatgcagggactgcctgtgatcccccgacgtaaaattttctataaaggaaaagagttggaggaaatggatgtggacgccattatccgccttcatcccgagattgtgattgtggacgaactggcacacaccaatgtggaaggcagtttgaacgagaaacgttggcaggatgtgatgactctgttggatgaggggattaatgtgatttccgcaatcaatatccagcatatcgagagtgtgaatgaagaagtgcaggagattacagggatcgaggtgaaagaacgggtgccggacagtgtgcttcaggaagcggatgaagtggtgaatatcgacttgacagcggaagaactgatctcgcgtctgaaagcaggaaagatataccgtccggaaaagattcagacagcactggataatttcttccggaccgagaatatccttcaactgcgggaactggctctgaaggaagtggcgctccgggtggagaagaaggtggagaatgaggttgtgatgggtgtttcggtcggaatcaggcatgagaagttcatggcttgtatcagtagtcatgagaaaacacccaggaggattatccggaaggcggcacgtctggcaacacgatataatacaacttttgttgctctctatgtgcagactccgagggagagtatggaccggattgatctggccagtcagcgttatttgctgaatcattttaagctggtagcagaactgggcggagaggtcatccaggtgcagtcgaaggatattctggggagtattgtcaaagtttgtcgggacaagcaaatatcttctgtctgcatgggaactcctaatctgagatttcctcatgccatttgctccatactcggatatcgaaagtttttgaataatttgtcacaagctaatgtagatttgattatacttgcataatattaaccgtatgaacgatatgaatattaaaacaaaactgattctcggcatcgggatgctggcgggaatgattattttgctggtaacactttctgttgtgaaccttcagctgctgactgccacagaacctgatagccctgccgctatgccggcattggaacgcgctctgttgtggatttccgttaccggcggtatttgtatattgaccggattgacattgctgtattggttgccccgaacaatcagtaaacccatcaaggaactgaaacaagggattcttgaaatagccaatcataattatgaagaacggctggatatgagaaataatcaggagtttcgggaagtcgccgagagtttcaaccgtatggcggaacgtctggccgagtatcgggcaagtacgttagcagatattctttctgccaagaaattcattgaggccatcgtgaacagtatcgacgatccgataatcggtctgaatatggatcgtgagattttgtttattaatgaggaagcactgaacgtgctgaatctgaaaagaggtaatgtcatacgtaaatctgcggaagaattgtctttgaagaatgatctgcttcgccggctgattcgtgaactggtgacgccgggagatcagaaagagccgttaaagatatatgccgatgataaagagagttatttcaaggcttcctatattcctatcataaatacggatgcagggaaggatgaacccagcaaattaggggatgtcattctgctgaagaatataacggaattcaaggaactggattctgccaagactacatttatttcgaccatttcacacgaattgaaaactccgattgcggctatcatgatgagtctgcagctattggaagataaacgtgtcggtgagctgaatgatgaacaggaacagttgtccaaaagcatcaaggaaaatagcgaacgcctgttgagcattacgggcgaattgctgaatatgactcaggtagaggcaggcaagctgcaattaatgccgaagataacgaagcccattgaactgatagaatatgcgattaaagctaatcaggtacaagcggataagttcaatatccagatagaagtagagtacccggaagagaaaatcggcaagctctttgtcgatagtgaaaagatagcttgggtattgactaatttgctcagcaatgcgatccgttattctaaagaaaacgggcgtgtcgtgattggcgccaggcaggaaggagatatgatcgacctgtacgttcaggatttcggtaaaggcatcgatccccgttaccacaagagtattttcgaccgttacttccgtgttcccggaacaaaagttcagggcagcggactcggtttgtctatttcgagagactttgtggaagcgcatggcggtacgctgacagtagaaagtgaactgggaaaaggaagtcggtttgtgatgcgactgaaagcataaaagagaatgttcggaaagtgtccgaggcggttgctgtgataaataaatgtggtagctgatttaatttgaaatgaaactttgggaatcaagacattgcagcgtcttttaaaatctttatatttgcagactaattgaagttaaagtcaaatttatacaatataataacttaaaagaaccagaatcagatgaaacaggacatgattgttatccttgacttgggtagtcacgagaatacggtattggcgcgcgccatccgtgcattaggagtttatagtgagatttatcctcacgacatcacagtagaagaactgaaagcattgcccaacgtaaagggtattattatcaatggtggactgaacaacgtgatcgacggtgttgctattgacgtgaatccgtctatttatacgatggggattcctgttatggctgccggtcacgataaagcgacttgcgcagtgaagcttccggcatttacagatgatatcgaggctattaaggctgctataaagtctttcgtatttgatacttgtcaggctgaagctaactggaatatggcgaactttgtcaatgaccagatcgagctgatcagacgtcaggtgggtgataagaaagtattgctggcattgtcgggtggtgttgacagctcagtggtagctgctttacttttgaaggcaatcggtgaaaatttggtatgcgtgcacgtaaatcacggcttgatgcgtaaaggtgagtctgaagatgttgttgaagtattcagcaaccaattgaaagcaaatctggtttatgtagatgtaacagaccgcttcctggataaattggcaggtgtggaagatcccgaacagaaacgtaagattatcggtggtgagtttatccgtgtgttcgaagaagaagcacgtaaactggatggtatcgatttcttaggtcagggtactatttatccggatattgtagagagcggaacgaagactgccaagatggtgaaatctcatcataatgtaggcggtctgcctgaagatcttaagttccagcttgtagagcccttgcgccagttgttcaaggatgaagtgcgtgcttgtggtctggagttggggttgccttatgagatggtttaccgtcagccgttccccggtcctggtttaggtgtacgttgtctgggtgctatcacacgcgatcgtctggaagcagtacgtgagtctgacgccattttgcgtgaagaattccagattgccggcctggataaaaaggtatggcaatactttaccgtagtgcctgactttaaatctgttggtgtacgcgataatgcccgttctttcgattggccggtgattatccgcgctgtcaatacggtagatgctatgacagctactattgaaccggtagactggcctatcctgatgaaaatcacagaccgtattctgaaagaagtgaagaatgtgaatcgtgtttgctatgatatgtcgccgaaacctaatgcgactattgaatgggaataagagtatagagcattaaatagaatagcccccggaagctgaatataaactttcgggggctaattttttgcatttagcgtcacctatggcgtcacctgccaccaattgatgtataaaagaaaaaggcacccaagagtggaagcctctcaaatgccttattcttatcaagtagcgggacccgggattgaaccggggacctcatgattatgaatcatgcgctctaaccagctgagctatcccgccatcatttctcgattgcgggtgcaaagatagatgtttttctgtaatctccaaaacaattcataacttttttgtgttttttctttagaacgaggttctctttttcctataaatagggagtttggggccttgaaaagaaataagttttaaataaagtgtctgatttatgccacataattagaaaaaagtatttatcttggcacacgtaaaaacaattcgaaattgctatgaaaaaagaaaaaattcatttggagtatttgttgaacgcaacatctaaaaatattctttgggcagctattagcacaccgaccgggctggaggactggtttgctgataaagtagtatctgatgataaaatcgtagaattccattgggggaagactgaacaaagaaatgccgagattattgcgatccgttctttctcatttattcgctttcgttggcaggatgacgaaaatgaacgcgattactttgaaatcaaaatgacttataatgagctgacaagtgactatgtattagaaattacagacttcgcagaggcggacgaagttgctgacatgaaagaattgtgggagtcgcaagtggcgaaattgagaagaacgtgtggtttttagttaactttcaactaaaaattttctatgctactttttttgtgctaattttgcgtcttaattgcacgaacctattaagatgctacgcataaagaaattagatatatttatcgtaaagagcttcctgatgctctttataggtacattcttcatctgtctcttcatcttcatgatgcagtttttgtggagatatgtagacgagttagtcggaaagggattggatatgagtgtgatagctcagttcttcttttattccgcattgacactggttccaatatcgttgccgttggcaatattgctggcttctttaataaccttcggcaactttggcgaacgttacgagttgctcgcaatgaaagctgcgggtatatccttgcttaaaattatgcgcccgctggctttctttgtctgtggtttggttgctgtctctttttatttccagaatgtcgtggggcctattgctcagacgaaactatacacactgattatttcgatgaaacaaaagtctccggaattggatatcccggagggggtgttttattcggaaataccggattataacctgaagatagccaagaagaaccggaagacaggtatgatgtatgatgtgctgatttataatctgaaagatggatttgagaacgcacatattatttatgcagattccggacggatggaaatgactgcagacaagcagcatctctggctgcatttgtacagtggtgatttatttgaaaacctgagatcacagagtatgaaatctcagaatgtaccgtatcgtcgggaagaattccgggaaaaacatacgattattgagtttgactcagactttaatatggcggatgccagtattatgagtaatacatctgctgccaaagatatgtcgatgctgcaagcctccatcgactcaatgaaaatggtgggtgatagtatcggaagacaatattaccgggaagtttctgaagggaatttccgtagcacctatggattgacaaaggaggatacggtcaagattatggaggcgaatattactgaatataatatcgacagtctctatgaggtagctcctttgatgcagaagcagaaggtgatttcatccgctgcaagtcgtgcggaaaacctgagcagtgatataaacttcaagagttacacgatgggtagccatgattatagtatgcggaagcatgagatagagtggcataaaaagatcactatttcactttcctgcctgctgttcttcttcattggtgccccattgggcggaattatccgtaaaggaggactcggtatgccggtcatcgtttcggtgatggtattcatcatttattatatcatagataatacaggctataagatggcacgtgacggcagatgggtcgtatggatgggagtgtggaccagtagtgccgtgcttgccccgttaggtgctttcctgacttacaaatcaaataaagactctgtagtgctcaatgccgatgcgtatatcaattggtttaagaagattgtcggtatccgtaacatacgccatttattcaagaaagaggtggtgattcacgatccggattatactcgcataccgggtgatttgcaggtgcttactgacgagtgcaaagagtatatagctaaaaatcgcctgatgaaagccccgaattattttaagttgtggatgtcgggcgagaaggatgatgagatgatatctatcaatgaaaagttggagacactcatagaggagatgtccaatacgaagtctgtgactttgctgaacacattaaacaattatccgattatttccgtttctgctcatatacgcccgttccacacctattggctgaatctggctgccggggttattttccctataggattattcttttatttccgtatctgggcattccgtgtccggttggcgaaagatatggaacggataataaaaaacaatgaacaaattcaattcatcatacagaatattaataaataagtgttatggaagagattaaaatggatagaatagaagatgcgattgccgatttcaaagaaggcaagtttgtcattgtagtggatgatgaagatcgtgaaaacgaaggtgatttaatcatagctgccgaaaagataactcctgagaaagttaactttatgttgaaacatgcgcgtggtgtgctctgtgcgcctatcacggtgtcgcgttgtaaagaactggatttgccgcatcaggtcagtgataatacttctgtattgggcactccttttacagtgacaattgacaaactggaaggttgtagtaccggagtttctgcttccgaccgtgctgccactattcaggcgttggccgatcctgcttctacaccggctactttcggacgtcccggacatattaatccgctgtatgcacaggaaaaaggagtacttcgtcgtgccggacatacagaagctaccatcgatatggcacgccttgccggactttaccctgcaggtgctctgatggaaataatgagcgatgacggtacgatggcacgtctgccggaacttcgtgcaatggccgatgaacatggactgaaactgatttccattcatgacttgattgcttatcgtctgaaacaggagtcaatcgtagaaaaaggcgttgaggtaaatatgccgaccgaacatggtatgttccgtctgattcctttccgtcagaaatcgaatggactggagcatatggctatatttaaaggtacatggaatgaagacgaacctatcttggtgcgtgtccattcatcttgcgctactggtgatattcttggctcacaccgttgtgactgtggcgagcaactgcataaagcgatggaaatgattgaaaaagaaggaaaaggtgtggtggtttatctgaatcaggaaggccgtggtatcggtttgatggaaaagatgaaagcatataaacttcaggaagacggtatggataccgttgacgccaacctttgcttaggacacctggcagacgaacgcgactatggagtaggagcccagattctgcgtgaactgggagtgcacaaaatgaaacttctgacaaataatcccgtgaaacgtgtagggctggaagcctatggactggaaattgtagaaaatgtacctgttgaaacagttcctaatccatataatgagcgatatctgagaacaaagaaagaaagaatgggacatacattacattttaataagtaaaatgccattttgttttcatatatcgaatattatcgcttattttgcaacgaatttcactcaacaacaataaaatagatacaaaatgaatcaattatcagatcgtttgaacagcttgtcgccgtcggcgacgcttgccatgtcgcaaaagagcaacgaactcaaagcgcagggtattgatgttattaacttaagtgtaggagaaccggatttcaatactcctgaccacatcaaagaagctgcgaagaaagccattgatgataacttttctcgctactctccggtaccgggttatccggctttacgcaatgcgattgttgagaagctgaaaaaagagaacggtcttgaatatactgctgctcagatttcttgtgccaatggtgcaaagcaatctgtatgtaatgcgatcctggtattggtaaatccgggtgatgaagtaattgtaccggctccttactgggtgagctatccggaaatggtgaagatggcagaaggtactcctgtcattgtttctgccggcatcgaacaagatttcaaaattactccgaaacaactggaagcagctattactccgaaaacaaaagcattgattctttgttctccgtccaaccccacaggttctgtttacagcaaagaagaactggctggactggcagccgtgctggctaagtatccgcaagtagtggtaattgctgacgagatttacgaacatatcaattatatcggtgcacatcagagcattgctcagttcccggaaatgaaagaacgtacagtgatcgtgaacggtgtatccaaagcctatgcgatgactggatggagaatcggtttcattgctggtccggaatggattgtgaaagcttgtaacaagcttcagggacaatacacttcgggtccttgctcggtatctcagaaagctgccgaggctgcttacgtaggtacacaagaaccggtgaaagaaatgcagaaggcatttgaacgtcgtcgtgacctgatcgtgaagttggctaaagaagtgccgggtttcgaagtaaacgtaccgcaaggtgctttctatctgttcccgaaatgtagctacttcttcggcaagagcaacggcgaacgtaaaattgaaaactcggacgacttggcaatgtacctgctcgaagatgctcatgtagcttgtgtaggcggtacttcctttggtgctcctgaatgtattcgtatgagctacgctacaagtgatgagaacattgtagaagctatccgtcgaatcaaggaagcattggctaaattgaaataagcaatcttagagaatatagaacggtaggctatctcctgaaaaagaaagtctaccgtttttttatgtaatttccttttgtccgtagcgataaaataaaaaaggctgccttccgtagaaagcagcctatacttttttgtcgattgtattattcagccgggtgaatagcttcagacgggcaaacgtctgcgcaagttccacagtcagtacatacatctgggttgatagaatagatatcaccttcagagatagcttctaccggacactcgtcgatacaagttccgcaagcaatacaatcgtcactaattacgtaagccatttttttaagatttaaattattagtactaattcgttcggcaaaaataaagcttttattcattacttggtatgcttctttgattaaattgacttaatttgtacgtcttctaaataagcaacctccctattatgtgctatatttttcgtatttttgcagccaaattactaatatatagcgattatgcctttaaatttacccgataagcttcctgcaatagaattattgaaggaagagaatattttcgtaattgatacttcgcgtgctacgcaacaggatattcgtccgttgcggattgtgattctgaacctgatgccgttgaagattacaacggaaacagacttggtgcggctgctctcgaatacgcctctccaggtagaaatctcgtttatgaagatcaagagtcatacatccaagaatacgccgatagaacatatgcaaacgttctataccgacttcgagcaaatgcgtaacgagaaatacgacggcatgatcatcaccggtgctcctgtggaacagatggacttcgaggaggtgacttattgggaggaaattactgaaatatttgattgggcacgtacgcacgtgacgtctaccttatatatatgctgggctgcgcaagccggactgtatcatcactacggagttcccaagtatccactggaccagaaaatgttcggtatcttcgaacatcgggtgctggaacctttccattctattttccgcggatttgacgattgcttctatgtgccgcatagccgccatacggaagtacgcagggaagatatcctcaaagtgccggaactgacattgctttccgaatcgaaagatgcgggcgtttatatggctatggcacgtggcggacgtgagttcttcgtgaccggacactcggaatactctccctataccttggatacggaatatcgtcgtgatctgggtaaaggactgccgatcgaaattccccgtaactattacgtagatgatgatccggacaaaggtccgttggtccgttggcgcgctcatgccaaccttttgttctccaactggctgaactactttgtttatcaggaaacgccttacaacattaatgatattgaatgatcaagcagcgtaaaatagaacttctcgccccggcgaagaatctggaatgtggtatcgaagctatcaatcacggagcagatgccgtatatatcggtgcacctaaatttggcgcccgtgcagcggctgtgaattctttggaagatatcgaagcgttggtaaaacatgctcacttgtataatgcccgtatctatgtcacagtcaatacgattctgaaagaagaagagttgaaagagacggaggagatgatccatgccctgtatcgggttggcgtggatgccctgattgtgcaggatatgggaatcacgaaactgaatcttccgccgatacctcttcatgccagtacgcagatggacaatcggacaccggaaaaggtgaagttcctttgggaagcgggtttccgtcaggttgttctggcacgggaactgtcgattcgtgaaataaggaagatacacgaaatttgtcccgaagttccgctggaagtatttgtacacggggcgctttgcgtaagctatagcggtcagtgctacgttagtcaggcttgtttcgggcgcagtgcgaatcggggagagtgtgcgcagttttgccgcttgcctttcagtcttgtcgattcggaaggaaaagtgattgtgaaagacaagcacttgctctctttgaaagatatgaatcagagtgatgaactggaacggttgctggatgccggagcttcctcattcaaaatagaaggacgtctgaaagatgtgtcttatgtgaagaatgtaacggctgcctatcgtcagaaactagatgctatctttgcccgccgaccggaatatgtgcgcgcttcttccggcacttgccgtttcgattttaaaccgcagctggacaagagtttcagtcgtggatttactcattacttcctgcatggacgcagtgaggatattttttcttttgatactccgaaatcattgggagaggagatgggtacaatgaaagaagcccgtggcaactttctgaccgttgccggactgaaatcatttaataacggagacggtgtctgctatattgatgaacagggacgtttgcagggattccggattaatcgggtggatggaaacaaactttatcctcaggaaatgccccgcatcaagccccgtaccaagctctatcgcaacttcgatcaggagtttgaacgcatactttcccgcaagtcggccgaacggaagattgccgttaacatactgcttgcagacaacaacttcggtttctctctgacactgacggatgaggacgataacagcgttacgctcactctgcctcgtgagaaagagccggctcggactccacaggctgataacttgaagacgcagcttgctaaattgggaaacacgcctttcgaagcggaaaagatcgaaatctccttctcggagaattggttcttaccggcttctgttttggcggatttccgtcgtcaggcgatagaaaagctgattgctgtccgacgtatcaattatcgtcaggaactggctgtctggaagccgacttcacatgattatccgcaggctgcacttacttatttgggaaacgtgatgaacacccgtgcagcttctttttatcgggaacatggagtgcagcaagtggctgaggcttatgaaaaggaacgggtggaagatgccgtgctgatgttctgcaaacactgcctgcgttatagcatgggctggtgccctatccatcagcgagtgcgctcgccttataaagagccctattatctggtatcgaatgacggaaaacgtttccgccttgaattcgattgcaaaaactgtcaaatgaaagtaaaagcggcacaatgaaacgattccccggcagagatatgcggagtttaacggagcttgttctcggcagagataagtttcgtacagctttgtgctgttctgtcgtggggatgttgctgactctgctgttcctttcatcctgtcactatacgcgtcccgatcttacttccgaggaactgtcggagaagacaaaagattctctgaactatctttatgaccggcattatacctggaatacgaatctggaagtaaccaccgactcggtaacaatggagtgcctgcccatcaaggacacctacatcgcattgtataaaggagatcgggtggttgttgccgagtttgccattcaccctgccgatagtgtggacagtgtctgggtaaagctggcgcatacacaagaggagcaggggtggatacgtgaaacagaattgaaagaatcgtttgtgccgacggacagtatttcgcaggctatccattttttcagtgatacgcatgcttcttatttcatgattatcttcgcgttgtttgttggagtctatctgtttcgcgctttccgtcggaagcagttgcagctggtctattttaatgatattgacagtgtctatccgttgtttctttgcctgttgatggctttcagtgcgacggtttacgaatcaatgcaggtctttgtgccggatacgtgggaacatttctatttcaatcccaccttatcgccttttaaagtgccttttatactttcagtctttttgttgagcatctggttgtttctgattgtcgctttggcggtgcttgatgacctgttccggcagttgactcccgccgctgcggtcttttatctgctgggactgatgtccagttgtattttctgctatttcttctttatcctgatgacacatatttatatcggttatttgttccttgcattctttatctgggtttttgcgaagaaggtgcatcggaatatcagctataagtatcgttgcggacattgtggggagaagttgaaggagaaaggtatttgcccccattgcggagcgattaatgaataatcttttatatcttgtttttatattcaaatcatacttctgaatgatggaaatcagacttaccgaattgaaagatctccctttggtgatggagatttatgattatgcccgtgcttttatgcgtgccaatgggaatgcaacccaatggattgacggctatccgtccgaatcatttatccgtcaggagatagaagacggtcatagctttgtctgtacggacgaacaaggggaaatattgggaactttctgctttatattaggcgaagatcctacttatctgaatatttatgaaggtgcatggcttaatgacgaaccttacggtgtcatccaccggatggctaccagcggtaaaaggaaaggcgtatcggaagcctgtctgaactggtgctttgaacattttgagaatatccgtgtggatacacatcgggataacaaagttatgcagcatattctggcgaaatacggctttcagcgctgtggcatcatctatgtcaagaacgggacagagcgcattgcttatcaaagaatactttaattgtgcgctacctttctcatgcagtctgttcatagataagttgttagtccatatagatcaagcatcagtattatatggagcaagcgttggtttcctcggaggaaacgccagttccctttaaaaggaacggtcgtttccattaaaaggaacggccgttccctcaccgggaaacgacagtttccattgcaggaaatgataggaaactataagttgttgagatctagttatatagagttctgttggcaatgttatagagttcatgttcatgcccgtacggttttgagctaaatgatagtcagctgaccattcagcagatcagcgaacagctgaacttctcgaatcaatcattcttcgggaagttctttaagcgctgtgctggtatgtctccaaaggactatatgaacagttgatctgttatttcttagaatcggcagcggaggtctattccgaattgtacgggacgtcctttctgcataaatcctttgttcatcgtttcaaagtagaaggctgcatagtctttgtccaggaagttacgtgcccagaagctgatcattgcattccctttttcaagatttgcacgccagttcagtgtgccgtaaaaagattggctaacatcattcagttccgtccagtagatgcgtccggcagcattgtagtttgcttggaatacaacacggtcgaagatggaacgggagctacaggtgatggcgtattctcctccgatattaagcgtatgcttggggacgaagggaacatatttgccgttgtagtcagcttttactgttaggttgccatctttgtctgcttcatttataatatagtcggtaaaggtggcgtacgtatatccgtaacttgcgttcagacttagttcgttggtcaggctggcgcggagggatgcttctgcaccgtagctgttgcttttgcctgcattgattgtggtacgtccaagaccgctgccgataaattgagagagttgctggtcacgggtatccatatagaaagctgcaaggtcggcccagagttttccttcccacaaagtgagatgagtacccacctcataattccatgaatattccggtttataggtggttgcatcttttacttcgggtatagcaggcattttgtctcctatcattccttcaatcaatgtgctgtatttttcgaactccgcactttttttaatggcttctaccatcgagtgcgcctgttgcccagtgattatatcagagaacatttggacattatagcctcccgaacggtaacccttggatactgtagcgtaaacgttattgccttttctccattcgtattgtaaggcaaacttgggtaataattggacataatcttcagatagtttaccattgtaggcagcatctgctatcaggtctttggcggtaataaccatagggcccatggcaaagttgaagtcgaagttgagtgggtcgcttgccgaattgtacttcatactcatcttttcgtagtccagacgaagacctacagtgaaggatagtcctttggtaaaaaggttattgaaggttgattgatgaaaaatggctccgttccatattggagtatcaaagttgccactgacttttaacgtagggttaagaacactcatgctcatcttaggtgctttattccctaaattttcaaagatgctgttggtatttccttcaatagtttcttttaccccgtcttctttgaaggtaaccggaccgtctgtattcaatgtctgatagaatccaaagatacctgttgtccattcccacttacggttgggcttcgatttaagcacaatttcttctgaaatagtatttagtttctgcttctgggtaagattgaatatgttcttttcagtaaagtcctggtcgagaaacattcggtctttcagatgctgataaccggtaacagcgcttaggatgaaattcttggcttgatattcgacattaaatcctgcattcagcaggttacggtagtagttgcttctatcattatatgcaatctttccgatcatttcttcccgttcttcagtctttcccttgttgacgccttcctgggtgatgcctgtgtaaaagtaaggatatcctccttggtcactatattcgtagctgacattcaagtctagtttaaggttatctttcggcagataaatacctctgaaccgtccacctcctgcattgcctttgtctacccgttcattattgcgtgcagagttttgatagaatcctccggtatgttcgtagaatcctccggtagaaaaggcgaattggtcggatatacggtggtaatgtgttaacgatacattgtagtcattataagttgctgctcccatacggatatctgtaccttgatatgtgaaaggtgacttggtgtgtaccttgatcagcccgcccattgtattacgtccatacaaagttccttgcggaccgcggagtacatcaatacgttctatgtcggagtagttgaaatcgaaagctgatttatcaatatagggtatgttgtctacatagagtccgatagccggtgtgttgatacgtgaaccaatcccccgaatatagatagaagtagtcagctttgatccatactccggaatgaaaatattcggaatgagtccggataatcttttcacggagttcacttggttagcctgcatgtctttctgtgacaatacagttgtagctgccggcagctcacgtagtttccggttttctttcggagtggcgatcactaccacttcttcgatgtctactactttaagagaatctttagggaaatcttcagcccatgttgttcctgtcgtcaggagtgtgagggcaatcataatattctttgttttcattcgcagttaatttgtctggtgcaaagtaacggcaaatatataaggtaggcaatcctcatttattaggattatgcctcatattttaagaaatcagattcggtccgcctctatgtatccgttcattacggcatagatggttaatcctgatacagacttgattccaagtttttccgtgatgtttttcctgtgggtgatgacggtagtcagactgatattcagtttgtcggcaatttctttgttgattaatcctttggtaatcagaaccagtacttctatctcacgggcagataagatttcctgatgtacctccggcatggcaatcgggggcatatcttttacaggatagccgttgtggtgtgcatgttgatgaagcttcaaaagacttttcaccagtttctcttcgggttcgtagatattgagtacaggcacacccgacagttggaattgcgggctgtcactggccagcacaattgttttccgctttcgggggaggaagaaggcattgtgttcaacatagatttgcgccgagatgaagtaatgggcatacatgtccggggtatcatccattagttcactgaaactatggaaagtacggatagttgccattggaataatttcttccaatatacttttcagtccgagacaagtgagggtattggactcgataatggctatttcaggtttgtagttcatttgaccgtagaatatttattaatgattgatataattagctaccgcttccgcacaccgttctccatcgactcctgccgaaacaattccacctgcataccctgcaccttctccgcagggaaacagtccgcgaacagtgacgtgctgtaacgtctccttatcccgtacgatgcggactggcgaagaagtgcgggtttccacaccaatcatcaccgcttcattcgtaaggaaaccgtgactggtacgcccaaactgctgaaaaccgagagataatcttttgctgataaaatccggcatccaaaaatgaagcggagaagaaatcagccccggactgtaggaagattccggtaaatcaaaacttaatttcttgcgagtaaagtccagcatacgttgcgccggtgccgtttggcgcctgccaccctgcaaccagcattgacgttccaactcctcctgaaagtgaaggggagtaagttgagtcttgagagttgagagctgagaattgctcagcaatggattaatggctaataactgcgcattttgttgcgcagccaactctccactctccattttcaactctccacttataaaatcttccggttgaatctctaccaccattcctgagttactccaacgcgatccgcggttagaaggagacattccgtttactacaacttgttccggtccgctggcggcaggaacaatgaaaccgccgggacacatacagaagctataaactcctctgccttcagcttgtgtcacgaagctgtattcggcagcaggaaggtatttcccccgcccgttcttattgtggtattgtatctggtcgatcagcatagccggatgttccagccggacaccgacagcgattcctttggcttctatcgtaacaccgtttgcagccagccagcgatatacatcccttgcggaatgtccggttgccagtatcacaggaccgagaaaagtctttcctgtgttggtttcaatacctttgatttcgttgttctcaataatcagtgcatccattctggtctgaaaatgcacctctccaccacactcgataatcgtattccgcatattctcaatgacacgcgggagtttgtctgtcccaatgtgaggatgggcatcggccagtatagccgcagaagctccgtgctgacagaatacattcagtatcttgtctatatttcctcttttcttgctacgggtgtaaagttttccatccgaataggctcctgcgcctccttcgccaaaactatagttcgattccggatctacggtatgttctctgctgatttgtgccagatcttttttccgttcgcgcacatcttttcctctttctacgataatcggacgtagtccgagttcgatgaggcgtaaggcggcaaacagtccgccgggaccggcaccgactacgataacctgtggcttgccttccacattattatatatagtgcgttcgaattcatcctccttgggcatctcattaatgtatgcccgtactttcaggttgacaaagatagtccgttgacgtgcatcgatgctccgtttcagtattcgggtagcagtgatattacgcaggttaatgcctttttctttagatatatattctttcagtcgctgttcgtttgctgcgatttcgggaaggatgcggagttggtattcttgtgtcatggatttatattaatttaaacttatccgaagagtgctctgaatgcctcttctacctttcttacaggtactaattctatttttagtttttgggtgtcaatcccttgcagattatacttaggaagcaggaaccgtttgaatcctaacttttccgcttctccgattcgctgctctattcgattcacggggcgtatctctcccgacagaccgatttctcctgccatacagacttccggttcgacagccgcatccatattggaagaaaggatggcactgatcactgccaggtcaatagccggatcattcaccttcaatcctccggcaatattcagaaacacatctttctgcgcaagcttgaagcctacgcgcttttcgaggacagccagaagcatattcattctccgtatatcaaagccggttgccgaccgttgaggatttccatagacggcagaacttaccaaagcctgtgtctcaatcaggaacgggcgtactccctcgatagcagaagcaatcgctactccgctcatcccttcatgatcctgacttaacagcaactccgaaggattgctgacctgacgtaatccgtcctgacgcatttcgtaaatacctagttcggcagtacttccgaatcggttcttgatgcttcgcagaatacggtacatataatgctggtctccttcaaactggagaactgtatctacaatatgctccagtacctttgggcctgcaatactgccttctttatttatatgtccgattagcaggaccggcgtatgcgtttccttggcaaaacggagaatcgatgccgaacattcccttacctgggcaatgcttccgggagatgattctatattttctgtggaaatagtctgtatggagtcgataatgaccaggtcgggactggtgttcttgatatgcacgtaaatctgttcaagtgaagtctcacaaacgatcagacagtcgctggagacttccgaaaggcggtcggcgcgtagtttcagctgtcgtgcgctctcttcaccggatacatagagaatcttcttgtccggcatacgcaagacagtctgcatgacgagtgtcgattttccgattcccggttcgccgccgatcaaaaccagagagccgggcacaagtcctccgcccaatacacgattcagttcgtcgtcgtgcatattgatgcgcggctcatcatcggcttctatttcgctgaggataacaggtttcgctttctgcgtctcgatgcccgataccggacggcggttggtcgtttctttccgtacgatttcttctacatacgtattccattctccgcacgacggacacttacccacccatttgggtgattcctgtccgcagttactgcatacatatacggttttttcttttgccattttctttttcctttaatataagaacccgaatgcccataacggaattttgtttcctgctgaatattctatatcatctgcggctataaatgcctttttgctgccagctatctgttttccgtccttactttttccgccaacttctatcgtgtatttgctgtctatcgtgtagtctgcactacgtgtacagtattctactctatgcagataagaaagttggttcaccataaatacttctctcaatgtgcctttgttcacatccttgaaagtcagcgcataaagtaaattggtattttccatgtatatcttatccggtttttgtagctttttgatagagtcattgtccgaataaagaagatgaattaacttggctctgtccaaatattgcagataggccagaatggtggtacgcgagagttctgccagggcagagagcttagtgatatccaccataaacggaacttcggaggaaaggatgcctaacaggcttttcaatttccgtacattactgatatctactccgcattgttggggaagttcaatctcaagtatcaaattcgttatattctcgattcgtgtataatactctgcatttccttccagataaaaaggataatacccatgtttcagataatcctcaaaatgagccagtggtctgcactgagagttgacctcattgcaaattccgtcactgctctccaagatctcttccaatgtatagggacggatatgaatctgatgaaatagctttagatattcacggtaagagagtccttgcatattgtatgatatgcatcggcgtgacaaatctgcttctgcattcagaagttgaagtaaggaggagcctgtgaatactattttcagttcgggaaactcgtcatatatatttttaatctccttgctccaggatggatatttatgtacttcatccagaaagagacattttcctcctttcagataaaactgttcagccaattcgctaagcgtatgttgagtgaaatacagactatccaggcttgtgtataaagcgctctgactatcgtttgcataatgaagtttcaggtactgaagcattaaagtcgtttttccgactccacgtgctccgcggatggcaatcagtcggttatcccaattgattgtatccattaagctcctgatataagtagtggaagtggctgttagtaaccttttatatcttctgattagtgtatccatatccttatttgttttctatggaatacaaaaataggcataatttgttcaacgcgcaaaacaaattcggataaaatttgttcaatgcattaaacaaaaggtccttataaagtgatctcaccagctatcgaccgattcatacaatcacgaacctcatccggagtatatccgtgtcccaataagaacatcaatttagtcacggccgactctgtcgtactgtcatatccggagaccactcctgcctgtagcagctggtaccctgtttcgtaacgttccatctccaccattccggcattgcattgggttacattgacaatgacaatcccctgcgcactggcctgacaaagcctgcggataaaccattcctttcggggagcattgccggaaccatacgtttcgagtacgaccgcttttaatcctttggtccctaacatcgtagctattacattctcctgaatgccggggaataacttgagaaccacgatgttcgtatccaataaataatgtggcactaactcctgcttgcttttgttgacatgaatctgtgcctgattatatttaatgtgaatacccgcttccgccaataccggataattgaatgaacggaatgcgttgaagttttcggcgttcatctttgtcgtacggtttcccctcatcagatgattctcaaagaagatacagacttccggaacgagtgctttcccgtccttatcctgtgcggcggcaatttcgatacttgtcatcaggttttcctttccgtccgtgcggagcacccctatcgggagttgggaacccgtaaggatcacaggtttgtccagtccttccagcataaaactcagggcggaggctgtataagccatcgtatccgttccgtgcaaaatgacgaagccatgatagagatcatagttctcatgaataatgtgtaccagctttctccacatatcgggttccatgtccgaagagtccatcggagggtcaaactgataagtatcaatcgggaagttgaatttttgcaattcggggatatgcctttggagttgctcgaagttgaagttctccaatgcgcctgttgcggtgttttcaatcattccaattgttccaccggtgtatattaacaatacggaagtatttaacggggtcatatgctggttttatgctgttgtttttgcaaatataataatataaacgatatataaatagcaaaatgtcataaaagtggaggacttttatgggaggaaaaagagacgggatgttctttttatcagaaaaaaaccgaaaaaagtgatagattgaacgtttttattattacttttgcgacacttatcaaaaacaatggtagaaacagagactatgatgaagtactatccacatacagtcacatccatgtgtaccatgaccctttggggttaatggatagtatttgtgtatctacgtgattcacgcctgtgtaagtaggcaaaactcaaatttaattttttcgtaaacaaccaatcaccctgtaataactatactcgaggggattgtatttaaatatgtatcttcatgaaagtaatgaaattcggcggaacgtccgtaggttccgtgaacagcattttaagtgtaaagagaattgtagagtcggccggcgagccggtaattgtagttgtttccgcgttagggggcatcactgacaaattgattaatacatcgaagatggcggcagccggagattcggcctacgaaggagagttccgcgaaatcgtctatcgtcatgtggagatgattaaagaagtgatacctgccggagcagggcaagtggcattgcaacgtcagattggcgaattgctgaatgagttgaaagacattttccagggtatctatctgatcagagacctttccccgaaaacatcggataccattgtcagctatggcgaacgtctttcgtccatcatcgttgccgaactgatcgatgaggcaaaatggtttgattcacgtacttttatcaagactgaaaagaagcataataaacatacgattgatgccgatctgactaatcagttggtaaaagaggctttccattccattccgaaagtgtcgttggttcccggatttatttcttcggataaggtgtcgggagacgtaacgaatctcggtcgtggtggttcggattatacggctgccattattgccgcagcgctcgatgccagcagtctggagatatggaccgatgtagacggctttatgactgccgatccgcgtgtgatctcaacagcttatactatttccgaactgagctatgtagaagcaaccgaactctgtaacttcggtgcgaaagttgtttatccgccgacgatctatccggtatgtcataagaatattcctattataataaagaatacgttcaatcctgacggagtgggaacagttatcaagcaagagacttccaatccgcagagtaaggccattaaaggtatttcctctatcaatgatacgagtctgatcactgttcaggggctgggtatggtaggtgtgatcggtgtaaactaccgtatcttcaaggctttggcaaagaatggaatcagtgtattccttgtttcgcaggcttcatcagagaacagtacctctatcggtgttcggaacgctgatgccgatctggcttgtgaagtgctgaatgaagaatttgcgaaagagatcgagatgggagagatttctccgatccttgcagagagaaatctggctacggtggcaatcgttggcgagaatatgaagcatacaccgggtatagcagggaagctcttcggtacactgggacgtaatggtatcaatgtaatcgcttgtgcgcagggagcttcggaaaccaacatttcttttgttgtcgattccaagtcattgcgtaaatctctgaacgttatccatgactctttcttcctgtccgaatatcaggtattgaatctctttatctgtggtatcggtacggttggcggcagtctggtagaacagattcgttgccagcaacagaaactgatgatggagaacggattgaagttgcacgtcgtaggtatcatcgatgctgcgaaagccatgttcagtcgtgagggatttgaccttgccaatttccgtgaggagttgcagaagaaaggcaaggatagtaacttgcagacgatccgtgacgaaatagtcggaatgaatatcttcaactccgtattcgtggattgtacggcaagccccgacattgcatcactttacaaagaccttttacagcacaacgtttccgtagtggcagccaataagatcgctgcgtcttcggcttacgagaactatcgcgaactgaaaacgattgcccgtcaacggggtgtgaagtacttgtttgaaacaaacgtaggtgcgggactgccgattatcaataccatcaacgacctgattcacagtggtgataagatactgaagattgaagctgtactttcgggtacattgaactatatctttaataagatcagcgctgacattcctttcagccgcacgatcaagatggcacaggaagaacgctattccgaaccggacccgcgtatcgacctgagcggaaaagacgtgatccgcaaactggtgattctggcacgtgaagccggatatcacatcgagcaggaagacgtagaaaagaatctctttgtcccgaacgacttcttcgaaggttcgctggatgacttctggaaacgagtgccgagcctcgacgcagacttcgaagcccgtcgtcaggtattggagaaagaacataaacattggcgctttgttgccaaactggaagacggaaaagcctctgtcggcctgcaggaagtgggtgccaaccatccgttctacggactggaaggcagcaacaacatcatcttgctgactacggaacgctataaagaatatccgatgatgattcaaggatacggtgccggtgccggagtaacggctgcgggagtattcgctgatatcatgagtatcgcaaacgtttaaataagggttattaaaatgaagcatattatcatactgggagatggaatggccgactggccagtgaagtcattgggggacaagacgctcctgcaatatgcgaagacgccttatatggataagttagcccgcatgggacgcaatggacgtttgataactgttgccgaaggtttccatccgggtagtgaggttgccaacatgtccgtgttgggatataatcttccgaaagtgtacgaaggacgcgggccgctcgaagcagccagtatcggtgtagacctgaaaccgggagaaatggcgatgcgttgtaatctgatttgtgtggaaggagagattctgaagaatcactcttccggacatatatctacggaagaagcggatgtactgatccagtatctgcaagagaagctggggaatgaccgcgtacgcttccatacaggagttcagtatcgtcatctgcttgttatcaagggggggaataaagaactggattgcacccctccgcacgatgtcccgttgaaacctttccgcccgttaatggtgaaacccttagtgccggaagcgcaggaaacggcggaccttatcaatgatcttattcttaaatcacaggaactgctgaagaaccatccgttgaatctgaaacggatgtcggaaggcaaggaccctgcaaacagcatctggccctggagtcccggctatcgtccgcagatgcctgctttctccgaaacctttccgcaagtaaagaaaggagcagttatttcggctgtcgacttgattaacggaatcggatattatgccggcttacgccgtattgcggtagagggagccaccggactgtataatacaaattatgagaataaagtagctgccgctctggaagcactgaagacggacgatttcgtttatcttcatatcgaggccagtgatgaggcgggacacgaaggagatatcgacctgaaactcctgacgatagagaacctcgacaaacgtgctgtaggtcctatctacgaagcagtgaaggactgggacgagcctgtggcgattgccgtattgcccgaccatcctactccctgcgaacttcgcacccatacttccgaccctataccgttccttatctggtatccgggcatcgaaccggatgaagtgcagacgtatgacgagatatcggcttgcgatggcagttacggtgtgctgaaagaagatgagtttataaaagaatttatgaatcaaaagaatatccaatgaaatactatagtacaaataaacaagcgccgatggcttctttgcaggaggctgtagtaaaagggcttgccgccgacagaggacttttcatgccaatgactatcaagcctcttccccaagaattttacgatacgatagatactttgtcttttcaggagattgcttatcgggtagccgatgctttctttggcgaagacatccccaccgatacactgaaacaaatagtgtatgacacattgagctttgatgtaccgttggtgaaagtggcggacaacatctattctctggaacttttccacggaccgactctggctttcaaagatgtaggcggccgttttatggcacgtttgctgggttacttcatcaagaaagaagggcagaaggatgtgaatgtgctggtagcgacttccggtgatacgggaagtgccgttgccaacggttttctgggtgtggaaggtattcatgtatatgtactttacccgaaaggaaaagtcagcgaaatacaggaaaagcagttcactactttgggacagaatattaccgctctcgaagtggacggaacgtttgatgattgccaggcactggtaaaagctgctttcatggataaggaactgaatgaacatctgtcactgacttccgccaattctatcaatgtagcccgcttcctgccgcaagcattctattatttctatgcttatgcacagctgaaacgtgccggaaaagccgataatgccgtgatttgtgttcctagcggaaacttcggaaacatcacagccggattgttcggcaaaaagatgggcttgcctgtcaaacgttttattgctgccaacaatcgcaacgatatattctatcaatacctgcaaacaggtaaatataatccccgcccatccgttgcaaccatagccaacgctatggacgtaggtgatccgagcaactttgcccgtgtgcttgacttgtatggcggttctcatgctgacatttctgctgagatttcgggaactacatataccgacgaacagattcgcgaaacggtgaaagaaacctggaaggaacatcattacctgctcgatcctcatggagcttgcggttatcgcgctttgcaagaaggactgaaacaaggcgaaacgggagtcttccttgaaactgctcatcctgctaaattcctggaaactgtagaaagtatcattggcgaagcggtagaaatacctgccaagttgcaggaatttatgaaaggggagaaaaagagcttgcaaatgacgaaagaatttgcagacttcaagaagtatttgctttctgtttgattgggttttaaagcaaggtgtaaaagaaataattatgcaagatatagtaaacggacgctgtggttggtgtggaaccgacgaactgtatgtgaaatatcatgatcaggagtggggaaatttggtcactgacgacaagacgctgtttgagtttcttgtgctggaaagtgcccaggcggggttgagctggataaccatcctcagaaaacgggagggttatcgcaaagccttttgcgattttgatgccgaacgggtggcacagatgactgatgaagatgtagaacggttaatgcactttgaaggcattgtgaaaaaccgtctgaaaattaaatcgaccattaccaacgctaggcaatttcttgctatacaaaaggagttcggtagtttttacgactacactctctcattctttcccgacagaaagcctattgtcaataccttttgttcattgagcgagattccggcatcttctcccgaatccgatgcaatgagtaaggacatgaaaaagcgcggattcaaattctttggaacgacgatttgttatgctcacttacaggcttcgggatttatcaacgatcacttgaaggattgtatttgccggaaaaaataaatgacgtgcggaaataattcaaatctgtttaggaatgaactaaacagtagtacacaatagtaactccattctcctccttcgggaaggaggagtacccgtaggggggggtggtaggtgaatacataatcctgtcatttacaaagaaataggtataaacattatttctcctaccacctcggtctgcgaccact

SEQ ID NO: 78 - DNA, 34585 bp, Bacteroides thetaiotaomicron
attctataaactgctgcatttaacttataaacgggagaaaaaaagaatcaaacctatatatcatattaagacctgaaacctgaacttgacaagtggggagaaattagagagagagagtattttacaaacgtccccaaaaacgagaacccctgccgactgtagaagccggcaggggtttatttttactactaaggagtccgaaaagaaagtaagacgttattctttccaagcacctccgcttatttacaatatttttttataagttcatccacattcggatcacccagttccttcgctttattgaagtttccgcaagcttcgtccgtcttcttcaactgtatctgacaaaggcccaacaaccggtatgcttccccatatttcggctcgtctttcagaatttcattcagtatcttcatggattcttcgtaacgtcctacacgcagattaaccactgcatgttctgcccgataagtcaaatctttggggctcaattcaaccgctttcacgatatcatccaatgcacgctgatattgacgggctttcagcgcagcctgctcacgataataatagaaaaggtcattgacctgtccgttcacagccttataataagcatcataatcgagcattgcatttcttgcctgatcgttgttcatatatatctgtgcacgttccagcagataaggagcaaaatttgccgtgacaggctgcggacaacgagcaatgcaactgtccatcaatgccaacacttctttggcatctgccttcagcaattctttcgtcttggcggcactaaagaatgaggctgctgaagccagattgctggcattcaccttctcataagcggccaaagcgcctgcatagtcctgctgtgcaaaaagtatatctccttccaactgcgtataaacgggcaaaggatcgatagccatcgcctgacggagatttttcaaagccgtatcatacgtccagtctttataagtcgtttccggttttgaaagctgataaccgtatatcagcttggcgatattataatacacatcatcctttttagccgccaccttcaaggcttgattaaagtcggctacagccttgtcaaaataagactggtcatccttaccttttgctacgtaatagttggcacggcggatatatccatcggtactgctggggaactggcgaatgaaatcgtccagcaatttctcatattcatcagccgacatctgcgtggaagccataaacagatacaccaatgcctgatcctccgcttcgggcaatcctttccggataccgatattcttcagagcaacgtctcccaaagacagagcactaatcttctgcgacattgcaaaagctgcccctgccgcataacaagtcgttaccgtatccacaccggaggacttctgtgaaataccgaacacctggccttccgcattcatcaccggacaactcaccatcttgtctttcatctgcatactcaaggtatagtaatggtattctccggcaatcttcgatacatccttcactttacccgaaacgcaggcaatgctcttctgcgtagaataaggaagcatccatgcgtcagcgcctgcagccggagcagtagtcgccactaccagtgacggcactttcttctcggtgatggccacacgaaacttgatcacatcgtacatatcatctgctcccaaaatcaggctgaccggcatttgcttgccttcggctgtgacaatcaccgcacgctcagcccctttgaaaagactgtagtcagaaagagccagtccgtcttcggatacgaaaaatccgtttccggtattcagcatcttgtcattcttatcataagttattactgagaaaacagcacgtttcgccttctccacccatttcggggtttgcgccagaccgctctgcaccaagaggaaaagcgctaaaggtaagattaaaagtttcttcatatcagtcgttgtttctttgtttcacagcttcataaatcaaaataccggcagctacggaaacattcagagattcgatggttcccagcatcggtatcttcacccattcgtcacagagagccagatgatcatatgatacaccggtgtcctccgctcccatgatgatacacatcggtcccgtataatcggctttcgtatagtcataatctcctttctcggtagcggcaacgatacggaaaccgctgtccttgagatactgcaaagtcgcacgcagattctgttcgcggcagacaggcaatgtatgcaacgcacctgcggaagtcttcatggcatcggcattcaccgatacgctgccacgcgcaggaataatcaccgcatccaccgcggcacattcgcaggtacgggctatcgcaccaaagttacgcacatccgttatgccatccagcatcacaaaaaacggattcttgccttgctcgaataagaaaggaacgaggtcttccgtcttctgataggtcacagaggaaatgaaggcaaccacaccctgatgattcttccgtgtgatgcggttgatacgttccaccggcacacgctgaacaggaatcagcaatcctttcaatgctgcgaaaagctctttggaaagatcactttgaatgtctttcttaacgagaatcttatcaatctcttttccagcctgaatggcctctatgacggcacggacgccgaaaatcatttcacttttatcggtcattgtaattttgaattataaattttgaattatggattatgaagtacgggccaacagggccttcgcattgctgagggcagcctcggtcaatgtggctccgctcagcatgtgagcgatctcctctacccgttcttcatcggtgagacggcggatatggctgttcgtttccgtatcgctgtccttcttatatactttataatgagcgcgcccgcgagctgcgatctgaggcagatgtgtgatactgatcacctgacggttgcagtcacccatttcctgcatcatatccgccatacggtcggctatttcaccggaaactccggtatcgatctcatcaaatacaatcgtaggcagtttcaccgcaccggcgatcatcgctttgatagaaagcatcacacgcgcaatttcacctccagaagcaacggaagatatgctttgcaacgttccgttcttgttggcggagaacaggaagttgacagtatcctccccctgtatgcccggttctttcttcaatcccatttccacttggaagcggacgttgggcatacccagcgggaccagccgttcagccagttgtttctccacttcacgggcggctgccgcacgggcttttgtcagcacggtggcttgcttcttcacccgttcatactgggcttccttgcgggcagtcagttcggctatgcgatcatcataagaggtgatctcggacaacttactgcgatattggtctgccaaggccatcaattcttcaagtgtctgtacccgatgcttctgttgcagggagtaaatcagattcagacgatcgttcacttcgtccagacgggtaggattaaactcgatggattctccctgcgctgagacttcctgcgaaatatctttcagttcgatgtaggcactttccatgcggtcgctcagttctccggcaggctgatacacctttctcagattattcagcgtattcagattatctttcaggaaagaaagcagtccgccttcgtccgagaaaaaagactgttcgatgcggtaaagccccgctttgatctcctcggcatgactcagagtttccgcctcctgctccagttcgctctgctccccttccaccagatgagcttcctccagttgttccagctggaaacgaagatagtcctcatccgtccggctttgctcggcaagtgccgtcagctcggacaattcacggtcgagcagcttccattcattatacagtaaatgatacttctccagcgcatcatcgttatgagccagaatatcgagtacattcagttggaaaccttctttattgagcaaaagattctgatgctgcgaatgtacatcgatcagttgttcgcccaattccttcacctgtgccagcgaagcaggcgtatcattaatgaatgcgcggcttttgccggacgcctgcacttcgcgccgcaggatacattcctcgtcgtcgtattccagttcgttctcttcaaaaaacgggcgcataccgtaagccgagatatcaaaacgtgcttcgataatacatttagaagctccacgacgaatcgctttcacatcggcacgctgtccgagcagcagaccgatggctcccagaataatcgattttccggcccccgtctcgcctgtgatgaccgagaagcctgtttcaaaaccgatatccagtttttctatcaatgcgtaattctgaatataaagtgaacgtaacaccttctgtaaattaaaaattaaacctaaaaaataaagatcagtgagtcaaaacggcaaccagatggttgatgatgtcttgcgctacttcctgtttgggcttcagaggataatcctcgcgacctttgcgatcaataatgctaatcttgtttgtatcgtgacggaagccggctcccgcatcattcagagagttgaggacgataaagtcaaagtttttacgttcgagctttccttcggcattctgctgttcgttatttgtttcgagggcaaaccccactaacagttgattgtcttctttgatctttcccagacttgcagcaatgtcctgcgtagcctgaagatgcaaggtcagttcttcttccttctcccgtttgatctttttgccggccaccgtttccgggcggaaatcggcgactgccgcacaaagaatccccacgtcggaagtcgggaaacaggtttgcgctgcctcatacatttcctgagcagattccacatctatccggtggatacgcgaatgctgcgttttcagttgcaccggtccggtgatcaatgtcacctctgccccacgacgggcacattcttccgccaaagcaaatcccatcttaccggaagaataattgccgataaaacggaccggatcgatcttttcgtaagtcggtccggcagttatcataattttccttccctgaagttcggcactcgcagagaaaaactcgtccagcactcggataatgttttccggttcttccatacgccctttaccgaccagatggctggcaagttcacccgttgcgggctcaatgatgcggttgccataggaacgcaatatatccagattcttctgtgtagaaggatgtgcatacatatcgaggtccatagccggtgcaatgaataccggagctttggccgaaagataagtggttatcagcatattgtctgctatcccgttcgccatctttccgatggtggaggcggtagcgggtgcgatcagcatggcatccgcccacagacccaagtccacatggctgttccacgtaccgtcccgttgggcaaaaaactcgctgatgaccggcttactggtcaaagccgaaagagtgaggggagtaataaattcttttcccgccggagtaatgaccacctgcacttccgctccctgctttatcagtccgcggataatgtaacaagccttataagcagcgatgctaccggttattccaagaattatcttttttccttttagcattattttgtaatcaaattactcatttcacgcagacggattttagtcagcaccgccttggtattcaacgtgaaatcactgtttaaaatccagctgtagtatccggggtctttcttcagtacctcggctacagacattcctttatattttccgaaattaaatacttccacaccattgtcgtcatacaccatccggccggcaaagtccacattcttagtgaaacttgaatattctgccaggaaggcgatgtcgttctgaagatccggatagcggtcgagctgtgctttcagcacctcataagtggcacgtgtatcggcctcggccgtatgggcgtcttccagactcttttcgcaatagaacttataggcagccgaaagggtacgttgctccatcttgtggaaaatcacctgtacatcgacaaacttgcgcttcgtcatatcgatatctacaccggcacgaagaaattcctctgccaataccggaatatcgaagcgattagagttgaatcctgccaaatcgcagccttcaatgtcacgggccacattctttgccacctccttgaaagtcggacagtccgctacatcggcatcataaatgccatgtacggcagaagaagcttcaggaatatgcatttcgggattgatacgcattgttttcgtttcctcattcccgttaggatatactttcagatagcaaatttcaacgatccggtctgtgttgatattggttcccgttgtctccagatcgaagaacacaatcgggtttttcaaatttaatttcatttctttctttaatggataatggataatggagaattgataatggataggaaacataaaaaatggataactcctgaccactgacagcgcagctcattatccattatccattctcaattatccattaaataattaattaatcgttcagcatcatcggcatcagcagcatcagcaagtcttcattttcttcctgttctaccggcacaatgactccggcacgcgacgggtcggcaagctcgattaccacttcatcggccgaaatattgttcaggatatcgatgaggaaagtagacttgaatccgatgctcatagcggcacccgaatattggcaaacttgtgtttcttcggcagaagtggagaaatcgatgtcctgtgcggaaatcacaatctgattctcctgcatacgcagtttgatcaaactgcttgcctgcgaagagaagatagacacgcggcgcaaagctccgatcagttgctgacggtctacagtcactttatgagggttgttctgcggaattaccgagttgtagttcggatagcgtccttcgatcagacggcagaccatgcggtagctttccagcataaacacagcgttgcgttcgtcaaattcgatggttactgttccctgttctttcggaagcaggtttttcagcaatgtagcgggcttcttcggaaggatgaacgcggcacgttcgtttcctttggcagccagcgttttgcaacgtaccagcttatgaccgtccgatgccaccatcgtgatgtcttctgttgtaatatcgaaatatataccgttcattaccggacggagttcgtcgtcggcagttgcgaataccgaacggttgatgccacccagcagtacacctgcttccatctccacgcggactgcattttcgcccagcacagccgactgcggaaattcgtcagcattctgtcccatcagactatattttccgttctgatactgcacggtgatttcataattgtccgtgttgacgtaaaatgtcaacggttgttccggaatttctttcagtgcatcaagcaatgttttcgctactacggcaaaacgcccgtttgtatcgctttcatttacctcaacggttgtcaccatggtcgtttcactgtcagaaacagtcacagacaatgttccgtcttccaattcgaagagaaaacaatcgagaataggcagcgcattctttgagttaattacacgactgatagcctgtaaatggctggaaagagcagtacttgaaacgataaatttcatatattttcgagtatttaagttttgaattatatatcgcacaaagttacgaaaaaagattcgtgctgcccaagaaaacgaaagaaaaaacaagcattgtgtgagggatattcctaaaaaattgtaacttcgccgcagaatttaaaattatcgcaatggaatttacaggaaaaatcatcgctatcctccctccgagaggtggagtctcaaagactagcggcaacgagtggaaatcacaagagttcgtaatcgaaaaccatgaccaatatccgcgcaaaatgtgtttcgacgtatttggcgccgacaaaatcgaacagttcaacattcagatgggcgaagaactgaccgtatcattcgacgttgacgcccgtcaatggaacgaccgttggttcaacagtatccgtgcatggaaagttgaacgtgtaggcgcaggtgctcctatgactccgggtgcccccgttcctcccccggctccgtctgctactccggatttcactatgggtgacgcaaaagacgacctgccgttctaagaattaaaaacaatctgcataaaaaactcccgatggaactatttctgtcgggagttttttatgactgtcccctgcagtaaccagacaccgggctgaagtgaattcacctcggggccaatgcggattcagcagcgaggcgaaaaggactgagcagcgaggcgaaaggaattgagcagcgagacgaaggagattggacagcgagacggaaaagcccccatgaaggtatgccaaaagtcaatagtaactaaactctcctccttcaggaaggaggagtacccgtagggggaggtggtaggtgaatacataatcctgtcatttacaaagaaataggaacaaacattatttctcctaccacctcggtcttcgaccactcctccttcccgaaggaggagaatagagatagaatcgactttttagtcacccccattcgagatggaatcgattttttagcccccactttagttcttttgacaccccttcatgaattctctcaaaggcatcttacggaatggaataaaaagtgaatcagcggcggcaaaattctctattttttttcttattaattctatttctttagaatagaattatatactcttctctactctactggtttccattcggttttcgcgccctgccagaaggcgtttcagagcttttagtttcacaaattaagagttgtttttcccctctatttttcgcctgtttttttcatcgaattctattcggatttatacttcaaaacaatgttgggataaaccaccccgtccgcacaagtaaactgcgcaaaaagaatgaaattacggaaaaattcggagttgcggagaaagaattccggcacataatgaacctgatgtccggactgttcgagtacgtgtccaaagtccgccatcaacatgaaatgatacgaatcggacaatccgtccgtccccgcccgataagccaaagcgccgtcaagcacttcgtcattatccagctggcggatatatcgtgacaaactatcttcatcgggggcaagcagtaaacgtccgccataaaatgtagcgaaaacatgcaaggacggctctacaaaactggttagttgcgtaaacaacgttgtttgaggcaacctgtacacagggtatgctttagagggagtataacaaaaagttatacgtgaattccggcctgttccttcctctgccggagccgtatttaccaaagagcgcaacatcctttccgcctcagccacatccatcaccgagagacttaaaacagccgcaggccccatcagagagtcttcccgctggaaaagacaagccaccaaatcctgccccgtattctctgccagataacgtgacaattcccgatcccgattcagcacttcactcgttctgcctgccgtcgcatattcctgcgtaccgccataggaaagcagggatgcccagtccgtaatgccctgtttactgaaataaaaagcagtggaaggcagtgtctcgcccggaaatcctttgacagattcctgctggcggattacatttataaagttaaaacaagtatctacataatggctgactccggagaaataaatgaaatcatccttcagcttcatatcaaactccgtccatcccatcattcctgccagacgagtgtagacggtagcaacagtcggacttttcttcggcgcccgcacttctttaaaagcagagtcggcagccagcgacttgccggttttgcggatatctatcacctcctctatcagctttttctgacaactgagcaccagaaagtcttccgtcagatagcaggcgagaaaatcaccgtccgccatcggatagataatgatatcttcacccttataatcgaatgttttcggaggatagcccgacgaaacatatttctgcacaaaacggtcgatcagcgcacggtctccattccccaaccggcagtaaagcacctgattacgatcattgtccggctcatggaaactgatcagcatctgattcatttgcctgctcagaccgtgaggagcatcttcgagaagagaataaagatattgtttcagataagaaaagagtttggaaacataaagatactggtgatcccgactacaggtcagctcatccacttccattacaaattcggctacatcttccgtcgcaaacactgctgaaacagaggacggaaccaaggtatagagatcaaaatctttctgatcttcggcagccgacaacctaaaaaaagagtacaacgcaaaacctgagcacaaaagtacaacagaagaagtgatcgctattttcactatcgtacgaagtttcataatatttgctgtttatcggctaggggcaaaaataataatttctacaaagaaaacaaaacttttgctaaaaaaatcaccaataatcagaaaatgatttccattccgtcatatgtaaggtgaatattttcaggaagctccttctctaccttcttgtgcagccccatatcatgactcatgtggatgaagtatgtctcctttgcccgaatacgttctgccaccttcaatgcctcctccagattctggtgagtaggatgaggagcgatacgaagcgcattcataatcagaacatctatcccttccaattgttcatacgattcttcgggcatggtcagcatatccgtgatataccccagcctgccgatacggtagcccagaatcggcagccgaccatgcatcacccgcaaaggcaccacttccgtatggtggatggaaaaggcgtgcccgacctcaatttcctgcaagggaatatcaggaacaccgggataacggtgatcgacaaaacaataaggcatccgcaaacgcaatgcgcgtgccacatattcttcggcatagataggaaccgccccgaagcggcaaaacggacgcaaatcatccagcccgcccacgtggtcataatgttcgtgcgtaatgagcacaccgtctatcttctcaaaaggaaggtgtaacacctgcgcccgaaaatcgggcccgcagtctataagtatccgcgcatcttccgtctcaacgatcgcagacgcacgcagacgattatctttcggatcggcagaagtgcagaccggacaggtacatccaatctgaggaactcccgtcgatgttccgcttccaagtattcttactttcattttccaaccaaatttacttccggatgaatgtctatgccgaatttcgcacgaacagaagcccgcactgcatccgaaagcgcaaggacgtcgctgcctttcgctccgccccgattgacgagcaccaaggcctgtttgtcatgcactgccgccggacctaatgcttttcctttccagccgcactgatcaatcatccatcctgccggaatcttcactcgtccgtcattcagttcgtagaaggggattcggggaaattcctgctgcaaggcttccagtttttcgcgcggaacgatgggattcataaagaaactgccggcatttcccatcactttcgggtcgggcaatttgctttcacggatatcgataatcactttccggaggatcggcaaggtcagttcgggatatttttcgagctcctgacggatggtgccgtaatctaatgtataccgttcttccttactgagccggaagcagacataggtcacaaatacggatttattctccgggcgtttgaaaatgctgtcgcgataggcatagccacattcatctacagcataaacacgctcctcaccgtgaatgttcactgtttcgacagaggtgatcaggtctttcacttccacgccataggcaccgatattctgcacggcactcgctcccacttcaccgggaataagggagagattttccgttccataccagccatgctctacgcaatagcctacaaagtcatcccagaccacgcctgctcctacccgtacggctacactccgttcgtcctcttccgtcacctcgatcccttcgatgcgggaatgtaagaccagcccttcatagtctttgacaaaaagcaggttgcttccgccgcctatatgcaaaaaaggtgtcgtaagggcaccttgagctatcaatgtcttcagttcttctaccgaagcatattcctgaaaccgttcggcatagacatcaatgccgaacgtattgtgtgataaaagagaatacatatcttccgttttttcgttgctaaatactggtatcttcaaacttatacagttgccattcgcctgctttccgcctaaaatatagaatattagagaagccgtttccgattcccttcaaggcgagaatctttgtcggcgagttatcatcattccgctgtccgtaattgatattcgaaaggcggtctgtaggcaatgccggcttgaaggcaaaccactggttcaaatcaagagaggtctccagaatagagaagtcatcgtccggatctgaggtgacaaaagccagaggctcctgcacacgccggctttgaaaaaggctgtcagcagcaaaatgactgaaaaactccacaaagtcttcattttcattccgctcaacagggcgcagattgatagcctccagtatccatgcccctttgatacgctcaaaataatactttttcaccattcgggttttcacgaatatccattccacctgaacggaggtcagtgaggtgtcccccaccaaatccatgtcttcttctttatcaaacaggagcgtataataatgctgtttggtaaataagtcatcatgcttccagttgcgttcttcgatattggttttctcatctcccttgtaatagggcaacggaaacttgacacgctgacgctgcaaggcatcatcggaagcaaaattatagataaaatcgtcgaaagattcgtccgcttctgtcggtttgggctcttccggcaattcctcctgatggatcgaatcggctttgtgccggatagaatccacctcttgagtgatagatgcaaaggggtcgatgttcgttttcttgtttccacaggaaccaaggatagtaagcaccagaacccccgcaattagttttttcattttttcagtttctctcttagcttttcaagcatatccaccgtcatgctttccagatcgtaagccggcttccacccccactcctcgcgggcgcaagtgtcatccagactatcgggccagctgtcggctatgcgctgcttcaaaggatctacatcatagatcatctcgaacgcgggcacatgcttcttgatggcatggaaaatcgtctcagggtcgaaactcatagaggcgatattgaaagcgttgcggtgtatcagcttggtcggatctgcttccatcagcatgattgctgcgttcagcgcgtccggcatatacatcatatccattaaagtgccttctttaatagggcacacaaatttttctcctcttactgccgaataataaatatcgacagcataatcggtggttcctcctcccggaggggtcacgttcgaaatgatgcccgggaaacggacagcacgtgtgtcaacaccgtatttgttaaaatagtagtcactcagcaactctgtcgttaccttggtgactccatacatagtacggggacgctggatagtatcctgtggtgtctgtgtatgaggcgtgcttgcaccgaacgatccgatagaactgggggtaaataccgcacatccctgctcacgcgccacttccaaaacattccacagtccgtcaataccaattttccaggctagcttcggcttggactcagccaccaccgatagcagtgcagccaaattatatatggtatcaatgtggtattccttcaccaccgattcaatcatttcaccattcgttacatcgacaactgccgacggtcccgactcttttaactctcctttgggctctgcaccctggatgtaacctgctactacgtttgtgtttccataacgcctgcgtaactccatcgtcaactcggatcctatttgtccggtggctccaataatcaaaatgtgtttcatttttccttttaaataaaagtgttaagctaaatagtgcgcaaagtaagcacttttttttcagatttaaatcaaaaagatattgtttattccaagaaaaatcgtgtcctttgcaccattaacttaatcactcaaacattatgtacggtaaaatgaaagaacacctcagccagacactggctgaaattaaggaagccggactttacaaagaagaacgactgatcgaaagtgcgcagcaagctgccatcactgtaaaaggaaaagaagtgctgaatttctgcgccaacaactatctgggactgtccaatcacccccgtctgattaaagcttctcaagaaatgatggagcgccgtggatttggtatgtcatctgtccgcttcatctgcggaacgcaagatatacataaggaactggaagctgctatctcggattatttccagacagaagacaccattctgtatgcagcctgtttcgatgccaacggaggtgtgttcgaaccgcttttcagcgaagaagacgccatcatctcggactctctgaaccatgcttctatcatcgacggcgtacgtctttgcaaagcgaaacgctatcgctatgccaacgcggatatgaaggatctggaaagatgcttgcaagaagctcaggcacaacgtttccgtatcgttgttaccgacggcgtattctctatggacggaaatgtagcacctatggatcaaatctgtgacctggccgagaaatatgatgcactcgtaatggtggatgaatcgcactctgcaggtgtggttggcgctacgggccacggcgtcagcgaactgtacaagacttacggacgcgtagacatctatacgggaacactgggcaaggctttcggaggcgcattgggaggatttaccaccggccgcaaggagatcatcgacttactgcgtcagcgcagccgtccttatctgttctccaactcattggctccgggtatcatcggtgcaagtctcgaagtattcaagatgctgaaagaaagcaatgcgctgcatgacaagctggtagagaatgtaaactatttccgtgaccaaatgacagctgccggatttgacatcaaaccgacacaaagtgccatctgcgccgttatgttgcatgatgccaaactctctcagatttatgccgcacgcatgcaggaagaaggcatttatgtgacgggattctattatccggtcgttccgaaagaacaggcacgtatccgtgtacaaatctctgccggacacgagaaagcacacctcgacaaatgtatcgctgcttttattaaggttggcaaagaactaggaaccttgaaataagtaataagtaataggtaataggtaataatcgtagctgccggtagctttacccgcatgacttattacttattacctattacttattacctattatttattacctattacctatttttcaagatggaagaacttacgctcactactcctgctttgcttttttcggctgtttcgctgattttgctggcttataccaatcgttttttatcgtatgcgcagctggtgcgacagttgcgggaccgctatatggaaaatcctacggatatcacggtagcacaaatcgagaatttgaggaaacggttgaatctgacacgcacgatgcagggactggggatagcaagcctctttttctgtgtagtcagtatgtttcttatttacatcggactgcagttgttatcggtttatgtattcggactggcattgatactgttaatcgcttctttgggtgtatccttccgcgaaatacagatttctacccgctcgctggagatttatctgggagctatggaaaaaggaaagataaagaaatagcccggcagggaagttgataagtaagataaaaaaagaagctgtctgaatataaacccaaacagcttctcttatataattttctatttttcagatcattatcagcgttgtcccagttgtgaatcaacaaagaaaataccggtatcaccagctttcttgattttatccacaattccctgtgcagtagcttcttcttctacctgttcgcggacaaatccccacaagaaatcctgagtagctttatctttttcagcagcagccacatctaccagcttgtctaccaatgcagatacatggcattcgtgtttgtaaacgtgttcaaacacttccagcggagtaccccagccattgggaaccacatcaatcttgtcaactatagcagttccgccacgtttgatgatgtaatcggccattgcataagcatgtcccatttcttcctgagattgtttcttcatccaatgtgcaaagccactgaaaccttctttctcaaagtagaaagacattgccagatacaggttagaagaccacatttcagcagtgatctgctcattgattgctttctgtaatttttctgaaatcataatcgtatatttttattaagttgttaatgtagttttcttttgaactcattacaaaaataacaagatttcagttaaaattgttccaagctccctgcatttttaaactacattcacattttatttacaccagctcgtccgaagtgtatcctttcggcagttcacgacagttgtatccggatgccataatctcaccataggcacctgcggaacgaagtgcaatcaggtctccccgcttcactttgttcaggtcaatcgctttaccgaaaacgtctgatgattcacagatcggacctactacgtcataagcctctacaggttcttctgaagtgatgttttccatcttgtggtaagcctgatacaaagccggacgaatcaagtctgtcatacctgcatcgaggatggcaaatttcttcttcgttccctgctttacatacagcactttcgatatcagagagccgcactgtcctaccaccgcacgtcccaattcaaagtgcaatgtctgataaggacgcagtttcagctgtccggcataggtagcaaaatagcttttgaagtccggaacggactggcggttaggatgaccgtagtcaatgcccagaccaccaccgacattgatatgctctaccagaatacggcgggcttcgagcttgtcctgcaattcattcacccggttacaaagagcgatgaaatcgcccatatccaatatctgcgaaccgatatggaagtgcagaccgatgaattttacattcttcatttccaaagccacatcgatcaccctgtccatgtcctgcatactgataccgaatttgttttcagccagaccggtggtgatattggcgtgcgtatgcgccccgacatccggattgatacggaaagcgacattagcgatcttattttgagcggcagccagttcgttgatgacttccagttcggggatagactctacattgaaacagaagatgccatattccagtccgaggttgatctcccaatccgctttcccgactccggcaaaaacgattttattggcagggaatccggcacggacagcggcacggatttctccgccactcacgcagtctgctcccattccgctttcacggataatggtaagtactttcggattggcattcgccttcacggcataatgtacggaatagctaggatatttggcaacctcttggttaatagccgacaatgtatcacgcagcactttcgtatcataataatagaaaggtgtctgcaaagtacggaatttatcgattggaaatattcctttcataattcaagaaacttgtttagttagttaaaaagagcgcttttatcagtatcaataaaagcgctcgtattatttgtggaattatttgttgttgaaaagcatatcgctcagcgactgcaacgccgtcttcttatcgcaatcccggataaggaaggaaatattgtagttacttcctccgaaggaaatcattcgcacaggtatgtcccgcatcgcatcaagcgctttagcttcgaaaccgacattctcccattccaggtcacctactacacagataatacacatatccttgtcaacagtgacagtaccgtattttttcaggtcgtccagaatctcgttcagatgcttggtgttgtctattgtaacagatacaccgacctctgaggtacagatcatgtcaatagaagtctgatagctttcaaagatctcgaatactttacgcaggaaaccatgagcaagcaacatacggcttgatttgatcttgatagctgtaatattgtttttggcagctacggctttaatcttacctttctccgtgtcattagaaattagtgttccgggagcatccgggtccattgtattcagcagacgtacaggtatattggcatatttagcaggctggatgcaagtcgggtgcaggatttttgcaccgaagtaagccagctcggctgcttcttcgaaatgcagctgacgaaccggagctgtcttgtccacaatgcgcgggtcgttattgtgcataccgtcgatgtccgtccatatctggatttcggaagcctttacggcagcaccgatcaaggatgcggtgtaatcgctgccaccacgctgcaggttgtctatctcaccgtaagcattgcggcagatgaaaccttgtgtgatgtaaatctccatatccggatacagttccagttgtgtctgcagtttctccttaatatatacagggtccggttccgcgttcttgtcagtacgcatgaattccaaagccggaagcaatacggacttcacaccgcattcctgcaggtagaagttgaccatagccgtagaaataagctctccctgtgccaaaaccactttctcttcgaacaaagtgaaaaggtctttagtataggagcggatgtagtcgaagtgagacttgatgacttccagacctttctgtttatattcctgagttgcaaaaagctcatcaacgtgctgtttatattttgattccagcttattgataatctcgttggcaccctccggattcttcttatacagatagtccgaaatttccaccaatgtatttgttgttcctgacattgcagaaaggacaacaatcttctgttcaccatcggtaatcaatttggctacttccttcatccgctgagcagaacccacggaagttcctccaaactttaaaactttcattttcgttactgttttagttatctatatttaaatctatttctattgttctctgtctgggcatgtattcgtctgtcacatccgttatacgatgttcggaacagcggtatacactgccgggatattctttcagcaattgcagattgtgcgttgtcatcactaccgacgaaccggattcgcagatgttgtgcaacaattcaacgatggacttgcctgtttccacatccagatttccggtcggctcgtctgccaggataatagccggagaattgagcacggcacgtgcgataacgatgcgttgctgttcgccgccggaaagttcgttggggagtttatagcccttgttggacattcccacgaggtcgagcacttcctctattctttcctgaatttcccgtttgttcttccagccagtggcacgaagcacaaattccagattgttgtaaacggtacggtccgtcagcagctgaaagtcctgaaacacaattcccagctttcttctcaactgagggatatgcttgcgtttgattgaacgcatattatagcccagcacttccgcttcgccgtcgattacgtccagttcgccgtaaaaggttttgagcaggctcgttttccccgaacctaccttcccgatcagatagacgaactctcctttgtgcaattccagattgacatcgctcagtacacagagttcctgttgatggatttctacgtttttatattgaattaatgcttcttccatgtactgctatgtctttcctgcaattcgcgtgcaaggtcttcgatccgatagccttttgaagttaataatacaatcatgtgataaatcaggtcggctccttcatagatcagacgttcgtttgttccattcgtagcttcgatcactgtttcgacagcttcctcacctactttctgagcgatcttgttgattccggattcgaacaggctggtggtgtaagaaccttggggcatttcttcgtgacgtttgtcaatgaaatcctgcaatgctttcaggaacataaccggttcttcgtttttctcaccccagcaagtatctgtgcctgtatgacaaacaggacctgccggatctgcctggatcaacagggtatcgttgtcacaatccgctttgatagataccacatgaaggaagttgccgctttcttctcctttcgtccaaagacgatttttggtacggctgaagaaagttacttttccggtttccaccgttttatcataggcttccttattcataaagcccagcatcaagactttgcgtgtctcgttgtcctgtatgatagccggaacaagtccgttcatcttatcgaaatccaattccatcttatattaagttctaattactatttcaatttactataccgtttgtgtgagcccatgccgcctcaccctctgatggttattccttcgccgcaaagatacgattttaattcgggaattttaatttctccgaaatgaaaaacgctggcagccaacgccgcatctgcttttcctactaaaaaagcatcacggaagtgttctttcagccctgccccgcccgaagcgatcacgggaatagagagttgatcggccaaggaagcaagcgcctcgttcgcataaccggtcttcaccccatcatggttcatgctcgtaaacaggatttcgcctgctccacgctcctgagcctctttagtccatgccagcaattctttatcggtttcgatacgcccgccgttcagataacacttccagccgttttctgtttgcttggcatctaccgccagaacgcaaacctgagagccgaagttcttggctatatcatcaatcagctgagggttgcgaatggcggaagaattgattgagatcttatccgctccggcattcagcaagcgatctacatcgctcaattcattgatgccaccgcccacggtaaacgggatattgatattggcagcaatccgctttaccagttccgtgaaagtcttacgtccttcgtgacttgcagtaatatccaaaaaaacaagttcatctgctccttgttcgctgtaagcccgccccagttctaccggatcaccggcctggcgcaaattgacaaagttcgttccttttacggtctgtccgtcttttatatccagacagggtatgattctttttgctaacacaattctatcttatttactatttgacaatttagattctactaatccgagaacctgcttctttattttttcattataacagggcgctccatttcattttagcactcctaattataaaaatatacgcaaatctttcaatgttatatgcccttcgtacaatgctttaccgaagatgactccgggaactccggcttcattcaaggcgataatgtcatccacgttgctcactccgccactagccatcagatagagattcggaaacttctccagcatttctttatacaaatcgatagaaggacctttcagcattccatcacaactaatatcagtgcaaatgactttctgaatacctttatttatatagtcttcgagaaatgggaaaagctcgcaggcgctttcgtctttccagccgtttacggcaatcttatgttccttgacgtctgctccgaggattattttctcactgccatatacttccagccaatgacagaacagctccggatctttcacggcaacgcttccgcctgtcaccatctgagcaccgctttcgaaagctattttcaaatcttcgtcactctttactccaccgccgaaatccactattaaagaggtacgcgtagcaatctgctccaatacccgatggttgactacgtggtgagaagcggctccgtccagatctaccacatgaagcctgcgaaccccgttcgcttcgaactccttggctacttccaccggattttcgttatagaccttcttactatcgtaatctccctgagaaaggcgtacacatttcccgtcaataatatcaatggctggaataatttctatcatctgtttatatacaatttgatcatttacgatttactattttagctgttcactccatcttcttatacctgtccttttcttcttctccgaaaagccggaaatagtttataataaacgatgaccgagtttattataaactatagcggagtttattataaactgttgcaacgtttattagagatccagaaagttcctcagaaccctttcacctgtcttcccgcttttctccggatggaactgggtggcataaaagttatctttatgcaatgccgcgctgaacggatggatataatcggtttcagcagcagtaaagtcacaaaccggcacatagaaactgtgtacaaagtagacaaactcttcttcggtgaatccttcgaacagtttgctgtttgtcttaccaatcgtattccagcccatatgcggcactttatcttcatgcttctgcggaacaaaacgtttcacgtctacatcaaagatattcaggcagtccacctcaccttcttcagaatgtcggcacatcagctgcataccgaggcaaattccgaacacaggctgacgcagattcttgatcagctcgtcgagccctgttgctttcaggtgattcatggtagttcccgcctctcctactccggggaaaatcactttatcggcagattgaagtatttctttatcggcagtaatcactgcttctactcccaaccgcttcagagcatagtccacagaacggatattcccggcattgtattttacaactgctactttcatcagctaaatattactgttttatttttataagccaaaatcttacgttcgatatgcttttgtaccgcacgcgaaagaacaattttttccaggtcctttcctttatttacaagatcttctatagagtccttatgtgtaatgcgtactacatcctgctcgatgatcggacctgcatccagctcagtcgtcacataatggctggtcgcaccgataattttcactccacgctggaatgcggcatgataaggttttgcccccacaaatgccggtaggaaggaatgatggatattgataatcttatttggatacgcattgatcatctgttcggaaatcacttgcatataacgtgccaacacgatgaatgtaattttatgtttggcaagcaattccatttctttgcgttcctgttcttctttggtctccttggtgatggggaacaaatagaaaggaataccgaaacgctctgccacgtgctgcaagtccggatggttgcttataataagaggtatctccacgttccactctcctgccgtgtagcgagccaacatatcgaacaggcaatgagacattttagaaacgaatatagccatacgcggtttcacatccgagaaataaagacggaaatccatttcatacttctgcccatatagcgttctgaaataatcttcaatcttttcctgcggaaccagaaaatctttcaattcccattctatacgcatgaagaagatgttctccacatggtctacatactgatccagatagataatatttcctttgtttaccgtaataaagtctgtcacttccgcgaggattcccggtttgtcgggacagtgcaataacagtttggctgtagtcatcattctttttactaatttactattccgggcggaaattcttccacctatctaattttagtgcgcaaaaataacgatttattgcaaaactacgaattattcaagcagaaagttgatataaaaacggtgatttcttacagatagaaagatatccaagactatttccaaagaagaagatgacaaacttcaggatagtgacactatcgcctccggataatgacactatcccatcgtgatagtgtcactatgacgaccggatagtgtcaccatcctgactgaagaaaaaactaatattttttttcattataaaagtactcaaaatgagacactaagcttttttcttgctttttattggaaaaaagtttcatcaaaacatttgcagatttacaaaaaacaactacctttgcacccgcaatcgagagagatgcagattaacaaaatgaaattctggttcggtagttcagttggttagaatacatgcctgtcacgcatggggtcgcgggttcgagtcccgtccggaccgcttcttttaagtaagaagcaaagagaaataaaatgaattagtctttaatatttggtgcgttagttcagttggttagaatacatgcctgtcacgcatggggtcacgggttcgagtcccgtacgcaccgcttcttaagaaagtaaaaaagtctttgattacattgataatcaaagacttttttttatgcattacacgaaacccagatcgctaacagctacagtctacgactaagactggcggatatcttaaacatgctgttacccgccatcggacatcagacctataaagtcatatataaaaaagataataattcactgcatcatctgggttattcaattttaaatagcacctttgcatacataaagaaaatagaatgatatatgaaagaagtaatttttgtattattaaatgagttcgccgactgggaaggcgcatttatagctgcctgcctgaatcagggtgttatgcccggaagtcctgttccttataaagtgaaaaccttgtctataaccaaagagcctgtctcttcaatagggggattcagagtattgcctgattatgatttgaaagatatgccggaagattatgcaggtctgatattaattggcggcatgagctggttttcaccagaagctgaattaatagccccgctgatagaaaaagctatcaaagataagaaagtggttggcggaatatgcaatgcttccgttttccttgctatgcatggatttctcaataacgtaaagcatacgagtaatacaatcgattatctgaaacaacatgtcggagagagatatacaggtgattcgaactacgttgatcagcaagctgtaagagatggaaagatcataaccgctaacggaaccggacaactggaattttgcagggaaatactatatgcattagaagctgatacagccgaagcaatagaaaaaagttatctgttttataaaaacggattctgtccggagtaataaaagcaaggttaagtttaacaattaccggataactaacattagatataaaaatagcctcatacccaaatagacaaaacatacggagaacatcgggataataaagttccatttttcgctacgttccaatattccgaatcgtcagaagagattaatctttcctgacgattcttttctaaacatcttccgcctacatattccctctattataaattaatcagaaagttaaccatttcagggtcataatgggagaagaacagactttcttttttatcgagtccggcaatctcttccatatcctttacggacaaggtgaagtcaaatacatcgaagttttctatcatgcgttccttgcgagtcgatttcgggataacgatgatatcacgctgaataagaaagcgcagagctacctgtgcaaccgattttccatactgttctccgattgctttcaatacttcattagagaagaaattattgcgtccttctgcaaatggcccccatgacatgaccttcgtatcgtatttcttcataatctcctgcggtttcacttgctggttgaagacgtgtgtttcaacttgattcaccgccggtttaatctcacaaaattctgccagatcaatgaaacggtccggatagaaattgctgacaccaatggcacgagcttttccggccttgtaagcctcttccatggcacggtatgtaccatagtaatcattgaaaggctgatgaataagcaacaaatcaacataatcactttggagcttacgcaaggattcgtcaatagaagcttttgctttttcgtatccaccgttcgaaatccatactttcgttgtgataaacagttcttcacgtggtacaccgcatttcctgactgcattacccactccttcttcattataatatgcctgtgcagtatcaatagaacgataaccgacactaatagcatccagcacacagcgctcacactcttcaggagttacctgatatacaccatagcctaaaatcggcatttcaacaccgttgttcaatcttactgtttccataaatgcactattttaattattaaactcaatacctccatacttatcaataacaagatcaatagttgaattgattttattacagtacaaaattaaggaagaaacatacatctgacagtagataaattacgggttgttcaaccattattactgattctattcaacagcgaaactttccgacttaaagttactgtaaaaccttccggaaatcgctgtaaattttaaaacacaataatcggggtccgtcactccttcgggatagtacatcgtatccccttcctgccatatcatctctttactggcaggatcggtcagcacttccatagtaccgcgcagcatcacccctctaaagaaccgcgtatcacaaaagtaaatacaggcatgattgttctcacgatattgggccacacgcattgacgaagtatttgtagtcagataaatcgtctttatcccttccctctttcggggttgtaacatagctttcatattaggaaatccttcactgtctatggaaccgataaaggccgttttcagcttatcaatcatgttccctactgttttttccgcatctctcatcgttcaataattttaattggttattatctgatgcgaaagtagggatatagaagacaatcagtgcaacagaaagaaagggagaaatatcactttttacggtttatgcgttcttcgataaagtaatggcgttgttccagtatattgccggaagctacggataaaataagagacagttgagaaatgaagttcaaacgcaatatccgatatagggaaatctgtataagtaagcagtctcttagcctcatccattactttattccggatatattgcttcgcactaatcccttttgtagaggttacaatctcattcagataattcggggtaatacaaagtttatccgcataatattgaacagaatgctgctctttcagatggctctcaaccaacttcataaatttgtcaatatggatattaccaacctctttggatgtagtttcttcttccatattcactttcttatattcccggtccaacaacatcaggacttcataaagtaatgcccttaatacatacacatcattctgtctgtacgaatcaatctccgttttaatattgtgcaatatctgaaggatacgcatataaagttcatccggcaactgtaatttggatgatgtctttcccgactggaagaatgaaagatgctgcacaaagagagaatccttaaaaagagaagataaaaactcatcttcaaagatcaaagcataaccattgactatgtggcgggtatcccagttccgaatctctcccggtttagagaaaaacacatcacgggaagccgcctcgttagtctgattatctatcgaaaacttgccctccccttctgtgacaaacgtgatatcatagtaagtcagcgtgtggacagaactctgagagaggaacttctttacgtatttcagttcgacgacatctatcaaaagttcacttccatacttattcttatagaaagtatatcggggaatcagatttttcatttcaattacaaaaataatattccttatcaaatgatccaaagactttccggttttgagaagcaccggggtaagaatagactattcaacaaggaatatcttcaaatatagagaatgagacatttcttatttacagcttccggccagatatcccagacttgtcacatcggcccctaaataataagtaatgtacttcaaagggactctgtacagaatatcgggaatttctgataataaagaaaggtatctttccctgatcgtcagtttacgtgcattcacactcatttcctctttaaggtaaaactgatattccatcatctgacgaatcagattggaaaacgtgatggacgttgcacacaattcctcgatctcatcttcgctgatgtaataggccacacaccttgtcagtgttttgacagaatgcttacttgtattgtagcacaatatagcgtcaccttcggacaggaatctgacggttttgtcctctccctgctgggtagtaaatgtatgcaggataccggaaacgataatgtacaagctctgctcgggcattgtagcagaagcaatcgtttctcctttatccagatacactctttccatgcgagccaacagctctttcacttccttttcttcaacctgatactcaaaacagagtttcttcaaataagcttccatacaaattgattttagttaatatatccacttaaaacacctaattcgacatagcaggcatcatggtgcctttcaaataaactttcttccgggtatatcttaaataccagatacagatcaacaatgaaaccactgttgaaagaggtggtgcaaagcccatgataaacaaggaagaactgtctatctgactaaaccagtacgacaacggaatccggaacaggaaagtcgctatcagactgtgaatcatcgggaacaatgaatttccctgtccgctgaagtaagagtttatacagaacacaaaacttacaacgatacagtcgatactatatccccgcagatactccgccgccattgataccaccgccgcatctttggtaaagaacgcggtaagcgtttccggcaggaattgtgaatacacacaaaccgatacaccgaaaacaaatgcaattcctatccccgaagccagacagcggttcatccgttgtataagtccggctccgtagttctgtgccgtcatcgtcgctactgccgatgagattgccatcggaggcagcatggcaaacactataattttctctacgacacccaaagaagccgatgcgatcactcccatctgattgactataacggtgatgatcagaaacgagatattgatcagcgcatcctgcaacgcaataggcgctcccaatgtcatgactttcttggccaggttccggttcagccggatatctttccgggtaaactcaaaatgaaatccgtgccgatataagaaccaaagagagatcatgaagctgactccctgcgccgttatggtggcaactgccgctcctgtggctcccaaatggaaatatcctaccagtataaaatcgagtacaatattaatcacacacgccagcgctacaaaataaagcggcgtcttggagtctcccaacccgcgcaaaataccgcatacgacgttatatcctactataaacaatatcccggccgaacatacaaggatgtaacttttcgtatccgccatcgcctctatcggcgtatgcattaactctgctatccgaccatgaaaaaccaccatgaccaaagtaagcagcaccccgattattgaaaacaaccatacagacgaaccgatggtgaaagctactttcttgtcatcctttgctccggtagcgatggcaatcaaaacggttgttcctgtcgtaatgccaagaataatccccgtaattgtctgcatcacctgactgccgatggctacagccgccacacttgcagaatcatcgtattgtcccaccacaaaaaggtcggccccgccataaagtgcctgaagcacattggcaatcagaaaaggaaccgcatattgcagtaatactttcggaacactcccttgtgtcaaatttaactccttcatagtttttcaatacttactcctcttatcttacttgttacaaaataaaaaagtgccggacaagctgaatgattcacaccattcatcttatccagcactataattatctattatagcaccctccgatgaggattttctatgcctgtccctatttttggggtgcaaatatgggctttgttttcataactaccaaattataatcgataattatttttttatgataccataaggtatcaatgtgataccaatttcagacctacaatggagcaaatcaatgtgaagatgaagaaaattctgccccagcttgccggctctttaaagaaaaaaataccgatcagcaccgtaccggcggcaccgataccggtccatatagcataagccgtaccaacgggcaatgctttggtaacccttatcagaaggagcatactgacacacagggatatcagcagtccgaatgaccacatatatttctctgctcctactactctgtttatttttcccagacagaaagtaaagaccaattcaaggcatcctgccaaaatcaaaagaatccaattcataacacttcttttttttgattgcaaaggtcatgaatttccggcgcccttcattttacatttgtaaaaaagggattttacaaagtttaaaaaatcatcttatcttcgcacggattctgcttagattgacctgtgagatgcctaaataggaagctataatacccaatggcacacgttgaagtatatcgggatattcggatatcagttcctgatacctctccaatgaagttttgaattgccttgatataaacaacttttccgatttgatgcattctctctcggaaaacttccgtccccagttggctatatgtatatcttccagatagagattgtgcaatttatcgacactgagttcatacaggacactgtcttccaaaagttcaatattctcatatcctgcccgattatcatgaagagtttgcagagggaagattgcatccccttctttcccgaaccagaaggtaaccttcttatccgactgataggtataggcatgcagcatccctttcttcatcagatagaacttagagtttttatgatttgcccggaacagatggaagcctttaggataggctacttcgggagcatcactcagtaaagcctcctttgaggcatccggcaacttgtaaatagagtctatgatatcatttatatccataagctgttttatttcaatcgttttgctacccttttcagcatagaacggatgatgactttatgaaaaggacgaataaagaagaagtacaaccggcccagtcggttattgaactttacaacggtcgtgattgtaaacgtctgcccgccgggctccttctctccacaccataatgaagcatgaaacgtcaggtgtttatcgggcataccgaaaacaacttcctgtgcattctgctcacatatcgtatcggcaaagcgcataccaacttccagacctaacggtttgactatcgcattccttaacttcatcaacccattcacccagcccggagagtgattaaaagccatatcaaagaactcgtcggaagtgattgctttttcactgactacgttccttgaaaaagaatcgcaataatctgccggaagatagccggctatcaaactgtcttggggtatattctgctctttcatcatcttcggccataccttaatagtatggtttgccaaaagtagtcactttagacagacaaacaatgactttgcccgattttctgctatcacctcctgtctggacgacagatattactattacttattcacaaacagaagggcataaatgaatatatacagcaagggctgcccttttacggagcagccctcaccattctatttacatctcttgtttttagtcttcaatcgtacatatacttacacgattccaatccggttcggtaaacatgtcacctacgccctgaccttcggcagtgatacgagaagcattgatcttgtatttattgaccagaatagtctttacggcttccgcacgtgcagcggcaattcttgcattgacttcagcactaccttccggagaagcataccccttgatgactacttttgcatcagcatatttcttcagataagaagctacgcgttccacattcggcaactgtgaagcatcaaccgatgatttaccctgtctgaaagtaatgatagattcaggaacacgggcagttttcactacagtctccaccggaacgaccttggtacggcattcttccagttcttgctgcaatccgctgattttttggttggcgctgttgagttcgccgtccttattgttcacttgtccgcggagagcattgatagaagcattcaaatcgtcgatttcaccctgattgtaaactcttacttcggtgaagtaacggtttcctgtactgctcttgaagtgataagtcagtccggcagtcagttcaaatgctgcattattggcattgaaacggctctttgcctgattaaagtccccttgcatatcatatacgatggcaggtttcagtcccaatgtccaggccttgctttcgcctagattaaagttcagattcaatccgaaacgggttgaccatgagttctggtcgccatcaccattcacataataatgtaaccatcccgcaccggctactgcctccacttcaaacaaacgaggagtgccgttgtaaccagcaaacaggttcatcagattcactttacccaacaggctgacatctgaggcatcaaaagctgttttacttggagtggtattgatataccccataccctgaaatcctaaaccgaagacaggagtcaactgtttggaaagaccaactccgaaagccggacgtgcattcttaaagaaagcgctgtgagtgagaggagtgattgcacctgcatttacttctacagaccaattatctgcaaactttgtaccttctacaacagattgggcttttgctgtaaatgcgcccaataccatagctaatagaataatagatttcttcataatcatacgttttaaattgtaatgtttcatttgctaaatcattagaaatgttttatttgctcatgcctaactttttagttcatcatttatttcgttattcactttaaacaacatacaatatgaattattagttcacggagcaagaggcgaattaacatctattttgtttcttaggaatattaaaaatagacctatagatgagataatgaacatcatacaagctaataacacagaatatgcagtgaaagcagaggtacaaaaataaaatcggctgcaatttccatcagcaattatcgaaagaaaaacaataagggtcatgatgcagcaataagatgcagtccggtcataatttcattcacgaagaacagtagatacgaaaaatggatttcatattaacagtttaaacttatccataaaaaagaggtttccagcacaaagtagcactcaaaaagaggttttactccattcttttaaagaaatgaacgctccctcaccgaccaacggtccgttggtttaaaaccaaggcagggtttcatttaaaggaaagacgcttaccattgcttgttataatgcatataatgattatttagatgcagaaatatgtccgaaagctgcatattatttcattattctatgcacttttttctctatttgatggaatttatactcatcgaggccaatgcaattattaaaaatggaacatacatcatatttatccttcctccaccagccagcgactcacgttgcgttcttccttgctgaactccgcgcctattttcaccatgcggcatccatcagccctcccaactacatagttacaattcaagtccatttttcagtccttcaatatcagagtaatcctcagcattaaaattgaaattaagatgcagtacagcatgctcgttccattcagtttcatactgctcgatggctagtccttcaaaaagttctttctttccacaaaaatacgcttccagtgtggaaagcaacaaacttttgccaaaacgacgcgggcgactcaggaaatacggattgcccgtggaggctagttcgtagacaaatgctgttttatcaacatataaataaccgtcacgacgaagtctttcaaaactctgtattccgataggaagattgcggcgaaggcctttcaaacggtcaatgatatccataatttcttctctttaataagtgagtcctttgtaaggataacaaatcttacagtgaatcggttatccgacaacggttttattatcctgctctacgaagttcccgacaaacgggagatatgcatagaaaaattacttaagcataacatcagctattattaccataagtacgtggatttctgttcttcaaggaaagaagatacgaaaaaagggaacaagttactacataaacatagatcacgtttattataaattctgtgaccgtttattataaacgtccccttcgtttattataaactcaaaaataaaaaatcatgggaaatgaattaaaattatgcaacaaaaaaggttgcaaactccataaagtttgcaacctttgctctatat

SEQ ID NO: 79 - DNA, 33905 bp, Bacteroides thetaiotaomicron
aatattctgcgcttcattgctttttaaactttaagcaaaataatgaatatctgcttatttccaacacgttacgatttatctattcaatcttgttagctcttgctttttactttatactccattgtgcgaggcacagcttcgcctcgctgattacgcttgaagcaggtgtgccgatagaaaccatcagtaggatgctgggacattccgacatttccacaacacaggtctatgcccgtgtcagcccgaagaaacttttcgaggacatggacaagttcatagaagccaccaaagattttcaattagttctttaatcctttaatacagaaaactatatgcgaagcacattttcacttttaccctacattaaccgcagcaaagtaaaggctgacggtacgaccgccatactctgccgcataaccattgacggcaaacagactgccatcagtacggggatttattgccgaccggaagaatggaacagcaagaaaaacgagattaaatccgtaagggaaaataaccgcttacgagaatatttacgactgacagaggaagcctacaatgagatactgaaatcgcaaggtgtggtcagtgccgagattttgaagaaccacatatccttgaacaacatccatccgaccactcttctacagatgggagaatgggaacgtgagcggttgaagaagcattccgaagaaatagactcgacttcttcctgtcgaagttcaatgtattatcagaagtacctgacggattttcttacgtccatcggtaaaaaggacattccccttgaagaagtgacggaggatttcggcaagtcctacaaagcccacttgaagaaatgcaagaacttcggggcttcccagaccaaccattgcctgcgttggctgaaccgactgttgtaccttgcagtagacaaggagattctccgtgtaaatccctgtgaggacttggaatatgagacaaagccggaagcaaggcacaggtacatcagccgtgaggagttcaagaagatactttccacaccgatgtatgacaagcgtatggaactggcaagacgggctttcatattttccaccctgacgggactggcgtatgtggacatcaaacttcttcatccccaccatatcggaacaaacgctgatggcagacggtacatccgcatcaaccgaaaaaagacaaaggtggaggcattcatacccttacatcccatagcggagcggatattgtcgctgtataacacgaccgatgacgagaagcccgtgtttcctcttcccaaccgtgatgccctatggtttgaggttcacgagttgggaataaccatagggaaagaggaaaacttgacctatcaccaaagtcggcacagtttcggaacatttttgatttcggcagatatacccattgagagtatcgccaagatgatgggacactccaatatcaggacgacacagggatatgcacggataaccgatgataaaatttccaaagatatggacaaactgatggagcgaagaaaggaaatatcgtctggcgaaaagaagaaatagcaaataatcatcataaaataaagggattatgagcagaggcataataacaatcagtgaaacggatgcagtcactatgccaaccgcacccgtatggatgatgcaatttgagattgccgacctgttcggggtgttctcatgcaatgtccgcaaggcaatacgggcaatctataagaacaatgaactgaatgaagccgatacgatgcgatatatcaggcaaccggatggtatcagttatgacgtttacaaccttgaactggttatagccattgcattcaggatatgcagtaaagaaagtgctttgttcagacggtttataataaatgaaatcagcactaccaaaagagaaacacctgttacgttgtttgtttcctgtggcaggagtaataaccgatggtatagttgaggttcatcccgtcagtaacttgtttccgttgccacacgtttgaaaggcatccgacaacgaaaaacaagcaactgatgggtaattataagagcagaaaaggaacggcttacggatgaagtgtcaatactgcgcttcgtctgtaagccgttccttttttctttttgtcgaaagtctattgctgccgcaatacagggcatacggcaaactgcactcctttaagaaaaatcaagttatcctttgtcggtaggcggagcggtagccgtcattcagcatccgttcgatgtcggattcacggtagaggattttaccgcccaactggatataggcgatacgcccttcattgcggtagtcctgaagtgtccggcggctcaccttcagccgtgccgacacctccttgtcagtgaagaaacgctcaccgcccaatgtcgggcggtaattggcggtcaggtgctctacattatcaagcagtcggtcaagactgcccataaagtggattatccacttgttgtccttgttaatcaactcattcatattactctggatttagtgggtgttgtcattatatttaattcatatagtctttcctttgaacttcgcttcctttcttctatcctccacaacggagacaatgagttccacgtcttcgggacggtaatacgtcttgtggtttatctgtgaataagccagcgtgccgttatcccgaagcgtctgtaacgtgcgagggctgatgttgagcatacggcacacgtcctgattatccatccattcgctcattttcttttccccgtgccgatggcagatggcatccatacggctgacgaaacggtcgaacttggcgaccattgcctcaaaggtctttctttcgattgatacaatttccatattgcctttcttttaattgttactgtttcttttgccacaaagaaatacattatccgctgtcatgcaatggattttcaaaaagtggcagcgtgttgcgccgatacggtagtcattgtccggggtactgcttgccggttatctgtgagcaagccggtggaatacgatttccgttcagcctttaattccctttttttataaagaagccacagccaaaataagggcttaatttaaaattgtccccaatcgtacctttgtactttcagctattcatatccggcaaatcggtgaagtccgcaccgatttgtcagtccccataaagcaaaaccgtacaaaaatgactaagaaaatccaagtgcttgactgactgtattaaagcaccttacttcgctcccgataatcggtcgaggtatagaccaagaccacattcaataacttaatcaatttgtttttacaatgaaaaaagaaccaaacattacagagcgtcaagctcgtgaaatcgtggaaaaaatggggcgcagggaaccctacacctccaagtcgatagacgacttctacaggagtatcggtctggaaccggaggagccggaacagcccggcaagaccgtcacggaagaagcagaaattcatatggcagaagaaccgtcaggagtggcgagcggagaagcggtaatgccgcagaagcgtatcagtggcaaacagcgcaggctgtctttagaagagtaccgcaccacctatctcaaagttcccaaaattatcaaccgcaagcccgtgttcgtcagtgagacggtgcgtgacgagttggacagggttgtccgctacctcggagggaagggcatgagcgcatccggacttatagagaaccttgtccgcctgcacctcgaggcctaccggaatgacatcgagcaatggcgcaaactctgacgggattacggtggaacaggttgagccgttggatgtactccatcggttcgaccgatacacaaagtgagttattacactcggaaatcaatccgacaggcggaggatttttgtgtcctcaaagacacagcaaggtatgttttcagttactcggatgttccggagtaactgaaaacccttgcaccgccgtgggcagaattatcctccgaagtcggataatttcaatctttctttatcagagattagacagtgaacaaaccataaaattgaaagaataagaagcatgaaaaagaagagtaaatacgggagaagtcccaagctgaatccgaagacgcactgcgtgatggtgcgcttcgatgatgaggaatggaacaagttcctcacgatgtacgaggaatcacaggtatatgcgaaagccgtctttctcaaggcgcacttcttcgggcagaagttcaaggtgttaaaggtggacaaggcgatgctggaatactacaccaagttgtcggacttccacgcccagttccgtgccatcggcacgaactataatcaggtagtcaaagagctgcgatgtcatttttcggagaagaaggcaatggctctgctctacaagttggaaagttgtaccattgaacttgtgaagttgagccgggagattgtggagctttcaagggagatggagaagtgttatcaatccaaatccgactgatatggcatcgataaaggtcaagtttcgcccatccaccgtaaacggcagggagggtacactctactatcaggtcatccacaaccgtgtggtcagacagataaacacagagtataaacttttcgtttcggaatgggactgccattctgaaacggttgtcttacatcatatatcgacaggacaagagaggaacaattatctgctttcaatcggttcacgtatcaagtgggacaaggagagattgaacaaaatcatacacacgttatcccagtccggcacatttgtaacggacgatataatcatgcgctttcatgacaacaggcaagaactgtcgtttaacgcttacatcagccagcagatagcgagactgaaacgcttggggaagatacgcacttctgaaacttatacagctgcactcagaagttttagcggttttatgaatgacccagaggccttgtttgaccaatttaatgcggatttgttggcagagtacgaggcttatttgaaaggcaggggaaatacgctcaacaccatatccttctatatgcgtattctgaaagcggtctataaccgtgcggtggaagatggattgaccgaacaacgacatccgttcaagtccgtctatacgggagtggagaaaaccataaagcgagccttgtcactcaatgatattagacgcatcaaagggcttgacttgtcattgatgcccaatcttgactatacccgtgacatgttcctgttcagtttctatacaagaggaatgtcgtttatcgacatggcttatctgagaaagaaggacttgcagaatggcactctttcctatcgcagacggaagacgggacaacggttgttcatcaaatgggaaaggtgtatgcaagagattcttgacaaatatttggtaaacgaaacggaatacctcttgcccatcattacaaaacgggacgatgattatcggaagcaatacgccaacgaacttcaccgagtaaaccatctgttgaagaaaatcggaaagcaactggatttgccaatacccttaacgatgtatgttggtcggcattcgtgggcaagtatcgccaagagccgtaatgtgcctatctctgtcattagtgagggcatggggcatgattcagagaacactacgcagatttatcttgcatcgctggatactactgtggtggataaagccaataagaaaatactggatttactgtgaagccgtggatgttttgcgaatctgtccaacgcttgccaagagacggatattataatgcaaagttacgcaaaataatgatttttaggtcataaaacgctgaaaatcttgtctattgccgtgcttttgttttgtaaaagataccagatgttttataaaagttagctatgcaaaagtaaaatacaactctatatcagcaggataagaaggcttatccgtctcttggcaagagaagtattatttctccttattcccataagagacgggcgtaaacttgatataaaatgcctgtagaagttgatatattggaagatagcatattccagctttcaccggaattgctgaacaccttgctcaaagaccatactacgagcaaggctgatatgcaacgcaatatcttctgggctacttcagattatgaacatattggcaaagaataccaatacaattctcctattctcccccacctcataataggagataacggacatatcatcatgcctcgtgtcctcaaaagtcgtgatacccagtcaatccgttctcgtgatatggctgaggttttcactccatcatggatatgcaatgcgcagaacaacttgattgatgaagcatggttcggacgaaatgatgttttcaatactgaatatgcaaacgaacagggacaccataaatggaaatcaacggaaggcagcatcatatttccggagggtaaaacttggaaggactatgtacgcgatatccgattggaaatcacttgtggagaagccccatacctgataagccgctatgataccacgacaggcgaaactatccctttggaacagcgtatcggtttacttgaccgcaaactaagggtggtaagcgagaacacatccacttcgggtgaatggcttgagtgggcacaagaagcctataaaagtatctacggttacgaatggcagggggacaatctactcattgcccgagaatctttgctcgtctcctttgtggagtattaccaacagaaatttggcaaacgccccttgttgaaatccatcaactacatcgcttatatcatttcgtggaacgtatggcagatggacggattgaaaggtgtcattccaaacagttgcggagaacgcaaggaggttgtagccgacctgttcgggactaccgaagtggttacccaatgtgaaggatgtctgaaagacgacatccgcaggcacaatggtgtctattgccaaatcaaggactggcatgctaccgacaaggcaacaggcaaaaaggggaaacgaatacgatttatagaccttataaaatagtgcagtatgaaattcacatcttcactaaaactaaaactgatatatgtgttccgcatcaatgatgctgcacataggggatgcctgaaagtgggcgaggccacttgtgacaatgacaatgttttcggtcttgctccgaacagcaaggctctcaacgagtccgcgaagaaacgcatcaaccaatatacgcagacggctggtatcgcatacgacctcttatatacggaactgacgatatacaacagcaaaaagagcttgtgctctttcaacgacaaggaagtgcatagcgttctggaacgttccggcattaggaaaaagatattcgataccgagaacaaagccaacgagtggtttattaccgaccttgagactgtcaaacgggcaataattgccgtaaaggagggacgggaatcgctctcttccgccgaagtttcacacgcccagactccgattgtattccgcccggaacaacgggaagccattgaaaagaccaagaaacaattcaagaagggtaatcagatgctttggaatgccaagatgcgttttggcaagacgttgtcggcattgcaagtggtgaagggtatggatttcagtcgcactttgattcttacacatcgccctgtggtggatagcggctggttcgaggatttcggcaagatattctatgactgtccctgttttgcatacggctcaaagaacaatggtgacagccatgcttcacttgaagcgagagcgaagcagggtaaatgccaatatgtctatttcgcttccatgcaggatttgcgcggttctgaacttgtgggcggcaacttcgacaagaacaatgaggtgtttgccaccgcttgggattgcatcatcgtggacgaggcgcacgaagggacacagacggaactcggcaaggctgtcatgcaggaactgacaaaagcaaataccaagatattgcgactttccggcactccgttcaacctgttggatgacttcaaggaggacgagatttacacttgggactatgtgatggagcaacgggcaaaggcttcatgggatttgacccatttcggtgatccgaatccatacgcctccctgcccacgatgaacatctatacatgcgacctcggacggttgctccatgagttcgtggatgaagatgtggcttttaacttccgtgagtttttccgggtaaatgaagccggaaactttatccatgaaaaagatgtgaaggcatttttgaatcttatctccaaggaggacaaggacagttgctatccgtttgccaacgaggaatatcgcaacatcttccgtcatacactatggatgttgccgggtgtgaaggaggctcgtgccatgagtgctttactacaatcacatcctgtattccagcatttcaaggtggtgaatgtggcaggagacggtgacgaggacgaagagagtaaggatgcgcttgctgcggtggaagaagccatcggcaaagaccctgatgccactcgtaccattaccttgtcttgcggacgattgaccacgggtgtcagtgtcaaggcgtggacgggcgtattcatgttgtccggctcttataataccgctgcatcaagttatatgcagaccatcttccgtgtgcagacgcctgccaccatcaacggacgcgtcaaggaacagtgttatgtgtttgattttgcgccggacagaacactgaaagttattgccgagacagcgaagatttcctctaaggcaggaaagaccagcgggaacgaccgcaagattatgggtgagttcctgaacttctgtccgattatctccatcgaaggctccaagatgagccagttcgatgtacccaagatgttggagcagcttaaacgtgtttatgtggaaagagttgtccgcaacggtttcgaggacaagagtctgtataatgatgagttgatgaaactcaacgacttggaattgcaggagtttgacgacctgaaaaagattatcggccagaccaaggcaatgccaaagaccaatcaggtggacatcaacaaccagggactgaccgatgagcaatacgaggaacttgaagaccttgaaaagaaatccaagaaacgcggtaaggacaagcaacctttgacggaagaagagaagaagcgtcttgaagagctgaaaaagaaaaagaacaaccgcgaggccgctatttctattcttcggggtatctccatccgtatgccattgcttatctacggtgcagagttgagcgatgagagtcaagatataacgattgataacttcgctttactcattgacccacaatcgtgggaagagttcatgcccaagggtgttaccaaacagaagttcaacagcatcaagaaatattacgacccggagatattctgtgcggcaggcaagcgcatccgtgccatggctcgtgctgcagacaaacttagtgtggaggaacgcatcgaacgtataacggatatattcagcacgttccgcaatcccgacaaggaaacggtgcttacgccttggcgtgtcgtgaatatgcaccttggcgactgtttgggtggatataacttctttgaaaaggactatgagaccaccttgtctgaccctcgtttcattgaccgtggtgaagtaactgccaatgtgtttgcccccgattcccgaatccttgaaataaattcaaagtcagggttataccctctttacatggcatacagcatttaccgtgcaaggctcaaggactccctgttttcggtgtcaagcattgaggatgaacagcgtatatgggacaaggttgtcgccgaaaacatctttgtcatctgcaaaactccgatggcaaagagcatcaccaaacgcactctcatcggcttccgcaaagcaaaggtaaacacccgatactttgaggacttaatcaatcaaatcaagaacaaaccggaacatttcatcaggcaggtagataaattcattacggatagaacaggaataaagaatatgaaaatcaatgcgatagtgggtaatccgccatatcaagaggttgttgcacaaaaggaaactgcaaatgggcaaaaagttagtgttagtatattccaatactttcaaacaataagcgaccgattaggtagatacacttctcttatctatcccggagcaagatggattcaccgttccggaaaaggacttgaacagttcggacttacacaaatcaatgacccgcatttgtgcttcttgaagtttttccctgattccatggatgttttcaaagaagttggtattgcagacggtttgtcaatagtgatgaaagatacgcaaaagaagagtaatggatttagatatgtctatgctaaaaaaggtaaggaagtgacgattgaagccaataatccgaaagaagaattattttctttgaatcctcttgatagtgaaatctcatattctttgaattgcgctataataaaatataggtgtttacatgatgccatattacctcgtagtctgttttctattgaaagtgatttcgtagaaaagaatcctatgttagtgagagaatataacgatggagattattttgacccaaaatcagaaataaaacttttcacaaatgacaaagcaggtaagagtggcagagccagatggtatattgcaaacaaagaggttctcactacagggcttgaacacttaagcaaatggaaagtcatcgtttcaagtgccaatgccggaggacaaaagcgtagcaaccaaattgccatcgtagataatcacagtgcatttggtcgctctcgcgtagcattgaaaacattcgctacagaacaagaggccaagaactttttcaaatatgccaccagcgagataatccgctttgctttcctgcttaccgatgaatctttaacctctttggcaaagaaggttccagacttattggattacactgacgctaacggtatcattgattacaatggagatgtgaatgctcaactttataaattgttgggtattgatgataggaatcaacagcatataaaagaattactctcacaaaaatgagatttttgtcgtacataaaatgtacctagattttatatcaagcaatttcatgactaaactttcggtgtccacacttcattgtggacaccgaaagtttagtcatggatatactgtttaatcatattgtcaaaatttgttctaaactcttgtgcctcctcagaaattgaacttaaaaaaggattaaggactttacaaccgtttcgcccccaatattctaattggctattaaaccatttttttgcattttggcgccccagttcacctcctgcatttatttgttccatggaatactctcggaaacagaattgttttgtgtacccatctgcaatcttagaccataatgggtctacatcagatagattatacaaataagaggccaatagtctttctggagacttatttcccggtaaaatcaaaatgttatctgcattgttgattttcctgagatcatttttattcattctaacatccccatctaatataacaatagaatatggatatataaaagcaggcactcttttggttacaagttccattaatgttgaacatggtaatgttacatccacaaaatccaacacaaaagccttgctctttaaaatagcttttacaaataagatattttccttgtcttccgtatatgctgtaattctgtttttcttgcgattatttccttctgcaacaacatttaaatccaattgaatgcctttgaagttcacgccctgtttaattgcaatcttatcatcaaccttcttaaggtaaaggatctttgcttgattggctgtttcttcttttttagttacttcttgaactaaatcatccattgccttaagaagagacattgaatgagttgtaaataaaatttgcaaattcaacttagatgcatatttgcgcaaaacctttaacaactctacttgggatgcgggatacattgttgcatccatctcatcaatggccaaaataccgcctttgtattgtcggggatatttgtcatgtaatcttttaaaagaaaataacgccaagataattttacctaaattatcttgccccatagagttttgattccaatcgtatagttctgtggatacacctatagattgcttgttttttgatgtgattgttgttgcggaagaaatgggagtttgtgctattagaattttattatgcaattgcttaaactcatttagttcttcttgcgttaataatgtatcatctgtaatgattttagcttcctctgccactggaactaatcgctttagacttaaaaagattgtggggaaggaaatgtatccatctccttcttgcctagctccttttttccaaaaacggacattaggatctcctgttcgtttgatactttcaacagtaaaatcatccattcctgcatcaaaggaaatagtccattcatgaccttttggtttatcaaaagtaggtgataacctaaacttatctttgaatgcggaaatataactaccaccacacaagggcttttcaactctcatagaatcttctgtcttaagagtgaaagtttgtgttataataccaagtaatgttgacttttgagttccgttttgccctgcaattgctgttaacaaagagcctacttcaaaatcttcattttgaaatcctcgaaatctttcgatatgaatgtgcgttattttcactttgtagaatggttaaatagtttgtgtttggggataactatgccatcgcaaaataccattatctctttacctttcccggaattactcgcactataattcaattcaaaacattgctgtctatattttgaatataggctggttatgaatggtacattatcataagagacaatccacttacaatttgcaatctcacttatagtgttagctatattttgatgatctgtatcattatagtaattcagataaagtcctttaccttttacatagtatggtgggtctaaataaaataacgtattatacggtaattcattttttaaccgttgtactaaagaaacagcatcttcatttgttaaatggattctatctgcataatctgctatacgttgaatcctttttatcaaatcttctttgttgaatcttgcatcaatcttataatttccagtttggtcataaccgccaatgactcctgctttcaagattcctgagcgattagtcctattcaagaagaatgtagaaaagcctaattctaacaagtcagaattctctttattggattgaatttctttttgtttaaaccaagtttcaacatttaaaggggtatcctttatcatcttgcagagagcatccacgttatttaaggcactataccaaaaggcataaatagatatatccttatcatttatatgtatgtcgctgacatattcattaaagagcaaagataatgcaacggaaccacctccaacatatggttcaacataagtgccatcgagcaatgcgttttctttgattaagcattgtacgaaatcagcaactttagccttaccgccagggtatcttaaaggtgatagaaattccataatattattctttattctttattgattcccacaattggataaaaaaactttctatgttgtcccatccagtaatcaaattatctgctttagggtagaaaaactcgttatgaacatatgcattcaatgattcgattgaaagaactgaatttttatcatttatttcagaccttatgccctttgataagtcattactcattgttcctaattgggtcatatgatttaagactttaccaactttcccttgcaaactttcaccagaagaacaagctgtaatagcattgtttcttactaaatcaaatttctccaaataggcatcaacagatagttctaaaaatactcttaaaaggactgaagatgcattggggcatgtcttgacctgaacatgttttagctcctcgaaaattttattaattttcgggttgctgatatgtaaattcaaagacttgggcactaaagctcctctgtttcttgttttcctgtttttatccccttttatttcttgtttctcgctatttcttgatgcttgttctttattgttctcaatatcttgaacactccattgttcagatgcttcattagacaaatctggcttttgactcttgccaaaattatcaatatattgctttcttttttctctgttatagatatcagaaactttgaattccggattcagaatgtctgtaacaacttttaaaagccccttaatgacttcggacactttaacctttgaaactaaaattccattgttaatttccaagccaaggtgttctctaacatatggatccgacatcaaacgttgcaagttggtaatgtttaatttagataatgaatccttaatcgtatcagaaacctcttcttgtgatttcagcaaagtgataatttgcaatggaattgatgattttccttctgtcttctcctcgaatctttgcttttgttgagcgttccaagtgacagttccgataccattaagttctccagagtgtttacgttttatccatatatcagcttcagtaggggtttcaaaaacagcacaagcaatattcttcaattcagaaatagcattaggtttttctttttgtaatttctgaaatttcttccttaaaggagagtatttgtcatctattagtgtcggattatttaatagttttaatgacgttattcgcctatttccttcaagtacaacatacttattgctgtcttcgttgggtgttacaataatcaaatcgacggggctaagaccattggttacaatatcgtccacaagagaatataatttatccccttgatcctctatcatcttatctattgcttctttttgtgatgataaaggctcaaatctataattttccgtattgacaaatagtgatgtcaattttatcgttcttataaccatggcaaaaccaatacttgttagtttgcaaagttactcatttttagtgaagttagcagtatttgaacaataaaaatgcacaggaatctgcgattttgcacgattttgcaggatgaagtttattgtaaatcaattctaatcactatctttgcattgcaaaaaggcgttcttttgatttaatgcaagacgaggtaaaatacagaacttcactcgtttccaaatcgttacctatcaagaaactaatctttgcaatctattcaaattcagcgacaaaggcaattcaatatgcctggcgcagtgaaacgtgatgttcttatctactcccgcttgcttggccacctttttcaagtatctgttcatcacctgattgagtggcacggggaatatatgattgttccgttttccttcgtgatatgcctcatacctttttaatatattaacggcaggttgtaataaaggcagtattgcgtgtatgtcagttttttgccgatagtagctaagccacaggcttttgtctatgccgacattaatattttcattggtaaggttctctatatcgacataggacaggcctgtatatacagcaaaaatgaagacatctctcacgatagacaggttggcaggcaaagggacctcctcaaggcttttcagttccttttcggagaggaatcccctttccacttttgttttcttggcattgagcaggcaaacagggtttcggcttatccattcgttttgcaaggctacattcatcacctttttgaaacgctggatatgctttaatgcaccattgactgcgcatacggtatccccttccctcctatacccttgaagataggcgtaaaattcataaacgaatgctttgtcaacagcagccaggtcataatcggaaacgtggtatttaatgcgtatgaaattgagcagatgttttttcgtgacgtgatagccaataaatgtactggtacggagattctttttctccatgatttcatggtagtcgaacagtgtgctgatcgtagagaactcattatcctgtgtctggaacatgagtttgaaattctcaatgttcaagggatagcttttctgcctgattttggcaatggtatcctcaatcgtgatcttcaaatcctcgatataccgattgacttctttatcattagcggttttcccgagcgacttttgcgcaaccgccgaccatgattctgagcgtagatgtagtttcgtgggaatttcgtatctttgccctgagatcgtaacccgacatgagagaggtgacatcttttcattcgttcttcctttccttatccagaaaagaacattgaaagtttgctttttttggttcatcgttgttttttttgagaatcactcaaaaaaatatcaaaaaagagcaatcgtgtcaccgaatttgtcaccgaattagcgtcaacttttttcgggtggcatttgtcaaagcatgaaaaaacccgctaaaattgcagttttagcgggtttttgtcattaaaaagctggtggtttgttgggctacctggattcgaaccaggaatgacaggaccagaatctgtagtgttaccattacaccatagcccaatgattttcgtttgcgggtgcaaagatacaaataatttgggaattgcaaacatttctgctattttttttgcaaaaactctcattttgctccttcaagtagaagcatctcccctaaaaaacacaaaaattaagtcataactttcttgtatccaataaatcaccgtatatttgtcaaaaatatcacgtttataatcagaaacaaagggtaatccttttttgttataaaccaaaagagaacatgaattattaatttcaattacaggaatgaacgatacgaaaatattaattgaaaaaattaaagagggaattcaggaaaaaaaaggtaaaaacatcattattgctgatttaaccagtatagaagataccatctgcaaatatttcgttatatgccaggggaactcccctagtcaggtaaatgctattgtagactctgtcaaggagtttgcccgtaaaggtgcagacagcaaaccgaccgcaatcgacggacttcgaaatgcagaatgggtggcaatggattattccgatgtacttgtacatgtctttctgccggaagtaagatccttctataatcttgaacatctgtgggctgacgccaaacttactcaaatccccgatttagactaatccacaattatggacaacaataatactaacaacaataacaataagcctaataataaggtgaatatgcccaagttcaatctgaactggctatatatgattattgccctcatgcttctcggcctttggtggagcagcgattcaagaggaagcggaagtaaagtcgttccttacagcgacttccagaagtatgtcactaacggctacatcagcaaagtactgggctctgagaaaactctcgaagctcatgtcaaaccgaatgccgtaggtgcaatattcggtgcggactccaccaaagtaggaagaaacccaattattaccagtaaccctccttctaaggacaggctggataaatttctgcaggacgaaaaagcagccggtcattttgacggaatagcagattaccctgccgattcggatattttcccggcaatcctgattaatattcttccgctggttttattaatcgccctgtggatattcttcatgcgtcgtatgagcggcggtggcggcggtggtgccggcggtgtattcaatgtaggaaaatccaaagcccagcttttcgaaaagggaggctccatcaagattacattcaaggacgtagccggcctggcggaagccaaacaggaggtagaagaaatcgtagagtttctgaaagaacctcagaagtatactgacctaggaggtaagattcccaaaggcgcattgctcgtaggccctccgggaaccggtaagacattgcttgcgaaggctgttgccggtgaagcaaacgttccgttcttctcactggcaggttctgacttcgtagaaatgtttgtcggtgtaggtgcttcccgcgtacgtgacctgttcaagcaagctaaagaaaaagctccttgtattgtctttatcgacgaaattgacgcggtaggccgtgctcgtggcaaaaaccctgcaatgggtggaaatgatgagcgtgaaaacaccctgaatcagttgctgactgaaatggacggcttcggctccaacagtggtgtgattatccttgccgctaccaaccgtgtggacgtacttgacaaggcattgcttcgtgccggacgtttcgaccgtcagatacacgtagacctgcccgaccttaacgaacgtaaagaagtattcggcgtacacctgcgtccgatcaagatagacgatacagtagatgtagatttgctagcacgtcagactccgggattctccggtgcggacattgcgaatgtctgcaatgaagctgccttgatcgcagcccgtcacggaaagaaatttgtaggcaagcaggattttctggatgcggtagaccgtatcatcggtggtctggaaaagaagaccaagattaccacagaagcggaaagacgctcgattgccttgcatgaagcaggacacgcctctatctcgtggttgctggaatatgcaaatccattgatcaaggtaacgattgttccccgcggacgtgcattgggtgctgcctggtatctgccggaagaacgtcagatcactaccaaagagcaaatgcttgacgaaatgtgcgctaccctcggaggacgtgcagccgaagacctgtttatcgggcgcatctctaccggtgctatgaacgacctcgaaagagttacgaaacaagcatacggcatgattgcttatttaggtatgagtgacaaactacccaacttatgctattataataatgaggaatattctttcaaccgcccgtatagcgaaaagacagccgaactcatcgatgaagaagtgaaacggatggtgaacgagcaatatgaacgtgccaagaagattttgtccgaacatatggaaggacacaatgaactggctcagttactgatcgacaaagaagtgatctttgccgaagacgttgaacgtattttcggtaaacgcccgtgggcatcccgctcggaagaaatcatggctgccaaagaaagccaggatgctgccagagcggaaagagaacttgccgagaaactgaaagcagaagaacaagaaatcaaagaagaggaagctaaaaattctgctcaggaagaagcaactacagaaacgaaaatcactgcggaaggaaaaaaagtaaccgtagaaggaaaagttactatagaagcaaaatccaatgagaaagaacaaactaccgaatctaaataattaaaacacgaagattttgattagtaattttataaaacgggccattacgggtatactctttgtcgccattctggtgggatgtatactctataattctttcagcttcggcattctgttcatggcgatcagtgcactgacgatctatgaattcggacagttaatcaacagccgtgcagaaggagtcaacgtaaacaaaaccattatcatgctgggaggagcttacctgttcctcgcagtgatgggattctgtatcgacgcagccgactccaagattttcattccttatttgctgttgctgctctatttgatgatcagcgaattgtatctgaaaaaggcaagttcaatgcttaactgggcatattccatgctcagccagctttatataggcctgccgtttgccttgcttaatgtcttggcgtttcatactgatccggaatatagcagcgtaagctacaatccgattctgccattgtccatctttatattcctttggctgagtgatacaggtgcatattgcgtcggttcattaattggcaaacaccgcttgtttgaacgtatctctcctaaaaaatcatgggaaggttccatcggcggcggagtagtagctatcggagcttcttttgtcttggcacattacttcacgattatgtcgatgtgggaatgggcaggtctcgctttagtcgttgtcgttttcggaacatggggcgacctgacagaatcattactgaaacgccagctgcacgttaaagattcagggaccattcttccgggacacggagggatgctcgaccgtttcgacagtgctttgatggctataccggcagcagtcttttatctgtatgcactaacttggttttaataacagaataaataaaataaaaggtcggaagccgctttgaagcacttccgacctttttttttcacacacagtgttcgtcaaggtttaggtttagttatttataaaagttttgctatttaacaaaagaagtagaatgcacatctttcgctttttccggaacgcctaccggatgatccaaatcaagaacgatcactcttccttctccattttcttttgaattaatagtcaccttaaatcctttaaattctgtttcagctgcatcttttgccgttggatagaactcttccagattataagaaactcgtccccatccccggtatccagttacatcatcatacgtattgtaacgtaattccagatgtatatacccatcttcatccacattcaaagcttccggtgtttccggagcttccggttctatcttattctgtacaagactgatgcggtgcttttcagaacgaggcaaatactgatggaagatgatattcaaaaactttcctcccagccacatatctccttgataaatcacgataggatcattaccgaattcctcttcattttcagccgtcatatcttccacctcttttgtcaacacttcctgaattccttcaatctttacctgagcacccttatccgtatcagccaaaggattgaaaaaagcaactactcgttcaccgtctaccggtttgtaccaaggaatagaactggccaccggatcaatcataccccaacgatcaccttccagataataaccaccgccaccggtggcacgaactgtagcccaatcccatcctatgtctccaattgagtacccatcgtcgtcacatgattgcagcgcaggtaccaatgcgagcaataacattactaaaagccaattaaattttttcatatttgttcctctctttttaattcttctgctatataaataaaaaagccgggcatttactgcaccggctttacgtttattcagaaaaagaaagttattttttcaacagttcaagcattttgcgagcggcatgctggggagcacctgcaggtcccaaccgatctgccatatactcatattcggcaagcatacgattcttatactcctgatcttcaatcagtttctttagttcattctgcatatttccgactgtcattgtatctgcaaccaactcctttacgacctcacggtctgcaatcagattgaccagtgaaataaatttcactttcaatatatgacgacgcaaaaacgaaaccacttttccaatcggtgtatagtaacaaaccacctgaggaacacggaacaaggctgtctcaagagtcgccgtacccgaagtggccaaagccacctccgcatgttgtagcaaacgataggtctgggcaaagattattttcactttagcctgccctacatattgcttgtaatactccggagcgatgccgggagcaccggccagtaccagttgataatcgggaaaagcagaagccgccttcagcatatccggcagattatccttgatctcctgtttccggcttcccgccaatagtgcgattatcggtttatcctccaggttattatccgccaagaatgcttccggatttttgggatgagctttctgataggcagtcacttcatctaccgtaggatttcctacataatgtataggatagcggtgtttcaaagtataaaactccacttcaaaaggaagaatggagaaaagttcatccacatcacgtttgatattctttatgcggtactctttccatgcccatatcttcggagaaatataatagaagacaggaatctgcgtctcggaatgcacaaacttagctatgttaagattgaaaccgggataatcgaccaagatcaccacatcgggattccaggccacaatatcttccttgcaacgtttcatatttgcaaagatcgtacgcaaatgaagtagtacagggataaatcccatatacgccagttctttataatgcttcaccatcgttcctccgacggcagccatcagatctccgccgaaaaagcggaaatcggcctgaggatcttccgccttgagggccgtcatcaaatgggacgcatgcaagtctccggaagcttcaccgacaatcagatagtacttcatgggaattttgaattaggagttttgaaatttgaaatcagcacaatgcgtatgtcagaattccagttgctgacaatagccattcagttcatctataaagccataagcagtcatatcgactgtcgttggcgtgatagccacatatccgttttccagcgcccaatgatcattattctcgttttcaagttcatgatcggtgaatgaaccggtcagccaaaagtaattatggtcatcgagacgggggcaagttacccattcattcacccagcatccctttgcctgttcgcaaaccttcactcctttgaggttgggagtatcgggaaagttcacattaagacaagtcaacgggggcagtcctttttccaatatcatggcagctatcttgcgtatataaggacccgaaggttcaaaatcagcatcgggccgatgattgcacagagaaaaaccaatcgaaggaattcccttcagacagccttcaatcaccactcccatcgttcccgaataatgcacgttaatagcggaattatctccatgattgataccgcctacgatcaggtcaggcttccggtcgagcactgagcccaatgccagcttgatacaatcggtcggcgttcctgtacatttatatacagtcagtcccacttctcttttgaccagttgataatgaaccggatgagtcaccgtcaatgcactgccgctgccggagcgcggagagtcgggtgccattacaacaatttcccccaacggacgaaggaacttcaccaattcactaatacctttagccataacaccatcgtcattcgaaacgaggatcaacggcttcttactttccatatattcaatcctttcctttttaatgttcgcacaaaagtagcaaaaagtaaccgtactgccaaccgcttatctccgaatatcacattaatcacatcgctatctgacgaatatacacccgtttacaaatcttaatcttctgcaagcgagtaaaaaaagaaatagatatccaatataaatatgtatatttgcaagctcaaacagagaaagtatgatgataaaatcaaccaggtttcggaactgtttcgtccggcagttattaacaaaaccggtgacttatcaacagaaaatgcaaagtttctcttttttcgtaggcgctctaaggaattatcacttatttcgctgccaataaatttagagtatatgggaaaaataattgctttggccaatcaaaaagggggtgtaggaaagaccacgactacgattaatctcgcagcgtcacttgctacacttgaaaagaaagtactcgtggtagatgcagacccgcaagcaaatgcctcttccggcctgggagtggacatcaagcagtcggaatgcactatctatgaatgcattattgacagagccaatgtacaggacgctattcttgacacagaaatcgactctttgaaagtgatctcttcgcacatcaatcttgtaggagcagagattgaaatgctgaacctcccaaaccgcgaaaagatactgaaagaagtgctcacacccttgaagaaagaatatgactatattctgatagattgttctccttcactcggactgattaccatcaatgccctgacggcagccgactccgtgatcatccccgtgcaagctgagtattttgctctcgaaggcatcagcaaactgctgaatacgattaaaatcatcaagtcgaaactgaatcccgctctggaaatcgaaggtttcctgctgacgatgtatgactcacgtctgcgtcaggcaaaccagatttacgacgaagtgaaaagacacttccaggaattagttttcaacagcgtgatccagcgaaatgtgaaactgagcgaggctcccagctacggtatcccgaccattctttatgatgcggactctaccggtgccaaaaaccatctcgcccttgccaaagagattatcaacagaaataaataaccgaagaagatatggcaacacaaaaaagaaatgcattaggacgcggacttgacgccctgctctcaatggatgatgtgaaaaccgaaggttcttcttccattagtgaaatagagttggcgaagattaccgtcaaccccaatcagccacgccgcgaattcgatcaaacggcattgcaggaactggctgattccattgcggaaatcggtatcatacagcctatcactctacgcaagctctcggacgatgagtatcagatcatcgcgggagagcgtcgttaccgtgcttcacaaaaagcaggactgaaaaccatccctgcctacatccgcactgccgacgacgaaaacatgatggaaatggcgctgattgaaaacatacagcgtgaagacctgaatgcggtagaaatagcattggcttatcaacatctgctggaccagtatgaactgacacaggaacgcctgagcgaacgtatcggcaagaaccggaccactatcgccaactacctgcgtctgctgaaactgccggctcctatacagatggctctacaaaacaaacagctagatatgggacatgcacgtgcattgatttcattaggcgaccccaaacttcaagtaaaaatattcgaagagatacaggaacacggatactccgtccgcaaagtagaagagattgtcaaatcgctgagcgaaggagaagctgtgaaaagcggcacacggaaaatcactccgaaacgcagcaaactaccggaagagtttaatttactaaagcaacaactcacgggatttttcaacaccaaggtacaactgacttgctccgaaaaggggaaaggaaaaatcagtattcctttcagcaacgaggaggaactggaacgtatcatggaaatcttcgatacgctaaaaaagtagatgacaagaaaaagtaagaaatatcagttacccatcatcaccctgcttctctgttttctacaggtggcagggattgatgtgtatgcacaagaacctgtgactccggtacagaaagacagtattattcagagccgggaagcaccgaaagcacgtgcacgaaggcaccgggatcctgctcaggtgatggattcgttgaaaaaggattcaatcaaaatattgcatccggaacgcctgcaagcaaccgacagtctgtctgctgtcaaaatacagatagccgacagtcttgacgcagccaataaaaaagaactgaagaagatagaacagccggcacctattgtagtgaaaaccgacacagtacctcctgtgcaggatctcaacaagaaactgttcattcccaacccgaccaaagcaacatggcttgcagtcgtattccctggcggaggacagatttacaaccgtaaatactggaaactacctattatatatggagggtttgcaggatgtgcgtatgccctcagctggaacgggaaaatgtataaagactattcacaggcctatctggacatcatggacagtaatccaaacaccaagagctatgaagatttgctgccaccgaacgcccagtataatgaagagcaactgaaaaacaccttgaaacgaagaaaggactcgttccgtcgttttcgggaccttagtatatttgcatttatcggagtataccttatctccatcatcgatgcctatgtcgatgcggaattatcgaacttcgacatttcacctgacttgagtatgaagctggagccaactgtcatcgacaataacagccagttccgctccaacagttacaagaataagtcagtgggactgcaatgcgtactacgattttaaaaacacaatttagattgaacttataattaaagcatgaagaaattagaaaactattgttcgattattttccttttcctgttggcaaccacacaggtaaaagctcaaagtgtagatgtagttattcgtgaaaacggaaccgaacgcaaagaaagcatcgatcttccaaagagtatgacttacccgctcgacagtctgctgaacgactggaaagctaaaaactatattgatttaggcaaagattgcagtacggcggaagtgaatcctttattcagtgattctgtctacattgaccgcctttcacgtattccggctgtcatggaaatgccttataatgacattgtacgcaaattcatcgatatgtacgcgggtcgcctgcgcaatcaggtttcattcatgctgagcgcctgcaatttctatatgcctattttcgaagaagcactggacgcttacggacttcctttggaactgaagtacctgccgattatcgaatctgcactgaatccttcagctgtgtcacgtgccggtgcttctggactgtggcaattcatgattggaacaggaaagatttacggtcttgaatccaatagtctgatagacgaacgccgcgacccgatcaaagcaacctgggctgccgcccgttacttgaaagagatgtacgatatttatggagactggaatctggttatagcagcctataactgtggcccaggtactatcaacaaggcaatccgccgcgccggaggcgaaacggattactggaaaatctataacctgctgcctaaagagacacgcggatatgtacctgctttcatcgcagccaactacgtgatgacatactattgcgaccacaacatctgtccgatggaaacaaacattccggcaagcacagatacggtgcaagtcactaaaaaccttcatttcgagcagattgccgaactttgcaatgttccgctggaggaagtgaaaagcctgaatccccaatacaagaaacaagtgattcccggcacgaccaaaccttgtacattacgtttaccacaaggtgccatcagtacgtttattgacaagcaagatacaatctacgcacaccgtgccgacgagctattccgcaaccgcaaaaccgttgcagtgaaagaagttactccaaccacccgcagacagacaagcgctgttgccggtaaaggaaaattaacttattataagataaaaagtggagacactctttcatcgattgccgaaaagctaggcgtacgtgtcaaagatatacagcagtggaacggtatgtcgaacaccagaatcgcagcaggaaaacaattgaaaatctacaaataaatgacttcccgcttgcttcattcggaaatttgcttatttttgcaaaaataagcgaatgaaaggataacgaatatggataatataacccccaaagaaatagcagatgaagagatgatcaatcaggcgttccaggaacttctgaatgattatctccatactaaacatcgcaaacgagttgaaatcatcacaaaagctttcaacttcgctaatcaggcacacaaaggaatcaaacgccgatccggcgaaccttatatcatgcacccgattgccgttgcacaaatagtatgtaacgaaattggtcttggttctacttctatctgtgcggcactgctgcacgacgtagtagaagacactgattacacggtagaagacatcgaaaatatctttggaccgaagattgcccagattgtagacggactgaccaaaatctccggagggatcttcggtgaccgtgcttcggcacaggcagagaacttcaagaagttactgctcaccatgtcgaacgatatccgagttatcctgatcaaaatagccgaccgcttgcacaatatgcgcacgctgggttccatgctgcccaacaagcaatataagatagcaggagaaactctctacatctatgccccgttagccaaccgcctaggtctgtacaagataaaaacagagcttgaaaacctcagcttcaaatatgaacaccccgaagaatatgccgagatagaagaaaagctgaatgctaccgccgccgaacgcgacaaagtattcaacgacttcacagctccgatccgcacccagctggataagatggggctgaaataccggattttggcacgtgtgaaatcgatctactccatctggaacaagatgcagaccaaacacgtcccgttcgaggagatttatgacttgctcgctgtccgcatcatcttcgaaccacgcaacgtggaagaagagctcaacgactgtttcgacatctatgtctccatttccaagatatacaagcctcatcccgaccgcctacgcgactgggtaagccacccgaaggcgaatggttaccaagcattgcacgtcaccctgatgggaaacaacggacaatggatcgaggtacagattcgcagcgaacggatgaacgatgttgcagaacaaggctttgccgcccactggaaatataaagaaggaggaggcagcgaagacgaaggtgaactggagaaatggctgaaaaccattaaagagatactggatgatccgcaaccggacgcaatcgactttttggatacgatcaaactgaacctgtttgcttccgaaatcttcgtgttcactccgaagggagagttaaagacaatgccacaaaactctacggcactggattttgccttctcactgcacacagatatcggtagccattgtatcggcgccaaggtcaatcataaactggtgccgctaagtcataaactgcaaagtggagatcaggttgaaatattgacctccaaatcccaacgtgtacaaccgcaatgggaggtatttgcaacgaccgcccgtgcccgtgccaagatcgcagcgattcttcgcaaagaacggaaagcgaatcagaaaattggcgaagagctactcaacgagtttctgaagaaggaagaaatacgtccggaagaagctgtcatcgagaagttgcgtaaatttcacaacttcaagaatgaagaagagttactggccgctatcggcagcaaagccattactttgggagaagcggacaagaacgagctgagagaaaagcaaaccagcaactggaagaaatacctgacgttctccttcgggaacagcaacaaggaaaaaccggaagagaaagaaccgcaggaaaaagaaaagatcaatccgaaagagattcttaaactgaccgaagaaagcctgcaaaagaaatacatcatggccgaatgttgtcatccgattcccggtgatgatgttttgggttacgttgatgaaaacgaccgcattattattcataaacgccagtgccctgttgctgccaagctgaaaagcagctatggtaaccgtatattagcgaccgaatgggatactcacaaagaactttctttcctcgtatatatctatttaagaggtatagacagcatgggacttctgaatgaagtgactcaggtcatttccagacagctcaacgtgaacatccgtaaacttgccattgaaacgaatgacgggatattcgaaggaaagattcagctatgggtacacgatgtggaagatgtaaagacaatctgtaataatctgaagaagattcaaaacatcaaacaggtgaaccgggtggaggaataatttatcgtccgtccagttctttcttgatagccagaagctcttccttaatacctttcagacggttcacaatttcgtaattgcgaaccgtggcttccttattatccttcaaccgttgacgggcaccgggaagcgtcagacctttctccttcaccagatgatagatcagaccaatcgtttccacatcctcctttcgatactgacgtatccccctccccgttgtcctgggagaaatctgcgggaactccttctcccaaaaacgaagcaaggatgcattgactccaaacatatcggccacttcggctatggagtaatataattttagttctttgtccgtattcagcatagaaatcgttgttttaagagattaatcgaacactttaccgtgattggcggctagttgaatcatcttctcataatcttccgcactcaagtccatgaagtaatagttgacaggattcacaacctttcccttcacgtgtacctcatagtgaagatgaggaccggtgctcttacctgtacttcccacttttccaatcacctcgccacgcaccacctttttcccaactttcgtgttatagctctgtaagtgagcgtaccgagtcagataaccgaagccatgatcaatctcaatcgtattgccatatccggtttcccatcctacttttaccactgtaccgtcaccggtcgcatagacatccgttcccggatgagcggagaagtccattcccgaatgaaacttcgtcgtaccgtaaatcggatcaatacgtgttccgtatccggaagcagtcttgcgaaggtctttattggagataggctggatagccggaatacatttcagcatttcatcatgattcttacacatatccaccacgtcatcgaaagatttggactggatataaagttgtttggacagtacatccagcttttgggtcgtatttaccaccagcttggagtttgccagatccatcagctcctcataccggttcgtacctccaaaacctgcctgacggatagccggcgaaacaggatcagcttgcagaatcacccgatacaggttatcgtcacgctgctgaatatcctgcagcacccccatcgcatcatccagacggcgggaaagtacattatattgcgccaaaagacggctattttcgattcgcagctccttctccgaaggcgatccgaacactagaagcaagacgatgaagcatccggctccaagtcccataccgataaaaagccggcgcagaatgctaagtgcacgctgccgtacggtagggtaaattcggtcataagtctgcgtccttggattgtagatgtagtaaactttgcgcatctttttggaaatatttcgcttgttaatacggcaaaagtaataaaaacaagctatctttgcacagttttttgagaatattaacctcaacaatagatatatagaagaatatgttgactgcaaaagagatcagagattcattcaagaatttctttgagtcgaaaggacaccacattgttccctcggctccgatggtgataaaagatgaccctaccctgatgtttaccaacgcagggatgaaccagtttaaagatattattttgggtaaccacccggccaaatatcacagagtcgcggactctcagaaatgtctgcgtgtaagcggaaagcataatgacctggaagaagtgggacacgatacgtaccaccacaccatgttcgaaatgctgggcaactggtcattcggtgactacttcaagaaagaagccatcaactgggcatgggaatatctggtagaagtattgaaactgaatccggaacacctgtacgccactgtattcgaaggaagtcccgaagaaggactgagccgtgacgacgaagccgcttcttactgggaacagtatctgccgaaagatcacatcatcaacggcaacaagcacgacaacttctgggaaatgggtgatacaggtccttgcggaccttgttcggaaatccacatcgacctccgtccggcagaagaacgtgccaaaatctccggccgtgatctcgtcaaccacgatcatccccaagtgattgaaatatggaaccttgtgttcatgcaatataaccgtaaagctgacggcagcctcgaaccacttcctgcaaaggttatcgatacaggtatgggattcgaacgcctctgtatggctttgcagggcaagacttccaactacgatacagacgtattccagccgatgctgaaagcgattgcagcaatgtcaggcacagagtacggaaaagacaaacaacaggacatcgccatgcgtgtaatcgctgaccacatccgtacgattgctttctccattacggacggtcagctgccttccaatgccaaggcaggttatgtaatccgccgtatcctccgccgcgccgttcgctacggatatactttcctcggacagaaacagtcattcatgtacaagctgcttccggtgttgatcgacaacatgggagacgcttatccggaactgatcgcacagaaaggtctgatcgaaaaagtaatcaaggaagaagaagaagccttccttcgcacgctggaaacaggtatccgtctgctggataaaacaatgggagatacaaaggccgccggaaagacagaaatcagcggtaaagatgcctttaccttatatgatactttcggttttccgttagacctgacagaactgattcttcgcgaaaacggaatgacagtcaacatcgaagagttcaacgcggaaatgcaacagcagaaacagcgtgcacgtaacgctgccgccatcgaaaccggtgactgggtgactctgagagaaggaacaaccgaattcgtaggttacgactatactgaatacgaagcatctattctccgctatcgtcagatcaagcagaaaaaccagacactgtatcagatcgtacttgactgtactccgttctatgcagaaagcggtggtcaggtaggcgacaccggtgtattggtcagcgaattcgagaccatcgaagtgattgacaccaagaaagagaacaatctaccgatacatattaccaaaaagttgccggaacatccggaagctccgatgatggcttgtgtagacaccgacaaacgggcagcctgcgcagccaatcactcggcaactcacctgctggactctgccctgcgtgaagtactgggcgagcatatcgaacagaaaggttcgttagtaacaccggattcactgcgtttcgacttctctcacttccagaaggtgaccgacgaagaaatccgccaggtagaacacctggtgaatgccaagattcgtgccaacatacctttgaaggaataccgcaacattcctatcgaagaagcgaaagagctaggagctatcgccctcttcggtgaaaagtacggtgaaagagtacgtgtcatccagttcggttcttctatcgaattctgtggaggtatccacgtagccgcaaccggaaatatcggtatggtgaagatcatttccgaaagctctgttgcagccggtgtacgccgtatcgaagcatatacgggagcccgtgtggaagaaatgctggataccattcaggatacgatcagtgaattgaaatcgctcttcaacaacgcacccgacttgggtattgccatccgcaagtatattgaggaaaacgcaggactgaaaaagcaggtagaagactacatgaaagagaaagaagcctcgctgaaagaaagactgctgaagaatatacaggaaattcacggtatcaaggtaatcaagttctgtgctccgttgccggcggaagtggtgaagaatatcgccttccagcttcgcggtgaaatcacagaaaacctgttctttgtggccggaagcctcgacaacggcaagcctatgctgaccgtcatgctaagtgacaatctggtggccggtggcttgaaagcaggcaacctggtgaaagaagcagccaaactgattcaaggcggcggaggcggtcaacctcatttcgctactgccggaggcaagaatacagacggactgaatgccgctatcgaaaaggtactggaactcgcaggtatctaaaaaagcagtaacatacatccaatacaagaaccgtgtcttaaagtcacccgcactttaaggcacgtttttttatttcagattccagtgtcaacagcaactaatcagcctcctgccaaaaatattcgtgatataaactcaattatcacaactttttcctacctttgtaaacagattaattatttttcttatccttcaaataataaaataagtaatcaccaatacccgtacaccgatgaaaac

SEQ ID NO: 80 - DNA, 33668 bp, Bacteroides thetaiotaomicron
gttatacctgtcccttttcgattacctcagttgtactattagtgtaattgcaattaaaagataagattttgaaagagaatatggaaaatatgaatccggaatcattgctccgaaaagcgcaggcattaggagaggatattaaggaaatggagtctattgatgtaatgggtgcctatcaacaagcacagacccaaataaagacaaacagaagaaggagtatgtataatcagttgatgcgttatgctgcattcttgactatacctttattactttcttctttgattttgggatatttatattggggagcaacggatactgaagagaagtatgcagaagtcatggcggctacaggttcagtcattcgttacgaacttcctgaccattcggttgtctggttaaactccggtagtactttacgttatcctaccgtttttaagaaagataatcgtaatgttgaattaaaaggtgaagcctattttgaagtagaagcggacaggaaacggcctttttacgtcaatactcctgccgggttaagtgtctatgtgtacggaaccaaatttaatgtgaatgcttacgaagatgataatagtatagaaacggtattagaaaagggtaaagtaaacgttatttcaccggacggaaaaacaacagttcagttagctccaggagaacgattgctttataataaggtagatcagaaattgttgaagggaaaagtggatgtttatgaaaaggtggcatggaaagacggtaagttgatattccgcaatgccgagttgggtgaaatattcaaacggctggcacggcattttaatgtagatattcagtttaataatatatcgggaaaagaatataaatatcgtgcgaccttccgtaatgaaacactgccacagatattggattatctggctaagtctgctgccttgaagtggagaactgaggaggcggtacaacaggcagatgatacattcacaaagaaaaagataatagtagatttatattagtaaccataaaaatgagaatagcctatgagataacacaaagatcgtaaaaaaaggaagaaagctgctaccaacagctgtcttcccccaatttttcagattcgcggtaaggagtcttgcaaacgctaaccggaatcaaaccacagttcattatagtaataaactttagttaaccgcaaatgtatgaaaaaaaatcattcatttattgcattatatcctaaatatgctttaaatctaaaactacctttagttatgaggattagtctggcactactttttgcagtcgttttacaactatctgcagagaatggctatgctcaacggacgcatgttgccatttctatgaacaatgtatctgtagaacaggtactgaataaaatagaagaagcttccgattatgttttcctttacaatgacaaaacgattcagaagaatcgtattgtttctgtgagaaataaatcaggtaagattctggatattctagatgatatttttaaggggaccgatattacgtataccgtagttgacaagcagattattttatcgactaataaaatgcaacttgttcagcaggaaggacaaatccaaataaaaggagttgtgaaagatgctggcggagatcccttgatcggtgtgaatgtgaaagtgaaagattctacggtcggtactatcaccgatataaacggaaactttacgctacagaccaggaaaggagatattctggaaatttcttatgtgggatatgccacgaaaacagtaaaggtacagaatgcccaagttctgaatattgtgctgacagaagatacagaagtactgaatgaagtcgttgttactgcattgggtatcaagaaggaagctaaatctttgtcatacaatgtacagcaagtaagcaatgccgagattacacgcattgcagatgccaacttcgtcaataatctgaacggtaaagttgcgggtgttacaattaactcatcttcagctggtgtcggtggctcttcacgtgtagtgatgcgtggaaccaaatcattgaatggtaataacaatgctctttatgtggttgatggtatcccgatgagtgatatgagtgccgcttctacacagcctacggactcatacgaaggtgccggtcagtccggtgatcctatttccggtctgaatcccgaggatatagagagtatctctgttttgagtggaccgtcagctgcagctctttacggtagtgccgctgccaatggtgttgtgatgattactactaaaaaaggtagggaaggacgtacttcagtcagcatatccaataatacgactttctccgctcctcttgtcttgcccgaatttcaaaatacttatgggcagacagaagtgggtagttactacagctggggcagtaaattgaatacgctgagcagctatgatcctaaagacttctttcagacaggtgtgaatgtaacaaatgctgccagtctttctacaggtactgacaagaatcagacttacttatctttaggtactaccaatgccaaaggtattatccataataatgactacgaacgttacaatgtcactgtccgtaatgttgccaagatgctgaaagataagctgactcttgacctgagttttatgcttagctctgtaaaagaacaaaatatgacctctcagggactttattataacccgttagtacctctttatctatttcctgcgggagatgatttctccaaagtacaggcatatcagcggtatgattcggaacgaaatttactgactcagtactggccttacagcacaagtctggctttacagaatccatactggattaccgagcatattaaaatacctaatcataagaaccgttatatggcaactgcatcggcaaaatatgaatttgctgactggattaatgtaacagcccgtgccaaaatggaccgcaacaacgaacgccgtgagcgcatgtatgatgccggaacaaatactttgtttgcttctaaatacggttattactccaagagtaatatcgagaatcaacagatatacggtgaattattgctgaatattaataagtactttgtcgataataccctaaatgtaacagctaatgtgggtgggaactttgaaaacaatgattatcagtctgattatttcggaggcaaactgaagtcggtagccaacctctttacttttggcaacgtggatacttcagagaagaatctggccaaccaatatggctatcatttgaaaaaacgcgccatattcggtagtgctcagatcggttacaagtctatggcttatctggatgtgacggctcgtaacgactggtcatctaccttcaaagggacgaataccggttctttcttctatccgtctatcggtctttcggggattatcacagatatattccgttgcagtacggatattatgccatacatgaaagtacgtatttcttattcggaagtaggtaattcaccggatgtatttctggctattccgacttatgcgttggttgatggcgttcctgttactcagtcccgacgtcctaaccccaatctgaagccggaacgtaccaaatcatgggaagccggatttaactttgtcttcttcaagaaccgtttgagattggatggatctatctatcagtcacgtacctacaatcagttctttgaacgtaccctttcttctactaccggctataaatcggaagtagtcaatggcggtcgtgtagataataaaggtatcgaattgtctttgcgctttgaggacaaatggggaaattttggctggagttcgtatctgacctattcattgaaccgaaataaagtggtggaattgctgcgcaactatgaagatccttatacgcacgaacttacttctttggatagaattgatatgggcgggacaagtatgtataaaatgatactgacagaaggcggatctatcggcgatatttatgtgaatacgcttcgcacggacgaacatggagctatctatgtccatccttcggaccaggttgtagttactcagcctgatgaatttgtaaaggctggtaatagtgctcctaagtataacctcggttggggaaacacattcagttacaaagggctttcattgggattcctgttcacggcacgtgtcggtggtgtagttgtatcacagacacaggcgacgatggacgcatacggctcttcaaaggctacagctattgcccgtgataatggcggagccattgttaacggtcgtccaatcggtgcggaagattactatacgaaaattggaggtgcaggtgctcagggtggtattggttctatgtacacctacagtgcgactaatgtccgtttggctgagttatcgttaggctatgatattcctatcaacaagtatgtggactggattaaggggttgaacgtatctttcatcggtaagaatctctttttcctttatagaaaagctccgttcgatccggaactgacagcaagtacaggcacttactttcaaggtatcgacatgtttatgtcgccaagtctgcgtaatttgggattctctgtgaaagttaatttctaatcaaacttataaattgtagaagatatgatattaaataaaatactatcatggaacaaactttccattctcgggatatctttgatgctattaaataacatttcgtgtatcgactatgaggataacgtaaatccgaatgaagtcaccgaggaaatgatggaagtagacaacttgaagacgggtgctttcttttcgcaaatgctgcgtcgggttgtaatcataaatgatggcgacaagctcgactctgactatcagattgctcagaacttatcgcatgacctttattcgggctatattgccgctaccttaggatctaccaatcataacgggcagtataactttcaggaacaatgggtgaatgccacttttgattatgcctataccggaattatggcaccatggcaaagtattcacaaaatagccactgaacaggaactgccggaagttgacgcattggctaccatcgtaaaggtagaaggcatgcaccgtattgctgatacatttggtcctattccatatgtaaactatggctcttccagcttatatgacgcattggatttggtttataataagttttttgaagaactggataatgctatcgaagtattgagcaattatgtgaacggaaatgtggatgctaagctgatgagtgactatgactgtgtatatgggggggacgtagagaagtgggtgaagttcgccaacacactgcgtttgcgtcttgctatacgtgtttcatatgcgaatcccacactggcagaagcacaggcaaagaagtcgatggaaaacatgttcggctttatcgaaagtaaagcggaacgtgccgaactttcgcataattcattggaatatcatcatccgttgcacgagattgcctataacttcaattcgggtgactgtcgtccgggtgctaccatcgtagcctatttgaacggactgaatgattcgcgaatcagctcttattttacagcagccgatgacggtgaatatcatggcgtacgtattggtatcacaacaagcaatatgagcaattatcaaggcaataaaatctctaatctgaatattaaccgtgcttctactccggtagtatggatgacggctgccgaatcgttcttcctgcgtgccgaaggtgcattacgtggctgggatatgggtggaacggccaaatcattctatgagcaaggtgtacgcatgtcgtttgaggagaataatgccgccggtgtagacgattatttggctgatcatacttcgactccgggtgcttttgcagacaatgtgggtagtgataattatactttcagcagcagggttactcctgcatgggatgataatgccggatttgaagctcagttggaacgcatcattacacagaagtggattgccaattatcccgacggtcccgaaggctggagtgaatatcgtcgtacaggctatccggaagttattcctgtagtaagaaacagtagtaatggtacgattgatacccagttacaagtccgccgtctgccttatacacgcgacgagaagatcaacaatgctagcggcgttgccagtggtatatcggctttgggtggtcaggatacgggtggaactaaactctggtgggacaaaaaatcccgataacaggagaatggacattgtttaattctaaaaacactaattacgatgaaaacaaaaataacaggtttactgactttccttatcggaacattctttttctatagttgtgataccgatgtggaagcgttagaaattcagaaactgaaaacatatgacgagcagtattttgagaatctgcgtgctttcaagaaaagcgatcatgagataagttatgcttattacgaagcgtggtcaccgattgaaggtgtgaccggctataaagatcccgcgtcgtggggtgaacgtatggtaggactgcctgacagtatagatattgtaaatctttggatgggaataccgacagcagagacacatccgatagcatatgcggatatgcaatactgccagcggaaattgggtacacgttttgtcatgcatgccgatgcttctcattacagacaccagtttaccgttgatggggttgattatgatcttagccagaataaggacgatgaagcgatggctgcatatgcaaaatggattgtgaatcaagtgttggaaccgggacttgatggagtagacgttgactgggaaggttggagtggttccgatttggtcagattgataaaggaacttggcaagtattttggtcctgaaggcgaacagccggataagttgcttatcgttgactactttagtggaacaccaccaacagacatcataccttattgtgattatatcgttcaacaggcttatagtgatcaagtggggttcttgactcaacccagtaactttccacccgagaagatgatttactgcgaatcgttcggagtattctatgccgatgggggacaacttatgaactatgcacgttgggaaccgtcgaaaggccgtaaaggcggttgtggagtattctacttaggaagaaattattattcttcatcgggtataccttataatgaattccgggaggctattcagataatgaatcctgctgtaaatgagtaaacaatgaataaataagaatcatgatgaaaacatatatatttaaacattctttgttgggagttatattaggtttatccattctgggttgtacagaaggtgataagtttgattataacaagaatatggcttttattacagggacagagactactcctgtaaccaagtttgtggtagaagataccccttcttcgtatgccgtcactgcttctactactgataaagtagataaagacgtaaatgtgaagtttgccattgacaggtcactggtagagacatataataatgaacataatactaaatattatgcgattccggagggcgctgtgactcttgaagatgctgatgctgtgattcaggcaggtaaagcgttttctactcctgctacagttaaagttatttctaccgaagactttgcagaagggcgagtatatgtagttccagttactatggtagaagtggatggacttgaaatattaaaaccttcgaaaactattttcttgcagatatctcgtgttattcatttcacctcattgaatatcagcaatacgaatctttatagtaactttattttctcagatgataagaaacaggaattgtctaacttcacctatgagatcaaatgctattctcaagagtggcatcgtatagctcgtctgtgtagtttcacttctgctgacgaacagcgctcaagtatgctgcgatttggagaaaatggattagatatcaatgccttgcagtgggtaagtccaagtggaagtattgtatcgagtacacgttttagcactgatcgttggtatatgatctcgttgacatatgatggcagtaaactgactatgtatgtagacggagtgaaagatgcacaaggcgatggtgatggtaaaccggtcgatttccagcgttttgaactaggaatgtcgtggacgggatatcgcggatctcagtattttcgtggccgtattgctgaagttcgtgtctggaaccgtgctttgagtacaggcgaactacagatgaatctttgtggcgttgattcacaatcagaaggtttggttgcatactggaaaatgaatgaaggcgaaggacacatctttaaagatgcaacaggacatggctatgatatggattggacgaacactgcccgtgaaataaatgaaggagctggattaacatataatctgaattatagcagtgctattgcatgggacagtgatgataataacagatgtaacgagtaacgaaataaatgattgctatgaaaataaatatgcatatcttaggattgttggttgtagtcggattatttagtcttcagtcttgtgatgacgaaagttacgatatcgaaggaagcaaccaaaattatgtatatattaatgtgaaccgttggacttcaacagaatatcctcaaaatacatttgtctatgaagtgttgagaacaccgattggctctagtttagagagtggaccggaaatagttaaggtaggggtacgctctactaaagttgcctctaaagatataacggttactttggatattgataattgtgcatccataggtgaattttcttctttccctgacggggtaaaagtaaccttggataaaaaagaactcgtgattcctgcgggaagtatgctttcttctgattcagttactattgaaatagaggatggaaagtggagcgagtttgtcaatacaagttatcttttaccgctaaaagtaacatcggtatcgaatgcggcattgagtgaaactcattcctctgcttatctcgctgttagcacctcttttacgaattgtgttccgggagcaacgagtgtggaaggcacattaattagtgatagaagcgcgtggactgccactaacaatggtgtagatgttggaacaactctgttcgacggaaatacaaggacttatccgtctcaggatgccagttctaccgttattgttaatttgaatggcgtataccaaaacataacaggaattcgattacagtattattcccgtaattatagtttgtccagtgccgctgtctatacaagtgaaacaggaggtgaagattatgagtatcagggaaacgttactttctctcgtgcaacgccgcaatatattcgtttctatggagctgtgagtgctcgatatgtcaaacttgaattattgccgtatagtagtggatatgggattgttttgtctgagtttgatatgtatcagaatgaataaacgggattgatgaaagtctcttataatagctaatgagttattatgagaggcttttgttttaaatgaaaaaaagtatggtgctgcgctttattatattgatttgttgcattaatttgtatttggttgcctcgtacgcacagactctttctgacgaactggtgttcgaagaacgtgtctttgattttggagaaataaaggaagaaaatggactggtttcacatgaatttgagtttaagaatgtcagtcaaaaagttatttctatcaatggagtaacaagcggctgtggttgtgtacagtttgaatttcctaaagaaccgctccgaccgaatactacaggtaaagtgaaagtgacttacaatccggcctaccgaccgggcttctttagtaaagaagtagttgttttgagcaataacaatgccaactacaaccgtatttgggtaaaaggcaccgtcattccctgcaaacatccggtatcagagaattatccgtatgagtacggtagtggactttggatgaatttcgaagtaatggcattcggtaccataggcaaaggcggtacgaaaacaatgaaactgaaatacgtaaacgataccgataatgatatacagcttatgtttgtcgttataggtggtaatacagatcttaagtttaccagtccccgtcaggtgaaagcccgtgaagaaggtgtgatgcccgttgaatatcaatattccggcagctttccgaccgaaacacgtgtctatcctgtgatcaacgggcgggcattaatgaaaccgctgaagataacatgtaccaatccggttgattagtaatataatatttcctatcttagcaccggcaaataaaataacctgaaaagataaaactataaatgaatcgaacaccatgaagagaaaaccaatcgcaaccagtatttctacagtagtattcagtctacttttaacaggatgtcagagtgtttcggcaccggaagctattttacccgttcctcaggaaaagcaagtaaattggcagaagatggaaacatatgcctttgtacacttcggtctcaataccttcaatgaccgtgaatggggttatggcgactctgatccgaaaacgttcaatcctgctcgtctggactgcgaacaatgggtgcagacatttgtcaattccggtatgaaaggagtaatcctgactgccaaacatcatgacggcttttgtctgtggcctacacagcttaccgaatactgtattcgaaataccccttacaaagacggtaaaggtgatattgtacgcgaactttccgatgcctgtaagaagtatggaatcaaatttgccgtttatctctctccgtgggacaggcatcaagccaattatggaacgccggagtatgtagattatttctataagcagttgcatgaattgctcactaattatggtgatgtttttgaaatctggtttgacggagccaacggaggagacggttggtacggaggagcgaaagacgcacgtacgatcgaccgcaaaacatactatgattacccgcgggcatataagatgatcgatgaactgcaaccgcaggctgtgattttctcagacggagggccgggctgccgttgggtaggaaatgagaatggatttgccggagctactaactggtctttccttcgggcaggcgaggtatatccgggatatcccaagtatcgggaattacagtacggtcatgccgatggaaatcaatgggtcgctgccgagtgtgacgtttctatccgtccgggatggttctatcacccagaggaagacgacaaggtaaaaacagtcgatcaactgacggacttgtattatcgtagtgtaggtcataatgcgactttattattaaacttccctgtagaccgcaacggtttgattcatccgaccgattcattgaatgctgtttcattccatcagagagttcagaaagagttggcagataatttattgagcagtgcaaaagtatcagctttcgacgagcgtggaggacaatttaaggttcgtgccgtaacggacggaaagtacgatacttattgggcaaccaatgacggagtgactaccgccgatttgactttcacttttagtcagccgacgaagatgaatcgggtaatgattcaggagtatgtacctttgggacaaagggttaaatcctttgttgtagaatataaggagggcgatcagtggctgtcggttaaatgcaacgaagaaactacaaccgtaggatacaaacgtttgttacgctttgaaatgatcgaaacagaagaattgcgtatacggtttacggatgctcgtgcatgtttgtgtatcaatgaggtcggggcttattacgctcccgatgcaacggaaaattatacaccggcaacctcagaactgaaaagtttcccttttacaattttgggagtggatacggaagaagcaaagaaatgtagtgacaaggacgatcagactgctgctttaatctcaggcaaggaaatcatgattgatcttggtgaaaatcgtacaatccattcattctactatttacctgatcaaagtgaatatagtaaaggattgatctcatcatacgaactgtctgccggtattaccgaagaggcgatgcaagtcgtagcacagggagaattctcgaacatccgtaataatccgattcttcagaatgtgtactttagtccggttgaggctcgctatcttaagttaaaagcgactcgtatggtggacgaaagtgattctttgggaatagcggaaattgggtgtcgatagcctctctctagaatattttttgattttatctgcaatatctgccacctgcttgtttattcggtgatttatagtggcttattgtgttgcagatacctgttgcagatgtgttgcagataatttatctgcaacacaggggttattatatctttgtgtgatctcttgatggattctttgaattgatagtatcttggtttgtttcaattggcagaacatttagtttctgaggcttgaaactagagtttctcctgtttgaaactaaagtttcatcagcttgaaactaaagtttcaccgcatgaaaacttctgcgaaaccagcggaaagtaatttttatattatatcatattgtatgttgacaaagcgattatatattttgattgtaggattggcgatgaatgtcgtggcttttgcccaatcttctctgttaccttataaaaatccggtcttgtctgttgatgaacgggtgaaagacttgctttcacgtatgacattggaagacaaggtcgggcaactattatgtcctcttggctgggaaatgtacgaaataaaggacgatgaagtacatccttctgaaaagtttaaaagactaatgaaagaaaagaacgcaggtatgctgtgggcaacttatcgtgcggacccttggactaagaagacattggaaaatggcctcaatcccgagctggctgccaaagccggcaacgcattgcagaaatatgtgattgaaaatacccgtttgggtattcctttatttttggctgaagaagcacctcacggacatatggcgattggaacgaccgtttttccaaccggcatagggatggcggcaacttggtcaccgacactgattgaagaagtagggaatgtgattgctaaagagattcgttcacagggagcacatatcagttatggtcctgtactggatttatctcgtgatcctcgctggtcacgtgtagaagaaacctttggtgaagatcccgtattgagtggacgactgggagcggcgatgatcctagggctaggtagcggagacctgtcctgtgaatatgctaccatcgctacattgaagcattttctggcttatgcagtaccggaaggtggacaaaacggtaactacgcatcggtagggaccagagatctgcacgaaaactttcttcctccttttcgggaagcgatcgatgcgggagcactgtctgtgatgacctcctacaattcaatagatggtgtcccctgtacggccaatcattatctgctgacacaattactgcgtaacgagtggagattccgtggctttgttgtttcggatttatatagtattgaaggagtccatgaaagtcactttgttgcccctactatagaagaggcagctatgcaggccgtttctgccggagcagatattgatttaggtggcgatgcgtttatgaatcttactcacgccgttcaattcggaaaaatcagtgaagcggtgattgatactgccgtatgccgggtattacggatgaagtttgaaataggattgtttgaacatccttatgtaaatccgaaaacagcaacgaagatagtgcgtagcaaggaccacatcaaattggcacgcaaagtggcgcaatcatctattgtattactgaagaacgagaattcgattcttcctttgaataagaagataaaaaaagtagcagttgtcggacctaatgcggataatcgttataatatgctgggagactatacagctccgcaagaagatgaaaacataaaaaccgtgttagacggagtgatctccaaactgtctccttctaaggtggagtatgtgcgtggatgtgctattcgtgatacgacagtgaacgaaatagcggaagcggtggaagcagctagccgttcggaagtcataatagcggtggtaggaggatccagcgcacgtgatttcaagacgagctatcaggagacgggtgcagcaattgctgacgaaaagagtatcagtgacatggaatgtggcgaggggtttgacagggctaccttgactttactgggaaaacaacaagatttattgattgcattgaaggctaccggaaagccactgatcgttgtctatattgaaggtcgtccgctggataaagtctgggcatccgagtatgccgacgcattgctgaccgcttcttatccggggcaggaaggagggtatgcaatagctgatgttttgtttggagattataatcctgccggacgattgccggtttccatcccccgttctgtcggacagatacctgtctattataataaaaaggctccccgcaatcatgattatgtcgaacaagctgcttctccattatacacttttggctatgggttgagttataccactttcgaatattcggatttacaggtaatacgtaaatctccctgccattttgaagtttcattcaaagtgaaaaatacaggaagctatgacggtgaagaagtggcacaactttatctgagggatgaatatgcttcagtagttcagcctctcagacaattaaagtgttttgaacgcttcttcctgaaaagaggagaggagaaggaaatctttttcactttgaccgaaaaagacctgtccattatcgaccggaatatgaaacgtgttgtggaaacaggagatttccggataatgattggtgcctcttcggatgacataagactaacaaaagatatttctgtagagagtctgtgagtgacgaagagacttatttctaatctgagtttataaacatggaacaggctgattctgaataatcacgagtcagcctgtttttcacttaaaacctaaaccttgtatttacttgctgttataagccgtcaacatccaaaccagcttttcctgttctttcagataatcgctcatcatcgaaacggttacttcatctccggcttgtgaagcgatagacagaatcttgcgttcttcaccgatcagataactgatagactgtagtatgttatccagtgcctgttctccgttgcttaccttatccacttcgttaatattggctactttcagataatcactgaatttgttggcaggagtaccgcccagcatcaggatacgttctgcgatttcgtccactttttcggcagtgtcatcatacatcttttcgaattggctgtgaagtacgaagaagtcatgccctttgatattccagtggaaaccgcggaggttggtgtaatatacttggaagtctgccagtaattgttgcaaagatgctactacgttgtttgctcccgattcgttcaatttgataaattctaaagttttcatattctatttgtttttaatgatttatattcgttttcttttttctgtactgcaaagataaggcggaaaatgcttgttgtcaaactgataatttctatctttgcatagaagaaatctataacttaatcatatttgatagatgacaatacaacaattagaatatatattggcggttgatcagttccgtcattttgccagagcggcggaatattgccgcgtgacgcagcccacgctgagtgctatgatccagaaactggaagatgagctgggagtgaagttgtttgaccgtacggtgcagccggtctgtcccacagcgattggagaaaagatcattgatcaggcacgtgtcattctggcacagacagcgcaggtgaaagaaataatcagtgaagagaaacagtcactggcaggcgtgttccatttgggggtattgcctaccatagcaccttatttacttccccgcttcttcccccaactgatggaaaagtatccggaactggatatacgtgtcacagaaatgaaaacacagaatatccagcaggcattgcatgccggagatattgatgccgcaattatagccagcaaattggaagacactttcctgaaagaagaaacacttttctatgaaacattcttcggatatgtatcctgcaaagaacctctgttcaagcacgacgtgatacgcacttccgatataacgggcgaacgtctctggttattggacgaagggcattgcttccgtgaccagcttgtacgtttctgccagatggaaacggtcaaagtcaatcagatggcctaccatctgggaagtatggaaacctttatgcgtatggtagaaagcggaaaaggaatcaccttcattcccgaactggctgtttcgcaactgaacgaagaacaaaagaaactggtacgtccgtttgccattccccgtcctacacggcagatagtgcttgcgaccaatagggattttatccgtcatagcctgctcaatgtactcaaagaagagatactggcagcagtacccaaagaaatgcaatccctgcaatccattcagtacttgctgtaatattgtttattcctgcgtactgcttccggctgtatggcgtttcaaccatcgccctatttcagctcccttaaaatagataatgagggagctgactatgataatcattcctgcaacggtactgaatgtcggatactctcccgggagcatgatccagctaagtatggcgcccaatatcgggttgatcagtctgcacatattgatatcactcactttggctcctttactctgtaaggcgataaaccagaaactgaaagcaaagaccgagataaataccagaatagaaagactgatatagaatccggcaggctttccgataaatgaatgatacccttccgtacctaatcctatcatatagatgagcagtccgccgaagaacatctgcacggcattcaggaaaatagggtttatcttgcctttatcttccgataccgaaatcgcggaatatccctgaaagatgatactgagcagcagaagtacaattcccgtgatccctttccagtccagcggagcgccattgctgcccatgcctacgataagcagcaaaccgatgaggctgacaataaggctgataatcttgtgcacattcagccggtcattgctggacagcagatgggctagcagtacattgatcagaggtgtcattcccataatgatagaagagatagccccgctgacgaaatcgactccgaaatagaaagccgtgtaccccataaacatattgatcaggatcagattcagaaacagtttgctgtgttggcgtatttctttccacattcccttatgccaggtataagcaaaaagaatgatacctacagtggtaaagcggattcctgcaaagttcatcggcgaaaagtcgtaactcagcccctgcttgataaacggattgacgatagcccataatacagaggccagtatagcataaaaaagtccttttttcattttatggtttggtggttttattcaaaaatgctgcaaagatagtaataattaggcacatacattttgaatctaggtattaattccttatatttggagaatcaaccattttttatttagtaatatgaaaaaatacattgcagaaatgattgggacgatggtgctcgtcctgatgggatgtggaagtgctgtttttgccggcagtatggctggtactgtaggagccggcgtgggaacggtcggcgttgctttggcatttggactttcagtagtggcgatggcgtatgctatcggaggtatttcgggatgtcacatcaatcctgctattacgttaggagtattcctctcgggtcgtatgaatggaaaagatgcgggtatgtatatgcttttccaggttataggagcgattatcggttcggctattctttatgccctggtgaccaccggcgggcatgacggaccgacggctaccggttccaacggctttggtgacggcgagatgctacaggcattcatcgcagaagtggtctttactttcatttttgtattggtggtgctggggtctaccgatccgaagaaaggggcgggagctttcgcaggccttgccatcggtctttctctggtattggtgcatatcgtatgtatccctattacaggtacttccgtcaatccggcacgtagcatcggtccggcattgttccagggtggagaagcgttgtcgcagttgtggctgtttattgtagcgccgtttgtaggagcggctgtcagtgcgctcgtctggaattatttcggtgacaagaatgaaaagaaataataagaagaaataaacggatcactttatgataaaattaagggcgagagtttcacaactgtcgccctcttttgcgtaattatatattataataaaaagagtgtttctataattactagatttaattagatgaggggaatttcacttcatagaatttttccccgttatataaggtcttgacacgtattctgagtcctttcttgcctttcatctgatcttgaatcttatccagtttgaaagatatatacccttcgcccagacggtcggcggtgtcgccttcgtcgttatgccggaattcaagatcgatatactcatcgttggcatcatcggcagcgggttcagcttccttgttgttgatgaccagattcaggaaatgtttcttgtcctcgctatgcgtgccgtaatattggaattcgattgtcagatatttcttgtcttgggtaatccacatataagtagaattgattttatcgtctccgatcttctcttccgtattttctccttcccccatagtcacgatttctttggtcaggatctcttttatttctcttacctgaatattatagtcatatcccttcaccggttcttccagctctttgaatatcacaaaggcgcgttgcccgtctttattcttgtcactgatccatccgtttccattgctcgggaacattgtttttccatcatccagagtgaaatagaaatccttgctatccgggctgatcagattgatggtgctgatgaccagtgaatcggatgaggagtcatcatcatccagacacgactgaagtatcggcattgtggtcataacagcaataataaatgcaatgaatttaaatttcttcatatactataaaaatgttttttaatgagtactatttacttgctttgtactctgaaaatgcaaggggggagaaaatattgcatttggatctgttaaagaaacaaaagttgcaaaagagttgttctctctgtgcagtatttctatctttgctgcatttataaggtaaacacgtgtataagcaaatggaagaatttgagttgtcggaacaatgcaggctgggaaataatcgagcccgcaaagaattgtatgagcattatggagggcgtttgctaggcgtctgtctgcgctataccggcgaccgtgatacagctcaggatctgcttcacgatggttttataaagatattcagttctttcgacaagttcacctggcggggtgaaggctcactgcgggcctggatggaacgagtgatggtcaataccgctttacagtatcttcgcaagagtgatgtaatcagtcagtctacgcctttggaagaagtacccgaagattacgaggaacccgacgcttcggctgtagagatgattccgcaagcggtattgatgcgatttatcgaagagttgccggcaggataccgtaccgtgttcaacctttacaccttcgaggaaaaatcgcataaggaaatagcacagttgttaggtattaatgagaagtcatcggcttcgcaattatttcgggcgaagagcgtgttggctaagagagtaaaagaatggataatgaataacggataggtagagatatggaagagaaagaattatggatgaataagttgaaggagaagctcggggattactcggagccgcttcctgcttccggttgggaacaactggaaaaagaacttatgcctcctgtggagaggaagatatatccttatcgtaaatggacggtagccgctgcggctgtcattttattggctttggggtcatcggtcagcctgtatttcctcgggactcctgctgctgatgaaattcgtcatgccaagactccggcgttagcctctgttccggatgttttgccggatgcgcagcaaccggatatgacaggaacaacgatagaaccggtagtgcgtccggtagtgaagaaccgcatcgcgaaagcggaacggaacattccccaaccaacggcaaatatcgacgaaccggtgaagaaagaagagcaaccttcggagctgaacgctcagaccggcgaccggaaagaaaaagaagaagtggaaccggtggaagaaacgaaagccatccggcataagcccgcagatacggaacaaccgagaaataagccacgccgtccttccagcagagacaaactgcatattccggcagaaaaagcatcttcgcagaaaggcacgtggtcgatgggactttcggtaggtaactccggtggtgcttctacagagttgggatcgggcattccttcttatatgtcccgtgtgagcatggtatcggtatcaaacggtctgctgagcatacccaatgatcagcaattggtctttgaagatggagtaccatatttgcgtcaggccaatcaggtggtcgatatggaacaccatcaacctatctccttcggattatctgtccgcaagagtctggcgaaagggttctctgtcgaaacaggattgacttacaccttgctttcttcggatgcaaagtttgcggacagcgaccagaagaccgaacagaaactgcattatctgggtatcccgttaaaagcgaactggaacttccttgataagaaactgtttactctttatgtatccggtggaggtatgattgagaaatgtgtttatggtaagctgggcacggaaaaggaaactgtgaaacctttgcaattctccgtctccggtgcagtcggcgcacagtttaatgccaccaaacgggtaggtatatacgtagaacccggtgttgcttatttctttgatgatggttctgatgtacagaccatccgtaaggagaatccgttcaacttcaatattcaggcgggtatccgacttacttattagtcaatatagttgagctatatattttaaaagcgatattttaccaatgacggttaaaatatcgcttttaaagttttatgtgcagaaactctgctgaaaaatcggaaatctgagaaaatattaatatcattgtcacctgtttctgaccgatggtaacatacctttgttgcaaaattctaagctatggtggattctataaatgaaaaacgtttattaaccgaattaaagaacggctcttttcaagcatttgaaagattatataatatgtatagcggtaagttatacaacttcattatgcgaatttcttccggcaatcaatatatggctgaagaagtagttcagtctgcctttatacgtgtttgggaagtacgtgagcgagtagagccggagtcttcatttatttcttttctttgtaccatcgccaagaatttattaatgaatatgtatcagcgtcagactgtagagtatgtttacaatgaatatttgaaaaatactggagtagaccgtgactcccagacagaagaaagtattgacttgcgattcttgaatgaatatatcgattctttggctgaagaattgccggcgcaacggaagaaaatctttattctgagcaaaaggcaaaattatacaaataaagaaatagcggagatgatgggcatttccgaaagtacagttgccacgcaactatctttggccgtgaagtttatgcgtgagcagttaatgaagcattatgataaaatcgttgcgcttctgtttgcctttttttgttaatgaaatgtaattgtaatctttgcttttggatggcagataggatgaaaatgtatacctgtaaataagtaggaagatggataagatacattataaagagctgattgaaaaatatttcgaaggaaatatagcggacactgaaataaaggagttgtccgattggataaagaacgaccgtcagttgcaaaactggtgggaacaggagtttaccaagtcggatgccgctattgatccgatactgcgtgataaactctttgcacggataaaagaaggaacactgaaacatacgtcaccgagaacgaagggcgtgagaactctccctatgattccttggaggtgggtggctgctattttgttacctgtctgtattgcttttttcacttattatttgatcgattcgtcgcaaatgaccagtgcgccttttattgtcaaagcagataaaggtgataaagctacagttgaattgccggatggaacgaatgtagtgcttaactcagcttctcaattgagttatctgaataattttggagagaaagtccgcagagtgcaactgaatggtgaggcctactttaaagtcgctcctgatgagaaacatgcgtttatagtgcaggtaggtgatttggaagtaaaggtattggggacttccttcaatgtatctgcttatgaagatgcaaaagacattacggttgttttgttggaagggaaagtaggaatttacactcaggaaacttcgcgtatgatgaagcccggtgataaaatagaatacaataaaaccactcatcaacttgttgctacccaagtgcatcccaatgattatattgaatggacgaaaggaaatatctatttcgagaaagaatcgttggaaaacatcatgaaaactctttcacggatttatgatgtggagatacgtttcgattcgaataaacttcctaaagaatactttacgggaacgattcctagtggcggcatacagaacgccttgaatattctcatgcttacttcgcctttttattatgaaatggatggctcggtcattgtcttgaaagagaagtagataagcatctttatcatgaaattagatatagccattcctgagttttcccccggaatggctttttaatttatgaagaaccgttagttaacaagagttaaagatagatagccgattggacgaaaggggagagcagtcggtatacctgtcaaacaacttaaaagttttgatatatggaaaacagaacaccctttgtgaaactccctcagtctacagcagggagaagtaagaactggagaacattacgggccatttgtctgctactgttcatgagcatctctttgaccgcttattctcaaataacggttgatttgaaaggcatctcgttaagagcctcattaaaaaagattgagcaagttagtaattacaagtttttctacagtgagagtctgccggaattgagttggaaagtttcattgaacgttcgggatgtaacgatcgaccagaccatgacacgtcttttggaaggaatggaactgacttacaaaaaagaacaggaaaacgtcattgtgttgattcgtaaaacacaaagtaaacaactgacgaaaaaagtaaccggaacagttgtcgatgccaacggagaacccattatcggtgcaagtatcgtgattaaaggtgagtctcacgggacaataacggattttgatggtaagttcgcattgcccgacgtaccggagaaagcagtcttgaccatctcttatatcggttacaagacagtcaatcttgctactaccgatcagacattggtaaaggtagtacttgaggaagatagtaagatgatcgatgaagtcgtagtagtaggttatggagttcagtcacagaagctggtcactacctctatcagtaaagtgaagatggagaatatagatcagggaaatgattacaatccgattaagatgttgcaaggtcgtgtggcaggtgtgaatatatcttctgcctccggaacaccgggtgaaactcccaatataactgttcgtggtatcggttccgttagcggaggaagttcaccgctgtatgtagtggatggaatccccagcgaaaaatatccgaatttgaatcccaatgatattgagagtatggaagtgttgaaagatgcgtcggcagcggcaatctatggttcgcgtgccaatgccggggtggtgctgatcactaccaaatcggggcagcaggggaaaacaaagatcgaagtatccggccgttacggctttgcctcccttgccagtgatatagagatggctaattcaacggaatacatgaatactatgcaggctgctattgataactacaatgtgcagatgggaaccaacctgcaactgtatattccttctcagattcaggaaaccgactgggtgaaagagatttcaagaaagaactcaaagacgggtgccggttctatcagcatttccggcggaaatgaaaagactactttttttgcttccttaggagccaatactcaggaaggctatttgaataagagtaagtatgaccaatacaatatgcgtgctaagttctcacataaaataaacagcatcttcaaactaaatatgaatctggcaggttcggcaagtcgttcggacttattggaagaaacgagtaccagtttgaaagtattgcgtacagcccgtgaggaacaaccttggtattctccttacaaagaagacgggacatcctataaagtgaatggaacggatattctgcgccataatcccctcatgttaataaatgaagaagactgggtagcaaagaaatatcagttgtcgggagtattcagtatagacgtcacccccttcaaaggttttaaatatacaccgacagtgagtgcgtacggcattttggataatgtttcaaagaagttatcggataagcacgatgcccgtaaaaacagtagtggttggggagctttggctcaacagaaagaccagagtttccgttatgtgattgataatgttttctcttacaataacgaatggaataaacttatttactcagttatgttaggacactctttcgagaaatacacttacgaacagtttggagcaaagagtgataattacgccaatggtgcctatccttcgtccagtttcgatctcattaatgccggaccgaacatctatgccggagatatcagttatacttcctacgctttggagtcttactttggtcgaatcgccctgaactgggataataaatatatcctgaatgcctcgttacgcagcgatggttcttcccgctttgcgaagaataagaggtatggttactttccctcggcttcttttgcatggagagcttccaatgaaggcttctttcccaaaaacaaatatgtcaatgatgccaaactgagattaagctggggtatgacaggcagcatggcaggtgtcagcaattatgctccgttgtcgctcattagtgcgggaggcgcatcctacaatggctctgccggattccagatttcacaggacgcacgtgcgctgacttgggagaaagcaagtcagttcaatataggttttgatatcgaaatgtttcagtctcgtttaaccttgaacgttgatatgttctatcagaaaacgaccgatctgctgtttaagaaacctgtaaatgcaagtaccggatataccactctacagtctaacatcggttcgttggagaataaaggacttgaattggcattaaacggcaaaattctcaccggaaaattcaaatgggacttgggaggtaatatttctttcgtaaagaacaaactgctctctttaattgaaggaagtgaaatgtacgttgtacccagtagcgggagtaaccttttgggtggttccatgcatgctttgatcaacggagaacccatcagtacattttatatgttgaagatggaaggcatttatcagcgtgacgatgaagttcccgccaaactttatgccaagggagtgcgtgccggtgatgtgcgatattttgattacaatgaagatggcgacatcaccgacgctgaccgtgtgaatgtaggaaaagctattcccgacttttacggtggtattacttcgaatttctcatacaaaggttttgatctgtcattatttgggcaattttccgtaggtggaaaagtgatggcggcatggcggggtgtcaatggttccgaaggtaccgaccatttaggtctggcactgtctaatgtaaaagtgggcgaccgtggagaatccgtagaacagttctttaatatcagtaaggaggtagccaatggatactggcgcggtgaaggcaccagcaactcgattccccgtcctgtaaggatcggtgtgcataccggatatgattatgactacaatgttcagacatccacccgctatctggaagatgcttcctacttcaaactgaaaacagtcacattaggatataccttgccggaatccatcacgaagaaaattcatgtgaactctctgagattttacgtttcggcagacaacttgctggcttttacaaaatattcgggttacgatcctgaaacttctttctcgggcagtcccggagactccaattacggagttgatttcggcctgcaaccagtgttgagaacatttatctttggtttgaatctaaacttttaaaaacagacgagtatgaaacgattttatatgatcaactatttactatgcggcatttgtcttttatggatgacaggatgctcaaatatgctggatgaaatgcgaccgaaggacaagatacctcaagacgcattgagcgagtccgacttgacaaagttgcttaacggggtatatgctgaaatggaagaactggttttcaagttctatatggacggtgatgtgaaaggagagaatttcaaagcgggcccgggattttccatgaatgatccgatgtcgatggctccgagctccaaagatgtattggggcagtggcagaaatgtttcacagccttaaagcaagtcaatttcttggtggagacctacgaagcatcctccaataaagacagtcaggtggtgaaacagaccggaggaaccggctattatttccgggcattgatttattatcatttagtcacccgttggggaggagcgcctattttacgtaagcgtacttacgacgtagtgcctatctcacccgaagccgatgtgtggaattttattaaagaagatttgggcaaggcagagagcttacttccggaatttaccgatcgcttttacgtatctttaagtgtatgtgatgcattgaatgcaaaagtttgtctggccttgaaagattatacgaatgcggctatttatgcagacagagtgattactaagtccaatttcgcattgagtaccacatcagctgaatatgctaatgctttcatctccaatagtaatagcaaagaactgatttttgctctggccaataaacgcagcacgggattgttacttttctatcagtctgttaatgatattgacccgacatgggattattctccctctgccgattgctatagtcatctttatgccgatacttcagtcaaaaagcaggatattcgtgccaaagcagtctttggggcagacaatagccggatcatcaaatttccgaatggaagcaccgggcagtttgtgaccaacgaacaaccttctcaaactcctatagtagtggctcgtgtagccgaaatgtatctgattaaagcggaagcactgggagcaacgaacggcctgtcgaccttgaaagagtttatgaataagcgttatgctacagtctcattaccttcaagcatgagcgacaccgagtttcagaatcagatactggacgaacgccatcgtgaactgtatgcagaaggacagcgctggtacgacttgaagaggaccaatcggttggatttatttacttcgctgaacggaagaaactatttaatgtactatccggttccccagtcggaacgcgatttggcaggagccgaaaattatcctcaaaacgatggttattaataaattaagaaagaacagattatgaagaatataaaaatatttgcaacgttttgcatctgcttgctgctgttttcagcctgttcggatgactggaaagaaaatgcgttaacagccaaattctcttttgacaagtcgctgtattatgtcggagatgaagttcgcattactaatgaaaccgtaggcggagaaggaaactacacttatgagtgggatttgggagacggaaagacttcaacggaccccaatcccgtagtcacctatcaaacgaacggtgcctatacggtgactcttcatgtgaaggatgcaaaaggcacttatgcgatggctcacaaattgttgaccattgattcggagcctttgcctgaagtaggaaatgtaaaactgaaatgggtaggcggtcatgtgttaggagaagtacgttctacagctccggctgtcagtgatgataatggggtgtatatgacttccaatgatcattatttacgtaaattttcggcagcgacaggagaccagctttgggaatttgacctttggacatctgctgacggcgatgcaccatccggaaatacgcatactactccaagcattgatatagacggaacaatctacgtaggaacaggagacaccagtggcaaagtaggacgtgtgtatgcaataaatccggacgggagtaagaaatggctggtggcaggtgacgctgaaaagggcttctggaataaaggaaacgcttccacaccccgtatcaattacctgacctgtgccattggtgagaatcatgtatatatgggtaatggcggttctacaggatcagtgcttgcagtagataaggtgaccggctatcgggtaggatacgtagcgaatgcggataattccggaggtccttccggaggagtatctgccggaatagtattggcaaacaacactttagtttggggtggcggaaagaatggattgttcggggcttctgcttctgcgttgaatgccggtggaaatgtaatgtgggcttggcaggtatttagctccggcgatgataagccgtcagaaaatatgaacggttctccggcagtagatgaggctggtactatttacggaacagctacgtttgcaggaatgggaagtagcgcatttgctatgggaagtgatggagtggagaagtggcgtactcctttgggcaatgtcggcacgctggatcaaggcggtgttgtgataggactcgacggaagcattatcgttacagtgaaacgtgctccgggggaagcaaccggaggaatcatctctttgtctccgggaggagctatccaatggcattacggcattgcggaagatgtaagcggttgtgcggcaattgatcaagcaggaaacatacatttcggcacccagtccggcaattattatatcattaaaccggaagaatcggatgaacaattgattctgaaaaaagaccttgctgcgttgattagtgaaagtgactctcctttaaaaggagattgggaagcgggaatcggtaaaatctggagttcgcctaccatcggaccggatggagcgatttatatcggagtcaccaatacggtggaccctacaaagagcgtgttagtagctttggaagatgagggaattaccggggccgcaacctctgcctggccgatgaaagggaaggacagacgtcactccggagcccaatcgggagggaatggagagaatcccggtggagaagaaggaggacagttgcctatgacggggaatttgaaagcagatttaaagagtctgtttgaaagcacctcttataaagtgtggctctgcgcgcatcgtggaaatacccaaaaagggatgaaagaggggattcccgaaaactcgttacctgcgatagaacactcggtcaaagcaggagttgagatgatcgaactggatgcacggccgacctctgacggtgtgttggtattgatgcacgacaacaccatcgaccggacaacaaacggtagcggtgcggtgggagactttacttatcagcaattacaacaattttatctgaaagatgcatccggcaatataactggcgaacgaatcccgactttggaggaagcgatgaagaagggaaaaggaaaagtttattataatctggatattgtcaacaagaatgttgcggtaaatacgatcgtcgcattgcttaaaaaattggatatggaaggttccactttgctgtatgtatccaacaatcgcaattatgcatttgatttgaagacagccaacagtagtttgctgttgcacccgatggcaaaagccgccgatgatatcacatacttctcctcatcctacactgataatgtacaaatgatgcagctgtctacgtcagacgctatgggtggaacgatggttaatgagattaaagatcaaggctggcttcttttctccaacattgtcggagcgaatgataccaatatgttgtcggaaaactactccggtttggtgggaatgattaacaaacgcatcaacattgtgcaaacagactatgctgaagtagctgccaaatatttaaagtctaaaggatacagataatagtacatatagatatgaagaaatatataatgataggaatcttattcgcatttcctttctgcctgtcggcagacgaaccggtgaaagccatttatgcgaagataacgaaccctgacaataaagaaatcacggttgtagctcatcgggcagactggcgttacgcacccgaaaattcacttgccgctattgaaagttccattcgtctgggagctgacgtagtggagctggatgttcagaaaaccaaagacggtcaattgatcctgatgcatgacaaaacgctggaccgaacgactaccggaaaaggaaaggtagccgaatggacattggattctatccggacactctatctgaagaatggagcggcactcaaaaccaagcatcgtgtacctactttggaagaggctttatgggttgccaaaggtcgtgtgatggtcaatctggataaagcatatccgatatttgacgagattttccccatcctcgaaaagacgggaacagtggatcagattatcatgaaaggttccaagcctgtggcagacgtaaagaacgacttaggtaaatatctggaccgtatcatttatatgcctatcattcatttggataagccgggagcaatgaagcaactggatgattttatgacggagctgcatcccgtagcttttgaacttctatttgtatcggatacctgccaggtccccaagcaagtaaaaacgaagttgaaaggaaaaagtaaaatctggtataatacgttgtgggatacgatggctggcggacatgatgatgataaatcgttggagaatccggacgaaggatatggttatctgatcgatacactcggagcggccatcattcagacagaccgtactgcctatctgctggaatatttgcaatcgcgtaagaagcgtagtgaaaacgggcaagatgcgtatcattaaaatatagacttctttatgggatttaaactattggatttttataaaatctctcctccggtgtccgggggagagactgattcggaacgctctgtccgtttcaagcgtattcgttgggctacctttctgtctgccactaccggatatggcatttattatgtttgtcgtttgagtatgaatgtaatccgtaaaccgattgtagaagacggagtttttaccgaaacccaactggggattatcggttcctgcctttttttcgtatatgccgtcggtaagctgaccaatggctttcttgctgaccgtagcaatgtaaagcgttttatgtctaccggattattgtgttctgctctgatcaacttatgtctgggattcacgaattccttctttgcttttgttctcctttgggggttgaatggttggtttcagtcgatgggggcagcatcaggagttgtgtcgctgactcgttggtatagtagtaaagagcgaggtactttttatggcttttggtcggccagccacaatttgggtgaagctctgacttttatatccatcgctttgctggtcagttggatgggatggcgttatgggatgatcggtgcgggagtgattggtttgcttggttttctgatgatgcttgcttttatgcgtgatacgcctcaaagtcagggctttttgctagatcggcgggggacgtcagatgctcattccgtttccggtaaacaaaccgaggaattcaataaagctcagaaagcagttttgaagaatcctgctatttggattcttgcattatccagtgcttttatgtatatcagccgttatgcagtcaatagctggggtgttttctatctggaagcgcaaaaaggttattctactttggatgctagttttattatatctatcagttctgtatgcggaattgtaggtacggttttctcaggtattatttcagataagttttttgctggcagtcgtaatgttccggctttgatattcggattaatgaatgtgtctgctctttgtttgtttctattggttccgggggtacatttttgggtggatgctttggcgatggtgctcttcggtttgggcattggagtgctgatttgttttttaggaggactgatggcggtcgatattgctccctgcaatgcttcgggagccgctttgggagttgtcggtatagcgagttatataggagccggtttgcaggatgtgatgagtggcattctgatcgaaggtcagaagacggtgcaaaatggagtagaagtttacgattttacatatatcaattggttttggattggtgcagccttgctttcagtagtgtttgctttgttggtttggaatgcaggagagaaaagaagtgaaataaattgagtacattaaagtaaaaatagagtcattgtttttgaaggtattagtcaccatttcgggaagcaggcaatagctgtgctttccggaatggcttttttataattaataaaaatcgtttttatggaaaattcattgagtgatgaattgttttgttcattgaagaatgaacttcgtgaagtagatgcacaaatcagtgtgcatagtgaaaaactgttggagctgattgaccaaaaaaaagaattgtcgtccaactgattcgggaagaagaacaaatgacgcccactgttatcgaatatcggggagatccgaaacggtacatttctgtcattctaggtgctattgaccgggggaggttgacgtataatggagacgcgaattgcgaacagacgttccggtccttgtcaagtgtgatagatgtcataagccctaagaacgggaaagcgcttagtatcgaaacgttggtctcgtatgagaagaaagaacgtgccggggagttttcagattattcggagggagattttaaataatctgtttccatcgctgaacggttgaattaaaaaagtggcggaaatctggatggaaacttgttgcagattgccgccacttgggtttctattactcaatagtctctattaaccaacggtttaagttccggctttctgaactaaattccactccgatctttacaataagatattcttccttcgtatatcttcaaaggtttgtattccaataggaagtttacgcatcaagttgcccatatctgattcttttgatcttttgcacatcaaagataacaaatatttcctgaagtctgcttcaattggtgggttgatttgaaaatgcggtgagaaatcgaaaaaagacggttgtgtttttccgatttcccgccgtctttttggagaaagaaaaggtaaaaagtgagaggagtgagagaggatttctaacattcgtattttttttagagaaatatagaaag

SEQ ID NO: 81 - DNA, 33652 bp, Bacteroides thetaiotaomicron
gtattattatgtgtttttttaataaaacattacaagaagactatataccttatattacaagaggaaatcagacactgtttatccttgacagtgataatatctttgctgataataaagaacaggatcgtcgtttccttctacagacaggttcttataattctaatgcatattctttaaaatatgatattaagttgggacaggatggttcagatatggttccaggcatacgtttgagtgagatgtattatattatgggggaatactttgctcgtaagggtgaatattctcaagctggcaaaatgctggatgaagtacgttatgcgagaggaattctgactactaatatggagaacagtattgggtcattggaaggatttcatacagagttattgaaggatatgcgtaaggagtttgtaggagaagggcaaatgttttttcaatacaaacgtatggataagaaaccggtagataatgcaatctttgtatttgataaaccggataatgaagatgtttaatgtatgataatcaacgaaaaagaaagatgaaaaaatatattctatttgctttaatatctctttgtttttggggatgttcggaagatgagataaaaccttatcatggtggacaatatctttattttagccaactgaaggaatttggtgatgaggatttcgaagtatctttcaataactatcctactagtaatgctattattgtgaagattggtctggggctaatcggaaaaccgttttcaatagatacaccttacaaagtaagtgtggttgcggaagatgagagtgaagataagataaaaaatgccgatcagaaaaattatcgtttgcctgataatccaatgtttaaagctggactatctaatgatacattggaggttatgctgttaaaaacggaagatttgaaagagaacgtgaagttgtgtttgaaacttctcccaaatgagtatttcgaaggatcaataccggaatacgaacaaattaaaattatattcaataatattattagtaaacctttatggtggaccaatgatgtcacgaagttgtatttaggtacatattctagaaagaaatatgaagagtttgtaaaatgcaccaatatctcagattttggaaaactaagtactgccgaaaaacggcaatatgcattgacattcaagtactacattgcagtaaacaatgtaatggataaaaatgatacaactggtgaggagtttccgatggctgtacctattaactaattagaatagcaattgaaatatgaaaataaagatattatttgttgtaatgttccttttgatcatcacgtcttgttatgaggataagggaaattatgattatagagaaatgaacgatatcgagatttctgtagagactgaaagttcttcgtatgcgttaggagataaagtgacatcaaaaccaaaattggttttcactttaggaaaagaatcctctgatttatcatatgaatggacgtttgatggacatgtcatagctgatactagagatctagagtgggtagctgatacaattgctagtactaaagaactgaggttggctgtaatggataataacacaggagttacctattttggttccacgtacatttctgtttcttctgcttatgcctctaatggttgggtagtactttctgagaaagaaggtatcagtactttagcttttttgagagaacagactgaagagggaatattaaagcctgttgttacacgtgatatttatcaaatgattaatggtgtaccgatgggaacacagcctgtttctatgtatcctcactggacagagcgctgggatggagaagataaaaccagttggctatgggtagcacagaagggtggtcaaggagctgttgatatatcaggtagcagttataagcaagaagggatattgtctcaaatgttccttagtaaatcatatccagaaggatttgttccggtaggtgttattgatatgcagtttctcacaatggcaattggtgaggatggaactatttatacccgcgttaaagatagcaatttattgtttaactctagtaatttccttgaccgaccattaacatctgatgaagaaggcaaggtaaaagtggatggtagcatgattgcttatgctccttttgatgaacatggaggtatggttctttatgataaaaattcttcgcaatatttgcatattgctgattataagagttggcaaggttataactattctggaaaggtactacctttgaaggtggaggagtatgagtatggtccttctgatgctaggttagataacatgaaggattattctgtatactttgtaggcgctagtttagttgattggggagatgtctcttatatgtctattattaaagataaagctggcaggttctatatacagaaatttacggtagaagcttatggaggaggtagttctgtcactaaagttggcgctagctttacatctcaaagtgagattgaggggctaagttcagtaattgacggaacgtccaaaaattgcttttatctttgccgcaatcaagataaagctccttatctttttataagtaaaggagagactctttatttttattatacggatggaaataagatatatacatgtgcccagtttgattctccaattacttcaattgatgctgaatgctttaataacaaatatattatagtgggtttggaaaatggagatgtttatattttgaaaggagatgatgataattcggattatactctaaaaaaatatgtgatccaacagaataaagtaattcaggtgaatgatgccgaaaataaatttgtgttattccatgaaaaagattttggacgaataattcaagttcgttataaatggaaagaatcttggaatgaatcatttagttaaaactttaaaacgataaaaccttgaaaaaactgtatttacttcttctggttgcactatgtggggcgatgatcagccccgctgtggctaagaagaaaaacaagaagaaagcttccaccgaagcgactacaaagaaagagaagaaggaaaccaagtacgacaaactgtttaaagacaagaaagtcaccacggctaaaggtttcattactcttcacaagttggacaataaaatttactttgaattgccgattaaggtgatgaatcgggatattctacttggttctaccatcgtggaaacgaccgataaccagttcggctgtgtaggagagaagtcaggtgatccttttctgattcgttttgtgcaacgcgactcaactattacattgcgtcgtgtacaggcaggtcagttctctgaagatcgtgaaatcaagaagcgcttggtaagcagtaccatgccggcaatcgctgaaacattcgagatcaaagcatataataacgatagcacggcagtggtattcgatatgacagactatctgctgagcgataaaaagaacctttctccgttctcaccatattcaatgatggagatgatgggagccgatattagtaaggattttgagaaggaaagctcatttattcagggagtcaaaggctttgaggataatgtgagtatacgttctttactgacctacaaaatcagcgtgggtatgaagggaaattatgcagtgaagaaaatgccgtttactgcggttatgaatcgtagcttcattctgttgcctgaacaaccgatgcgtccccgttatgctgatccacgtattggtatttttgaacactctgtagtagaatttgcttccgaaggtcgtaggttgcgtactcgtcacattgctcacagatggaatctggagccatcggattcagcagcctatctccgtggcgaactggtagagccgaagaaacctattgttttctacattgatgatacttttccgttgagttggaataaatatatccataaaggagttgaagtatggcagaaagcatttgagaagatcggttttaagaatgccatcattgcaaaagatttcccgaaagatgatccgaacttcgacccggagaatatcaaatattcctgtatacgttatgctccgtctacggtggccaatgcgatgggaccttcttggatagatccgcgttccggagaaatcattaatgcatctgttacggtattccacaatattgtgcagttggttcagtactggcgcttcttgcagactgcccctgctgatgaggaagtacgtgatgttgttttgcgtgaagacttgctgggagattgtatcgcttatgtgctctcgcatgaggtaggacacacattgtcattgatgcacaatatggcaggttcttcttctatccctgtggaatctttgcgtgatccgaagtttactcaggagtttggtacgacttactctattatggactatgcccgtaacaattatattgctcaaccgggtgataaagagagaggcgtgcgtttgactcctccggaactgggagcgtatgattattacgctatcgcctggttgtattcaccgatctttgaggctaaaacggcagaggaagaaattcctatcttggataaatggatcagtgagaagtctggagatgttaaatatcgctatggtaaacaacagttcagacgtcgttttgacccaagttcagtagaggaagatttgggagacgacccggtgaaagcttctgaatatggacgtcgcaacttgcaatatctgctaaagcatatcaatgattgggtagcggataaggataaggattttgagttccgcacggctgtttatgatgaaattgtatatgcttacgtacgttatttgactttcgttttgggagatatcggtggtatttatctgaacgaacgctatgacggtgatcagcgcccaagttttaaaactgtatcgaagcaacaacaaaaaaaggctctgaatttcttattgaatgaactgaaggacctttcgtggctggatgcacgcgaaacactgaaagaattccctatccgtacttctgtggccatgcagatggaagatgcaattattgatggtatcttgtctcgttgtggtgcggtggctatctgttcgggtaaggcgacatcagctccttatactcagaaagaatatcttgccgatatagaacgttttgtatgggctcctacccgcgccggaagaaccttgacagaaacagaaatgcgtttgcagatgaattatctgacgaagctgattgaaggttcggttgcaggggttgcaaagaatgctacccgtaaaggtatcgcagatatgtatgctcacattgaagtgcccgaatggctgaaagctgcttcgcgcgaacgtttcggaatcatctcggaggaatttatgggatgttttaataacaagcctcgtgagatgcaggctgcccgtttggaggaaatcagtggatttgatgatgatgtagatctgaaagcaccgatcgaaccgatggaacatatatactacggtgagttgaagaaggttcgtagtctggttgcagcaagtgcttctaccggttcggctgatacacaacgccactaccgcttattgttgtacaaaattgaccaggcattaaaatgataggaagtatgagaaatagatatagtaagatactttgtttattgcttctttttgcatgttgcctgccacaggaaggaaatgctttctggccttttaaaaagaagaaaaaagaagataagaaggaaaatctgacaccatatcagaagctgttcaagaataagaaagttcagacagcacacgggctgatgactattcataaggtggaagggaaagtgtatgtggagttcccggttgccatgttaggccgtgagatgctgtttgcttcttctattgaaaatacgagtgacggtggtgaaggagctcccggacagttagggggtaccgacgtacgtttccgttttgagatgatcgattctactcttgtggcacgtatgcctttattgagtaagccggtaaataccagtggtgatgcttatatcgcacgtgcgttggacaatgcgcataatccgggtattttcaaaagctttaaggtattggcttgcactccggatagttctgcacttgtggtagatatgaagggattatttttggagggatctgcttttaccaaacctttcccttcgacatcggctaacggatactatggattcgtgtcgcgcgatcattctctgcaatcggataaatctgctattttgggtgtatcggcttcagaaaatcatataagtgtacgtgaagagttgtcatatactgtcgaccatacgctgatgggagcatacaatatgtacaaagacgtacctttgacagcggtcgtcactaaaatgctttgtattctgcccgaggagccgatgactcctcgcctggctgactcacgtttgggattgactacacaattgaaaagtgattattcaggggcaactcaggaagtgaagagtatacgctatgcaaaacgttggcgtatcgagccttccgactctgctgcctatcgccgtggcgagctggttcggccagtcaaacaactggtgttctatatcgacagtctgatgcctgtcaaatggaatccgtatatcaaggctggtgcggaatcgtggaataaggcatttgagaagatcggctttaaagatgttatttgtgtgaaagaattcccgaagaatgacacattgttcaatgcaaacagctttgactgtatgacaatacgttattcggcttcttggctgaattcggcacagacaacgatacactcagatacacgtaccggtgaaatattgaacgcgtctattctgattaatgcaaatatgatcagtgttcagtatgctgaccgtataggggccactgttgctattgatcctcgtgtgcgtactactgttttcccgcaggagatacagggtgagttgattcaggctgctattgctcaggctgtaggaaccggattgggacttacaatgaactggggagcttcctgtgcttatccggtggattcgttgcgttcggcaagctttactcaaaagtatggtctcgcttcttctgttatgggaggcgtaatcattaatgacgtagctacggaggaggatgttcgtaatggagtgtgtctggttaatgcaaagcctggtccatatgacgaactggtgattaaatatttatatcaacctatctatgcttcttcattgcaggaagaaaaagagacattggatagctggattcgtgaacatacgggagacccatattatgcttatatacgtaatcagtcacgttttgattctgatcctcgtaatagtcgcggaagtctgggagatgaccatttgaaatcattcgactatatgcttcctaatgttcgcaaaggatttgagaactattatagttggtttgccaaggaagaccgtgattttttaatgcgcagacgtgtacactctgcccttagtgaaagactgagcgggcgtatttatgcaatactgagttatattggcggtatttacttgaatgatattcgcgagaaggatgcgataccaagttattcaatggtagatcgtgagaaacagaaagcagctttgagtaaagcattggaactggcaaagaatctggattgggtggacgataccgctcatttgaatgaatttgaaatttcagataagaaggctgaccgtttacgtttggatatctttaatggtattttcggacgtctgccttatgtcgaggtttgtacagaacgcttcccggatgcagcatatactgcttcggaatatctggatgatatctatggaattgtttgggaaggtgtcttgaagcatcgtccgttggagaatttcgagagagcactacagacagcgtttctggaaagtattatttcaacatcgacagcaactgcgcctattggtagtttcaaagcctcaaaaacaggatttgcggctaccggcaaaccggagatcaatctggctgctttgagaaatggcggaaaggtggatatgaagatgtattcattgcaaaatgcagaagaagtagcaggcttttcttcaattccgccgatctataccaaccagacaaaaatagctgcttactattttgacttgttgatgcgtacgaaagacatgctcaagaaagcaatttcgacggctcctgaggcagatcgttctcattatgacctgttgatctaccgcatcaataaagctacggaaattgaataaatctctattacataaactctctcttaattaatttgtctctatgaaaacaatattgtaagagatatttttaaagatttcttctatgcaatattgagcatttttcacccgggtttacattgtcgaatgtaaatccgggtgaatcttttataggcggatatcttttggaaagtaccatacaactagattgcccgagagaaaaatatcagtctttctgtatagaacattattatttaatttgtatttttggcgcaaaactcccgaaatgactaacaatgagatttccatagaacaaattaataagttggatgcggctgctttccgactgctttataagaattattataaagcattggtttgctatgcaataacaattgtcggagattcagaatctgcagaagatattgtccaggagttattctccactatttgggagaaaaagatgtttttccggtctctggcttcattcagggtttatctgtataactctgtcagaaatgcttccttggattatttgaaacataaggatgtggaaggcaattatcttcagaagatgcttgatagtcattccactacatttaggatggaagaggaggaagagggcttctttagtgaagaagtctatcgccagcttcttcagacaattgatgcgctgccggatcgatgtagggaagtttttttgatgtatatggaaggcaagaagaacgaggagattgccactgcactccatgtttctcttgaaactgtgaagactcaaaagaagagagcaatgtccttccttagaaaaaaattaggctcctatcattttctattattacaaatgttacttccctaaaaagaagcataacactcaatccgctttacttgttaacacctgtttgcaatgaacaaaatgttcgttgtttttcttgattattgtacaaaaagaacggtcttctaaataaataaagtatcttttgaataaaaaaacttcagaatcctgtccctcattttttcttcttagtcgtctttgctataaataacctgaaataatatgataaagcgtaaaagaagtataaattctattatccatgatcagttgctgggatacgcttcggaagaagataaaaaacagttgcagtcatggcttgatagttctcaagaaaatagagagaactatgatcgtctgatgcgtgaggcttgtttgattgacaggtataaacagtttgcccaggtagatgaagcacgtgcttgggaaaggtttcagaaaaagcatttctctattcgctctgctcgttggatcaaaataggacggtatgcggctatcttcttattgccgataatcggttttgcaatatggttttggactttgcggctgatggattctcagccggtgatttcggatgaagttcgtattgctatgatccggtcggagaagatgggtaaacaaaaggcaacactggttctggcaaatggacagaagatggatttaaaatcagtgcctgctaagcctttacaggattcggtggaacaagtgactgttgctcagccgtctgtccctgagactgatgtgaacgaatcggaagaggtctctgttgtagaaaataataagttgagtacttatgatgacagtgaattttggatgacgtttgaagacgggaccagagtgcatctgaattataatacgacattaaaatatccaccacattttggtactaccactcgcacggtctatttggatggggaggcctattttcaggtagccaaggatagcaagcgtcctttccgtgtcattacggcgaatggagtggtcaagcagtacgggacaactttcaatgtaaatacacatgtgcctggaataacgaaagtagtgctggtgaaaggttctgtaagtgtgcttcctaatcagggaggggaatataaaataaaaccgggggaattggcggttcttcaggctgatacgcaagatgtacaaattagcgtagtggatatcgagccgtatatcgcatggaacagtggacgttttgtttttgataattgttctttggagagtctgatgaatgtaatatcacgttggtacaacaaagatgtcgtattcgaatcggaagataccaagaagatacgttttacaggagatattgatcgctacggctcaatagagcccatattgaaagcgatacagcgggtgactcatctggaaatggaaatacaggggaagaccataattataaagaaataaacatattaactactattaaaaaaggaggacgacatgcaaaaaaagagagctcgagaacgcattatcatgtttctctgtattatttccttgttgtttacaccggtgttggctgcatcgcaatctaatgcaatgagggtatccttagatcttaaatctgcaacagttaaagaattttttgatgctgtaaaagtacagactggcctgaactttatttatagtacggagcaagtgaagaatatgcctcgtatcactattcagagcaatagtcagcctatcagtgaggtgttgaacaaagtgctggcaaataccggatacagttatgagatagaaggaaatattgtaaccattgtatatcagcaacctaaagagaatgtccgcacggctacgggcgttgtggttgatgagggagggttgcccttgccgggagcttatataaaactctctaaaacggaacattcgacgataactgataatgaaggtaaattttctattaatttattccatcagaaagagcctgtcctgattgtctcctatttgggaatgattgtacaggaagtaaaagttgccggtactaaacctatgacaatcgtgatgaaatcggatgtaaagtcaatcgatgaagttgtagtaacaggttatcaggagattgacagacggaagttggcaagctccatatcctctataaagggagctgatctgattggtggggagtatctgtctatcgacaaaatgttgcagggacgcctgccgggtgttgctgtgatgaatatgtcatctactccgggagctgctcctaagattagaatcaggggatcttcctctattacaggaaatagagaaccggtatgggtagtcgatggaattattctggaagaacctgtcaatatctctacagaggaactgaacagtccggataagataaatctgatcggaaatgccatcggttcggtcaatccggaagatattgaacgtgtggatattctgaaagatgccagtgctactgctatctatggtatcaaagcggccaatggagttattgtggtcactaccaagcaaggaaaaagccagaaaccgagtatctcgtataccgctacattggggataacagctcctcctacttacgataaaatgtttcggatgaattctgccgacagaattgatatgtctatcgaaatgcaggagaggggattatctttcggaagttacaaaccttcggatattggctatgaaggggcattgcaacatctgtggaataaggatattacctatcaggaattcttaaaccaggtgaagaccctgaaaggattaaataccgactggtatgacttgctgttccgtacagcatttacacatcagcattcggtatccattacaggtggaaatgaccggagtaattattatatgtccatgggatatgcgaataataacagtgtgacgataggggaagggttagagcgctataacgtactggctaaaataaataccagaattaaccggaatatacatttgggattaaaggttagcggttcgctttccaaagccgaacatcctcatacttccattgatgtgtatgagtatgcttataatacttcacgggctattccacttcggacagcttctaatgagttgtatttctatgcgaatgaggctggacgtaacggagtattgtcttacaatatcatgaacgaactgaatcatacaggaaacaagaatgataattccgctatagatgtagctgtcaatctggattggaaggttgcttcatggatgagattttcatctatattaggactgtccagaagcaacgtgacacaagaaaactggggtgatgaacaatcatattatatttcttctatgcgacaaagtccctatgggaagatgttgccgaatcccattgaagattctgaatttgcagaaagatattgtctgcttccgtttggaggagagttgatgacgaccaatacacgtaatacttcttatacatggagaaatagcctgtctttgatgcaaagtttcggaaaacatgaagtttccggaagtatcggacaagaagtcagatcttcaaaatatgacggattaagctctacgcaatatggttatttgcccgaaagaggtaaaaagtttgttgatattgacccgacagtctggaaaagatacggtgctttggtaaagagtcatccggatgtggtgaccgatacaaagaataatgtgatttcattatatgctacggctgcttatgtttatgacagtcgctatattctgaacttcaatatacgtactgacggttctaataagttcggtcagagcaagagcgttcgttttctgccaatatggtcagtgtctacacgatggaatgttatcaatgagaagtttatgaagaacgtcgatttcttgaatgatctggcaattcgtgcctcatacggtatacaaggtaacgtgcatccggatcagacccctaacttgattgctagtttggggacattggaatcaatgccacaggagtatatttcaacattgtataagctgccgaataataaactgaagtgggaaaaaaccaattcgtataatattgcaatcgactgggcattctggaataacagaatctatggatcgcttgatgtatattacaaaaagggagtagatcaggtggttacgaaaaacgtagctccttctacaggtgcgtcaagtgtctccattaatgatggtgatgttgagaataaaggttgggatttggctgtttcttttgttccgattcagacccgggactggatgtggagtttatcattcaatacaggtaaaaactacaataaagtgttgaatgccgggaactcagcgatcacttggcaagactatattgcaggaacattagtgagcaatggcaatgcgataaatagtttctattcttataaatttgataaactggatgatcagggttttcctacatttaaggatattaatgagaaagatgaagaaggaaatgctgtggttcattctttgcaggagatgtatgaccgtgcttttgttctttccggaaaacgtgaacccgatctgaccggtggattctctacttatttgaaatataagaatattacatttaatgcgttgttctcattcagctttggcaataaaatgcgcttgaatgatttgtatgagtcctccggacagcggcttccttatccggatcagaatatgtccagtgaatttgtgaatcgttggagagagccgggtgatgaagacagaaccattataccggttttatcggataagagtttgcagatcaacgataaggatgtgacctatcgtattgcggataatggatgggatatgtataataagagtgatatccgtgtagtttcaggcagtttcctcagatgccgttcgatgtctattcgctatgattttaaacgtgaatggttgaaacctgtctatctgaaaggagcaagtgtcagctttgatatgggtaatgtatttgtcattaaagataaagcgctgaagggcagagatcctgaacagattggatttggctcaagaagtataccaccgcagcgttcttactcacttcgctttaatattactctttaataatgaatgatgatgaaaaagtacaatttatatatcatattgtttatctgcacattatcgtcgtgcagtgactttttggaagaaagttcacaagatttgatgatacccagatcggtgaaggattacaaggaactgttcttcggtgaggtaatgaaaacgaatgaaaaagacatacctcatccttatctggaatatatgacagacgatgtgaaagaccaatgttactatggaaccagaccacaagtcatttctaatgatttcagagaatatgtttgggcatattatacgtggcagggaaacccggaagtgggaatttcaaatgaacttacgccggatgttgcatggacagtctattatcataagatattgatgactaatatcatactggaccagctttataccatgaacgggacggatatggaacgtcaggatttagcaggtgaagcttatttcatgcgggctttctcgtattttatgcttgctaatttgtatggaaagccttatcatcctgcaacggcaaatgaagacttatgtgtaccgctcaataaagaaatcggcttatcagataagatgatgaagcgggccacgaatgcagctgtttatgcccaaatggaagaagacattaataaggctatccagtgttttaaggctataggaggtgagaaaactattttccgtcctaacttgccgagtgcttatctattggcatcacgtattgctctttttcaggagaaatatgatgtgaccattctttattgtgattcggtctttaaggtcgcgactcagccactttacaaacttcaggaaaaaaaggatcactatttcttttctcttgctaacaaagaaatcttgttatcctacggacttacatcacttgagacgcatatgaaagaagatttcagatatacggggaacttggtggtttctgatgatttgctagcgctatattcggaagatgatttgcgtcttacgaattatttcaagaatacaatcggcaaccagaccagacctactaacaaacagtatagtgtctatacacctattaagtggactaaaaattctgctacagtctatgccaacgccttacgtatttcggaagcttatctgaatcgtgctgaggcttttgctgaacttggcaatacgaacaaggctcttgctgacttaaatgagctccgtgaaaatcgtatgaaaccgggaactccgccgttagctgttgatgaagacggaattgtagcaaccgtacgtaaggaacgccgtagagaactggcgtttgaaggattccgctggtttgatttgcgcagatatggctgccctcctcttacgcatacttacagttcaaaggagaacgagggagcaggggatgtcttcgaactgaaagagaaaggatacgtattgccgattcctaagagcgaaagagagagaaatacggaaatagaaatattcgaccgtccgaatagtgaacctgttaataattgatcgattatgaagaaacttatattattaatttgtatgttggcaggtatgtcttcttgttatcatgaagatgcgttaatcgttcctgagcaaccggataaatacaacattttgacagatgacccgtcagatccgacacagcattttatataccagttttatcagaaatatcagactgtgattataactaatccgactgaggctgattataaattcaactttacagcgaataacggaattaaaataactgctcccgaacaaaagcaggagattattgatgaagggattgagtttttgcaaaaggtattattgaatttgtactcggatagttttttaaagaagaatttacctttttctatattgttatctgaagaggtccggatggcctcttatggtgagacaaccatcatgaattgctatgctagtagcagctttatagccttaggtaatgtatcatcttctctgaaaacaatgaccgatgaggagtttgtgaaaatcagagcagatgtgaatgccagcttttgggcaaagtatatgtcggaagtcagaggattgtttactatttcagatgctttttatgaagctagtgaagaagttgaaccgaaattgtacgacccgaactggtatcgttttaaaggaacggaccctaatgaaatcgatttttataagtatggggtgattacttattctgagaactcctatattgatgaagattggccggattttaattccatttatgctcctttaaagagtgaagaccttgcgcaatggatgaatttcgtctttgagaaaactcctgccgagattcaggaaatctgcgataaatatccggtaatgaagaagaagtatgatgtgattcgggaagctatgcttgaaaacggattcgatctgtccaaactggaactatagaacttaaaaacagcatgatatgaacaaaattttcaccttattacttgtaggagcattaactgccggagcggtaactgctaatgccgaaagtcagatttttaaaaagaaaaagaagaaagcaaaagcggaaacagagcagccggcggcaaaagattccacaaagagtagtatgaccgaatacaaaaaactactgaaaggagccaagacgattgatggcatgtttaaggtacacatcgttaaggataagtattatttcgaaatacctaaagacttgatgggacgcgattttatgattgcgtccagagtatcgagtaccagtaacaataaagatatagctgccggacaaatgccacgcaatccggtactggtaactttctcggcagataaaaagaaaatctacatgcacaaaaagatggtgcgcaatttgtgtgacaccacttccaatatgtatgctgcttttcagcgcaacttctcagaccctatttgggaagcatataagatagaaagtctttcaccggactcttcagcatatgtcatcgatatgagttcgcttttcataacggatgtacccgaattcagcccgtttcgttcggaaaatataatggatgtattgatgaagagaaaagcactgaagggaagtcttgcttcttccaaatcgactattctgggaatgaagtgttttccgctgaatataaacatcaagacgctgatgagttatactgttgacggaggaccgttcactgtaaccatgacgcgtaatattattttgctgccggaggaaattatgcgtcctcgttatggagactcgcgtatcggttattttgatgaaagcaagcggttttatactgaaaagaaagatggtttgcaagaacttacttacatcaaccgatgggatttgcaaccaaaaccagaagacttggaacgttataagcaaggtgagttggtggaacctcagaagccgattgtatattacgttgatactgctatccccgacaagtggagagattacataaagaaaggaatagaagactggcaggttgcgtttgaggaaataggatttaagaatgcgattgtagcgaaagactatccgaaggatgatccgaactttgatccggatgatattcgttatagctgctaccgaatgattaccactccgatacaaaattcaatgggaccttcctgtgccgatcctcgttcgggtgaaatcattcagggcgacgtcttgttttattcaaatatcattaagttgttgcataactggcggtttgttcagactgctactgttgaccccaaagtacgcaaggctgtgtttgatgacgagacgatgggaagctcgttacgttatgtagcagcgcatgagatcggacataccctgggactgatgcataactttggtgcatcttattcgtatccggtagattcgctccgttcggccactttcactcagaagtatggtacaactccgtccatcatggactatacgcgctataattatgtagctcagccggaagacaaaggagttgctctgactcctccgcttttgggtgtatatgataagtttgccatcaaatggggatataaacctatatttgatgcggcatctcctgaagatgagaaagctactttaaacaagtggatcaaagagaaagagaatgatccgatgtacaaatacggtccgcagccttttattaatgaggtcgatccttcttgtaaatctgaggatttgggtgataatgccgtgaaggcaggaagatatggcttaaagaatctgaaacttatcatgaaaaacctgccggaatggacctatgaagatgatcatcaatatgaacgcttgacggaatcatatcaggaagtgattatgcagatgcaacgctacttactgcatgccatggtgtccatcggtggaatttattttgatgagccgagacgggacagcgaaaagcctgttatccgttttgtgccgaaagctgaacagaaggaggcattgaagtttattatggaaactatgatggaactacccgaatgggtacttgacaagaaggtgattgagtataccggtccgacttattcgccaagtactttgcagtcaatcattatgaatcgtttgttcttcacatacattacatccagtcttgttttgtatgaggagttatatcccaaacaggcttatacttttgctgaatatatggatgatatttatgattttgtgtggaagaaaactatatccggtgcccggttgaatatgtacgaccgtaacctgcaaattacttatgtggaaaagttgttgaaagaaggaggaatgctgaaacaaaaatcttctccattctcatttaaagacttgaatgaagttgagaaacaactgcttacggataatgtcgattggacgaaagccggctttgaactcaacccgctcggaagtgtggatatggttaagaatccggctatttatcagaaggtaatggatagctatagtttgctgcgaagcaaagtaaatacgggtgatgctactacccgggcacattatcaaagtcttgtctttaaaataaagcaagcgttaacggaacaataactatctctcttagatacttgggggcacctcgtcgcagtgattgtggcggggtgctaattttatccggtcaatggctttttattgcatcgccaactatcgcattgccaacgccttattctccgcctcttccataatttccctttccccgggacctttgtcattgataccgcagagatgaagaataccgtgaataataacccggtgtagttcatcatcataagctgccccgaattgttcggcattggtgcgtatcgtatccagactgataaacaggtcgcccgacagacgatcaccctggcaataatcaaaggtaatgatatccgtgtaataatcgtgttgcagatattgtcggtttacctccagaatcttttcatcggagcagaagatataagcgatttcaccgagtctttttccataagaggcagctacattctttatccattctgtagtttcccgttttttgatatcaggcatcttgacgccttcggtttgataagttacagccataattgagtctatgatttaaaagaaaaataaataactgattaagatggcggctataataccggagaagtctgcaatcaagccgcaggtgactgcattccgggttttactgattccgacgctgccgaagtaaacggcaaggatatagaaagtggtgtccgaagctccgcgtactacgcaactcattcggcctacaaacgaatccggtcccatctctttcatcgtgtcaatcatcagcccattggcaccgctaccgctgagagacttcatcagcgctgtcggcaatgctcccacaaaactggtatccactccgcacagatcgactacataaccaatgcctcccacaaggaaatccatcgctcccgcagtacggaatacggcaatgcctacaaggaaggcaaccagatatggaatgattcgtacggctgtcgtgaagccttctttggcaccttctacaaaagaatcatatacgttaatcttcttccggacccctgtcagaataaacaggatgatcaccccgaacagaagaatatttgctatcagcgtagagtaagtacccatttcctcacgcgaaatattcagaaacagataaatcaatccggagaagaaaaggcagataacgcccatcaatatcaggataggcttattgatcagattgatcttctgggcgatactgacggctatgacaccgaccagagtcgagataaaagtactcagcaggatagggataaacacatccgtaggctgggcagcccccatctgcgcacggtataccatgatactgatcgggatgatgatgaggccggaagtattgataaccagaaacatgatcatcggattggaagccgtatctttcttcgggttcagttcctgcagttctttcatcgctttgagtcccaatggggtggcggcattgtcgagcccgagcatattggcggacatattcatgaagatggaacccaataccggatgccctttgggaatgtccggaaacaggcggcagagtaccggactcagaaagcgggcgagtgcattgatcagtccgctgttctctccgatcttcatgataccgagccagagggccagtactccggtcagtcccagagatatttcgaaagcggttttcgaagagtcgaaagttgagttcatgatagctgtaaatatctccgtgtctcccagaaaaattacttttatcagggcgataatgaaggcgataacgaagaatgctatccagatataatttagaaccatagtcgattgcgtgtatatagatggtgcaaaagtagttattacgttttaaataaactaattgttttcgggcaaaagagtagaagaccgaaaccgggcttgtgtactttttcactctattcttcaatagaatgatgcgttgcttaagaaaagaatgtgtaaatacgatatttttaggaagaagaggcttttatggtcattaaatagcaggggaaaagcggaaagcaattacttgttattatgtttatacacagccagatgcaggttgctatattctcagagtattctcaccgtgatgagaaaaaattctcaccgcagtgagaaaaaatactcatgcctatgagaatattttctcattgcattgagaaatttttctcatgcctttgagaataattgcgctttggtaatattgaaaatgatccccttgttatcagggaatgaagtcaccgaaagaagactgaatgacatcttatcatcgcatcaattttgagatttattcttcattattcctcttggaaaagagaaatgggtaatggccggaggtttttattattctttcttatatcgaaaatgaatggatttctctatctttgtctcctacatttcaagaagaaaatggaacaagaagattttaacatacgcgaacatcagctgacttcacgggagcgggattttgaaaatgcgctccgtccgttaagctttgaagactttagcgggcaggataaggtggtggaaaaccttcgcatctttgtgaaggcggcacgtctgcgtggcgaagcactcgaccacgttctgctgcacgggcctcccggattgggtaaaacaacgctttccaatattatagctaacgaattgggagtaggctttaaagtaacttccggtccggtgctcgacaaaccgggcgatctggcaggagttttgacgagtctcgaaccgaacgatgtgctctttatcgatgaaattcaccgtttatcgccggtggtagaggaatatctctattcggccatggaggattaccggatagatatcatgattgataagggaccttcggcacgtagcattcagattgacctgaatccgtttacgctggtcggtgcaaccacccgtagcggattgctgacggctccacttcgtgcccgttttggtattaatctgcatttagagtactatgacgatgatattctgagtaatatcatccggcgttcagcttccatactggacgtaccttgttcggtgcgggcggcatcggagattgcatcccgaagtcgtggtacgccccgtattgccaatgctttacttcgtcgcgtacgcgattttgcgcaggtgaaaggttccggctctatcgatacggaaatagctcagtttgcgctggaagcgttgaatatcgacaagtatggtttggatgagatagacaacaagatactttgtaccatcatagacaagtttaaaggcggtcctgtcggtctgacaaccattgctaccgctttgggcgaagatgcgggcaccatcgaggaagtgtatgaacctttcctgatcaaggaaggttttatgaaacggactcctcgtggacgtgaagtgacggagcttgcctataagcatttgggaaggagcctctatagcagtcagaaaaccttgtttaatgactgatagtctgatctgacggctgtcggtatggagagtgttggcgacaattaacagcaggctttttgaggaacgtttaaacagataactgattttattgaatgattggagtatgaagcagtggagtatcttacttgtatttctctctttgagtctgtcattatcagctcaacaaggttatgagaaggacgtatttgtctcttccacaggagattctttgccttaccggatgattcgccccgagtcaatgaaggcggggaagaaatatccgctggtcctgttcctgcatggagccggtgagcgtggaaatgacaatgaaagacaactgacgcatggcggacagatgtttctgaatcctgtcaacagagagaaatatccggctttcgtacttgttcctcaatgtccggcaggtagctactgggcttatacggaacgtccgaaatcactgtttccggcagatatgcctgcaggacaggagatgagttctcttacccggactctcaaacaattgctggatacttatctggccatgcccgaagtcgataaaaaacggatatatattgtcggattgtcaatgggagcgatggggacgtatgatttggtggtccgttatccggagatttttgcggctgccgttcccatttgcggatcggtgaatccggaccgtttgccggctgccaaagaagtgaagttccgtatatttcatggggatgccgatgatgtggtaacagttgaagggtcgcgtgaagcgtacaaagcactgaaagctgccggagcaaaggtggaatatatcgaattccccggttgcaatcatggcagctggaatcctgcattcaattatccgggcttcatggagtggctgttcaaacaaaagaaataatattattcattgataataaagagatctaaataaacatggcagaactaaagtcattggcaaaggacactgcgatttatggtgccagcagtattattggtaagtttctgaactattttctggtaccgatttatactttttcacttcctgctgcttccggaggatatggagtgatcaccaagatgtatgctattgtggcgttattgctcgtggtgctaaccttcggaatggaaaccggctttttccgttttgccaataaaggagatgacgatccgaagaaggtatattctgtttcgttattgatggtagggggcgtatcgctcctgtttttgctgttgtgtctggtcttcctcaatcctattgcagggctgatggggtatagtgaacatccatggtatctgggcatgatgctgattgtactggctatggatgccattcaggctattccgtttgcttatcttcgttataagaaacgtcctatcaagtttgccggactgaaactcttatttatatttgtcagtatcttgctgaatatcctttattttgttgtcatgaaaggcgatgacgtaggggtagcctttcttattaatctgatctgttcttttgttgtaatgctcgggctgatacctgaattccgtgaattccgctattgtcctgaccgtttgctgatgaagcggatgttatattattcattccctattctgatattaggggtggcaggcattgtgaatcaggttggagacaagattatttttccttttgtctaccccgataaggtggaagcggatgtacagttgggtatttacagtgcagctactaaaatagccatgataatggcaatgatcacgcaggcttttcgcttcgcatacgagccttttgtctttggcaaaagtaaggataaggataataaacgaatctatgcgcaggcaatgaagttctttatcatctttacgctgctggcattcctggcagtcatgttttatctggacattttacgttatatcatagcagaagactattgggagggactcagggtagttcccatcgtgatgattgcggagatgtttatggggatttattttaatctctcgttttggtataaactgacggatgacaccagatggggggcatatttctccattatagcctgtctgactgttgttctgatgaatatcttcctgattcctgtatatgggtatgtagcttgcgcatgggcgggttttaccggatatgccatagctatgttgctttcttattttgtcggtcagaagaaatatcctattgcttatgatttgcgtggaataggttgttatgtaggcttagctattattctgtatctgattggtgaatggataccgattcataatacagtcttgcttcttgcattccgcacagtccttctgctactatttattgcttatattatcaaacgggacctgcctctgagtcagattcctgttattaaccggattataaaaaagaaatgactatgaagacagatgaacggaataagtttgcgatcaagtcgttcttgggtgaatacctggacttgaaaaaggataaagacaatgaaatggaaaccgttgactctatccgaaaaggagtagaattcaaaggagccaatttgtggattcttatttttgccatctttatggcttcactgggcttaaatgtcaactctacggcagtgattatcggtgccatgttgatttcaccgttgatgggacctatcatgggtgtcgggctttctgtcggtttgaatgatttcgaactgatgaaacgttctttgaagagcttcctcatcacgactgctttcagtgtgacgacggcaaccatcttctttcttttcactcctattgccgaagcacaatcggagctgttggcgcgtacttcgcctacgatttatgacgtattcatcgcacttttcggtggtttggcgggagttgtcgccctgtctaccaaagagaagggaaatgtgattccgggagttgccattgctacggcgttgatgcctcccctttgtacggcaggttatggtctggcatcgggcaatctggtttactttctgggtgcattctacctctactttatcaactccgtatttatcagtctggctaccttcatcggtgtgcgggtgatgcacttccagcgtaaggaatttgtggataaggcacgcgagaagatggtgcgtaaatacatcattctgattgttgtgctgacgatgtgcccggctgtttatctgacgttcggcatcattaaaagtactttttatgagacggcagccaatcggtttatcaatgagcagttgaactttgagaatacgcaggtacttgataagaagatcagttatgagcataaagacatccgcgtggttctgatcggtcccgaagttccggatgcttcgatatccattgcccgtagcaaactgaaagaatacaagctggaagaaacaaagctgaccgtactgcaagggatgaataatgaggcggtagatgtctcttccattcgtgccatggtgatggaggacttttataaaaacagcgaacaacgcctgcaggaacagcagaaaaagataacccgactggaagaaaacctcgctcaatataaagagtacgatacgatggggcgtactctggtgcccgaattgaaggtgctttatccttccatcacttcgctttctatcgctcactcgctggaaacacgggtagactcgatgaaaacggatacggtgacactggctgttttgaaatttggcaaacatccgtcagttgccgagaaggagaaaatcagcgcatggctgaaagcacgggtgggagcgaagaagttgaggctcattaccgaataatggctcccggattgatcatagaatatataaatctaaaaataatagcatgaaactcagactaaccgcaatgattctcctctccctttgcctgtcacaggcatttgctgacgagggaatgtggctattggggaaccttcgcaagaacaaacaggcggaacgggtgatgaaggaactcggtttgcagatgcctgtaaataaactgtataatccgaagaagccggctttggcaaatgccgttgtcagtttcggtggattttgttcgggagtggtggtttccgaagatggtctggtatttaccaatcatcactgtggtttcagcagtatccagcagcattcttccgtagaacatgattatctgaaggatggttttgtagcccgcaatcttggtgaagaactgccgaatcccgaattatatgtccgtttccttcttcgtacggaggatgtgaccaagcgtgtgctctcggctgccaaacatgctcatacggaaagcgaacgtcgcgtagttgtcgactctgtcatgaatgtaatcggcatggaagtatcagagaaggactctacgttgacgggaattgtcgatgcgtattacgccggaaacgagttctggctttctgtctaccgcgattataatgatgtccggctggtttttgctcctccttcttcagtcggcaagttcgggtgggacacggacaactggatgtggcctcgccatacaggtgacttcagcgttttccgtatttatgccaacaaacagaacggaccggcggattattcgccagaaaacgtcccttatcatccggaatacgtagctcctatttcgttggatggatacaaggaaggctctttctgtatgactctcggctatccgggcagtacggagcgctatctctcttcgtatgggatcgaagaaatgatgaacggcattaatcaggccatgatcgatgtgcgcggggtaaaacaggctatttggaagcgggaaatggatcgccatccggatatccgtatcaagtatgcttctaaatacgatgaaagttccaactactggaaaaacagcataggaatgaataaagccatccggcacctgaaagtgctggaaaagaagcgcgcagcagaagcagccctccgggactggattcagtctcatccggaagaaagggagaaactgattcgtctgttctcttctctggaactgaattataataatcgtagggaaacaaaccgtacccttgcttatttcggggagtcgttcattaatggtcccgaattggttcaattggcactcgaaatactgaatttcgattttgaggccgaagagaagttggtcgttacccgcatgaaaaagttactggagaaatacgataacctgaatctgtctattgataaggaagtatttgcggccatgctcaaagaataccggtccaaagtggataagaaataccttccggcgatgtatctgcaaatagacaccttgtataacggaaatgtccagacttatgtagactctttgtatgctacctctcaaatcacttctccgaagggtctgaagcgcttccttgaacgtgacacgacctataatctcatcgaggaccctgccatttctttaagcctcgacctaatagtgaaatactatgagatgaatcagagcgtctcagaggcttccgaacagatagagcaggatgaacgcctgttcaatgccgctatgcgtcgtatgtatgccgaccgtaacttctatcctgatgccaattccaccatgcgccttagttttggtacagtctgtggatattctccttttgacggggctaccttcagttattatacgacggtaaaaggcattttcgagaaagtaaaggaacatgcaggcgatatagactttgcagttcaaccggatcttctggctttactctcttccggtgatttcggcagatatgccgatgaaaagggagatatgaacgtttgttttatctcgaataatgatattacgggaggaaattccggcagtgccatgttcaatgcgaaaggggaattgcttggccttgcttttgacggcaattgggaagcgatgagcagtgacattgtctttgaaccggatttgcagcgttgtatcggagtagatgtgcgctacatgcttttcattatggaaaagtatggaaaggctgctaaccttatcgaggaactgaaattaacccgctgaaacggaaaaacaattttataggaaggctgctcttatcgtttcagtataattaccattacagcaacgataatcagtgcaatgcctacgccaatacttgtggtgaatgcttctccaaagaggaagatgcctacacatacggcagttaccggctccatagctcccaatacagaggtgagtgtggagccgatgctttttactgctctgaccagtgcaagattggaaacgacggtcgggattaatgccagcaagattagatttccggcagtatgccattctctgataggctgaagatggctgatactgctggttccgataaggagaaagattcctccgaaaagaaagacatagaaagtgagcagtaatcctttcatccggccgatctttaactggctcattgtgacaaggtacagtgcatatcccaatgctgataaaagaacgatgaaaaggccgaaaaatgagaaacttcctgtctctgtatttccaccggataagaagtagacacctatcacggcagaggcgatggcggctatccgccaaccggactttttttctttgaagaatagcatcatgaccagggtagtcagtaccggatacatgaagtgaatagtggtggctacaccgcttgccataaacttatatccccagaacaggaagacggcagacatcagataaagtatcgcaagcaggagcagggaaggaatgtcccgtctgctgattcgaaaggattgcccgttgatcagtagaatcccgcctaatgccatacacgcaaacaggaagcgatagaagagtatcgattcgaattgcatgcccgcctgcatggcaggaatggtgaatagggggataagcccaaaagaggccgacgaaagcagaccgtacaggaaaccgttgactttattcatagttaagtatatattcggagtgcaaagatactcataatagataagatgatattatgtttgaattataaaatagagattacgtccgaaacgtatgaagctgtctctgttttcttgttgagtatatcgaatttttcgctaaaacatgtgtttagggttgaaataaacagatattgctaaattatgaacagatattttctctggtagtgtttcttttttctgacctttggtgtgtccagagtacaaacctgtaaatatttgaattgacaacaaaactatgatacatatgaaaaacagattagttggcttattagtgttcgcgttggttgcttttaacttatatgcgcagtctgatcaaagtaaaaagggacttcttacttttaccggtacgcgtattatttcctttgatccaatgcgggaaatgcctaagatggcttggtatagtgaaaatcaagatattcgggtagatgaagaagtgctctttaataatcagtcgtcattgttgattccgtctgtacggggaaagaaaacagaagcttatttcggcatgaataaccgcgatattacaggtaagacgattgtgtttaaaggcaaatacaaatatcagcaggcaaataatgccaaagtgagtttcgcaattaaactggacactcaccttcaaagaatagacgagaaggctattgattttgaatgtaacggcagtcaggactggaaagacttttatgtggaaatgccgtttacacgttccaagaaatttttctttcgaatactctgtgacggggaggccaggctttgggtgaacgactgccaggtgctgatagatggacagtcacttgatttaatcaagaatccggatgttgaagtagacaaggatctggagttcgcaggaaattcaggaatatcacttggagacgttgacgggcaaacattggaaaatttggtggttttgggcaaggtttggggattccttaagtattttcatccgcaggttgtggttggaaagtataactgggattttgaattgttcagagtgatgcccgggatagcagctgtgaagagcaaaaaggaaaggaactcactgttaaacaaatggatagataagtacggtaaaatcacggaaaccgaggagtatgtaatcggagattcggcccaatatcatcgttttgcacagcttggctggctggaagatccgaatgtcttcgataagaaactgtctgaaaaactagtgagaatcaagaatgccaaacgtaatagtgtattgaactactatcttccgatattaaccggaaaggaggaggtggaatttgccagagacaaaccttatccttcaatcgactgggaagatcagggatatcgtattcttacggtttatagattgtggaatgccatcgaacatggatatccttacgccaaccttacagaccatagatggagtactctgctggcgcaatatctgcctgaatttatcaatgcctcttcggaaaaagatttggaccattctatacgaaaactggctgctgaaatcaatgattcacatggagggcttgaatttccgaatcatgctccccgattgtatggtcttccattgggattgactcagacaacggacggtaagcttgtagtagaatcgactgcattaaaacagattgagcggggatcggtcatactggctgtaaatgataaaccgatttcggaaataatcgacaattaccgttctatattgccttcttcaaatgagcatggtttactgaggaatgtctcattcagactatttgttacatcggagaatgaaatgaaagtcacggtggagaatcaagggcagtctcatgaatatacaatacccatgcagtcttttgaaagagcatcttttaaaggccgaaagagtccgtcagattacggactggatgccagaaagattctttatgtagatgcaggtataatggggcttccggaactggatcagatgatgaaaacaaatttgaatgctaaaggaattatattggatatgcgtaagtatccgagatgggacattatggaagtacttggaaaatatctttatcctcaaccgactacatttatgtggtattccattaattcgaagaaatttccgggtaactttggtcttgatataattgggaaaattggttttaaagaaaatcctgattatttcaaaggtaagattgctattcttgtaagtgagatgactcagagttttggagagctaatgtctgtcgcttatagagtggcaccaaaaagtgcggttatcggtacgcaaactgccggtgcgaacggtcatgtcggatatttatatttgcctcggggaattaaattcacctatacaatggcgggagcattctatcctgaatggaaattgaatcaacgggatggagtgactattgatattccggtggaacagactgtagaagatatagctgcaggagaagatatgtggattagaaaagcgattgaatatattgagagtaaacggtaaggtttcaccctgattaaagggatattcagcccgtcgatataattcgatttgaatatattgacgggctgaattatactattagcaagctgaacttatttctttatcggtctgcttggaatcttttcaaagatagatctaatccgttccatctcaaatttaggctgtcggtcgtaagtgtagataccgtttttctcttgttcgatatctgaaaactgtgtatagcagaatccgctgatgattccggaggattgaatcgcattgatgagtttttcgatgcgttcgaagagggcatcttcgttggtaaatgttcctccatgtccccatgtgtcttccttggttctggatgtttcccatacaataccgccgaattcaccgatgataaaaggttggttggcataagctgcctggttcttgtccggctttaagcttagtgcgaaacgtgttgcatccggttcgtaagtactgatgctccagatatctgtcaggaaatggaatccactgccggtaaggtcgttgaacgggcgactgggatcgattgcttttgtcagtttttgcaggtcaaataccaggcgtgcaaatgtaccggacgaaacattgctcaatggtacagtaagaggtgcccatgtgatgatagaagggtgattacggtctcgttcgagtatctctatccattcactgagaagatttcttgatgcgacctcgtcatcgggattcattccccagttaggagactctccccaagtgataaatcccagcttatctgcccagtaatggaatcgttcttcgaaaaacttttgatgaagccgtgccccgttgaagccggcttccttacttagtaaaatatcatttttaagggcttcatcggtaggtgcagtccagattccatcaggataatacccctgattcataaccagacgctggaaataaggctcgttattcaagtaaaatttgccattggctatatgcactttgcgcatacctacatatgattttacctcatcgatgatctgccctttggcatctttgacgcagtaactgatatcgtaaaggtggggagtttcggggctccagagcttgatattctttatcggtaagatcaggttactgccattggcacattttgatgtcacttgagcgacttttttctggctgtcatagatcgtaacttccagtgtctggtcattggatatctgatagaattccggagtaatgatcaattgattattgtcaatatccggataggtatttgccgatttcagtccacagggagagagagcttccatccacaccgtttgccagatacctgtgacacgcgtataaaaacaggcaaaggagtttttctccggagactgtttgccgcatgcctgacgacctgattttgcatcatcggacacggatactaccagattgtgactattcccgggtttggctatgcgactgatatctattacaaaaggagagcttccgccgttatgaaaaccgacgaggcgtccgtctatataaatctctgctaaatagtcgacagcgccgaaatggagtaaaatcttcttgttgctccagtcagcgggtatcggcagagaacgttgataccacattttttttataaagtccgtgtgattaactccggatagtttgctttccgggcagaaaggaaccgtaattgttttgctaagctcctttgccgtaggtaagttacgctttttcccggaatcatcaagatcgaattcatatgtccacgtaccatttaaattaacccaggtagttctttcaaattgtgggcggggatattccggccgaggaatatcattggttgcgtttgctgcaaaagagagtagtaaaccaactagtatcagatgtgcttttctcatgttttgtaatttttgttattgtataatttaagtgtcttagctgattgtaaaaatagagatttaaaagaagaaaaggtgtaaacgattgttcaaattaggaaataatctgatcatagtgaagattattcggttatatttgataaatgtgtataataatgtcacaaatttatggtatgaaat

SEQ ID NO: 82 - DNA, 33570 bp, Bacteroides thetaiotaomicron
aaatttgatattttattgcattaaaactcagaaaaaagatatttatttattctttttcatcgacttatagacaggaataaagactaatgctgccgaaatgacaagcattactatcgtcataccgtcaatacgttcggcttttgtgagaactaaatagcaaagcgccagccaaagcaggctgacgcaaactatttgtgattttgataacggccttctcatcggctttcgtttttcttcttcactacgatggcgtcgatcacggctacggctgtgatgttcacgatgtcgcggacagaactttcaaagtcagtgaaatggataggcttgttcaatcccatctggatagggccgataaattccgtatcggggtccattgcctgcagcagtttgtatcctgcgttggcggagctcaggttcgggaagatcagcgtattcacgtctttacctttcaggcgggtgaacggatacttggcgtcacgcagttcgcggttcatggcaaagttcacctgcatttcaccgtcgatggcgagttccggatattccttctgcatatagttcactgctccgtgcactttgacagggctgccggaggtatcggcgccgaagttggagtacgacaacatcgagatgaccggtgtatggttgaagaaacggactgtcttgtcagccagtttggcgatgtcaatcagagtttccgtatccggatgacggttgatcagcgtatctgccaggaagtaggtacccttctttgaattaagaatgtgcatcgttccgaaatggttgaatccgggctggatgccgattacttctttggcaactttgatggtgttgctgtatcttgtgtagagtccggtgataaatgcgtctgcatctccggtttctaccatcatcataccgaagtagttgcgttcgaacatcttgtcgttggcttcttcgtaggtaaagccttcgcgggcacgtttttcggcaaggatgcgtgagtagcgttcgcggcgttccgactcgtccggatggcggagattgacgatttcgatgccttccaggctcaggtcgagttcttcggccagtttgccgattgcttcgtcgtttcctaataagataggatggcagatgccttcggcttttgcttcgacggcggctttcagcatgttgggatggatgccttcggcgaatacgacacgttgcgggttgcggcgggcggtgtcataaagctggcgggtcagtttggattcgtatcccatcagttcgcgcagatgaacgcagtaagcgtcccagtctttgatttccgtgcgtgccactccgctttccatggctgctttggctacggcacaggaaacttcagtgatgaggcgcgggtctaccggtttcgggatgaagtattccggaccgaaagagaggttgttgacgtggtatgctgtgttcactacatcaggtacaggctgttttgccagattggcgatagcgtgtactgctgcgattttcatttcttcgttgatcgctttggcctgtgtatcgagtgcgccgcggaagatgtacgggaagccgattacgttgttgatctggttcggatagtcggaacgtccggttgccatcagtacgtcggggcgggcgctcattgcatcttcgtaagagatttccggtgtcgggtttgccagtgcgaatacgatcggcatgggagccatgctgcgcaccatgtcctgactcagtacgttacctttggacaagccgaggaatacgtcggcgcctttgatcgcttcttccagtgtgtggatatccgtgcggtcggtggcaaaatatcttttctgttcgttgaggtcggtacgtgtcttgctgataacgcctttgctgtccagcatgacgatattttcgaggcgtgcccccagtgatacatataatttggtacaagatacggcagatgctccggcaccgtttacgacgattttcacatcctcgattttctttccggccacttgcagggcatttaccagtccggcgctggagatgatagcggttccgtgctggtcatcgtgcatcacagggatgtcaagctcttctttcagacggcgttcgatttcgaaacattcgggagctttgatgtcttccagattgataccgccgaaagtaggagcgattgcttttacggcagcgatgaatttctccgggtctttctcgtccacttcgatgtcgaatacgtcgatacctgcgtagattttgaaaagcagacctttgccttccatcaccggtttgccgctcagtgcgcctatgtcacccagtccgagtacggctgtaccgttagaaataacagctaccaggttgcctttggctgtgtatttgtaagcgtcctgcggattcttctctatttcgaggcaaggctctgccacaccgggagagtatgcaagtgataaatcagtttgagtactgtaaggtttggtaggaactacctcgatcttaccgggtttgccctgcgaatggtagagcaaagcggcttctttggttattttagccatggtattggtatttttattaataagttatcatttggctgcaaatgtaggaataaaagttatacattgttgtctttagatgataatttctattaattttatagcaaaatgactgattttgcacaaacttatggttgctatccgggtctctgtactccttaatgtataatggttatttcttttttctgattgctatataacatatctgttttgatattctctgggcgacattccttcatgccgtttgaaatatcttcctaaatacgactggtccgggaaaccgagccggtcggctatatcctgcattgtcagctccgtggactggagcagtactttgatttcgagaatggcgaaatcatcaatgatcttctttgcggaatctccggtcacactgcggcagatacctgtcagatatttggtcgaaatacaaagttcgttggcgtagaagttaacttcccgttgtgaaatgcagttttcgtgtactaatgcgacaaacttcttgaagatttcgtcctgtcggcttcccccttctatttcctgtttgtcgaagtagcggtagcatttatcgtaaatgtccagcatgaaagactggagatgattcttggctatctgattgcggaagcggttctcgcgatcattataaatagcagttgtcgcctgtatcaatccgttgattgctccggtatccttatcgggaagtacatagcatggtttttccttcataaaacggaagaaggtcggttctaaccgcaggcaggcttcccgaaacatatcctttggaaatccgaaaaaggaggctgtgaagtcactgctgcttccgttgatgcggataatgcttcccgggagcagtaccacctgagtgtttttgacgatttcgtactctttcagatcgatggtgacgtgtgcccatccactgcggcagaaatagatggcacccccttccattttccagaggtgatgcatgataggtgacaaattctcatcgcttccggcaacgaatgattcccggagaacggcaagggtagagtttctctgtatcataactattcttatttagtgggcaaaaataggactttttcactaaatatcgctcatattgttccgaaaatgaacaaaactctaaacactatgaccagttttctatggtgaaaagagtctacctttgccgcgatcaaaaattttaataggtaacacaatgagtaaaaaggtatgtaaaatgaagcaagggctattattgctcggctgtctggttgctgctgcaggttgtaagcaagctccacccacacaaatggaaacaggatatgaagttatgaccgtctctccgaccgaccggatgatttcgagtgcctattcggcgactatccgcggacgtcaggacatcgatatttatccacaggtaggcggtacgctgacaaaagtcagtgtcaccgaaggacagcgggtgaagagcggacagacgctgttcatcatcgaccaagtgccgtatgaggcagccctgcagacggcagtggcgaatgtagagtcagccaaagcgtctctggcgacggcacagctgacttacgacagcaaagaggaactgtataaggagaatgtagtttccgctttcgatctgagtacggcaaaaaattctcttctggctgccaaagcgcaactggcgcaggccaaggcacaagaagtgagcgcccgtaataacctttcttatacggtagtgaagagtccggcagacggagtggtaggtacattgccttatcgcgtaggtgcgttggtaagttccagtatccccgaaccgctgaccaccgtttccgacaattcggatatgtacgtttacttctcgatgacggaaaaccagttgctgggattgattcgccagtatggctctaaagacgaggcgctgaaaagtatgcccgccatcgatttgcagctgaacgataaatcggcttatcccgaacagggacagatcgagtctatcagcggagtcattgaccgttcgacgggtactgtcagcctgcgtgccgttttccctaataaggacggattgctgcacagcggcggtgcgggtaacgtagtgattccggtacagaaaacgggagctttggtgatcccgcagggagctactttcgaaatacaggataagagatatgtatataaggtagtagacggcaaagcgtagtccagtcaggtgcaggtgacccgtgtgaacggcggccgcgaatttatcgtggatgaaggactgtctccgggcgatgtgattgtggcggaaggcgtaggattgcttcgtgaaggtactccgattaaggcaaagactgcccaggcatctacgacaactactgaaaattaaacaaaggaggaatcatccatgaatttaagaacctttattgaacgccccgtattatcggcagtcatctctattacgattgtcgttgtgggtatcatcgggctgttcagtctgcccgtcgaacaatatcccgatattgctccgccaaccattatggtgagtaccacctattatggcgccagtgcggaaactttgcagaagagtgtgattgctcctttggaagaagcgatcaatggtgtggaagacatgacttacatgacttctaccgccaccaatgccggtacagtgagtatcaccgtgtacttcaagcagggaacagacccggacatggcagcggtcaacgtacagaaccgcgtgtcgagagcgacgggacagcttccggcagaagtaacgcaggtcggtgtgacaacttccaaacgtcagacgagtatcctgcagatgttctcgctctccagtccggacgatagctacgatgaaaacttcctctccaactatatcagtatcaatatcaaaccgcagattcttcgtatctcgggggtaggtgacctgatgattatgggaggtgaatatagtatgcgtgtatggatgaagccggacgtgatggctcagtacaaactgattccgtcggacatcaccggtgtgctagccgagcagaatatcgaatcggctaccggttcatttggtgaaaactcgaacgaaacctatcagtatacaatgaaatataaaggacgtctgatcactccggaagaatttggagatattgtcattcgttctacggacaatggtgaggtcctgaagttgaaagacatcgccgaggtacagttgggacaggatagctatgcttatcacggtggaatggacggtcatccgggcgtttcgtgtatggtgttccagacggcaggctccaatgcgaccgaagtcaatcagaatattgatgaactacttgaagaagtccgcaaagaccttccgaaaggagtggaactgacgcagatcatgagttcgaacgacttcctgttcgcttctatccatgaggtggtgaagacgttgatcgaggcgattatcttggttatccttgtagtatatgtgttcttgcaggacttccgttctacgctgattcctttggtgggagtcattgtttcgctcatcggtacgtttgctttcatggcgctggcaggattcagtatcaatctgctcacgctgtttgcgctcgtgctcgtcatcggtacggtggtggacgacgccattattgtcgtcgaggcggtgcaggcacgcttcgacgtggggtacaggtcgtcctatatggcaagtatcgatgcaatgaaaggtatcagtaatgctgttatcacctcttcgctggtgtttatggcagtatttattccggtatccttcatgggcggtacttccggtacgttctatacccagtttggtctgacgatggcggttgccgttggtatttccgctattaatgcgttgacgctgagtccggcattgtgtgcgttgctgctgaagccctatatcaatgaagacggtacgcagaagaataactttgcggcaagtttccgtaaagcattcaattcggctttcgatattctgatagagaaatacaagaatgtggtgctgatctttatcaaacgcagatggctggcatggtcgctgctcgtttgctccgtagtgttgcttgtattcctgatgaacacgacgaagaccagtctggtgccggacgaagaccagggtgtggtattcgtcaatgtaagtacggcggccggtagttcgctgactacgaccgacgaagtgatggaacgcatcgaaaagcgtctgatggatattccgcagattaagcacgtgcagaaagtggccggctacggattgctggcaggacagggaagctcgttcggtatgttgattctgaagctgaaaccgtgggacgaacgtccgaatgacgaggataatgtacaggcagtcatcggtcaggtgtacggtcgtacggccgatatcaaggatgccagtgtcttcgctatttcgccgggtatgattccgggttacggtatgggtaatgcgctggaactccatatgcaggataagatgggcggtgatatcaacgaattctttaccactacccagcaatatttgggggtattgaaccagcgtccggaaattgcgatggcatattctacgttcgatgtgcgctatccgcagtggacggtagaggtggatgcagccaagtgtaaacgcgcaggcattacaccggatgcggtactgagtacactgtccggttattatggcggtcagtacgtgtccaacttcaaccgtttctccaaagtatacagagtcatgattcaggcagacccgcaattccgtctggacgaaacctcactggacaatgctttcgtacgtatgtcgaacggagagatggctccgctgagccagttcgtaacgttgacacgcagctacggtgcagagtcgctgagccgtttcaatatgtacaattccatcgccgtgaatgcgatgccggcagacggatatagtacgggagacgctatcaaggccgtacaggaaacagccgtacagtctcttcccaagggatatggctatgattacggaggcatcacccgtgaggaaaatcagcaaagcggtacgactatgatcatctttggtatctgcttcctgatgatttatctgattctgagtgcattgtacgagagctttatcattccgttcgccgtgcttctgagtgtgccttgcggattgatgggaagtttcctcttcgcatggatgttcggactggagaataacatttacttgcagacaggtttgattatgttgatcggtctgttggcaaagacggccatcctgttgaccgaatacgctgccgaacgccgtaaggcaggcatgggactgatcgcttccgcggtaagtgcagccaaagcccgtttgcgtccgattctgatgacagcgttgacgatgatcttcggtctgttcccattgatgttgtccagcggtgtaggagccaatggtaaccgttcgctgggtacgggtgtagtcggtggtatgacgatcggtacgctggcattacttttcatcgtgcctactttgtttatcgctttccagtggttgcaggaacgcttacgccctgtgcagagcagacctacggaagactggcagatcgaggaagaaatcaaggtgagtgaagaagaaaaatctaaagcaggaaaaaaataattgatgatgaagaaaatattaatcttatccgcagcaacgctcgtgttgagtagttgcggtatctacaataaatacaaacctgtatcggaagtccccgaaggactttatggaagcgagaccgtcgcttccgccgatacggcgaacttcggtaatctctcgtggagagaggtctttactgactcgtatttgcagaatttgatcgattcggctttggtacggaatacggatatgcagacagcgcatctccgtgtgaaagaagcggaggcttcgttgctgacgtccaagctttcttatctgccctctttgtttctcgcaccggaaggagctgtgagcagcttcgaccgtggcaaagcgacacagacctactcattgccggtgactgcctcgtgggaactggatatcttcggaaaggtgaccacggccaaacgtcgggcaaaagcggcctatgagcagagcaaggagtatgaacaggcggtgaagacgcaattggtgtctgccgtggcgaatacttattataccttgctgatgctcgacgctcaatatgagatttccgtgtccaccgaagcggcatggaaagagagcgtgcggacagcccgtgccatgaagaaggccggtatgatgaccgaagccggactggctcagacggaagctacctattataatatatgtacgacagtgctcgacctgaaagaacaaatcaatcagaccgagaactcaatggctttgttgctggcggaaacacctcacaagatgcaacgcggcaaactggaaaaccagcagttgccggaagacttctccgtagggattcctttgcagatgctttccaaccgtccggatgtacgtagcgcggagttctctttagcgcaggcgttctatacgacgaatgctgcccgtgccgctttctatccttccatcacgctgagcgggagtgccggatggacaaacagtgccggtagcatgattatcaatccgggcaagtttgttgcttctgccgtagcttcactgacgcaacctttatttaacaagggagtgaatatcgcccagctgaaaatagcgaaggcacagcaggaagaagcccgcctcagctttgaacagacattgctgaacgcaggtgtggaagtaaacgaggcactggtgcaatatcagacggcccgtgagaaatccgctttctacgataagcagatcacctctttgcagactgctgccagaagcactagtcttttgatggaacatagtaataatactacttatctggaagtactgaccgcacagcagacattgctgaacgccagactttcacaggtagccaatcgctttaccgaaatccagggcgtgattacactgtatcaggctttgggcggaggccggatgtaggaggatagtatgaatcctgaaaaagtacggtgtcagataatcgaatacaccaaacacgagatgtatctgcacggtgctgacggactgaccatggatgacatagccaaggggatgaagatgtcgaagcgtacgctttacaagctgttccccagtaagacttgtctgttccgcatctgtctttatgatttcaccaacgggatcagaagtcgtctgaaacaaagtcagatgcggatggacagttcgtgtatgcaggtgctttttgccacagtgaacgggtatctcacgctattgcattcgttaggaaagactttattgctggatatcgccgcgaatgaagattaccgtgcttccttcaaacgggaagaggccttctggttgcagcagtttatcgacgtactgacgcattgcaaaatctgtggttacctgcttccgggagtcgatccggatcgctttgcggcagatttgcaggaggttatttatcagagttgcctgcaaggtactccgtatgttgttcagcggacgctgaaccatactctcttacgagggctttttgaggtggacggcattcggtatattgacgaacacctgaaactggataaattcaatgtttgtgtatgaaaggaagggcgtgtattgctttttaagcaggcacgcctttttatttgtttgaaatgagttattctctgaaattcacaatcatgtgatatattaagttgctttttaaatcttgtcaattaaatccggagataagcagaaaggcagttaactgttggcaggttagtataaacgcttttattctcaccacaatgagaacattttctcatcgcattgagaaataattctcaaaggcacgagaactttttctcactgtggtgagaattttttctcaaaggcatgagaatactttgagaatatagcaacttgtatcatgctatgtattaatcggatagcagtatagtggtatctgtcttatgcctactattttatggctgcctcaaacgctcaatctctaataatgtagtttcccgcttgtttggtaaaagcggctgggctattctttgtctccatatgaaaacttgacaaatgatcaatctaaagccctttcaccacatcgacagacaaacccgtgcattctgctatcacatcatccgctatacctttctgcttgaaattacgggctatctctatggtttggttgtgctctttgagtgcggagaacaccagaccggaaagatattcaagtgtactgtacaagcgttcccgattttccttccgctgataatccacactaaaaaatgtggaacgcttacggtgtaatatcaggtaatatgtcccggcagtaagaagtcccgctattatatcaattgggatacccgttccttcaaacaaatgcttgtattcttctatagccaatttgtaatgcttttccctgcttcgtgccatacgtcttgtggtcgaattgtccgcttcgagttcccacactagcaagtgctgcatatcggtattgtcatataagtaatttgccaaagcctttaaggtgcttttcatgatgtcctcgttggctttgtctgtagggtgttcttcatcgaaaagatcgtgcagccaataatcagaaatgtaagcgtacttatccagcaatcgctcaatattcttatagttattgagcaggacggacatttgtatgtcggctctttgcataatatctgtaaaggtaatttgcgccagacctttttcacttgctaactgccggatggcatcaaacacgtccgcttccagttcggcgcgggtacggcgtgcacgtttattcttcgattgttccatgtttatttctttgttgcatacaaatgtatgaaaaataagtataagtcacttattttcctttataaaacagatttatgaaacggctcggtcactgaacaaatttatttctatctttgtcttcttagtatttagagaatagaaaaacaaagaacactggagaaagcagagtgggtaagggaacggctttctccatgaacgtatctttgagtattatttaaatcagtagaaaatggggaatttaatttcgtttatgaaggaagtagccgatgggctgcgggaaagtgggaattatgggaccgcccatatttacaggagtagcatgagtgcaatccttgcctttcatggaagtgataagcttcctttccggaaagtaagtcaggagtttcttaaaagtttcgaatcgtatctgcgtggcagaaattgtagctggaatacagtttccacttatatgcgtacgttgcgtgcagtgtataaccgtgcggtcgaccgccatcttgcgccttatgtgcctcatcacttccggtatgtttatacaggaacgcgcgcggacaggaaacgtgcgctggataaggaagacatggagcgtctgatgaaggaacttccgaaacagctgtgtcaggacaacaaggaactacagcgtactcgtggtcttttctttttaatgtttttacttcgtgggattccttttgtggatcttgcctatctgaaaaagcatgatatcgatgggaatgtaatgacttaccgccgtcgaaaaaccggcaggttattaacagtgactcttgtgcctgaagccatgaagctgatcaaacggtatatgaataccgatcctgcttctccctatcttttttcgctgatcaccagtggagagggaacggaagctgcttacaaggaatatcagctggcattgcgcaactttaattatcagttaatgattttgaaacaggttttgggactgacatctgaagtaagctcgtacacggcgaaacatcatacaatctctatctaattgaaaattaaacagttatttctgtttaattaatatcaggtaacgatttagaaacgagcgaattacaatattctgttttcttttgcctctgtcaaagaacgattctttcaatgcaaatatacactttacttgtgacaaaagcaatctttttctacatttaatcgacttacagtcagccttaaagagggtatctggtctcattccatcttcttcctcaaaaataacatagcagtctaaattggtttatgtatgggataggtcttgttcattcgatccggtagactactatacataaaagtataaaggcgagatacgacaaggagatgccatgcttttgtgtaaggggaatctctcttagcttatcgcagaccatgtatagctaagtgttttgagaataaacagtctgtaaaaaacggaaagacaccgattatgggccgtatcaccatcaatggaacccaagccggtttcagttgtaagaaagaagtgtccctcgctttgtgggacgtcaaaaccaaccgggccaaaggcaagtccgaggaggcccgtacactcaatcaggagcttgacaatatcaaggcgcaaatcaccaggcactactagtacatctgcgaccacgacagttttgttacagccaagaaagtctataaccgctatgtcggcttctcagaggaatgccacacccttatgaaccttttcagggaacagctggaaccgtataaaaagaaaatcggcatagagaaagccgaaagcacctactgcggtctggttgccgattacaagagtctcctgcttttcatgaaaagcaagaagaatgcagaggatattgtcatcgaagaacttgagaaatcattcatcgaggattactacaactggatgctcggtacatgcgctttggcaaactccactgtcttcgggcgtgtcaataccttgaagtggctgatgtatatcgcgcaggaaaaaggctggatacgggttcatccgttcgcatcattcgagtgtatgcccgaatacaagaggcgttctttcctttccgaagaggaactgcaaaggataatccatatagaaccgagatacaaacgccagcgtgccatgcgcgacatgttcctgttcatgtgcttcaccggtctttcctatgtggacttgaaagccataacatacgataatatccataccgactccgacggcggtacatggctgatgggcaaccgtataaaaacgggagtggcgtatgtcgtaaaattattgcccattgctatcgaactgattgaaaaatataggggtacggatgaaaagaaagactccccgaatgtgtctttccggtaggtgaatacaatgccatgcggctcagtcttggaatcataggcaggaaatgcaactccggggcgaggtcaccccgcacatcggacgccacgcatttgccgttctggccatactcaaggggatgctgctggaaactcttcagaaagtgtttgggcataagtccatcacatacgtcctgcgcatccattcacttgtccggcgcaggcggggcaatctttttctggaagtcgcccatctgtacgaccagcgtgctgaccagctttctcaactcctaatacgcgcttgtttcaataattgtcagttccatactaaaattctttttaagattctgaatatgcgacaaagtaacgcacatcctatatcctttccaaacagataatatcagagtcttccgttggcgtgcattggcgtatccaacgttaaaagagaaggtccttcacctgcatccatgcggcaacggaacttccattcccttacttgttttccataaatttataggattaatttctggtgcatgatattaatagtcattattctgtctgctttttttgcttgcataattgcagctaacagttatctattccagaacgcattgttatggaaaatggcaagctgttttgttggtttatggatattgtgtatgataattaccgtcttcgtttgtcgtaaacttgaatgctctaattaaaacagtacggttgtcatgctttgtgtgttttattataaatattatgaattatttggaattgatatgtaatatagataattttgcagtcgggaaatggtttcgggaggtttacgccttccgaatgaaaagggaacccggtgaaaatccgggacagtacccgctgctgtgagtccacaaaaacggacatcgaacttttgccactggtgtaataccgggaaggcacgatgaccgggacgagtcagaagacctgccatgaccggaatgagatttacacctgcgggatatacgggtcgtaatcaaataaggaatagctcatcggccattcaatatttgaagacagacatattcccgttcgtgtaagtccgcacgaacgggaattttttgtgtttgttaataatatgttttacattaaaatgagtgacctatgaaaagaaaattacgctttctggcaggtgcctgtctatttaccgcaaccgccttgttctctggctgtagctcggacgatgactttttgatggacccggttgattccggaacttcgcaaacccgtgctgtgacaaatccggacggtactttaactatcactttcgatgatttcgatcccggcatgttagcaggacctacctcggccggagaaaatctttattcgtaccaagggtatcctcaagtaaccaccatttacgacaatactccggaagaatatctcttcctttcaatgtttaatactgtaggtggaagcacagagtattccagcggcggcatcgcactttccaactggaacatccgctccaatcagtcgggaaataccggagactggtggtattcttatctaaaccaatgttctgtctataacactgcggtggaagcggaaggacagaataaggaagccgggcacagcggttccaatttcggtgtcgtttacggatatgtggatgcttacaatcaggcatggatggctaaaccagaattttatttcaatgttccccggaaattggtcggcctgtggatctgcaacacctcatacacttatggtgtcattacttatggtaatcagttcggttctacgggggtagcgactcctctgaaagagatgaaagggtatttccaagtgaatctggaatgttatgatgtgaatggcggtctgatccgcacttacaaacgtcttttagccgattatcgtaacggccaacaacaggttgatcctatcacgacatgggattattgggaaatcaatgccgaaggggtgcaaagtgtgaaattcaacttcgagggttcggattcgggagcatacggtttgaatactccggcttatatctgtattgatgatatcaccatacaataaaaagaatacaaggatatcccttctgtcgggggtatccctgttatttttctaaaatccacacatcatgcatcgttttcactattttattatttctgcctgtatgctgttcacctcctgcaacaaggatgaagtcattaccgaagaagtaggaggacaacctataatagaacttgacagcgagaccggtatttacactgtcaaggtcgatcacgaattgactatcgccccgacataccagaatgttgaagatgctctttttgcttggacgatagacggtacgctggtttcttcgggtccgtctcttcaacgtacatggaatgaatgcggggatttttatgtcaaactaagagtagacaatgcggaaggttatgccgaagaggaactgaaagtagaagtgaaagaactcacccctccggtcatctcactggcactaccttcgcaggggctaaaagtcgtccggaataccgattacacatttactcccgatattcagcattcggatgtcgaagggttcaaaatcgaatgggtacgggaaggaaaaatcgtttccaccgagaatacttatactttcaatgaaaaagaactcggtgtttatacggtgacaatcaacgcttccaatatagatgggacaacaacgaaagacgtaagcgtagaggtcgtggaaacgatgccctacgttgtcaaattcccgaccccgtcttacctgcaaacatccacggacaggtacacttttgccgaccgtcctgttttcctgcgtccgttgttggagtatttcgacaatccccgttttgagtggagtgtggacggtcaggtcatggaaggagaagtggaacgcatgttcaagttcacgccgtccgcacccggagaatacaccgtctcctgtactgtgtcggaagacacaccgacggaaaaaataagcaggaatatcgacaaagggaaaacggctgtcactgccaccgtaaaagtcgtttgtgtggacaaaaaggaacaagacggcttccgggcttcgggaagttccaagctctggaataaagtctatgaatataccccagctcccggccaatttatcaacgagacgagcacgataggcggtatgaccggcaacgaaacatcccctgaagcggctgtcgcatgggcaacacagcgtttgaaagacaaactgcacgtctctttaggttctttcgggggttatatcatcgtcggcttcgaccacagtattcccaattcgggtaaccaatatgatttctgtgttcaggggaacgcctttgacggcagttccgaaccgggtatcgtatgggtcatgcaagatataaacggaaacggattgccggatgacgagtggtacgaactgaaaggatctgaagcaggcaaggaagaaacaatacagaattttgaagtgacctattaccgtccggaaggcaaaaaaatggatgtccaatggatcagttccgacggtagaaacggctgggtagactatctgtccgcttatcatacacaagactattattatccggcttggatttcggaaaacagttataccctgacaggcacttgtctggccgcccgcaacacccaagattctcaaaccggttattgggataatcagagttatgactgggggtacgtggataatttcggaaacgaccagatagaaggcggcagtacggtggatggaagcggacaaaggaacggtttcaaaatttccaatgccatccatgccgatggaacggaagccaatctgcaatatattgactttatcaaaatacaatgcggtgttctggccaaaagcggctggctgggcgaagtttctacggaggtattttcttttgaggatctaaccaaataataaaaattacaagtatgaaaatttattttcttcccatgctcctatccttgttctttttgggagcgtgtgacaaaaacgatgaaattatacctgaagatgcagatgaaaatttcatcacatcggtcgtgatgaccgtggacgggaaatcgtacacggccgacattacggacaatacagtaacaataaccgttccctatacggtatcgctgaacaacgccgaagtggaattcaagtacacaacttctgcaacaatcatacctgatcctgaaacggtaacggactgggataacgaacgaaccttccgggtgacatcctataacggagatgcccgcgaatatacctataaggtcgtgaaaagcgagatagaatctgacggagatgtggagttgaagaccaccgaggaggtagcttcttttgccgcaaccaaaacaaccgttgtcaaagggaacctgattatcggctctgatgcggaagaggcagaaaaaatcactgacatatctgcattggcatctttgaaagaggttactggcaacattgtcattcgtaacagttacaacggtgcagacttgacagggttggataatatcgtttctgccggaggtttacaggtaggttcgaccgatgtcgcctcgaaagctacggaacttcacatgatttccatgaaagcattggaaacgctctccggagacatatcggtatataacgaccaagtgacgtatgtcctattcgagaaactggcaactattgaaggaagcgtgatgttcaatgcgtcgtcgttacagagttttgagtttccggttctgactactgtaggtcaggatctgaatcttcaaggactcaatgaagagaacacagcagccggttcgattgcgtctttggaaataccggaactgacaagtgtcggaggggtcttgtccgtaaacaatcttgccaagctgacttccatgagcttccttaagctgaaagagaccggtggccttgatttccataccgtccccgtgatgttggaaaccatcaaccttccggaaatcgaaacagtaaacggaagtattattatggaagccaatatggaagctcctcctaccggtagttttgttccccaacgaaatgacgtgcttcaggctttcggtggaatggacaaactgacaacgataaagggacagataaagataaagaatttcacggcactcaaacaacttcccgactggagcaagatcaccacacttggaagcatcacgctggattatcttgaagatgtgagcggaacactgctgttgccgaacgcccgatttgaaaccttcggagaaacagcgccccagattgaaattataaacaaggtgcagctctccaaaattgaaacagccgaagatttgtcaaatgtaaattttgtcatcaccagtctcacgaataataagttccctgaaatcacgttcaagaatatcaaagacttcacttgtaagccaaccaccaacaataccgattataccatatcgacaattcaacatgtatatggaaatctaaatgtgacaggccaaatgcgaagcaatgccaaatttcccgacttggaaatcatagatggatatggatatatccaaatacccatgtttgcttcaatcacaatgccagtcttgaaagaagtgggaggacagttctatttatctggaaattttaccagttgtaacttgcccttactatccaaagtttgttgttcagcttctcctgtatattataaagagggagagggttcgttagcaatatctttacaaagtaaatcgctggatattccggaattgcttcacgtaggaggtgaagggttgttcgttaataaagcaacaggcattacttgtgataaattacagactatagatggtacgctacagataaaaagtgcgacttctctttctcaggaaacactttccatggagaagttggagaccttgcatggggttgtttttgacggtttgacgaaatttaccgactacactttcttcggcaagtttatagaaaacggaatgattacgggggaaagttggagcgtgacgaaatgtgggtataacccaaccttccaaaatatgaaggacaaacaatatacgcagcaggattaaaccttataccttaaccagagtacccgtaatgattcgggtactcttttttatccgaatgacaatgagcagaacaatacaacggatttgcctttttcttttctgcctgccagttttcggcagttgcatgaaatgggattacggagagatggaagatttctctgtatcggcctctggtcttttcattaccaacgaggggaatttccagtacagcaatgccacgctttcctactacgatcccgccacgtgcgaagtggagaatgaagtgttttaccgtgccaacgggttcaagttgggcgatgtggcccagtctatggttatccgggacggtataggctggatcgtggtgaacaactcgcatgtgattttcgccatcgacatcaatactttcaaggaagtgggccgtatcacaggtttcacctcaccccggtatatccattttctgtcggatgagaaagcctatgtgacgcagatatgggactaccgtatcttcatcatcaaccccaagacatacgagattaccggctatatcgaatgtccagacatggacatggaatcgggttccaccgaacaaatggtacaatacggcaagtacgtctatgtgaactgctggtcgtaccagaaccgcatcctgaaaatcgacacggagacggacaaggtcgtggacgaactgaccatcggcatacaacctacttcgctggtcatggacaaatacaacaagatgtggaccatcacggatggcggttacgagggcagcccatacggttacgaggcaccgtctctctatcgtatagacgccgagactttcaccgtagagaaacagttcaagtttaagctgggcgactggccttcggaagtccagctcaacggtacacgggatacactttactggatcaacaacgatatttggcgaatgccggtggaagccgaccgtgttcccgtccggccttttctggagtttcgggacaccaaatactacggccttacggtcaatcccaacaacggggaggtatatgtggccgacgctattgattaccagcaacaaggtatcgtgtatcgctattcgccgcaaggcaagctgatcgatgaattttacgtgggaatcattccgggagctttctgctggaaataacgaggaaggaggacaaaaatgaaaagacatcttattctattgttcgtgggggtaagcctgccctttctgcttgccgcccagcagaaaaattccgtcagcattaccaaaagggtactacgtattccggaggttacggtggtgggcaaacgacctatgaaggatataggcgtgcaacgaacccgtttcgattccatcgccatgaaagagaacatcgccttgtctatggccgatgtgctgacattcaactcatccgtttttgtcaagaactacggacgcgccacgttatccaccgtggctttccggggtacctctccctcgcatacccaagtgacgtggaatggtatgcgcattaacaacccgatgctgggcatgacggatttttccaccatcccttcttactttatcgatgatgcctcgctgctgcacggaacgtcatcggtaaacgaaacgggcggcggcttgggtggtctggtcaggctctccacttctccggccaaccatgaagggttcgggttgcagtacgtgcagggagtggggtcgttcagcacgttcgacgagtttctccgcctgacctacggtgacaaacactggcagtcctccacccgtgtggtgtattcctcttcccccaacgactacaaataccgaaaccgggacaagaaggaaaacatctatgacgaggacaagaacatcatcggttcctattacccgacggaacgcaaccgcagcggggcttataaggatctgcacgtcttgcaggaaatttattataacacgggcgaaggcgacaagttcgggctaaacgcctggtatatcaattccaaccgggaactggcgatgctcagcacggattacgggaacgacatggacttcgagaaccgccaaagggagcagacgtttcgcggcgtcctctcgtgggatcgcgtgcgggagaaatggaaggtcggtgtaaaaggcggctatatacacacatggatggcctatgattacaagcgggacaagggaaacggcgaaatggcttcgatgacccgctcacgcagtaagattaacacgttctacggaagtgcggacggggattatgctccttcagagaaatggctgttcacggccggtgtttccgtacaccagcatttggtggaaagcgcggacaaaaatatcatctcgcaggaaggtaacaaggctgttgtcgggtatgacaagggacgtgtcgagttttccggttccgtttctgcgaaatggcggcctgtcgatcgttttgccgcctcgcttgtccttcgcgaggatatgttcggtacggaatgggccccggttatcccggctttcttcatcgacggggtactgtcgaaaaaaggcaatatcgtggcgaaagcatccatctcccggaactaccgttttcccacgctgaacgacctctattttctgccgggcggtaatcccgacctgaaaagcgagcacggcttcacatacgacgtggggttgtcgttctcggtggggaaagaaaatgtatatgctttgagcggtggtatcaactggttcgattcgcacatcgacgactggatcatctggctacccacaaccaagggattcttctcccccagaaacctcaaaaaggtacatgcttacggggcagagaccaacgcccaccttgatataatgctcggaaaggactggaaactggatatgaacggaactttctcgtggactccctcgatcaacgagagcgaaccgatgagtccggcagaccaatccgtcggcaaacagttgccatacgtgccggagttttccgcaacggtgaccggacgtctgtcatggcggacatggagcctgctttacaaatggtgttattacagccagcgttataccatgtcgagtaatgactataccctgacgggctatctgcccccttacttcatgaataacgtgacactggaaaaacagctctctttccgatgggccgatctgtcgctaaagggcagcatcaacaacctgttcgatgaagaatacctttccgtattgtcccgtcccatgccgggcatcaatttcgagatattcatcggcataacacccaagttcggaaaaaacaaaaatagtaaacgataatctgcatcaatatgaacgcattaaagaatttaagcctgattttgttgctttctctggcatttacaggctgccacaacaaaagctcaaaaatcaatgatttcaacctgctgctttatgctcccgaatatgcctccggcttcgacatcaaaggggcgggcgggaaggaaagcgtactgataaccgtcaggaatccctggcagggagcggacagtgtaaccacatggctgtttatcgtccgcaacggtgaagaggttcccgaagggtttgcaggacaggtactcaaaggagacgccaaacgcatcgtggcgatgtcttccactcatatcgccatgcttgacgcaatcggtgaagtccggtgtataaccggcgtttcgggaatcgactacatttccaacccagacatccaagcccgccgcgacagtattggcgatgtcggctatgaagggaacatcaactacgagttgctgctctcgctcgatcccgacctcgttctgctctatggggtgaacggcgcaagcgcaatggaaagcaaactcgaagaactcgacataccgttcatgtatgtcggcgattatcttgaagagtcgcctctcggcaaggccgaatggatggtagtgctttcagaagtcacaggaaaacgtgagaagggtgaaaaagcctttgccgcaatcccggtcagatacaacgccttgaaaaagaaagtggccgacagtaccctcggcactccttcggttatgcttaatgttccctatggcgactcgtggttcatgccttcaacccaaagttatgtagcccgcttgattactgatgcgggaggccgctatatctaccagaagaacacgggaaacgcttctatccccattgacttagaagaagcatatctgctcgcgtcggatgcggacatgtggctgaacgtgggaatggcgaactcccttgacgacttgaaggcatcatgtccgaaattcaccgatacccgatgtttcaaaaatggagaggtgtataacaacaacgcccgtaccaacacagccgggggtaacgactattacgagtctgccgtcgtgaatcctgacatcgtgctccgcgacctcgtgaagatattccatcctgaactggtgcaggaagagtgtgtgtattacaagcaactgaaatagatgcgttcccgttcgactatattattctccatattgattacgctcacggtcggtctttttttactggacttggccgtgggagctgtcaacattccgatccgcgatgtatgggcagcactgaccgggggaaattgttcccgtgccacggaaaaaatcgtactcaacatacgcctcataaaagctatagtggcactgttggccggggctgccttatcggtcagcggtcttcagatgcagaccctcttccgtaatcctcttgccggtccctatgtccttggcatcagttccggtgcaagtctcggtgtggcacttgtggtacttgccgggatcggttcatcaataggcattgccggagcagcgtgggtgggtgcggctgtcgtgttgctcgtgataactgccgtcggacagcgaataaaagacatcatggtaatcctgattctgggcatgatgttctcatcgggcgtaggtgctgtcgtgcagatattgcagtacctcagcaaagaggaatcgctgaaagcctttgtcatttggacgatgggggctttgggtgacgtcacctccggacaacttctgattcttgttccatcggtgtttgccggactgctgttggcggtactgaccatcaaaccgcttaacctcctgctgttcggagaggaatatgccgtaacaatgggactgaatattcggcgttcacgcagcctgttgtttctctcgacaacgctgctcgccggaacgataaccgctttttgcggtccgataggtttcataggtctcgctatgcctcatgtcacaagaatgcttttccaaaatagcgatcatcatgtccttctgcccggaacaattctttcgggagcatcgatattgcttctttgcgacatcatttctaaaatattcaccttgccgatcaacgccattacagctctattgggaatcccaatcgtcgtatgggtggttttacgcaacaaatccatcaccgcatgatagaattacagcatttttccataggttacaaagaaaactcgttgctccacgaggtaaatgccacgataaaaaaaggtcaactgacagcccttatcggaagaaacgggacaggaaaatcgacgttgctccgcgccatagccggtctgaaccggtgttattccggaaaaatcattctcgacgggcacgacatcgcctgcatgaaaaccgaagatatggcaaaaacgctggctgtcgtcacgaccgagcgcacgcgcatcgccaacctgcggtgcaaggatgtcgtagccataggccgtgctccttataccaactggataggtaggatgcaagaaacagataaggagatagtcatgcaatcgctcatttcggtgggaatggaggcttatgcaaaccgcacgatggataaaatgtcggatggcgaatgccagcgtgtgatgattgctcgtgcattggcacaggatactcctatcattctccttgatgaaccgacttcctttcttgacatgcctaatcgctacgaacttgtggcgttgcttcgtaggcttgtccacgacgagaaaaaatgtatcatgttctcgacacatgaacttgacatcgcgttgtccatgtgcgattcgatagcattgttagataccccgaatttaagttgcttgaccgcgtctgaaatgcagaaaagcggatacattgacagacttttccaaaatgaaaacatccgtttcgactccttatgcggtacaatgattttgaaacaatgagtatatacactgtagaaaattttacttcagacatcactgttgaaggatacatcgccgaatttcgtgacgaactacattttcttgaactttgcaaacaatgtaccaattacggtaaaagttgggggtgtcctccatttgattttgatacggaatcgtttctccgacaatacaagtatgcacatcttatggcaacgaagataatccctgaagacaaagatattccgattgaatatacacaaaaactcattttaccggaacggatacgaatcgagagcgaattattggatatggaacggaaatatggagggcgttcatttgcctatataggtaaatgtcttcactgctcagataacgagtgtacgcgtaactgcggcacaccatgccgacacccggaaaaagtgcgtccgtcactcgaagccttcggatttgacatagccaaaacgctttctgaactttttaacatcgaacttctttggggaaaggatggcaaattacctgaatatcttgttctcgtaagcggattttttcataatgaatacgaactttgcaacatagcatactaatgattcggacatgaaataaacagacaaactaaccacattcggttcaatctgttttgtgatttcaaatgaattatagttagatatgtaaaaagcgacgctggagcttgaaataagtaacggtttatcggtgtattctccgttaaaccgtcctgttttcgttaaacgaaaacacaacttgctgtccgcaggagcggaccacatttatccaataattattgtgtattggcccattgtatggctattctcctgtgatttacgaggcatttccatcaggtgtttgccggctgctctccccataaaagggtggatatctctccataatcatatgacttacgtccataattcgggaataaggaggcgaatatacgggaaatctgccctttacatgccctattgtccattaatggattgttacttctacacatctacaaatggagagcggcagtgagccgtatatggtttatggtttttctgcattatcttcattaatggattactacttctacacttctgcaaatggagaatgtagccgtgtacaccttatggtcttccttcataattctccattaacggattaatacttttacactcccatagaccgataatttaagaatccgtatccggacggatgcgcgctctcacgcctgcccataaggattaaaaaggaacggtggacaaggaaacggaatcccgctcgcttttccacaccactacgggcctctgatgtcgcctccgcataggaagaaccgtccgaacggaacggcatctccgtcccccccgtcatgtgtatcatgacaataactgactttggatgactataagtgacaggtggtttcatcctgttctcttcttcctttattttgtattccgagacaataccagttgtgtaatttaataatttaagattttaaaatatggattcagaaaaggaaaagaaccggctttccgatatcgttctcgagagggtcggactcacggggaaccttctgtcagctcccgtttccccatccctggaaccagtggtggagataccaagtcatggaagtcaggtccgggcagggaaagtgacaggtccggaggaatacaagaggaggtttctggttcccgctcccagagccgctgagtggaagaccgcctacattgatgggagactgcaccgccggatcgccatgctggtcagggccgccggctgcggcagcatctccggttttatcatccggttgttggaactccatatggaggaacacagggaggacatcgcctccctgctcggtgaggtctaccgtccctgggatgaggacggacagccgggaggaacacctcgccgataaaacgttgtcattgtccaagaaggcatatcatgacaggaaagaacgtaaaagagcggattggtcttggcgggatggacgcggaccgcatccgtgagatcatgggggaagcgcctgcctgtccccggaagagacgtggaacgtccggtaacgacattatacgtcccgcaaggaaaaatggccccatgcaaccgtccgtctacggggaggaatacctgcatggcattgcgggcgtgcagcgtcggtcgctgcatattcccgccgccctgcaccggaaactgtccatcctggcgggagcctcgagaaacggaaaggtcactctggaggggttcatcaaccaccttgtctcgcggcatctggaagaatacagggaaacgacggacatgattctggaggagtccctgcccggccggtcataaaggctcgtcccccatgacaggggatctcccccgatgggagcattatttttgtttctgaaacaatagtgtttaacttttaatgaaaaagaagtatgatgaaaaaagaaaaagagttgttggttgccatcgccagccagaagggtggcgtgggaaaatccgtctttacggtactgctggccagtgtcctgcattaccgcaaagacgtgcgtgtggcggttgtggactgtgactccccgcagcacagcatcgccctgatgcgtgagagggacatggagaatgtcatgaaaaatgacgacctgaaggtgaacctgtaccggcagtacgaaagaatccgtaagcctgcctatccggtcatcaaaagcgacccggaaaagggggtggaagacctgcggcgttatatggacgaaaaaggggagactttcgatatcgtgctcttcgaccttcccggaacgctccgcagcgagggggtggttcataccgttgccgcgatggactatatctttgtcccgctcaaggcggacaatatcgtcatgcagagttccctgcagtttaccaaggtgctggaagaggagctgatcgccaaggggaactgcaacttgaaaggaatccggctgttctggaacatggtggatagaaggggacggaagaatttgtatgatgcctggaaccgggtcatccacaggatggggctgcggctgctgtcctcacacattccgaacaccctccgctacaacaaggaggcggaccctgtctgtaagggtgtctttcgttccacgctgtttccacccgatccccgtcaggagaaagactccggccttcctgaactggtggaagcggctttcttcggacgtgatccgggtatcaccctgttataaggattgtcctccagcatcttctcgatgtcggctctgcggatgaacgccatacggttgctgatacgcgaggcccgtagcctgccttgtgccacaagtttataaatgtactggcgtgagcatcccatgaggatggctgccttagaaaaggtaagatactcctgacgctgtatctctaaaactggctctacggcattgagcaagtcctgctgccgcttcttcttcgcttttttagcttcatcagcacaatgtacggtgcaatatttctgcataccgctgttgggcgtgaacattctgccgcaaaatgcacatttcttggttgttttcatttcccctttgtttgatgttgaacactcattcttgtatattccatcggggagtgaacggaagtgaaccgctgttgcctgttgtcaacggggtaaatatctgtggcaatcctcgcattatatcctgctgtttgttgccacttgtgaacccttgtaaaccgatgtcaacaggcttcgattttgtggcaataaaaaagtcccgtacattcaccgcgatagaaatacgtcacaaaaatatgcggaaaatggcggaacaacaaataaggtgtgctaagtgttaaattttatacagttttggtttccagtgatttaaatgcagacaatactcgttatttgcaggtatttacacctatctaaatacaaaagcagaaacagattatagatgattataaatatgaaattggtattgcaaaggaaagggggatagaacctaatatcaaaatagaagaatccggtattcaacaagagaatggccataaacaagttaatacaagaatcgattattcaaacaaacctcaagataagtataatattgaagcactctccaataaagaagtcataggaaccatttcatattatgactttaatggcaaagtatgtgaagttattgaatacaatactgttgagagctatttgaaaagtataaaagatgaattaaattctaatccaaacggctttaaatatgaaacattaaccacagatgccaacatcagaaaatcagtagatgacatagtttacggtgcttacggtgaagataacccacatcctttagaatggtactcctcgaataatacaaaagcagcgataagtccagaacaatatttatcagaagaacgtaataaaataatgcgtgaatatgctaaaaatccttttggagctctcaataaagaaaatatatcagccgagggtatggataaatgggcagccgttaccaataaatatatggaaatgaaaacaaacatatcaacaaagcaaatagaattgcaatcttccggttgtaaaactctgatctatgatgtatctcattcttccggccaagaagaaatcggcaattaccgcattctagataaatccaccggtaagacagaatctataaatgtgggggatattgacctggaaaagcagtctccggaaacactcaaaaagttgttatccggacaacaaacagaaatgaccaataagtccggcacaaacagtcttgtcactctgaataaaaccataacggggtggggaatatccgcagtaaaacaagtattcaactcagctgacaactctgccggcatttaaattattctggcaacaaaaacgaagatataaaatgaaagatcaaaaagaactactgaagaaatgtctggtaaacgatattccagccattgttttccagggaagcgacagctgtgctgtagaaattctgcaagcagcggaaaacatttataggaagaacggttgcagtccggagtttttgatagatttccatgaaaatgtagtggaaaatttcagagcataccaactggaaaactctatagcaaccaagctcccagatctgacaacaagtgaaaaagaagcgttctacattcttcaggagaaagaagaggcctatttccctattcatataaaagattttgaacaacacttaaaagattacggatttaccagaacctatgagaatacaacatcttatggcaagtatcttttattaaaggaaaaagactatataggtatcacaggaaataacggaaactatgattttgccattaattatagcaaagaaagcaatcagataagctacttcgttttttctgacgatccgaattatccggaacgaataggagactacaacagtctgaaaacatgcttttctgacataatgtccagacacccgttaaaagaagaaaagaacgaactatttacagtaatagaaaactaccatcaaatgggatacgatgatatatcccaagccctgacacaatatgcatcagccatagacaacttttgtaacaatgcccaatcaaaatacataattgaaggtgtttccatatgtaaaacagacagcaggcaactaaaaggaaatataacaattacccaaaaaggaaatataccggtcagtcagattacagatttccagataaaagtaaaacagaacctctaaacataggcagtattaatctggaaaagcagtctccggaaacaatcaagaaactgctgtccggccacaaagtcgaaatgaccaataagtccggcggaaatagtcttgtatctctgaataagacggtgacggggtgggggttatccattgcaaaacaaatcgccaactctacagattcgtcagcagaaatatagaataaaaaaagtttttctcccttttttccctatcagttcaaaaaaatgtgtaattttaaattttaaaagatatgaaaatggattacgatgaatgcagggccaaaatatcaatcatagacatagcagaggatctcggatatacacgtatatcgggcagacaagcaacgaacttgacctatgttcttggcacccccaaaaatccagaagacgaaatagtcatctttcctaaaaagaacacctatttctcaaggaaaggcagctttgacgataagggagagctgaccaagttcgtccttaaaagattgcatatgttctcttattgcactcagcagggatataggggagtcaatgaagttctttcaagatatatgactggcgaaagaattgtcaccggaaacgtacaaagccgtacaaaagaccacacccagaactacattaaggaattcaatttgaattattggaatcctcgtcctatcaaaaaggataatccatatttgaccgtccaaaggaagctctctccacagactgtggaggatttcgccaatagactgttcatctaccaggtaggaaaaaacaatcatatcggctttccattccgcaaaccctcccagatggaaatccttaactttgaaatgaggaactattttgcagagaccaataccaattataaagcctttgccacgggtggtgacaaggcacaaagctgttggatggccaattttgttccttttgacaaggttacagacatatatctctttgaatccgctattgacgcaatgagtttctacgaaataaaccattatactaaagaaaccacatgcgcattcataagcacgggggaatatgtcaccaaatcccaaatagagaatataagccgtatattcccatctgataaggtaaagtggaattgttgctatgacaatgatgccagcggtaatggttttgacatcaccacagcatattatctcaaaggtgaggaatgtaaagcttttgcaaggaccaacactggagacacatataagaccatctatttaagtttcccggatggaaacacacagaccttcaaagaagatgcattttcctccggcgagtatcttaaacaacatagtatagacaatgtaaatatcatcaaaccttcacggtacaaagattggaatgagcttcttgtctattacaaaagatttgatttgaacctgggtccaggaatgaaattcatcccggctatcgaaaagaccatatcccaactgaatctaagaggatatgaacaattggccaatagtatcagttcttccacaaaagaactggtggattctctgcttgagcaagccaattactgcatttccgcacctcttgccgagagcggcgcttatactcttatggtagactgtaatatcttcatggggctggacacgatggtaccggtaccaagcaacttatatgttatagaaaagtgcacgcaaaaaaagatatcggcacatgccataaatgaatttcttaaaaaagaatatataaacatttttagagacatgagttcatctgatttcaaaaattttctagagaaagacatcctaacttatacaaagggtgctgtagaaaagaattttgagaaagtgatattgactttcggatggagccttaaaccttcaattctaaaaaaaaagagttttgacttagaacatggtatatagcataacaatacagcatgataccataatagtagctgtttcaagcagacatgttgtcacaattcctgccaggtttaatggaatgattctcgggctttggaacttgatacagattttcgttgcctactgtaatgagaatccgaattgggtgagtaatgtccggtcactgtggggtgaccgattcaaatagggacaggtatggaacggatgcctattcatgcccctattatagctgacacatggacttttatacattcttgcactttttaagtgggtaaaaaagtactatttgtattttatacaaaaaattgtttgcttaatgaaatggaacatacattgccaatgatatttaatacctatatat

SEQ ID NO: 83 - DNA, 33425 bp, Bacteroides thetaiotaomicron
agagtgagggaaatacaaaaatacagcaaaatccatataaaaaagaatcaatggcatgggcagcatggattattgcaaggttaggagcatggagtgcatacaagagccagtccattccaggatatattacctttaagaatggactggatagattttatacacagtttgaactgtatgagttaatcagctaagacttgtgtataaagggtagcttcctgaaggaggagaatggagttactattgtgtattactgtttagttcattcctttgcagttttcaagaatctgatgatgggagaaaataataaactgaagaatataaccatgactataatgctttttctataactcccataaaaacttattaaagaaaagaggagcgaagccccccttgacttcactcccccacaatctttctcctctactttttgcctaatacacggagaaaacaagtttgaattaaaaaaagttacacctaatatttataaacctctagaaatttctaccagtatcccaccaaaggcgagttccaccgttatcttcacctcccaaagctttcttcaaagcagaatattgagtaggattgtttttttgaatgtctgacggatatggcaagcgacgaatacgtatgttggtatcgatagctccaccactattgttcacaaagactttgaacaactgcggataacctgtacggcgttgttctgtccaagcttcatagccttcaggataacaagcaatccacttctgtgtaaggattctttccagttgctcttccggagaagcacctccatcccacttcggagtcactttaatcagcgctttcacatcatattttgcttcgaaggcatcgacataatcggaaggagtagcatcacttgtgagataatcgcctacattcactccccattgctgacaggaaaccgtaatacctttctcgtagcagtctttcacgttttcggaagtaaatccacgcaaggcagcctcagcacgaaggaaccatacttcggcagcagtcatcaagatagcatcggtctgtttggttatcgtactcttggaatgcagacggtaacggttttcgtcttttacagtaactcctgttccttggggaacacctttataagtaccggcaatcttatttctttcggcaataatcaaattacccttttcgtcttttatatcaccaccttccgctttcgagtaatacttaatcagtcgcggatcattatatcctaccaaaacagactccatcgtagcacccatgaatacttctccccagccttcattgactgttcccagcggattcttataaccgctttcggtagaaacagcaactgtttcatccgcactctccaacacgccaccggcagttgcatccatcgctttggcaacttctgctctcgccagatcaggagcactcatcgatacacggattgcaagccgcaagcggagagagtttgcaaacttcacccactgtgatagtgtacgtttgcctgccggcatcagaatatcggcagcagcaaaaggttcgagagcggcattgtctttcttatattcgttgatcagtttgactccttcgtccaaatctttgaagaactgacggtaagcggcttcctgactatcgacattatcaccctcttcctgtccgaatttagtgtagacaatagggccataagtatcagctatacggtgcatcaactcgactttcaggattttggtcactcccagcaaacctttctgttcctgattgatcttctccgatttctgagcggcggtcattatatatccataagtatatgtccatgccgagcctgtccagccgtcattcaaagcatatacagagttcttgtcattgaaactgttgttcatatcgtgaaaatatccggcaaacatatcatgacccagattctgtatagtctggaaagtccagtcggtacctcttccccaatcgtaattaaagtaaataccctgttgcatgactccgaggttcagcacatatttctgaagatcatattcctgaagttcaggcgtatatccggctttattggcattatctgattcaaaaccatccgtacatccggtaaatgtcatcagtccggctactaacagattcgctatatatagattttttttcataattcgcttgctttaaagttagaatgtaaatttaacgttgaaaccaatgttacgggttgtcggcataccgaatacatcaactccctgattagtgttacctacagacaagatagcatccggatcgaaaggagcatctttgtagaagaagaacaggttacgtcccaccaatgatacatcaataccggtgaataccttagtcttggccagcaaagtagacgggaacgaatagctcagagataattcgcgtaaacgaatattggtcgcactgtacatataacgctcggagataccgttacggtcacctactactgaatagaaaccttctacattctcaaatcttgttccgtcaacttccacataacctctgtcacgtgcttcagccgtagccttcgttacccctctgccgtccaatgtagcttgtgtcagagacatgacatcaccgcctttgcgcatatcgatcaggaaatacagagagaaacccttataagtgaaggtattagcccaactcaacagaaagtccggattacaatttcccagatatgttttattacctgactctgaaataggtttgccttcatcggataccttaatcttaccttgttcgtcacgtgcgaacgtatttccatagatgtctcccaaagagccgccttctttaatctgcatcatatatgccatagagaaacccgggtcaccatatacgaaggaagtataattcggagccagttcgactaccttattacggttttgtgaataattgaaagtcgttttccaacggaaatcttcggtcagcaccggagtagctcccaatgtgatttcaaatcctttgttgcgaatcttacctgcattgatataacggtatgcataatcttcacctgcactggtcggaactttcagcaactgattcttagtatctgtcttgtagtaagtaaaatcaaaatcaacacggctgttgaacagtctccattccagaccaaattcaatagagttactgatttccggtttcaggtcacctctgttatatacgtctactgcctgcaactttcctccggccccgatgatatcggacaaatcggtaataccaatcggtaagtcgttacctacctgcgcccatgatccgcgaatctttccgaaagaaatccattgcggtaatttaaagctttcgttgatcacccaggagagtcctacagaaggatagaagaatcctttgtccacactattggtatgtgacaacgtggacgaccagtcattacgtgctgtcaagtcgaggaacaatgcgtctttccatcctacctgtgctgttgcgaatacggattgaattgtacgtctgcggtcaatcacctgctcggcagaagcactggtgttcattacaatattgggaacagtgaataagttgggtttgtacaaagaagctgtcttggaatccaatgtcaatgaattctcggtctgcacattaatactaccacccaaagcggcattcacggagaaatcaccgaaatgcttgttgaacatagccatcacgtcaccataaatcaggaagttctgtgtgtcggcatatacatagcggccgttatttcctacaatggcaggagaagtgctcgcatacattttctggtcaaacttatcgctgacgtaatccacatttccacgagcttgcaggttgagccagtcggttgctttcagattagcagtcagggaggccaatgcacggtagcgcttattgttgttcaagatacggttctttacccaatatgggttttgtgtccattcgctcggagtggtaaaccagctctgtacgggcatattacgattctcgtcgaacttttcgaaattagtggcatattcgctcaggtcctgtccgcgcgggaaaccataaacgtccaccaacggattgagatagatacctccggaagtaggagagtttttaatagtctgcaccatcaggttagcattggcgtccagtttcagacggtcattgaaaagagaagcactctcacgcaaagtcagattgtgcttacgcaatttgttggagtcgacaatacctttggcggtcgtgttggcataagagaagtaagtctgcagtttctcattaccggtcatcacagaaaccgagttgatagcggtcactccattgttgaaccagtttccggcattatcatagtccttcacattttccttttctccccagcttgaaccggctttcgctccataactattttgaaattccggcaaactgatcgcatgatcaactgtcagaccggatgagtaagtaattctctggattcctgctttacctttcttagtcgtaataagaatcacaccgttggctgcctgcgaaccgtacaatgcagcagcagaggcacctttcagaatactcatactttcaatatcatccggattcagattggagataccgtcacctgcatcacggttgacaccgtcattcttaccacccataacagtagatacggattctgtggtgctattgagcataggcacaccgtcaatcacatacaacggctggttatttccgtcttcgttggccgaacggataccacggatagatactttggccgaacctcccagaccggaagcactcttgctgatctgcacacctgccgattttccggcaagggcggcaatcatgttggggtctttggcacgggtcagttcgtcgcctccgagctgttgggtagaataagtcagcgaggcggcttttttcttgatacccatagcagttaccactacctgctccagtgccatcgactcttcttccatcttgatcttgaaagtggtttgtccgctgacagagaggctctgcggttggtaacctacataggtgatattaatgatagcgtcgcttggcactttcaaagtaaagttaccgtccaaatcggtgattgtaccattcgtcgtacctttttccacgacactggcgccaatgataggctcgcctctcatgtcggtcacgacacctttcaccgtaatttgtttctgttgctgtgtggatgcatgttccgttatgttcttggtcagcacgatattattgccttccaccacataatggatacctgttccttcaaaagccttatcgagtatttcggataccggctgattggtagcatctacattaactacccgcttggtatcgacactttttttattgtagacaaacaaatagtcggtctgagactcaatctgggtaagcaattcgcttactttcagagtcgaacgcggaatgcttattttagcactctgagagtatccattctcacaataagcctggaatgttacgaacagaagaaggaataatgtgatcttcatagtcagtattatttgcttagattctaaactttttgggcaaaaaagccctttcaaagaaatttttctcatatctttgcaacgtgttaagttaataaattgattaaggtcgatttttgactgtttcgaatcgggaagtatgggggtactttccgattctttttcggtaaggggtatacttattgactgttattcataatcattatgcttttaaagggttagtactaatttaaggtgtatatcattgagctcagttattcatcttaatttttattctggctttattctatccggatgctgtctccttcttcactgatcgaataagtaaacgggtgatctttctggataaccttgagaatgtgttcaacgccgtcctgttccttgaacttgcccgtacagcgataattcagcactttcggattctctacggtgatcttcacattataatatttctccagcttggtgaggatgcaactgaaaggagaatcgtcgaagcaatacagaccttcccgccagcgcagataatcataagaaggcagaacggcttttttatatttcccctgataggaaccgaagaattcattcttagtcaggcgggtcagcggacgttcattgtcataagcgtaaatatcaacgatgccctctaccaaggtagtctcaaattcattgcttcctttataagcgcagacgttgaaatgagtgcctaccactctgacctgattggtctccgtatttacgtagaaaggtatctccttattcttcgctacttcgaaataagcctctccgtccagttccacatctctgtcgcggcgcccgaagtcagatctgtagctcagcgtcgattcagaattcagccagactttggttccgtccgccagcgtaatctgtgcccgttgaccggcaggaacagtgaccgtctgcaactgtgccaatttatcatactgatattcattaatcagaaatccacaactgacagctacaattacagcagcagctatacgggcactccaccttaacatgggaatgatgcgagcgcccgcgcctgctttctctctcatttttctcttagagtcagtaaaaagggcgatgtcaaacagcatacgttctttctgcaatgtcttccggttttcttccgattcgtccacccagttaagaatgcgtttttcttcgtcgacagaagtctcgcccttaaaatatttatgtagtaaatcctggttcatagatattggcttttcctatttatatttatagaaaggctttttctctcccttctatatataaaacaggtcagccttgaacaaccctaacgaaaaatgcgattatttttaaaaaagaatagaaaccaggtaatctttcagttcggtacgcagaattttcaatgctttggtgatgtggaactccacacttttgacggaaatgccgagttgttccgctatctttttgttcggagtattttgataacggctcaatataaaaatctgccggctttggttcggcatacgtttcaatgctttctgtacgatatgctgtatttccgaatcaaagatcgcatccggttcgcaggcttccagtgtagagattctcaggtccagttcccgctggctatggctatttatctcttcttcggcccgaagacgcacctgcagatgtgccagatagttgagcgctttgtttttgatgatagtcagcagcagaccgtgcagattggaatcttcttcccacttatccctgttttcccacagagtaatcattgactccatcaatatatcttccgcctcctgcctgtctcttatataagaataggcaaacgacaaaaacttctcttgattctcatgaaagaattcagaaaaaagttgaatagaagatatgttgttcgtttggtgcatcacgcataagatttacaggctattttcattagttcgtacaaaagaacacatattttcgcagaaaagcaaaataatagacaaaaaaaatagcccgaatactgagtaatcgggctatcacattatctaaaagctatctgcttttttacttcttttccggtcttggcatcaatacttttcttgaaagtttgaattttcctgtcttcggatcgatgtcgatcagtttcacttcgatctcatcaccttccttgattccggcttcttccactgtttccagacgtttccagtcgatctcggaaatgtgcagcaaaccgtctttacccggcaggaattcaatgaatgcaccgtaaggcatgatagagcgaactttacctttatatacttcgcctacttcaggaacagcaacgattgctttgatcatgcgcattgcatcatcaatacatttcttgttggttccggaaacttcgatgcgtcccataccgtctgtttcttcgatagtgataacagcaccggtctcttcctgcataccttgaatgatttttccaccagggccgattacagctccgataaattctttaggaatagtcattgtttcaatgcgaggagcatggtctttcaggtcagcacgcggttcagcgattgtctcggtgatcttgtcgaggatgtgcatacgtccttctttagcctggttcaaagcacgttccagaatttcgtaagacagaccgtctaccttgatatccatctgagtagcagtgataccgtctcttgttccggttaccttgaagtccatatctccgaggtggtcttcgtcaccgaggatgtcagacaatacagcatatttttcttcgcccggattcttgatcagtcccatagcaatacccgataccggcttcttgatcttcacaccggcatccatcaatgccaatgttccagcacatacggtagccatagaagaagaaccgttagattcgaggatttccgaaacaacacgtactacgtatggatagtcagcaggaatctgtcctttcaaggcacgccaagccaagtgaccgtgaccgatttcacgacggcctacaccacgttgagcttttgcttcgcctgtagagaaaggagggaagttatagtgcagcaggaaacgttcttttccgtgttccaatacattgtcgataatcttttcgtcgagcttcgtacccaaagtgacagaagtcagagactgagtttcaccacgagtgaaaatagcagatccgtgaggaccgggcagaggaccaacctcacaccagatcgggcggatttcagtagtcttacgaccatccaggcgcttgccttcgtcaagaattgaacgacgcatcgcttctttttctacatcatgatagtaacggtcgatcagcggagctttttcttcaagttcttcttcagagaactgagccttgaactcttcgcggatagcatcaaaagcatcgaaacgttcgtgcttgttgttatttccggaagcagctactgcataagccttgtcataacaagcctcacgaactgccttacgcaattcttcatcgtttacttcatggttatattcacgtttcactgtcttgcctacttcttcagtcagctccatctgagccttgcaatgcactttgatagcttcgtgagctaccttcattgcttccagcagttcagcttcagatacttcgtgcatttcgccttctaccatcatgatgttatcataagtagcggcaaccatcaggtccatatcagctttttccagttggtcaaaagtaggattgattacaaactgaccgtcgatacgtgctacacgtacttccgagatcggtccgttgaaaggaatatctgaaacagcgagtgctgcagaagctgccaatccggccagtgcatccggcatatctacaccgtcagcagagaaaaggatgatatttacatatacttctgcgtgataattatcagggaatagtgggcggagagcgcggtcaacgagacgacaagtcaaaatctcataatcggaagctctaccttctctcttggtgaagccaccaggaaaacggccgaatgccgcaaatttttctttatactctacctgcaaaggcatgaaatctgttccgggaactgcatctttagcggcacaaacagtagctaataacatggtgtttcccatgcgtagcattacagaaccgtctgcctgttttgccaactttcccgtctcgagtgtgatggttcttccatcaggtaactcgatcgtcttaacaattgggttaatcataaaaattgttttatctatacttttctttcaaaattcctgcaaagatatacatttctcgttgtaatcaggtggaaatgagctaaaaagttagacgctatatgttttttttgcaaaatagaggtgaagaagcaggcaaaaagctttgagtaatcttgaaaagacgtatatttgcaactcttaaaaaacacacgagatatgaaaaagataacttttgtagcgcttgccgcacttaccattacagcttgtagttccggtcctgagtttgaagtgaacggagacatatcaggggccgacgggaaaatgctttatctcgaagcttccggtctggaaggtattgttccgcttgattcggttaaattgaaaggagaaggtacattcaagtttaaacaaccccgccccgaatcacccgagttttatcgcttgcgggtagacaacaaagtcatcaacttttctgtggattctatcgaaacgctacagatcaacgctccatacgttgatttctctaccgcctacacggtagaaggatctgaaaacagcagtaagataaaggaactgacgctgaaacaaatcaatcttcaaaagaatgtggacgagcaactgaatgcgctgcgtgccaacaaactgggacacgatacgtttgaagagaacctcgcaacactgctgaagaactataaggaggacgtcaaagtgaattatatattcgcagctcccaacacggcagccgcttacttcgccctgttccaaaagctgaatgactatctgatcttcgatccgctgaacaacaaggacgatgtaaaatgttttgcagctgtcgctaccagcctcaacaatacatatccggatgctgtacgttcaaaaaatctatataatatcgtaatcaaagggatgaaaaatacccgtcagccacagagcaagtctctggaaattccacaggacaagatcatcgagaccggtattatcgacatcgccctgcgtgacgtgaaaggaaatacccgcaaactgaccgacctgaaagggaaagtagtgctgctggatttctccgtattccagtcaccggcaggagcgcctcacaatatgatgcttcgcgaactatataataaatacgcaaaggatgggctggaaatctatcaggtatctctcgacgcagacgagcactactggaaaaccgcagcaggcaacctgccctgggtttgcgtacgtgacggcaacggtgtctactcgaccaacgtagctgtatataatgttcgccaggttccatccatcttcctgatcaaccggaacaacgaactgaagctccgcggcgaagacatcaaagacctcgaagcatccgtcaagtcattactctaagttgttataatttagcatatttcatttaaatatgttacatagcatcatttttcacttgacagatatcacttaaaagtctatctttgcagagaaataattgaagagagggttccaacatgtgccatgttggaattcttttttgtttatatgaccattttaaataaaaggaggaaaaacatcatggcttatatgtcagaagaaggttacaaaaagttaatggcagaattaaaggaactggaaacagtggaacgccccaaaatctctgcggctatagccgaagcaagggataaaggcgacttgtcggaaaatgcagaatatgatgcagccaaagaagcacaggggatgcttgaaatgcgcatcaacaaattgaaaacggtcattgcagatgccaagatcatcgacgagtccaaactaaagacagactctgtacagattctgaacaaagtggagctgaagaacgtcaaaaatggcatgaagatgacttataccatcgtttccgaaagcgaagctaacctgaaagaaggcaagatttccgtaaacaccccgattgcacaaggtctgcttggcaagaaagtaggtgatattgcagaaattaccgtaccgcagggtaaaattgcattagaagtagtaaacatatcaatttaacagaaaggcaggtctccgtgtgaggcttgccttcttttatctatcaaagattatggcaacaatattcagtagaatcatcgcaggcgaaattccttgctacaagatagcggaaaacgatcgtttttttgcttttcttgatatcaatccattggtaaagggacatacgctggtagtccccaaacaggaagtagactacatcttcgatttaagtgacgaagacctcgcagcaatgcacgtattcgcaaagaagatagcccgtgccatcgaaaaagccttcccttgtaaaaaggtaggcgaagcggttatcggcctggaagtaccgcatgcccatatccacttaattcctattcagaaggaatcggatatgttgttctccaatccgaaactgaaattatcggatgaagaatttaaatccattgcgcaagcaatcagctcctctctataaaacatgatgacgacataagcgagcgggcaccctgagaagggcgcccgctttttttcatatcatacattatatatgattatttcttcaaggggtccggcgacttgtctttgctttcggctacctcaaccagataaacgccgatacaaataaaaatgatggcacacgtctgcgtccagctaaaacggtcctgtccgagagccagagaagcaatggtcgcaacaatcagaatcagataaccgtagatcgcgacgactgttgttttcagatacttcagaccgaccggaagcaacatatagctgatcgttgtcggaaatatgagtacaaacatcaatatcaggaaaggtgtccaatggaacggcatagagaacaccggcgcatcgaatcctgtaataaatgtcacaataatagcagaaaccgccgcaccggagaatgtatatctcaacatagtcatcgccccgatagatgaaaggatacgctgactcagaatcagatagacagcataaacgatggaactgatcaggcaaagcatattccccacgaaagcatcggaggccaaatcatcgctctgttgggtcaggatgcagaccagtgcaccgaccagtccgattgagattccaagaattttcttccatgtcgccttctccttataaaagaaaatcataatcagaaacacccagataggctgcagactggtaaatatggaactggatacaggagtcgttttactcaatcccgccagataaagaaacataaagccgtacagtccgaatgcccctaacaggaaaagcagccatttgtctttggcggatgacttttccggcggcatgaaccatccgatcacccaaaatgcagcggcggcaaaggtgcaacgaagtgtcgcacctgtcaacgggctcatccataggggaagcagatacttcagggcattcatattcaaaccgctgaatatttttgatacagccatactcagattggcttccagtttcttattcttcatctttttttatttcagttgatcgttaaacaaaaaggtatcgcggcgcaggtaagcccaaaagaatgtgacaatagttatcaacaagttgaagacaaaaggaaactcttgcgactgggtatgaaacagattttggagaaaatctataataaaaggataaagcaagatggcgagataattcatcatcattacaaaagccaatgccattgtcgccttttgaggcagtgccgtatgtgtcgttttatcatacagcataggctgaataatgccatatcccaaaccgaccaggatacatcccggaataatcagccattcgatcggggcaatccagatcagcgccagccccacagccatagacaggaggctgtatgctttggtacgctctttcagttcatccactatcttgtccagacagaaacccggagccataatcgctaaaaagaaaagcgagatcatcagtcccgaattgccactggagaaatggtgtttctccatcaggaaagaaaggttgaatatgactgccagcacaataaaagtcgtcactccgtagaaaagcatgatctgaagcagatgcctgatatggattccatatttacttcctccggtatctgcggcagccgtttgtccggatggcgcggtactttgagaagaaggttcgacggcggcgtcagaccggctctcttttaagtgaccgaccagcagaatagaaatcaaagggagcagatagaccaaaaacggcaaatgccagctgacttccgccagatatccggtcacggcagtagctatcaccaatgtaaaattggtaatggcagaactcaatccgaattgtttcacccggtaagtacccacaaagtattttgagattaatcccgtggacagcggaataatcagtccggagccgatgcccagcagggcactcacgacgattaattgccacattttgttggagatcagatacaagataccgcttgctgcaaagagccagagtccgattttcaggatacggacaaaatcaaccttttccgtgagcttaccacccaaaaggataaaagggataatcagcaacgatggcagcgaagtcaacatctgaatatccaggtcggtcgctttcggaaagattttggtaaggtcgcccaatataggcgaaacagccagccccggcaaagaggtcaatgccgagatagaccaaatagctattaaagtgataagaggtattgttccccttccagtttgtattttcatataccggttcgttaaaagtttaggtctgatgaaaacaatgattaccttataaagttcaaatgaggcaacagtgaatattcaaaaaacgggtgaaaaacacccaaaaactatcagattatggcctaaaaactatccgcaaacagtttttaggctaaattccgtcagtttcacccccgccgtacttaaaaaaatcccgtaaacttgcatcatcgaaatttaacaacgaatattcacaatttaaaaagcaacgtatatgaaaagtgtaagcttcagaaaagatttagtaggagtacaagacgaattactccgtttcgcttataagctgacaaccgaccgcgaagaagcaaacgatttgttgcaggaaacatcattaaaagcattagacaatgaagataaatatatgcctgacacaaattttaaaggatggatgtataccatcatgcgcaatatctttatcaacaactaccgcaaagtagttcgtgaccagacattcgttgaccggacggacaacctttaccacctgaatttaccgcaggacacagggtttgaaagtaccgaaaaagcctatgacctgaaagagatgcaccgtgtagtcaactcattacccaaagaatacagagtgcctttcgccatgcacgtttccggcttcaagtaccgcgaaatcgcagaaaagctgaacctgccgttaggtacgataaagagccgcatattcttcacccgccaaaaactgcaggaagaactgaaggacttccgctaaaccttaacaacacaattcaataggtatcagataactataagctgccagttgtcagcgaatagccaaaggcaagagggaaacaaccccttcttgccttttttatttccgttccccccaccttacgcctgccccaaagccgccccttaataaacgccaaataatgtaaaagccgaaaactttcaaaaccatctgctgttgttgagggaaattcgacggggaaaatccccatcgccctaaacctttaaaaaaacaaattagtatggaagatttaaatttcagaaaaggtgatgcaaaaaccgacgtattcggttcagacagaatgttacaaccctctccggtagaaagaattcctgatggtccaaccacccctgaagtcgcttaccaaatggttaaagatgaaacttttgcccagactcagccacgcttgaacttagctactttcgtaaccacttatatggacgattacgctaccaagctgatgaacgaggcaatcaacatcaactatattgatgaaaccgaatatcctcgtatcgccgtaatgaatggcaaatgtatcaacatcgtcgccaacttgtggaactctccggaaaaagatacatggaaaaccggtgcgttggcaatcggttcttccgaagcttgtatgctgggcggtgtagctgcatggttgcgctggcgtaagaaaagacaagctcaaggtaaaccgtttgacaaacctaacttcgttatctcaacaggtttccaggttgtatgggaaaagttcgcgcaactgtggcagatcgaaatgcgcgaagtgcctttgactcttgaaaagaccactctcgaccccgaagaagcgctgaagatgtgtgatgaaaacacgatctgtgttgtacctatccaaggtgttacatggacaggactgaacgatgacgttgaagcactggacaaagctctcgacgcttacaacgccaaaaccggttatgacattcctatccacgtagatgccgccagtggtggtttcattcttccgttcctctatccggacacgaagtgggatttccgtctgaaatgggtactttctatcagtgtatctggtcataagttcggtctggtatatccgggacttggctgggtttgctggaaaggcaaagaatacctgcccgaagaaatgtcattcagcgtcaactatctgggtgccaacattactcaggtcggcttgaacttctctcgtcctgccgctcagattctgggacaatactatcaattcatccgtttgggattccaaggttacaaggaagtacaatataattctttgcagattgccaaatacatccacggtgaaatcgccaagatggctccgttcgtcaactactccgaaaatgtagtgaacccattgttcatctggtatctgaaaccggaatatgcaaagagtgccaagtggacattgtacgatctgcaggacaaactgtctcagcacggctggatggttccggcttatacattgccttccaagctggaagattatgtagtaatgcgtgtggttgtccgccagggattcagccgcgacatggcagatatgttgctgggtgatatcaagaacgcaattgccgaactggaaaaacttgatttcccgactcctacccgcatggctcaggaaaagaatcttccggtagaagccaagatgttcaatcacggtggtcgtcgtcataaaaccgttaaaaaataaattgatctatggacaaaaaagtaacactcgctcaattgaaagaagtggtacaggaggcatacgatcaggtgaaaacgaatacaggcggtaagaatgccgactatatcccttatctggccaatgtcaacaaagatctctttggaatcagtgtctgcctgctcaacgggcagaccatccatgtgggagatactgactaccgcttcggcatcgaatccgtatccaaagtacatacggctatccttgcactgcgccaatatggtgccaaagaaatattagacaagatcggagctgacgcaacgggcctgcctttcaattcaatcattgctatcctgctggaaaatgaccatccgtctaccccgttggtaaacgccggtgccatctccgcctgcagtatggtacaacctatcggcgactctgccaagaagtgggatgccatcgtagagaacgtgaccgatttatgcggcagcgctccccagctgattgatgaattgtacaaatccgaatcggatacgaacttcaacaaccgctccattgcgtggttgctgaagaactacaaccgtatttatgatgatccggatatggcgctggacctgtatacccgccaatgctcattgggagtaacggccttgcagctttctgtggcagccggaacaatcgccaacggtggtgtgaatccggtgacaaagaaagaagtattcgatgccagcctcgctcccaagatcactgcaatgatcgctgccgtaggtttctacgagcatacaggagactggatgtatacctccggcattccggctaaaaccggtgtaggcggtggtgtaatgggcgtattgcccgggcagttcggtattgccgcattcgctcctcctttggatggtgcaggcaattcggtaaaagcacaattggctatccaatatgtcatgaataaactgggactgaatgtattcagtgacaatcacttgatcgtagtcgactagtttatccgctctatgagaaaaacaaaaggttgctatccttcaaagggatagtaaccttttctactatcaatatcttacttctattttccttaagtactctattcaaaaaaacaatgtacttgaacactaatattctcatacctttgagaaaaatttctcaaaggtatgagaacacgttgagaatatagagactcatatcgcactgtgtatcatcccaatacaaatcgatacggatatgagtctgaccttataaaaaaggattatgtcccctatgcagacgccgtcttttcttcctcttccgcataatactgctttttcttttgattagactgctgaatcagattcgtaatatagactgtaaagatcgggaacatcatcattcccaaagctgccagcagtacggagagtactcttccggtggtcgtcatcgcgattatattcgacccgacggtagtcacatccataaatgcccaccacaaagcgtctccataatccgtgaccaacggattcactttatgttcaaggacaaagaaggcaaggctggcgaaatagaccgttgccagcaacatcgtcagataggagacgaacaggctggaagcccggttataggtgagccagcccactacgatggccaatgcgtatccccctctcagcaaaggaataaaccggagcaggtaagtgacttcgggagaaaaggtccacccgtaatacgcaatgatgttctgataagggatcgccaccagcaaaaagataaagtgcgtccgtatataacgccacttatgctttgccagaaaaaactccagtacaaaatcgaacaggaaccagatgcaaatccacaactggatcttcatgtacgaggactgtgtataaaaaggaatccccttaaacgtatcgatcgaaatactaataaccagaaaaagggacattaacaatataataatgtggagaatgccataaatcccctttttccccagaataaaatcggaaagcgctgatttcataactacttaatttataataaaatgattcttatgtaacttataatgcttagaaacaatctgagaaagcgattgtttcggaacaggcgtccggaggtttacaattgagccatccggtgatgttaattaacgaactttgaaagagattgcggaaacatctcacgcaaaatgttgttataacactgactttaaaatatttttcacttaaaaccttaacttatggcaaatattaaaaatgcagtgaagctgggcgtgtttaccctggctatcatgaacgttacggcagtagtatcattgcgtgggctaccagccgaggccgtatacggaatgagttcggccttctactatcttttcgcggcgattgtcttccttatcccgacatcgctcgtagcagctgaactggcagctatgtttcaggataagcaaggtggtgtgttccggtgggtaggcgaagcctacggcaagaaactgggattcctcgccatctgggtacaatggatcgaaagtacgatctggtatcctaccgtattgacattcggtgccgtatccatcgccttcatcggaatgaacgacgtacatgatatgtcgctggcaaacaacaagtattacaccctcgtcgtagttcttatcatctactggctggctacattcatttctctgaaaggtatgagctgggttggtaaggtagccaaaatcggtggtatggtgggtacgattattccggccgctttgctgattatattaggtattatctatctggcaactggaggacaatccaatatggatttccacagcagcttcttccctgactttaccaacttcgataacgtcgtccttgctgccagtatcttcctgttttatgccggtatggaaatgggcggtatccacgtaaaagacgtagagaacccttccaagaactatccgaaagccgtatttatcggtgcgctgatcactgttcttatcttcgtattgggaaccttcgcattgggcgttatcatccctgctaaggatattaacttaactcagagtctgctcgtcggtttcgataactatttcagatacattcacgcttcctggttgtcaccgatcatcgctatcgctcttgcattcggagtgttggcaggtgtgctgacatgggttgcaggtccgtcaaaaggtatctttgccgtaggtaaagcaggttatatgcctccgttcttccagaaaacaaacaaactgggtgtacagaagaatatcttgttcgtgcagggtatcgctgtgactgtactgagtttgttgttcgtcgttatgccttccgtacagagtttctatcagattctgtcacagctgacagtgattctttatctgattatgtatctgttgatgttctccggagctatcgcactgcgttataagatgaagaaattgaatcgtccgttccgtatcggtaaatccggtaacggtttaatgtggttcattggtggtcttggcttctgtggttcattgctcgcattcattctgagctttatcccgcccagccagatttctaccggtagcaataccgtttggttctccgtattgatcatcggtgcattgatcgtagtcgttgctccgtttatcatctacgcatccaagaaaccgtcttgggtagatccaaactctaatttcgagccgttccattgggaagttcagcctcaggctgttactgtcggtgttactgccaacagtgcaaatgccgctcgtccggcttctgcttcgacatcgtctgcaagtccggtcagttccgctactgccagaccagcaagtaccccaacttccggtccggcaagcgcaggctctacaacctccggttctactccgacaagcaatccagctccttccggtggaaataccgcagcaagcaacggatcgccagattccggaattaaagatgcgggtgcacctaaatcttaaaagctaaacatattgtttacataaataatcccaccttgaatatttcctgattcaaggtgggattattcatatcttatcatttgttatttctttcttcgtaaccaaaggcaagatgaacaaaaaagtactacccttaccgacttccgattctacaccgaatcttcccccaagattatgaacaattgtttgcgaaagtgtcagtccaagccctgttccctgcatctcccgatcaagcttcgtaaaacgggagaatatcttttcctgctcctccttcggaatgccgataccggtatccgatacataaaaatagacttcatccgtgccttccatacgacatccgaaacggatttcacctgttttagtaaatttcatcgcattatgaagcaagttcgtcaatacctgaataatacgctgcttctccgaatgcatcataatcggttccagatgtgcttcacagaccagtgtcaccaaaggattctcattcagcctcattccgaaaagtccttccagctccctcagcagatcattggcatcaaactccgaatatacaaagttcaacacgcctgcatctatttgcgaaagatcgaagatatcatttaccagtcgcaataaccgctcattattttcagagataatatcggtatacatcttcttttcctcctcgctggtagccgtagccatcaacccagagaatccgataatggcattcaacggagtacggacttcgtgactcatattagcgataaaggcagacttaagtttgtcggcagaaatcgcattttctctttctacatccagcaggcgctgcatatttcgaagttccgtcacatcatagactgtcagcaccatacgttcttcaccatttattttcagataagtgcccgaaacagaaacatcacagggaataaccgtcttttcatcctcacttaaaagttgcatagaggcatccagtttcttaaagcttctcttctcataaaaagccttgcttatagatgtacgtatacagcacaacttacactgttcatgtttcccgcattctccggctactatcgcatttctgcaatgcaataaatctccgactcttttttcttctccctgcgcaggagtcaaatgattcagtgtataataattggtattgtggacgatgaggtctctgtcaatcaacagatagtaaacgtttatattctgtagtatggaagtcaactctttggattcatgcagcattacagatgtttccaatatcattttcttcttaaccgactgatacttaatcagtagataaatgaatccagctaataaaacaactgtaacaaactgtaatgccataataatatattctattgtttgtagtgccctgatcgttttgactcgtaaaagtataaaatataccgaataaatgatactacatttgcatatttattctacctagaaagaaaagttttttttctttctccctaagtagacgaaaaattctctctaagttattgcagtattaaaaaatatacttatctttgcacccgcaaacgagaaaggtgccatagctcagttggtagagcaaaggactgaaaatccttgtgtccccggttcgattcctggtggcaccaccttttaaaaagcaagacaatattaatccctgatttttttcaaaattcagggatttttctttttctggaacaggtaaaaccaataggaatgagaatcaacataaatatgataccattctgcaattgattttggtacagcatttattcaatcattatctcatgttaagcaacagcttttcgcccactttaaaattcatttaatgaacaaactttttctatagcaaatatgttttctattatcctaaatgaatgataaataaaaatgtttccatcaggcattttttctgtatgacaaaggattaattttataaaaagacagataaatgctcatttgttatattcatttatttatagtttaatataacaaatcatgtagatatggcaacaataaaaatcaaattccgtacctcttccgtgaaaacaaaagaaggcgtattgttctatcaaatcattcatgccagagtaaccaggcaaatcaataccggctataaaatttttccttcagaatgggataagcatttggcttgcatcattcttccggacaataatgacataagacgacgttttctcgctcaactaacaagccgaatagcagaagacatgcatagactgaaaaatatcatttcaaaacttgaacattcgggcaatccttttacctccggaaaaataatagagctattccgtattccccccatcaataaatacagttttctatcattcgcacaagatcttattatacaactaaaacaaatcggcaaagaacgcactgccgagtcttatgcctcagcatacaacagtttcaagcgttttatggacaataatggtgacgttctacttgaagatgtaaattccaatctgatgataaaatatgaaatataccttaaaaactgcggtgtctgtccaaacagctgttcatattatatgcggaatctccgagcaatatacaatcgtgctgtagaaaaagagttaacacaacaacaatatccgttcaagtatgtgtataccggtattgacaaaacagtaaaacgagctgtatctctaaaaacaattcgccaaatacaaaatttagatctgagcacaaaccctttgatggattatgcaagagacatcttcatgttctcgttctacacccgcggaatgtcgttcattgacatggcatatctgaaaaagaaagatctgcagaatggagttctgtcctatcgcagacataaaaccgaccaacaattgttcattaagtgggaaaagcccatgcaaaaaattgtcgataaatataacactatagaaagctcttatctactacctatcatcaaaaacaacggtaaagacccaagaagagaatataaaaatgcctcacatttgattaatagaaagctgaaggtaataggacaaatgttagagatccccgtcacactaacaacatatgtcgcccgccatgcatgggcaaacattgccaagagtaaaaatatctctatctcggttattagcgaagctatgggacatgactccgaaaacacaacacgtatttatctagcctcgttagacgcctccatagtggataaagcaaacagtattatacttaaatcattatagtataccaaaagagtattgacggggctgacccaaaagtcagcccttagttttccaatgctacattattaataaataagattatcatggctctacacaacggataaagcatgcatcacttttaggcgtttctattttattttcaccagtaagagttgcgtaaacattacttttagaaatcaaattaaaatcaaaagagaagtaattaatatcccacgccataatatcactttctccatcgcgccctggtggatatatctgctgtaaccaatagatagcccccggacgcatatacaaatcataaaacaaaggtttctcatcacctgccgtcatattgaatttatcactacgtccagcagaataacggagtacaactgtattctttgtctcaccatgtatatagccctgaccagtaactacgccctgccaatttttcatatcaccatatccttgttttctatgtccatagcctgacgctcctatcggaaagaatagattccgcccatccgttttattatatataaaacaaccacgcataccatatgtgccgaaactatcataacgatatccgtatacttcattgatattggaaagtgtttcctcggcatcatcaccatagagtacaccatagcccatttctatatccttgcttttatacaatacattataatcatcgtaattggcaatttccacttcttttccattaattttaggcttttcaaaaggggtattaaaaggctgagatgtgatttcatcccacaatttagtagtcccttttccagcaatctctagtggcttggctttatcatctttaaagtctttcggctgcacttctatccaatattctttctcatgtttattacttgacgcatcaattggttcattcagatttccccacttaaacaatgacccttcttctaccggcgaatctgtttcctccgtaggagtcttcatattaaacgtatgccaagcccgcccttcgtcaagcaaagctacaggagcatagccctggcggacaaatataaggtgattgcaagtattgttgtgataactgacacgaataacggcatggcgggattcattttctgcacatgtaccattgaacgtaattttgaaatcaattactgaaccggaaagccccttaagtgtaccatgttcatctatactcgtgtacttgttactactacttttttctaacttcacaaatccttcgtgcgttgtcgctgcaacaacagcttcccaagccccctcggaagtaaattcttcgaaatttgtagcattctcccgtgccaaacgttttaaaacaacatggaaaggcttgtcattattatgccgtcgatatattcctttaggattgactacgcgacgtacctggaatatatcaactatttctgttaatggctcaccctgcgataaagtcgcggttatttttatttttgcctgacgccggtaggctacatatggattattcccggtataactagtttttgcaatcatctgtttcgcacgtgtatataaaggtatactcatatgaagtatattcgtcccctcttctttacgcacagaataattaccatattcagtatcttcgtgaatgcctggatctacggcatattcgcgatttcctcgttgagttcggttatagtattcctggttgctttctgcataaacaatacctgaatcctcattagcatctgcttttgttgtcgtaagtatggttgcagtagtacggcgcaaagaaagaaatccattccatacattcttgccttccaaatcaaaatgataataatcaaaattattagcatctgcaccaataggcgcccaaccattgttgagtatttccgctttcacactttccactttcgcataaccaggatttatttttataggcaaatccatcgttctgttatataaataggaaatataatagggattgggcacctcaatacctggttccggttcagcatattcgatatgccagtctgcatcatttgcaaaatttttaaatttcaatgtaagtttatagtgatgattacgttcggcatcatagtttgttgtaatgtttttaccaagcataaaacggtatttaatatcaccactacctactttttcttcattaatagaacgataataagcgtctacttcaatatatgtaccataaggtacgttatcttttggtctatattttgaataatctttgtccggctgttgcagatgaggaggtaatccgggatgatccagttctttatctccatctgcatcctggcgtttatcatatggctggtccccctgcatattctcatagaaaaacaaagcatcagctgcctcttcgtgtccatatttaaaagttccattctcttcacacgggtaataagctctccccgtagctaaacgtaccggataaaattcgtcaaatgcaggtggggtagttcctgtataatactttatgatttctccgtcttttattaaagacgattgttcatcttcacttggtgtgtttgtttttcccaagtagcaattaacaggaatatcctttatctgaaccgatttcaaataaataaaaactccttctttcaatccagtggcatcataagcaatggttactttggaagctgcgcggcgaatccatgcgtgcaattccatatctttcttatttatagctactcgtgaagcttccgtattgcggttagcccccgcaggtgcattctcttttgttgtgaagtagccaaacatctgatggtttttagtagctcttgtcacttttccatcagcagtttcttctgtcgcgaaccagttttctgcttcccatgtcagattaatcgatttcagtttatcgactgtttgtatattatctttttctaactcagccaagttacccatatttgctaccgcatacatataataatagccgtaaggaacttgagctaacttgaaggtagcccgtttggttttggcttccgccgttttgcctccttccgcatctgtgtctgcacggtcaatatcatcaacatcgaatctatctgtagtttccgttgaagcagtacctttcggaagaagatagtacgatttcaccagatttccttcctcatcatacagcaacacacaaagatcattgatgtctttgattacatctcctgccgtacgagtgtttacatccagagccggccgaagaggaagaaactctacagtagcactcacactgacttctccttccggcattctttcgccttcgttgttcagccaatcatccgtacaggcagtcaagacaaatatcagcatacctgtaagactataaataatgttgcgtttcatattttcctgtataaagttatttaaggaaatctttcctttctttttttataacccgaaatcgggttctagtgtgatttcggtataaggacgcacatctactatgcaatccattgcatgttcattaattgtgatatttaccaccacatgtgtatttcgcggcaactgtggcagatttggcaagtaacttttcaattcagttccgttgacacccaaagtcagcagataaggattttccttattgttgtcatcactatgcttcccctccaacaggtaaatcggttgctcattggttttcgtattttcatctcccggaagcagttgccctttaaacaacgatgacgcatcgtatgtataataccctttcaaagtaggaacatcgaaactatttatgtcccagaactttgttccctccgtcgtttctctctctatatatgtagcattgtgtggcaagtaatactccctttctgccattttatcaatagtcagtttcgtgatttctatggaccgactgcttttattcgttatattgaaagtaaatttaacagccgctctcattatggaaagctcacgttcacaatcctcggcaggcacatctaccatataaagtccactcatcggcaacggaccgtcgattcgctccatattactgcctaaccgaatggtcagactggatatataatccgtaaagaataagcttccgggctgaattttctcaaaatcacactctaccaatttacgtttcggaaaaaatcccgttgtctttatttccgtagcttcatttgcaaacaaataaattcgtttcttttcgtttccgataactttcatcggctcgctataacaatcggtagatgcaacctccaaattgtaaatccggttatgttccactatattatcattgttacgtacgacaataatacgcaacgttttcatcttttcattatcatttactggagcctctggatagatgtcactggcccgtgtacccgattgcgatatgtcagacagggcaacactgatattaagattcactaacggcacttccctgtcaaacatttcactatctgcatcatgagcacacccccgaaaaaggagagaaatagcccatggtataatgatatatgcgattttcttcattgtcttatatcgttgattctgacagtccaatcgtttatcttaatataagttttaatccattcaagattcgggcttaagaagaatatcattgaccattcactttcacgatcaaggaactcctgcgaatccatgcttgcatacagatcactcttaagcataagcaaatagttaataagtggaatattgataatttccacaccatctgctttgcgacgcaccgtcagcttaggcgagtaccaatcacgcaccatcaaccgtgaagtagatagttcggcataagctaccaccacttctcttccctcatcagtgaatcctgccgaagcttgcccttgtgcccatggagtgtatgtcaccataccattctcaagcaaattattatcgtaactgaacagtatattatcatcggtaatttcaaattcaaatttcttatcatctaccggctcaccattcatttgttgcaacacaacacgaatattattggtgttcttcatcatctcaacagtgccttcactgtaaaggtcggcagtagcgagagtaagttcaccccaatacaaaccgtgcaagttctttcgtctgggatttgtcaagcattccgaatctagttccacttgcaaatcggtatatccagttccttctccgggggtatacttcataaggaaagagctcttattacaagccagaccaccataagctacgaaatgataatttccttgtttgaggtccagcttcatgcgatagttctcgtcctgcaactccgtacccgtcactatgcgagtatccacataattgccattttcatcatagaccagcaatgtcagacaatccaccttcttagcaaatgcattggcatattccatattgtagtcgtaaatgaagcgtagtgacacgccatgcggacatggagcaagatcttcatagatacgctcacacgatgaaaaggcaaaatttatcagtacgatgccaagcaccgtactgataaaccctgaaattatatttcgttttttattatgcatctttggtttcttagaaatcgatattattgacacgaactacccaaggcaatacatctaccgaaactgtcagataaatatcacctcgctcatcgggagtatcaggacctgggttatcagggtcattatctgaaatacgtggatgcccaagacgggaaatgttagttacagcaagtttataaacattgttgcgaactacagcgaactccatcggagccatttcaccttccacaccattgtcattgtggcgattccaataataatagtagcaataatagccccaaccaccgtctttgtcctcgcttgactgatagatggttatgccggcatcagtagctgcttgtctgaaatcactgagataagaaccttcaagtgttttatcgtttctgtcccaagtgttccattttgaattagcactactttcatcttgagggctagcatccccttcctcacctgtaccaccggtaccatatacagccacataaagcggatgagaacgactccatgttttggtctcttcgttgtatgcaacagctttcactgcttttcgcacatttggccaacttacatacaaattgccgccgaacatataaataatcggatctttataagaatccttcattaaaccagaagcagtgtaattaataacttctgccaagtgcctggtatcttcgtcagtgctagcggcagcagcttcagtagctaccatttttcctttgaaaacaataccggttgttataccgtttacctgcctgtcaaccggtcccggaattgtattttcagttacataccgccatatacgatagtcaccatatttgttaccagtattccagctattatctgtatcttcttcacccccaagaaccgtagataatagatgcgtgttccattgatcttgctttgtattgtctattgagccgtcaggttgaaagagagggtaattaaaatactcacttaatttcgtagtctcaatgccttgattcttctcggttgcccacacatccacgacataattaccattaagatgagtttccccacctcccacagcggtaaaccagggcttttccgggctgcaaagactagcttgtgccggaagtccattatcagatacacgacgcaaataataaaaactattattcatattcaccaaagccattttacctaattcaacgtttacaatgtaagccccaggtgttccgtccggcgcaatatcttgtacaaccggataagtgttgcctttctgaggacgtatattttcaggcaaactgcgactaccatctctaaaatcgaaacgtgccattgcgcgttctactttcactgcaccacctacactgttgtctacttgtgacaagcttcccgcattgtttattccggaaagattaaacggagtggcttcattatataacaaccagtcattcatcgtattagggagcaagcgcttagctatggaatagttggacatcagaaagctgccaccttcattcttgctccatatctttcctaattcctcatcgtcacccttgcaaattgcattataccatgtcgtattcttatattcagttttactaataagttctaccaattcatctgtcgggttacaaaatataaatacattcacttcctttttatcagttggtgtttctgtatcattatagaactgagacaattgcgttttagttatttcggaagtcccaatataagcctgtttatttgcggattgtttcatcttgtccgacatgtcaccaaaagcaatgaatgcattatccgtgctgcgggcaagtaccacatacattcttttcacattgttctcataatctttaccgatttcgacaccaacattgctgccaccaccttcaaccgtattactacgcgaaccaggcacagacggcatagttacctgtactgtcatgtatgccttatctccctcataaacagtagggtcaaattctgtttcacctagtttatcctcagcacaacctgctgtgagaactacggcaaaaaggcataaaaaatacttgctaattcttttcataatctgcaactttgaatgaattaataatttctatgtttttatatttagatcctgttaatgttttatctcttctatttgctttaacatctcctctgcatcagccagccccctatgtgcagcttcagtaaacattttctctgccatatcaaactccttcttcaaggcagcgtatgtcccccgaccataaacagcctgcggtgagtttccagctttcttcagataatattccgcattcttcatatcccccctagccattgcggcatttgcagcattcagattagccacttcatcatcagggaacatacgtacagcgacttcgaatgtttcattatattcttcactccccagtttcatatcctgtgcggcaagatacatctcattcaaacttaacttctgtggctgtgttttaatcagacgcttgatttcgttgatatcagtataggtacgcacttcatatttgactgcatagtctgaatgacgaagccccggataaacctctttcagtaagaatgcataatcttttggaaaggcagtcttgatgctacgttcttttgcatccggttcctggttactgcggattaatgccagaatacctgctttgttttcgagatacgagttttccacataacgttcgagtcctgcccaatcttccggctcgttatcggtaatgaatagtgaatcggcaaaatcgtactgtttgcgtacatactctttcaatgttttcgttcgtcccatcgccagacgttcattattcgaatagggactttcaggcgaagcatatcctttgatgctgacagagataatccgtgtatccacatcattcttcaccgcatcaatagtattaagtatcttttgtaattcagccggattacgacgataattctcatggatttctgttcggttcacaggaaagtcaatataagccgaaccttccaatacattaatttttggttctgctttcggacgaatgtatacataggcaggcacaaattctttcggctccaactgaagcaccaacagaggctcgttgccatcaacaagtgcctcgccgcaacaaccgcatgtttcattgcccgtactgagcgtggcacgtttcatccaatcggcataaggtaccactgtacgatatttgaccacagatactttgcttttttgataaagcatcatatcatccgtacacaagccattgcgcagatgatgataatagcggttgcgaccagctatcatcaccgaaggtaagttcagttcattaccttctcctgacagtctaggcgtaagaatcacttcacggttactttttacactcaatgccgaaacatcaatatccattgatacgaacaatttatcttccgaacgagacacggcaaggtcagatactgtcacattaccgcccattattgtttgagcctttgctcctatcatcaagagtaggaatagcaaactactacaaagtatttttgttgttctattcatatccgtaatttgtgtgatttaaaaagtatatatgagattgactgccgcttttgtgggcccaacataattatgcgattttccatcggctatttttgtaccgcattgggcacagggataactgtcgtagcgagtataaatccagcccaaacctaactccgcttccaaattccaacgtttgttcaatatccacgcataaccatacgcaatgccaccaccggcaaaccaaccttgataacgacgatcagaaagcacagataaatctgttccaagaaacgaaatatgattgttcagattaccaatgttatactgcccacccaaagcatgaacaccaacaaaatgaccagcgaaacgatcacaaaaccaataacgtccttctggttgcagaagccaatgtttccacttacgctcatgtgaaaaagtccagccattatagttagcggaaagatcaaatgtccatttcggagcaaggccaacttctattcctgcattaacagttgcagtaacatcatacaataaattgcttttgattgctactttctgacaatgtacttctgtgcagagaagcacaaaaatcataattgcatacagtttcaatttgttttttttcatatatataagtattatat

SEQ ID NO: 84 - DNA, 32971 bp, Bacteroides thetaiotaomicron
cttaaaaatcgaacattgctgtctctttttcaaatttggtatcagatgaaataagacaattattgaaaattaattgaaaaagaataaatctttaaacttttattccttactttgttatttatacagatatatatcaaacttaaactggaaagattatgaaaataaggcagatttgtatgctggtgctattatgtctgggagtgattccggcagtgcaggcacaaacttacgacaaattatggaaacaagtggagcaggcagaaaagaagagcctgcctgagactgtgataaaactgactggcgagatttatcagaaaggggagaaagaaaagaactctccacaaatgctgaaagcgtatatgtggcggatgagataccgggatatgctgaccccagatagcctgtatacgaacctgaatggtttggaactgtgggcaaagcaaactgaccaacccatggaccgagctgtattacattcgctgatagccgagatttattcaatgtatgcttttaacaatcaatggcaactccggcaacggacagagattgtaggtgaagctccttcggcagatatgagggagtggacagcaaacatgtttgtagagaaagtgagaacaaacgtaaaggaagcaatggcggattccgtactattgcttaacacatcttcacgtacttatattccttttgttgagttgggcgaaacaagtgaatactatcatcatgatatgtatcatctgctggctacccgcggtattgtagctttacagcaggtagcgggattggatcgtgccactccggtggaagatatttcggaagattcgtctgctgaaaaagaatcttcggtgaaacaggatattatagcaatttatggaaatatgattgctgcttataaagcatccggtttgaaagaaggctatgtgttgacagcgctcagctatttagagtggagacgtgattcagatagaaacatccgccctttcggactgaagaaaggattgtcgggattaacagaagatacctacgttactgcactgaatgaactgaaaagcagatttaaatcagagagtatttgtgctgaagtttatttggcccaggctcgctatgcgattgaaaaagaacagcaaacgtcagctttgcagctttgcgatgaggccatccgtttataccccggttatcgtagaattaacgctctgaagaatttgcgcgaagatatcctgtcaccgtttctgaatgtaactgcggctgcaacagctttccctggtgaggaaatcgaaataagagcttcgcacaagaatctggatggatttacacttcgtctttatcaggcaaagaagttgataaaggaacagcactttgcagttcttcgtcccgaagactaccggacgcaggatacggtatttacctttaaagcgccggaagtcggacaatatgtaatgcgtatcgttccggatattcgtgccaagagagacagtgaaagcaaattcaatgtgacacgtttcaaagtattgacctgccgtttaccgggaaatcaatatgaggtagtgacgctggacggacaaacgggacaccctataccgaatgcgaaaataactctttatacgaatgacgaaaaagtattgcaggaatatataactggggcagatggcaaagttgtcttcccctggaaatccgaatacagatatttgaaagctgctaaaggtatcgataccgatatgccgtttcaaagcatttacggtggaagttatggatattacggagatgaaaacaaggtctccgaaggaatgactttgttgacggatcgttctttgtaccgtcctggtcagatcgtatatgtgaaaggaattgcctatgtacagaaatctgatacggcaaatgtacttccgaacaaggactatactgttgttttgatggatgcaaataatcaggaagttggacagaaagcggttcgtaccaatgaattcggctcgtttactgtcgattttgcattgccatccgcttgtctgaatgggatgttttcgttgaaagccggcgagggaagaacgaatattcgcgtggaggactataaacgtccgacgtttgatattactttcgacaagcagcagggcagttatcaattgggcgataaggtagaggtgaaaggtaagatacagtcttatagcggtgtgttgctgcaagaccttccggtaaaatatacagtgaagcgttctgttgtcgatctttggagactggcggaaagtacgcagattgcttccggtgaggtaattgccaatgaggacggggaatttacgattccggttcttctggaagaaaataatgcctataagaataataccagaatctattaccgctactcgatagaggctactgcaaccaatgtagcaggtgaaacacagtcgtctacagatgtgatagcagcaggtaaccgttcactgattctacaaacagaattaaaagagaagacctgtaagaatcaaccgtttaacactgtatttaaggtacagaatctgaatgggcagcctgttgaagtaaaaggtacattctccctctatcaggcgaaagatgcggacttcaagcaactggacgagaatccggctgcaacaggtacatttacttccaacgaagaaatgacgattgagtggggaaaccttccttccggaccgtatgtgttgaaagctgtcgtaaaagatggacagggcaaagaagtgacggctgaggccaacaccattcttttctcccgcgaagataaccgtccgccggtagaaacgaccgtttggttctatgaggcaaatacggaatttgatgcaacgcatccggccgtgttctgcttcggaacttcgaaaaaagatgcttatgtgatgatgaatgtattctccggtaataagttgctggaaagcaagactatgaatctgtccgacacaattgtacattttaaatatccatatcaggaaagctatggtgacggagtactggtaagtttctgtatggtaagagacggacaagtctatcaggaacaggcaaggctgaaaaagcgtctgccggacaagacattgaccatgaaatgggaagtattccgtgataagctgcgtcccggacagaaagaagaatggaaactgactattaagacaccgcagggacaggctgccgaggcagaaatgctagcaactatgtacgatgcttcgctggataagatatggaataaaaaacagaatttcagtgtattctataatcagatcatcccttattctagttggatgggcggatatttcggtaataattcgttcaattactggtggaataataaatacttcaaagtaccgacaatggaatatgactattttgtgacgcagggaacgatgtcgatggaccaggcgttgaatggaatggtgccgggagtgatggtcagaggatatggcgtgcaaaagcaggcctcaatgacgggcagtatgatgatacggggcgtttcgagaagcaaggcggaagcaaaatatgtacctgctttggctggaagtgttgctgaggatgcggtatttgaatcagagttagtgtcagtagaggcaggcaagctggacggcgcatccgaagaagaaactcttcccgaagctcccgccgatttgcgtacgaaccttgcggaaacagccttcttctacccacaacttcgtaccaatgaacaaggcgaagtttccttctccttcactatgcccgaaagtctgacccgctggaacttccgcggttactctcataccaaaggtatgctgatgggcacactggacggtgaagccactacaagcaaagaatttatgctgactcctaatctacctcgtttcgtacgtgccggagataagacatctgttgccgcctccatttccaacatgaccggaaagccgcaggccggtacggtgagcatgattctctttgatccgatgacggaaaaggtaatcagcacacaaaaacagaagtttaccgtagaggccggaaagacaatcggcgtcagcttcatgtttaccgtgagtgataaatacgagatactgggatgccggatgatagccgacagcggtaccttcagtgatggtgaacagcagctacttcccgtgcttagtaataaagagcatctggtagaaacgcttccgatgcctgtccgtggagaagaaacacgtactttctctctcgacagcctgttcaatcatcatagtaagacggcaaccgaccgtaaactaaccgttgaatttaccggaaatcctgcctggtatgctattcaggcattgccttcattgagccttccgggaaataataatgccatttcgtgggctaccgcttactacgcaaatacactggcttcctacatcatgaacagccagccacgtattaaagctgtattcgatagctggaagctacagggtggaaccaaagaaaccttcctgagcaacctgcaaaagaatcaggaagtgaagaatatcctgttatccgaatctccgtgggtactcgaagcgcaaacggaagaacagcagaaagaacgtatcgccactctgttcgatctgaacaatatccgtagtaacaacattgccgcattgacaagattacaggagttgcagaattcaagcggagcatggtcgtggtataaaggtatgaccggtagccgttacgtcactacctacattgccgaattgaatgcccgcctggctatgatgacaggtgagcaaccaagcggcacggcgcttgccttgcagaagaatgcctttacctatctccatcaggaagctctgaaggaatatagagaaattctcaaagcacagaaagacggggtgaagtttacaggtgtttccggaagtatcctgcaatatctgtatctgatcgctctgtccggcgaacaagttccggcttccaataaagccgcctatacttattatctgtccaagataggcgaaatgcttccgaccgcttcgatggatacgaaagcgattgccgctatcattctggataaggccggacggaagaaagaagctcaggagttcatcgcttcactgaaagaacatctgacgaagacggacgaacagggaatgttctttgccttcaatgaaaatccctattcctggggcggaatgaaaatgcaggctcatgtagacgtgatggaagcactggaactgacaggcggaaataacgataccgtagaagaaatgaaactctggctgctcaaacagaagcagacccaacagtggaattctccggtagctactgccgatgccgtctatgccttactgatgaaaggcgtaaacctgctcgacaatcagggagacgtgcgtattgtcattgccaatgaggtgctggagactgtctctccaagcaagactaccgtaccgggactgggctatatcaaacgctcgtttacacagaagaatgtagtggacgcccgtaagatagaagtcgaaaagagaaatccgggcattgcgtggggagccgtttatgcggaatatgaatcacccatcaaggatgtgagacaacagggaggagaactgaatgtgcaaaagcaactgtatgtggaacgtatggtgaacaatgctcctcaactacagcctattacagaaaagaccgttcttcaggtaggcgataaagtagtttcccgtttgagtattcgtgcagaccgtgcgatggacttcgtacagttgaaagatcagcggggcgcctgcttcgaaccgatcggcagcgtatccggttacaactggagtaatggaatcggctattacgtagacatcaaggatgcttccaccaatttcttctttgaccatttaggaaaaggagtgtatgtgttggagcatagctatcgtatcagcagagtaggaacctatgagacaggtttggcaaccatgcaatgcgcctatgcgccggaatacgcttcacactcggcttcgatgacaattattattaaataacgcacagagaagatttcttctccaccggtgagcagggcactcgccaccgataaggaaggtgttccccaccgatgaaggttaccttcatcggtggggaactttttgttgatgaatactgcgttgcaggagttgtcacagggtaaagtattttctcaaacggtgttaatctatgtaatctgtgatgaaaaactcatctaaaactcctacatttgtggaccaaaataaaatatatcacatgaaacgtactttactattgatatttactctgcttactgtcactttggcggctgttgcccaaccccgtatttcctctaacaaggagacgcacaactttggacaaatagaatggaaaaagccggtaacagtagaatataccatcaccaataccggaaacgagccgttggtgctgaccaatgtcacgacttcctgtgcctgtgccgtagccgactggacaaaggaacccattgctccgggtgccaaaggaactgtgaaagcctcttttgacgcgaaagcgctgggacgttttgacaagtcgataggcatatacagcaatgccactccgaatctggtttatctgaaattcaccggtgaggtagtgcaggaaatcaaagattattcaaaacttcttccgtacgccatcggcaatatccgcattgaccgtgacgagttctccttccccgatgtctatcgcggacagcaaccgtctatgacgttcagtattgccaacctttccgaccgcccgtacgaaccggtgttgatgcacctgcctccttatctgaagatggaagcggaacctaaagtactgctgaaaggtaaaaaaggaacgatcaagctgacactggatgccagccagctacaggacttcggactgacacagacctctgtctacctgtcccgtttctccggtgataaagtgagtgaagacaatgagatacccgtttcggccattcttcttcccgatttctcgcgtatgacggagaaagattctttgaatgctccttccatccacatctcggagacgaatattgacctgagtattccgttgatcaagaagaataaagtcagccatgatatattgatcgctaatgcgggaaagaccccgttagtcatcagcaagctacaggtattcaactcttctgtaggagtaagactgaaaaagacggtcattccgccggacggaatgactaagttgaaagtgacgatccacaagcgggatgtaggtaataagaaacatcatttacgtatcttgatgattacaaacgacccgttgcgtccgaaagttgaaataaatatcaaacgctaactcttattgccatggaacatcctgaaaataacgaagaatataaaggactcgttgtcaataaaggcatcgaacagccctcatccgtgaatccttatttgaaacgtaagcccaaaaagcgtcagctttcggtagcggaatttgtagaaggtattgtgaaaggcgatgtcactattctcagtcaggctgtgacactggtagagagcgtgaagcccgaacatcaggctgtcgcccaggaagtgatcgagaaatgtctgccttattccggcaattccatccgtgtaggtatcagtggagtgcccggtgcgggaaagagtacctcgattgacgtattcggtctgcatgtgctcgaaaaaggcggtaagttggcggtgctggctatcgacccgagcagtgagcgtagtaaaggcagtatcctgggagacaagacacgtatggaacaactttccgtacatccccaatcgtttatccgccccagcccctcagctggttcgttgggaggagttgcccggaagacccgtgaaacgattgtgctttgtgaggctgccggattcgataaaatctttgtggaaaccgtcggagtgggacagagcgaaacggctgttcattctatggtggatttcttcctgctgattcagttggcaggtacgggagatgaattgcaaggcatcaaacgaggaatcatggagatggcggacggtattgtcatcaacaaagccgacggagataatctggaacctgccaagttggctgccagtcagttccgtaatgcgctgcatctgtttccggctcccgaatcgggatggattccgaaggtgctgacttactccggtttttataatatcggcgtgaaggaaatctgggacatggtgtatgaatatatcgacttcgtgaagaagaacggttattttgactatcgccgtaatgaacagagcaagtactggatgtacgaaacgatcaatgaacagctccgtgatagcttctatcacaatcctcggattgaagcgatgcttcaggagaaggaacaacaagtgctgcagggaaatcttacttcgtttatcgctgctaagagcctgctggatacctattttgacgaattaaaacgatgataaagcagaaacagtgatggattagaaaaacgaccgaacatttacccccgataactataccctaattaataaccaattgttaactttaacacctgatgaacaaaaccttattaaccgggcttttgtgttgtagtttgtcaatacagagctttgcagaccaaccgttagaaggattcacctatggttcggtgaatgctcctacaggaaaagagtgggaatctcccgaaaacctggcgctcaacaaagagcagccgcatgcttatttctttccgttccagcatttggataatgcccgcaaggtattgccggaaaacagtaagtattggcagtcacttgacggtgactggaagtttcactgggcacccgaccccgactcccgccccaaagatttctatcagactgagtatgatgtcagctcatgggatgcgattcccgtgccttcaagctggaatatttatggcattcaaaaggacggaagccagaagtacggaacgcctatctacgtcaaccaaccggtaatcttccagcacagcgtgaaggtggatgactggcgcggaggcgtgatgcgtactcctcctgccaactggactacttacaaggatcggaacgaagtaggttccttccgccgtgatttcgaaatcccgcaggactgggacggacgcgaagtctttatcagcttcgatggtgtcgattcattcttctatctgtggatcaacggtcagtacgtaggtttttccaagaattcgcgtaataccgctaatttcaatatcactccctatttacagaaaggcaagaacaccgtagccgccgaagtgtatcgtagttcggacggttccttcctcgaagcgcaggatatgttccgtctgccgggcatcttccgtacggttgccttgtactcggttcccaaagttcatttccgtgacttggttgccacacccgatttggatgcgacttatacggacggttctctgactgtcaatgccgaaatccgtaatctggataagaaagccatcaaagactacaaggtatattactctttatatgccaacaaactgtattctgatgagaataccttggtagatggattcttatctcctgtgatcgacaaaatcgctccgaatgaaaccggtagtgttcagactgttcttaaggtaaaggctcctaataagtggtcggctgaatttccgtatcgctacacgttggtagccgaattgaaggataagaagaacagaaccgttgaaatggtttccaccattgtcggtttccgcaaagtggagattaaggatactcctgcttccgaagatgaattcggacttgccggacgttattattatgtgaacggaaagacggtcaaactgaaaggggtgaaccgacatgaatccaatccgggagtagggcacgccataacccgtgagatgatggagaaagagattatgttgatgaagcgtgccaacatcaatcatgtacgtaattcacattatccggatgatccgtattggtatttcctgtgcaacaaatacggtatttatctcgaagatgaggcgaatatagaatcgcacgaatattattatggtgctgcctccctctctcatccggtggaatggaaaaatgcgcacgtggcacgtgtgatggaaatggtgcgtgccaatgtcaacaatccttctatcgttatctggtcgttgggcaatgaagccggaccgggcaagaactttgtggcggcttatgatgctttgaagaagtttgatacttcccgtcctgtgcaatatgagcgtaataatgacattgtagatatgggttccaaccaatatccgtctatcggctgggtacgtggggccgtgcaggggaaatatgatatcaagtatccgttccatatatccgaatatgcccattcaatggggaatgcctgcggtaatctgatagattactgggaagctatggagtcgaccaatttcttctgtggaggtgccatttgggattgggtagaccagtctatgtacaattatgacccgaagacaggtgtccgttatctggcttacggcggagactttggcgatactcccaatgatggtcagtttgtaatgaacggcatcgtgtttggtgaccttgaaccgaagcctcagtactatgaagtgaaaaaggtatatcagcacatcggcgtaaaggcaatagatacagaaaagggggtatttgagatcttcaataagtactactttaagaacttggcggaagattaccagttggtatattcgctttatgaagacggtaaaccgataatgaccggtaaaccgatggatatcaatatagctccacgccaacgtgcacagatcactctgccgtatgatcatgcctctcttaagaaagatgctgagtactttatgaaactacagtttatactgaaagatcaaagaccttgggctgccaaaggctttccgatggcagaggaacagattttgataaaggaggctacagaccgcccgtccatcagtgaagtaactgccggtgcagcaaaactggatggattcgtactggacaaggatacgaagcgcatccttataaagggagctgactttgaagccatatttgacccgcaaaccggaagtatctacagtctgaagtatggcaacgagactgttatcgccgatggcaacggtccgaagctcgatgctctccgtgcttttacaaacaatgataactggttctatgccccctggttcgaacatggtttgcacaatctgattcataaagcaactgaatataaagtactgaataaaggcaatggcactttggtattgagttttacggtagaatctcaggcaccgaatgccgcacgcattaagggtggtacaagctccggtaagaatagcatcgaagaactgaccgacagaaaattcggtagcaatgactttaaatttgtcactaaccagatatggacagtgtatccggacggttctatcgaattgcagtccagcattacttccaatcgttcgagtttggttctgccacgtttgggttatgtgatgaaagttccacaacaatacagtaacttcacttactatggacgcggaccgatagataactatgccgaccgtaagagcggacagtttatcgaacagtatacgaatagcgtagcaggtgagttcgtaaacttcccgaaacctcaggatatgggcaatcacgaagatgttcgctggtgtgcattgaccaatcaggcagggaatggagctgtcttcgtagctaccgaccgtctttcggcttcggcacttcagtactcggctctcgacttgattttggcttcccatccttatcagttgccgaaggcaggcgatacctatctgcatttggattgtgcagtgaccggtctgggtggtaacagttgtggtcagggagctcctctcgtacacgaccgtgtgtttgccaaccagcacagcatgggattcatcattcgtcctgccgataaggaactgagtgtcgttgccaatgttgctcctgcgggagatcttcctctgtctatcacacgcacccctgccggaatggtcgaattgacttcggcaaagaaagatgctgtcatttgttatagcattgacggaagtaaaaaagtgcaggaatacacagagcctgtccctatgcgtaacggaggtacgatcaaggcatggtataaggatagtaaggatatcagcagcacgatgaagtttgagaaaatagaaagcattcagacgcaagtcgtatacgccagtagtcaggaatcgggtgaaggcgatgcttctcatctgactgatggtgatccgaataccatctggcataccatgtattcggtgacagttgccaaatacccgcattgggtagatttggatgccggtgaagtcaaggaaatcaaaggctttacttacctgccacgacagaatggaggaaacggtaatatcaaggattactctattcaggtcagcatggatggaaaagaatggggagagcctgttaataaaggaacgttcgcaagggactccaaagaaaagagagtcttgtttgacaaaccggtgaaggcacgttatatccgtttcacggctttaagcgaacagaacggacaggattttgcgtccggtgcggagataacgattctggctaactaaagatagctgaatatatagaagaaaagtatcaatgggaatgtgtccccccttctaaatttatgagggtttcgacacatccccattgatgcttttctctattttatcggtatgaggaaacttctacaactcctttcccgccttctcaaaatccgccttagacttactctgcgtcacaatatacacacccagaaacacaagtgtaatggcgattcctttttcccagccgaagctcccgattcccatgaggattgctgcaatcgtagccacaatcggctgcatatagttatacatacttaccactgtagggcggagtaacttctgagctgtcatgatgcagagataagcaaggaaacttcctcccagtacgacatacaatacctgcaaaatggcaaccattggaatgctggtccattgaatgaccgaaatatcttgataagagaaaggaatataacacatcgaagcatagataaacatccatttattgatggttactgccgaatatcgctgagacagccccttgaacaccgtcagatagatggagaaactgatttgcgcaaccagacaaagcaagtcgccgatcagacttccgttaccactactcgctgcctgactgctcataataaggataagcgctcccatagctcccacgaaaatacccagtactttcttgttcgtaatcggctctttcagatagatggctgccacaatcatggtaactatcggcagagtagtcgttacgatagaagcatcaataggcgaagtcatcgaaagcccgaagataaatatcccctgattgaaaaccagagcaaagagggaagcaaagaaaatcttcagcatatcgcggtggtccacatgctcctgtttgcagaagatggaaagtatccagaatgccgctgccgcacctaccatacgaaacgtggtgacggagatagctgaaaactcttgaagtgccgatttgccgataggagacatcagtccccacataacgtttgccgtgagtgcaaacagatgtccgtgcagattcttgttattgcccataagtctgtgtataccttttaattgttacctttattgaaaactgctgcaaaggtaaccaatttgtcacatgatttgtttatatttgccttgattaaaattgaatattatggaacaacaggcagactatatccggcggatcgagatcaaaggactctgggcccgctttaatatacaatgggatttgcgtccggatgtgaatatcctttccggcatcaacggagtgggaaagaccactattctgaaccgttcggtgggatacctcgaacagctttccggcgacatacagctctccggtgaaatgaaaagcgacgcaaagaacggagtacacctcttctttgataatcccgcagcgacttatatcccatacgatgtgatccgcagctacgaccgccccttgattatgggtgacttcacggcacgcatggcagacaagaacgtgaagtccgaactggactggcaactgtatctgttgcagcgccgctatctcgattatcaggtcaatatcggcaataagatgatcgaaatgctttccagcaatgacgaggaacagcgcagcaaagccgccaccctctcccttgccaaacgtcgttttcaggatatgattgacgaacttttcagctacacccgcaaaaagatagaccgccgtcggaatgacatagccttctatcaggacggagaattgctgtttccatacaaactctcgtccggtgaaaagcaaatgctcgtgattctgctgacagtgctcgtgcaggacaacagccactgtgtccttttcatggacgaaccggaagcctccctgcacatcgaatggcaacagaaactgatttcaatgatccgagaactgaatcccaatgtgcaaatcattctgaccacccattcgcctgccgtcatcatggagggctggctagatgcagtgacagaggtgagcgatatttccaccgaagcggacggattcagactccccccgactattaattgttaatgacaacttctacatggcaacttcactacgcgataatctgacttcttcttacttcaatgctgcccacaagctgtattccaaaaaggctcgccggcgcatcattgcttacgtagagagctatgatgatgttgctttctggcgcacattactcgaagagtttgaagatgacgagcattattttcaagtgatgctcccttcggccacctcattggcaaaggggaagaagatggtactcatgaacacgctgaataccgccgaactgggcagaagtctgattgcctgtgtcgacagtgactatgatttcctgttgcagggagccacgaacacttcccgaaagatcaaccggaacaagtacatattccaaacctacacatacgctatcgaaaactatcactgctttgccgaaagtcttcacgaagtatgtgtgcaggccacattgaacgaccgttttatactggatttcaacgcttatctgaaacggtattcggaaatcgtatacccgcttttcctgtggaacgtgtggttttatcgtcaacgggatacgtatactttcccgatgtacgacttccatacttatactgccttgagggagatcagtctgaaacatccggaacacagtctggaagcactgcaacaccgagttaatcagaaacttgctgaactgaaaaaacgcttccccggttctgtcaaccaagtgaacggattgcggtcggaattaaaggaactgggactcgtccccgaaaccacctatttatatatgcagggacatcacgtgatggataatgtcgtgatgaaacttctgattcccgtctgtaccgccctgcgccgggaacgggaacaggaaattaaacgactggcggaacataatgaacaattcaggaatgaattgacttgttatcagaacagccaggtgaatgtcgaaatcatgttgaagaagaacgtcgcctataagcgactcttccactacgactggctgaggcaggacattcaggaatatctggccaaaggagaatgaataaaagggaactaactaataagggaataaactaaaagagatactattttatgaaagaagtgattgatacagtgagtgtggcattggcaaatggagatacggagaatgttggcaatgtcgtgatgcaggaggtcaaccgtacgttgctctcggcaggtgtggatgaagtatgggcggacaaaatagataatctgatcgtattgctgtttattatcggaatagccttgttggctaacataatctgccgtaaaatcattttacgggtggtagccaagttggtgaagcagaccaaagctacctgggacgacattgtattcaaccataaagtgatggtgaatgtcagccggatggtagcgcctatcctgatttatatcgccattcctatcgcattccccgagcatgcggattctgatttgctcgattttctgaggcgtctctgtctgatatatatcattgccgtttttcttcgtttcatcagcgctttgtttacggctgtctatcaagtctacagtgagcgggagcagtatcgggacaaaccgttgaaaggacttttgcagacggcgcaagtgattcttttctttataggagccatcattattataagcattctgatcaatcagagcccgatggtcttgctgaccggattgggagcgtctgccgctattctgatgttggttttcaaagatagtatcatgggatttgtatccggtattcagctttctgccaacaatatgctgaaggtgggcgactggatcaccatgccgaaatatggtgcggacggtacagtgatagaagtaacgctgaataccgtgaaggtgcgtaatttcgataatacgattacgaccattcctccttacctgctgatcagcgattcttttcagaactggcagggaatgcaggagtccggcggacgccgggtgaagcgttccattaatatcgatatgacaagcgtgcgcttttgtactcccgaaatgctggaaaaatatcgcaagatacagttgctggcaaattacgtagatgaaacggagaaagtggtagaagaatataataaggagcatgatattgataattccgtgttggtgaacgggcggaggcagaccaatctgggagtttttcgtgcctatctgaccaattatttgcgaagcctgcccactgttaatcaggatatgacctgtatggtacgccagcttcagcctacagaaaccggcattccgctggaactttatttcttttctgccaacaaagtatgggttgcttacgaaggcatacaggcagacgtgttcgaccatgtacttgccatcattccggagttcggcctgcgcgtctttcagaatccgtcgggtgaagacctgcgacggataggagtgaagatagaacactgatttaaaagatagaatactatatattttaagaacgatacatactgttaaccattattgattatgaacacacctatacccaatcagattatccgtgaaattacacctttgtccgacaaagactgtttctatattgcagaacgttataagacggagtttacctatccgattcataaccattctgaatttgaactgaactttacggaaaaggccgccggagtcaggcgtgtagtgggagattcctccgaagtgataggagattatgatctggttctgattacgggcaaagacttggaacacgtatgggaacagaatgaatgccgctccaaagagatacgggagatcaccatccaattctcttccgacctgttcttcaagagctttatcaataagaaccagttcgactctatccgccggatgctggataaagctcagaaaggactttgtttcccgatgtccgccatacttaagatatatccgttgctggatacgcttgcttccgagaaacaagggttctatgcggtgatcaagtttatgacgatcctgtatgaactttctctctttgaggaagaggcccggacactgtccagttcttcttttgccaagattgatgttcattccgatagccgccgggtacagaaggtgcaggaatatatcaatctccattatcaggaagaaatccgattgggacagttggcaagcatggtcgggatgactgatgtgtcattcagccgtttctttaagttgcgtacggggaagaacctttccgattatattattgatatccgactgggattcgcttcgcggttgctggtagattctacgatgtctatcgcagaaatctgttatgagtgcggattcaataacctgtctaattttaatcgtatctttaagaagaaaaaagattgttctccgaaggagtttcgcgagaactaccggaagaaaaagaaactgatctaatttctctgtctcctcgcatactttactagtctgtttctctattagggctgactaataattagcttagaatcgtgttgaatttagagtcttgtttcctaagatttattcttcggggggctgacatctattctccgttaggtacaaaactaatcgtctgacagttgttgttttttcgtctgacaactgtcagacgaaaaaacaacaactgtcagacgaaagtttaactatagtcagacgattaattctgtgcatgacgggagataaattcttttgatatgcggattaaatcttacgtagaagaggactaaacctcattggtaagcggattgaaacagtgtggtaagtcattgataacaagtttgtaacacgatgtaacaaacctgaaacggctatttcaaaccattgtatctgattcgtattcatattgtaatctcttgggtctacctttgccgacgtaataaaaacgtagagcgaagttcgatgaaaaaactatttcttttaagattttcagttgcagccttcttttgtttgttgtgtgttcttcccgcattggctgccaatattaagattaaaggtgctgtgaaagataaactttccaaagagcctttgattggagcaacgatacggttggtaggaactcctgccggagccgtgaccgatatggacggtaattttgaattgaacagtaccggtgttttggaaggtttgtatgatatagagattaaatatgtaggatataaaacggaagtacgtcgtaaggtccgtgtagaaaacggaaaactggcgattctgaatctggagttggagacagatgcgcacgaactttcggacgttgtggtggtagcaaagaagaatcgtgaaaatgagaatatgttattgctcgaacagcagaaggcggtcattgccgtgcaggctgtcagcgtcaaagagctttcacgcaaaggtgtttccgatgcggaaggggctgtaaccaaagtggcgggagtctccaaacaggatggagtgaagaatgttttcgtccgtggactgggcgaccgctataatgcgactacctttaacggatttgccgttccttcggaagatccggaatataagaatatctctctcgacttcttcggaacggatattatccagtctgttggcgtcaataaggcatttaatgcaggaggtatcagtgatgtcggcggtgcgacaatcgacattgtttccaaagaactgattggcagcggaaacctgaatatcggcctttccggaggactgaacacgcagactgtgacagcagactttctgaagcaggacggagtaaaccttctgggcttcgccactacaacagaacccgccgatgagaacaactggggattcaagaataagctggccccctccaagcagagcttgcagataaaccggagttatagcatttccggcggaaagcggtttcatataggaaaagacaggaatccgctctctttctttctcactgccggacataccactgattatcaatttacggatgaaaccatccgcaacacaacgacgagcggtacgatctacaaagatatgacaggcaagaagtacaccgagaatatcagccaactggcactggccaatgtggattatgatatgcagaaccgtcaccacatgagttataacttcatgatgattcatgccaatgtgcaatccgtaggagactataccggtaaaaactccatcttcagtgacgattatgataatcagggatttacccgtcgccagcaagcgaatgacaacttactaatcgttaaccagctgatgactaactggggactgaccaaaacattgagtctggatgccggtgcttcttataatatcgtgaaaggcaatgaacccgaccgccgaatcaacaacataaccaaagcggaagaaggatataccttactcagaggcaactcccagcaacggtatttctccactttggacgaagatgacatcaacgtaaaggcaggactcatctaccgtctgaaagataacgtagaagaaatctctaatatacgcttgggctatacaggccgatttgtagacgacaatttcaaggcgactgaatacaacctcacagtaggacacgcttcttccatcccctcattggataatttctcactcgacgattattataatcagcagaatctctcttccggatggtttaccgttcagaagaacatcgataagtattcggtcgccaagaatatccattccgcttatgcggaagccacctaccagtttactccccgttggattgtaaatgtaggaatgaagtatgacaatgtggatattcaggtagactacaatgtgaataaaggcggatcggaaggaagcaacacgattcaaaaggatttctttctcccgagtctgaatctgaaatacaatctgagtgaaaaacattccttgcgtctcggagcgagcaaaacatatacgctgccgcaagcaaaggaaatttctccttatcgctacgtaggtgtgaatttcaacagtcaggagaatgcgaacctgaagccttcggacaactataacgtcgatttgaaatgggactttaatcctacccccactgaactgatctctctgacagctttttataagctcatcaagaatccgatctcacgcattgaagtggcaagtgccggaggatacctttcgtatgaaaatatagccgataaggcaacagtggccggagtggaagtagaagtacgtaagaatctgtttgtccgtccgctaagcagtgcggcaaacggaatgaataagctctctttcggcttgaatggatcgtacatttatacaaatgcgaaaatgcctctggcaacggttaccaccggatcgcaactggaaggggccgctccctggattgccaatttcgacttgtcccacaacttcacgaaaggaactcatagcttcatcaatacattggtattcaactatgtcagcgataagatttataccatcggtacgcaaggctaccaagacatcatggagcagggaatgatgacgcttgacttcgtttcgcaagccaaactcaacaagtatgtctcacttacgctgaaagcccgcaatctgctgaatccctcttatcagttgagtcgcaaagccaacgaaagcggagagaaggtagtactcagcgattataaaaaaggaataaatatcagtctgggagtgtcgtgcacattttaaaccggataatgaaataagattattaactaattattaaagcaaaatgaaaagattgtttgtaaactttatgacgtttgccgctatggcaactgcactgacattcactgcgtgtagtagtgatagtgacggagatgacaatggaaacggtaacggtggaaatggcggaggaacaggtagttctatcgtggtaggcgaaaacatcctgtccggaacactgaccggtgaacagacactggatgccaaagaatacattctgaacggaacggttatcatcgccgacggcggtcgcctgaatatccctgccggaactaccatcaaggcgcgtgaaggtttcagcagttacctgctggtagcgcagggaggtaaactctatgccgatggtacggccgacaaaccaatcgtctttacggcaaataccaccagcccggtatccggatattggggtggcgtgatcatcaatggtaaagcacctatttccggttcaaagaccgacaagagcgatacggcactgacggaaatcaacaatgactataaatacggcggcagcgcagctgatgacaactccggttcgttgacttacgtgaaaatctgctatgcaggtgcacgctccacagcagacatcgaacacaacggactgaccttgaacggtgtcggcaacggaacaaagattgaaaatatctacgtactggaaagtgccgacgatgcaatcgagttctttggtggaacagtaaatgtaaccaatctgctggctgttaatccggatgatgatatgttcgactttacacaaggctattgcggtacgctgaagaactgctatggcgtttgggaaagcgactacacaagtacggaagccgatcctcgcggcatcgaagccgacggtaacatggacggtctgtatccggatcacctgcgtcagtctgactttaaggtggaaaacatgactatcgtgaataatgctgccaacactgccgataacgtagaccgtatgcaggatgtaatcaagattcgtcgcggagcaaaagctaccatcaccaatgcattggttaagggtacgggtggtgctatcgacctggttgatatgaaagacagcaaaggtgcaggaaacatagaatccagcattaacatcacaagtacattaagtctcacaggattgaagcagaacggcgaactgaatacatttgtcgaatcggcagacaatacaggtgcagacgcttctctgttcggctggacaggctataatttatcagcattctgatgaagtagccaacggttctttttcacagtaggtattacttttcgggcacggattgcacgaattgcacggttatgatttactaaaaccgtgtaatccgcgtaatccgtgccaaatcatataataatgagatgcgtttattacgcttttacctccctggctatccctgctactatcctctctcttctattatgaattatttcagatattatatgtttcgctgattttctttttcgtatatttgctattcattattatacgatcaatcacttatgcaaacaaactacgagcgatactgtaaaatgtcttctttggctcagataggatggtgggaagcggactttttggctgggcattatgtctgctctgattttctttgtgatcttttgggactggaaggagataccatctctttcatggatttccagaatttgatacgtgaggattaccgcgaacagatagtacaggaatttcgggccaatgcaaatatccataaagacttttatgaacaaacctttcccatctgtttaaaaaatggtgaagtttggctgcatacccgtctggctcttcgtgagaaaggtaccggaaccaatggaggtgacaaatcttttggcgtcatccagcgtgttgaggcgcctaaagaagtggaacagaaaaataccctccggcgtgtaaacgacctgttacgccggcaaaactatatatcacagtctttgcttcgcttcctccatgatgacgatgtagattcttgtattatggagatattgaatgacgtgctgagcctctatcaaggcggtcgtgtgtatatctttgagtataacgaagactatacgcatcatagttgcacgtatgaagtcgtttcggaaggtgtttccaaagagaaaaacaagcagcagtccattccggttaatgaaacccgatggtggtgtgagcagattctatctggcaaacccatcatactgacttccttgaaacagttgcccgaagaagcggagaatgaatataaattccttgacgctcaaggtatttgttcgttgatggtcgctcctttgatggcaggtgaccgtgtatggggatttatgggtatagatctggtcgaatcgtatcgtgaatggagcaatgaggattttcaatggttctcttcattggcgaatatcatcagtatttgcatcgaattgcgcaaggccaaagatcgtgttgtccgcgaacagtcttttttaagcaatctgttccattttatgccgttaggttatatacggatgtctgtcgtccgtgatgaaaacggtcagcttcttgattataagataacggatgtcaacaaggcctgttcccgcttctttgcccgacctgccgaaacgtatataggagtcttggcctctgaaatatatccggatttttcttcacagctcctctttctgaaagaagtgctggataacaattcatacagggaaaaggatatctttttcccgcagacagagctttatacccattggatagtttattctccggaaaaagatgaagtggtaggtctgtttacagattccacggaggccgtgaagaccaatagggcactggaccgtagtgagaagctttttaagagtatctttgccaatatcccggcaggagtggaaatctatgataaggatggattcctgattgacctgaataataaggatctggaaatattcggtgtagaaaataaacaggatgtgataggagtcaacttctttgagaatccgaacgtaccgcagcatatccgtgaccgtgtgcgggatgaagatttggtagacttccgtctgaattactcttttgaacgggcagaaggttattatcaccccgatcgtcgggatacgatagatatatatacgaaagtcagcaagctctatgataacgaaggaaactttaacggctatatcctgattagcattgataatacggagcagattgatgcgatgaaccgtattcgtgattttgagaatttcttcctgctcatatcggattatgcaaaggtgggatatgccaagttgaatctgctgaaccggaagggatatgccattaaacaatggtataaaaatttaggtgaagaagaggatactccattggcggacgtggtgggagtctatcgtaatatgcatcccgaagaccgtgaacgtatttttgatttctatcgggaggtcagaaaaggaaaccggaagcactttcagggagaaatgcgaatctaccgtcccggcaagaagaatgaatggaactggatacgtatgaatgtagtcgttacgacatacaatccggaggaaaacgaagtggaaatcatcggtatcaactatgatattaccgaactgaaggagacggagaaagaattgatcctggcacgtgacaaagccgaaatgatggaccgtctcaaaagtgctttccttgctaacatgagccacgaaatacgtactcctctgaatgccatcgtcggcttctccgacttgctcgtcgatacggaaaatatagaggaacgacgggagtatattcagattgtgaaggagaacaatgacctgcttttacaactgatttcggatatactcgacctgtctaagattgaagcgggtacatttgagtttaccaacggagatgtagacgtgaatatgctctgtgaagatattgtccgctccatgcaaatgaaggtgaaggagaatgtcgaactgatgttcgatccgcatcttgcggaatgccgcattattagtgaccgtaaccgactgcaccaggtaatctccaattttgtgaacaatgcgattaagtttacctcggagggaagtatccgtgtgggatataagcagaaaggagaagaactggagttctatgtacaagatacgggagttggtattgacgcagagagtcaggcacatatttttgaacgttttgtgaagttgaactcctttgtacacggcacgggcctggggctctccatctgccaaagtattgtggaacaaatgggcggaaagataggggtggaatccgaaccgggaaagggttcgcgtttttggtttagccttccctgttttgtggtgatgtcggaagaatagacaagaatgatggggctgactaaaaagtcagccccaaagagtcggtttcttatattccgaatgatagtttatcgatagactgatatacgatacttgcaatacccagtccgatgatgcccagtgtgcagagcgccagtccccactttgtacagcggtcgctgcggaaagtcggaatcgggttatcggaaggcatgatatacattgcttttacaatcagcagatagtagtacaatgaaatcacggtattaaccagtgcaatgaataccagcaagtggaagcccgcttcgaaagctgccatgaaaataaagaacttcgagaagaatccggcaaacggaggaatacctgccagtgagaacagcgaaatagtcatcagaaaagccattttcgggttcgttttgtagagtcccgcataatcttcgagggtaaacttctgactgcgtaatgctacgatagtgatgacggcaaatactccgagattggcagcggcatatacaagtatgtaatataccatggcggtcattccctgtgccgttcctccgattacacccagcatgatatatcctgcctgcgaaatactggagaacgccatcagacgcttcagattctgctggcggatagcgaatatattggcgatggtgatagaagcgatagtcacccagtaaagtacttcttgccagtcatgtatcatcggtgcgaatactttgatcagaattgccatcagcacaaatgctgccgaacctttggagataacactcagataggcggtaaccgtactcggtgcaccttcgtaaacgtctgccgtccataaatggaacggaaccagagagagcttgaacgccataccggtaaagaagaatacaaaagccatgatttgcaacggatttccatcgatatgagcaggaagatcatcgaaatacagtgttcctgcggaaccgtaaatcattgacagaccaaacagtaacagtgcgctggagaaaagtgcggtaaggatatacttggcaccggcttcagcggagttatggcggtatttgtcgaaagcgatcaaggctgccatcgggatggaagctgtctccagtccgatgaagaacatcaggaagtgtccggcggaaatcatgagatacataccgaacagggtggagagtgtaagtacatagaactcaccttgcttgaatgaagtatcgtcgcgtttcatccattcgtgtgccatcaggaaaacaatcagcgtgcctatgttcaggattgatttgacaaccgtgtgcatgggtacatagtgatacataccgccaaaaatgtcggcagctgtgcctggaaccagattgatcgctgtatggatggccatcaggataactggcagcatggtgttcaaaacgggtctcgtccctttttgcttgtgtgcgtccggactcatgaagagatcggcaaggaacagcaatagtaaaactgctacgagcgacagctcttcccgcatatgtagaaattgtgaataatccatctttataaattaagaattaaagattaaaaaataaaggttatgggatgagttgtgagactacagggagtacactttcaccaatcatgtggcttacccagaaaggagccatacccagtccggctacacaaacgatgaggcagataacagctacccgttcatcccaggtcgcgtctgtcagcgcaagatgatgtttgttggtgcaggtaccgtacagaatcttgcctaccagacgcaggatatagactgccgtgatcacgatggatgaacaagcgatgatggtcagtgtacggtggaatacgtcgttgttctggaaagaacctacgaagatagtcatttcggcaatgaacccgcttaatcccggcaaaccgagattggcaagaccggcaatcacataacatacgctgaggaacggcattactttcattaatccggtaagctcgcggacatcacgtgtgtgtgtacgtccataaatcataccgatcagggcaaagaacaaggctgtcatcaatccgtgggaaagcatctgaagaatggctcctgtcgcagcagtctgattcagcatcagaatggcgaaaagtaccagtccgcagtgagaaacggaagagtaagcgttgatgtatttcaagtctgtctgtacgcaagcggagaatgctccgtaaacaacggagatacctgtcagtatcaggaatatccatgaaagttcgttagcggcttccggcatcagatacatggcgatacggaaacatccgtaacctcccagtttcatcagtactccggcgtgaagcatggatacagctgtcggggcggaagcgtgaccatcgggactccatgtgtggaacgggaaaagagcacccagcacaccgaacccgaggaaggtaagcgggaaccagatacattgctgtgcaaaaggaatattatgtagctgtgctatttccagcaggttcatggtggtagctcccgaaccgaaatagattccgagaataccgatcagcaggaaagcggaaccgcccatcagcataagggtcagcttcatggctgcatattctttacgtcccgaaccccatacaccgatcagcaggtacataggaatcagcgcgatttcgtagaacatgaacatggtgaataagtcgatggatataaagaatccgaagactcccatagacaacagtgtgaaccaaaggaaatattcttttgtcagaggctgcagacgccaggaggcgaaagtacctgtgaatacaataacggcagacaataacaacatggctaccgaaataccgtcaacgcctaccgagtaggagatgtgaagcggtgcataccagagtgtatccgcacggaatagcatttctgccgtgttgccggcactgcgttctcccaaatacataaaggtaagtacgacggaggcaatcagaagtgccgatgcgccggtaaccataaccccccgaatcgctttgattccccgtgctgcccaaagtccggcaagcatcagtaaggggatgagtacgaagattgataaaaaattcataattgaattattaagttttaagtattaattcgcagcgacttgttgcgcagcttaatatctaatacctgatagttaatacttgctatagaactaacagcaggataagcgccagcgctccgcaaaggaacacgtatgcgtattgctgtacctggccgctttgaagaccacgtatctcgtcgcttgtcgtattcgtagcccatgccaggaaattaaagaatccatccactacatgacggtcgaaccatgcgataggagtcgaaatgcaacggaagatgatcttatgcgtaataaactggtatatatcatcaatataaaaacgatgataagcagctgtccacaatccattgaaccgtttggcaagtgcattggcaacaggctgtttggcattcttatacatccatgtggcaatcccgatagaaataatcgcaattacaacgcttgtgacagctaccgacagatcgaggtgaatagagtaagactccccattcgaactgataaaatgtccgaaaggaatgaatcctgcaaggcaggtaacaaccgccagaaatatcaacggaaaagtcatagccaacggactctcatgcgggcgacaaggtgccgcttccaagtttccgtgcggtgtgctatgatccgaatgggagcttgcccggggcggctcggccccccagaagatgccgtagtagaggcggaacatatagaaggcggtcattgcggcgattactgtcatcacccaacccattgcagggctatattggaagcaggcagccaaaatctcatcttttgagaagaaaccggagaacggaggaataccggcaatggcgagacaggcaatcaggaatgtccagtgagtaataggcatgtatttgcgtagtcctcccatggctgacatttcgttggaatgtactgcatggataatgctgccggcacccaagaagagtaatgccttaaacatggcgtgtgtgaagaggtggaacatggaagccatatatcccagtcctccgtggtgcgggtccatagaagtacaaacgcccagtgctaccatcataaaaccaatctgtgaaatggtcgagaaggccagcacacgtttgatatccgattgtacgcaagccacgcttgctgcataaaaggcggtgaaagcacctacccaggcaatcatatgtaaggtgtccggtgcataagcaatgaaaagcgggaacatacgcgctaccagataaacgccggcaactaccatcgtagccgcatggatcaaggcactgacaggagtaggaccttccatggcatcgggcagccagatatgcaacgggaacatggcactctttccggcgccaccgataaacatcagtcccaaagccaatggaagcatggaagcgccgccactgatcaatgataccgtatccggtgtgaagccgaatgtgccaccgtagtatccgtaaatcagaataccgataaggaagcctaagtctgcaaagcgggtgacaatgaacgctttcttggaagcggcaatggcagcaggctttgtatagtaaaaaccgatcagcagataagaactgacacccaccagttcccagaaaagatacatctggaaaatgtttgtggcaaccaccagtcccagcatagacattgtaaacagggacaggaaggcgtaataacgttgaaagcctgtctcgcctttcatgtaaccgaaggagtagatatgcaccatcagtgacacggtagagatgacaatcagcatcatcacggatatgggatcgagcagaatgcccagatcaaatcgtaaagtctcggtgaaaggaagccacgtaaaattataaggtatcaacgtggcaaatgttccgtcttccaaacgaggggcggagaaatattggaaagccgtaacgtacgacagtactactactgctcccagtatcagcgtaccgatagcacccgctgtccgatgagacatccattttcctccgattcccagaatgaggaaggagaggaagggaagaaggagtattagaattgttagttccatacagtttattttaattacttgttttattattgttcatatttatcacgatatccatccgaatggaaattgggtcgtgccgctttggcactaccacttcagatcgtccagattgcggacttgaatgcttcggaggttgcggtaaatgttaatcatgatggcgatagctatagccgtttccgcagccgaaatagcgatggaaaagagtgcaaagaaatagccttccatgcctcccggaaagagaaaacggttgaacacggcgaagttgatgtccgtggcgttcagcattaactctacagaaatcaggatagccagcgtattacggcgggtaaagaacccatagattcctgcaaacatcatgatggtagaaactaccagataatattccatgtgtatcatatctgaaattattaggttttaagtaataagtattaattccttgcggttcattgcgcagcctaatacctgatacttaatagttaatacttacttatttatctctttcgggcgatcatgataccaccgatgatacaagccagcaataaaatactgattgcttcgaaaggcaatatataaccatatttgtcactgcttaataaagcattaccaatggtgtggatgtttatttccagcggaaccaggttggtcgtttgcaggaagttatgcttcagggtgataaacaagataatcgctaaaccggcaaccatcgtaaagagtcctgccagaaacctgcttcgtttcagtttctcggcgcggtcaccttctccactggtcagcaggatggagaatacataaaggacgacgataccaccggcataaaccataatctggacagaccccagaaatgtgtaacccagcaggaaatagatgccagccgtgccgaagagcacgaagagcagataggtggctgagcggacaatacgttgggtagtcaccgtcatgatggacattgcaataataaatgctgccaaaaagtagaatactactgtttcaagtgttgatcccatatctaaacttcttttttcttttcaattactttactaccggcatgattcagttgcagaacaagcttcgtccggtcaaagacggcatgttcgaagttctggtcgaacgtgatggcgtcatgcggacaagcgttgacacacagttggcagaacatacaagctccgaggtcatattcatattttgccaggattttcttcttcttgccgtcttcagtctcgatcgtttcgctggttacggtgattgtatcgttcggacaagctatctgacacaatccgcaggctacacagcggtgttcgttattctcattgtggggcattgccagtgtaccacggaaccggtcgaacattttcagctctttccggttttcaggatactgttcggttaccttcttacggaagtataccttgatactggttttcatacccgttgccagagtgctgataccatgtatcagtcctcccaaatacgtatatttttgatctttatattccataattcttattttagaagtggaagccaaaggcaacacaacatgccattaataataggtttaccatagaaattggaaccagatatttccattccagattcagaatctggtcgatacgcaggcgtgggaaagtccatttgatccacattaagaggaacacaacgaagaatgctttggcaaagaaccagatgaagccgggaatatagtccataacagcgttgaatccgtccaaaccgatgatatgcaatggcatccagcctcccaaaaagatggtagcggccacgctggctacgataaacagattcagatattccgccagataaaagaaaccgaagtgcataccggaatattccgtatgatatccggccgtcaattcactttccgcttcgggaaggtcgaacgggccacggttacattctgcatttccggcaatgagatagatgatgaaagcgataacggcaggaatatgtcctttgaagataaaccatccgtcagcctgtccttctacgatttcggagaactgcatggtgcccatcagtacgaccatcgtcatgatgctcatacccactgacaactcataactgatgatctgtgcgccgcttcgcatggcaccgatcagcgaaaacttgttgttactaccccaaccggcaagcagaatacctaccacaccgatgctggaagcagccagcaggaagaatacgcccacattaaaattcagaatttccgctcctttattaaaaggaatacaagcgaaagtgaggaacgaggcgataatcaccatgaatggagccagattgtagaggaagcggtcggcatccttcggagtgaaaatctccttggtcagcatcttgagtacgtcgcatatcacttgaatagaaccccatttaccgacacggttcggaccgaggcggcactggaagaaaccacagactttgcgttccatgtaaatcagtacgatagccagaatagcatatagtgcaacgatgcacacgccgacagctatgcactctataaagatggcccatccctccggcataacggagagcagcatctcatgtatccagtttgttactatactaaagtcgaacatatatattttaattat

SEQ ID NO: 85 - DNA, 32542 bp, Bacteroides thetaiotaomicron
gtattaggtattaaatattaggtataaagtagactgccttatccgcaaggttaatacttaatacctaatactcaatacctgtttttaatgtttaaaatgacggataccggtggtcaccatcgccataccgtgctcgttgcagtaagcaaaagtaagatcgtctttcaccgagccgcccggctggatgactgccgtaataccttctttgtctgctatttctacgcaatccgggaaggggaagaaagcatctgaagccattaccgcaccgttcagatcgaatccgaatgatttggctttttcaatcgcttgtttcaaggcgtctacccgtgaagtctgtcccacaccgcttgcaagaagctgtttgccttttgccagcacgatagcgtttgatttactgttcttaacgatcttgttggcaaacaacagatcttccacttcttccggagtaggagctttgtctgtcacagttctcagatcggcaaccgtttcaatattcatatctttgtcctgcaccaatacaccgttcaacaaagcacggaactgtttcttaggcagtttggcttctttgcgaaccaggatgatgcggttctttttctgtcccaaaatctcgagcgcgtctacgtcatagtccggcgcgataatcacttcgaagaatatcttgttgatctcttcagctgctgctttgtcaatcactccgttagtaatcaatacgcctccgaaagcggaaacgggatcaccggccaacgcgtctgtccatgcttccagtacagttggacgagaagccaggccgcaagcattattatgtttcaggatagcgaaagtcaaatcttcgtattcgtcgatcagatcgacggcagcattgatgtccagcaagttgttataagagatttccttaccgtgaatctgatcgaacatggcgtccagatttccgtagaaataacctttctgatgagggttttcaccgtaacggagttgcttctggttgtttaccgaacaacggaaagcagaaccttcgccggcatcgaaataattgaagatagctgagtcgtagtgagaagaaacggcaaacgcttcttttgccatccagcgacgttcttcgagtgaagaagtagcgccatgttccatcagcatatccagcaatggcttatattgtgcctgagaagccacgatgatgacatcgttatagttcttggcagcagcacgaatcaaagagattccacctatatcgattttttcaatgatgtctgcttcggatgcgccggaagctacggtagcttcaaacggatacaggtcgacaataaccaaatctatttcggggatttcatacttttcaatctgttgaatatcctgttccaggtcacgacggcaaaggatacctccgaaaatcttcggatgtaatgtcttcactctaccaccaaggatggaaggataagtggtcaaatcttccactgccttacagggatatcctagtgattcaataaactgacgagttccacctgttgagagaaactcgactccttcttcgtaaagtttggtaataatttcatccaaaccttccttatggtatacagataccaatgcagtttttattcttttagactctgacattgaattgcttattaagtatttgatgcgcaaagttacgaaatattgtttatcgtacgtaataaataaggtgtgaattaataaaaaaaagcgttgactgttcctgttggaaagtcaacgctccttcgcacatagagcttctaatcaaaatatattaccagatagacactcgtttatccttcgctacgaacataggatcatgttctgtgatattgaatgcttcgtaccagttctggatatgaggcaatgctccgtccacacgccattttcctaaagagtgaggatcgagtttggtcagtcggagaatctcttccgggcggatgtgtccggcccatacattagcataagcaaggaagaaacgttgttcgggagtaaatccgtcaacaacttccagcggtgctgtttccattgctttcttgaaagccgcgaaagaaacctgcaagccaccgtggtcggcaatgttctctcccaaagtaagttcaccgtttgcatgtacaccgggagccacttctatgctgtcaaagaagttaaccatcacttgagcacgttcctcgaactttttagcatcttcttctgtccaccagtctttcaggttaccatccttgtcgtattgacgaccctgatcgtcgaatccgtgagtcatttcatggccgattaccacaccgatagcaccatagttcatcgcatcgtcagcgttcatatcaaagaacggagcctgcaggatagcggctgggaaacagatttcgttggttgtcgggttatagtaagcatttactgtctgaggtgtcatcaaccattcgtccttgtcgaccggcttaccggctttcgcgatcatgtcattgaagtcccattggctggcacgctcgatatttgcccaataagagtcgtctttgatctccagagcagagtaatctttccatttatccgggtaaccgatctttacatggaaagtagccagtttctctaatgctttcacctttgtcggttcgctcatccattccagcgctttgatgcgttcgcccagagaagtctgcaaattcttcaccaatccaaccatacgttctttggcagcggcagggaagtatttctcgacatacatctgtcctactacttcacccaaagagccgtctacagtgcttaccgcacgtttccagcgaggctgcatttctttcttgccagacattgttctactatagaagtcgaagttttgtgctacgaaatcatcactaaggaaagaggctgcggcatcgatcagattccattgaagatagaacttctggtcttcaagaggcactgtattaataacatcggcaacttccttcatggctgcaggctgaccgatattcacttctttcaagtcattcagtcccgaagtagtgaaataagcatcccagttgaaagtagggaagttctttttcagcgtttccatatccatcttattatagttggcatgcggatcacgcaattctacttgtgaacgggcagctttggcaagacgtgtttcgatgttcatcacagccaccattgctttctgtgcggtagcttcgtcatagccggccaactggaacattttaacgaggtgctccttatatttatcgcggatactctttgtctgctcgtcattctccagatagtaatcacgctgtcccattccgagaccgccctgataggtctgaaccatgttcatagagctgttcatatcatccgcactaacaaacatggtaaagtaaggacgtattcctttcttctgactttcggcaatgtaagtgtaaatctcttctttatctttgagcgcatcgatagccgccatttcttctttgatcggagctgctccttctttgttcagcttcacgctgtccatagcgatgttataaagatcacccactttctgggcagcactgcccggagcgttgtctttctttgcagccagttctgcaatcagttctttcaactgttcgcggcttttctcgtgaagcatatcgaaagagccgaagcgtgaatactcgtctgtcagcggatgactttcaatccacccaccgcaggcatactgataaaaacttgtacccggcattgccgtggtatccagattagcaaggtcgataccggacgttagtacggcctctttcttgctattacatcctgttgtcataaggcatacggcaagaattggtaaatacttggttactttcatattatataataaattagtttttcacttcttccagttccatcgaaacccgttcccactcttcaacggtggtatccaattgctgtttcagcttctgatgccgttcatacagttgcatatccgatgctccttccggggttgccatttttgcttccagaatggcgattgccgattccgtttcttcaatcgaagcctcacagtccgccacctggcgttccaacttctttatcttcttattgagttccttctgcgcttcatacgagagtctgttctccgaaggttgctctgtatccgcttcgtttcctttggcagatgcggtaggagaagtagagagagaaactcctttctgaagttcattcaggctgtcgatcttcttcttttgcaggaaatcgtagataccgccaagatgttctttcactgttccaccaccgaactcatatactttagtcgcaagtccgtccaaaaaatcacggtcgtggctgacaagtatcactgttccgtcaaattcgcggatagcttctttcagtacatctttggaacgcatatccaaatgattggtaggttcgtccaaaatcaggaagttcaccggttccagcagcaacttaatcatagccagacgagtacgctctccaccggaaagtactttcacttttttatccgaagcctctccgccaaacatgaatgcacccaaaatgtcacgtatcttcaaccggatatctcctgtcgccacacggtcgatcgtatcaaataccgtcatgttttcatccagcatctgcgcctgattctgtgcaaagtaaccgatctgcacgttatgcccgatcgtcagtttaccatcaaaatcaatctcgcccatgatacatttcactaacgtagatttaccttctccgttctttccgacaaatgcgactttttctcctctgttgatcgtcagattcacatcatggaaaacaacgtgctgtccgtatgccttgcgtacgtcttcacagataaccggataattcccgctgcggctggcaggaggaaatttcagacggagggaagagttgtcttcctcatcgacctcgatacggtctatcttttccagttgtttgatacgactctgcacctgtacggctttggttgccttatagcggaaacgttcgataaagtcttccgtatcctgtatctgcttctgctgattctcataggcacggagctgctgctcacgacgttctttacgtaatacgacaaactcatcgtacttcactttatagtcataaatctgaccgcaggtaatctcgatcgtacgggtagttacattattaaggaaagcacggtcgtggctgaccagcacaacagcattggcacgggtagacagaaagttctccagccattgtatactctcgatatccagatggttagtcggctcatcaaggagcagcacatccggacgacggagcaagagcttcgctagttcgatacgcatacgccagccgccggagaattcggaagtcgaacggttaaagtcttccctgctaaagcccaatcccaacagggtacgttctatttccgcctgaaaattggttcctcccatcatcaggaagcggtcgttttcgtgtgtgaagcggtctattaactggtggtattcttcggattcatagtcggtgcggtcggcaagctgctgattcatccgttcaaggtttgcctgaagttcgaaaatatgctcgaaagcgagttctgcttcctccatcaccgtgcggacatccgaaaggatcatgacttgcggcagatagccgattgttacatctttagggacggctaccactccacgggtcgggttttgcagacctgccaatattttcaacatagtcgatttgcccgcaccattcttgccgaccaaagcgatgcggtcttttttattgataacatagctgacatccgcaaagagcggtgtcgcattaaattctactgataatccttctactgaaatcacgtctgtctctgatttataagattttggattgcaaagataatgaataattattggataaagggcagtattatccgttatgaaagacaaaaaaagcagtcattctcatgaatgactgcttcctggtctttatcaaaagcttttctttagaacaatttagcagggtattcaccggcatctaccaatgcctgaatcttatccactacgctctgacggtcttccggataagttacaccaaaccatttgctggtagtatccagaacttctacagttgcagttccgtcgttaatcaatttatccaccatcagcgggataaagaattcgctcttcaggttctccatgttcttcggatcgctcaggaaagtcttgaagaactcttcactgtaagcaaagtagtcgggagtaaagccccagaagttcatacttaccggagtcgtatcaggagtagctgtccattcaccgttatcatcgatgtattttacttcgccgtccagacgttgaatcttcgtacgttccactacggaagtcagcaagttgttagcatctgtactgcagataccacgagataccgtaccgctctcgctcaacgtatttcccacacggaaacctaccattgaataaacattcttggaattttcgggaagagcagacaggaatttgcccattacctggaacgagtcacgaccatagaagtcatcgcagttgattaccgcaaacggttcactaatcacatcagctcccatcattaccgcatgatttgtaccccatggttttgtacggtctgccggacaagtgaatccttccggaagatcatcaatagactggaataccagttcgcaaggaatgtggccttcgtatttagaaataatcttttcgcggaaatcctgttcaaaatctttgcggattacaaatacaagcttaccaaatcctgcgttgatagcatcatagatagagtaatccataatagtttcgccgttaggacccagtccgtccaattgcttcaagcctccataacggctacccataccagcagccaataagaataaagttggtttcataaattgtgtaatattaaaaggttagtgatgtcaatggcatcagatttcgttgcaaatttacaaaaatagttgaatccaacaggacaaatatcaatcattattcactaaaatcgtacaaaaatcattcattagaacgggtaaccgatagcaaaatgtattcccagattcttgaagaaagctccggttacattataatagccgctacgttccgtatcataaggcagatgcagaggaataccgaagtcgagacggaatacgagaatatccatgtcataacggataccgacacccgttcccaaagctatttgtttagggaaagtcttcagacgcagttgtgaattgggacgtgcttcttttccatcagccaaaagctttctgtctttgcgcaacaaccacacatttcctgcatccagaaaggtagctccccaaaagctcttgaaaatacggaaacgatattccacattcgcctcaaagcggaaggttcctgtctgatccaggtaggaatattttccctcttccggatgataaccgcccggaccgacactgcgcactgtaaaagcacggatactattggcaccacctacataaaattgttcactatagggagctatcgtagcattgccataagtaaacagtgcacctactgccatgcggctggctatcgcattattcttatctatgttccacaaatgacgcaactctgtattcaacttcacaaactgtgcaaacggagcccccagcaaactcttatcctcttcattgaacggcttgccaaaagcacggtaaataagggaagtgatattacccgccgaagtgacggtagactgccaccagatagggttctttatccgacgacccgaagcattgtcatacgtatacgtatattccatcgccggaataaactggttcctaagactgacatacaatgcaggattagcttcagctatctctttaaaatcctcagactgatgctgcaagacattaaatgtcagtttaaaaggagtaatactatgccggctggtacgggagggctggaaatcgtatgtagcattgccgccaaaggacagcagtttataatactttgcccggttcagctggttgatatacagacgaaaggtcgtcgtggccgggaagtcaaactcccgtttacccagatgcgggaacacgactctcggaaaagtcagagaggtagaaagccccatttcccaactgttcatcagtgagctcttctcaccgcctccggtctgccactcataagagcctttcagttttacgttccagctttcaccacctccgaatacattgttacgagtgacaccgaaagatgcaccgggaccggtctggtcattactcttcgttactacattcagttccagttctgcatccaacggtttggcaaatgtagcctgcatagtgacatccagtgtatcacaagccgctgtcgtatctcggggagcatattgcatatccatatagctgaatataccgagctgactcaatttctcctgcacctgctcctgccggtactggctataaagacgggtacggttggaagccctcatctgtttgctccgtacaaactgctgatagttcatccatcgatagagcatattcggacggacctgcagtttatcataatagtgaatattcagattcttgtacaagatactgtcattaggtgcctcgccattctttccgaagagatagaccgaagcatctcctacatagtaagaacgttgagcggcagccggtaatcccggaagaggaatcagacgaagactgatatgtccgccgggaaccaaggttgtatctgcctgataggtcatatagtccggacggaagtagaaatatccccgattacgcaaaagggtactgatacgggaacgttcttcatccaaatccaccacattaaactgttcgccgggggtgatgtaagacatacgacgtccgcgttccatgatcttcagagtctggggagtgaaacgctgataatacactgtatcaatgaaataagggttcttcatatctaccgtatagagcagacttgctttcagactatctttcttatcgaccaaagtctcgtaagtcacctttccattgaaatatccgtaatcacggagcaggttagtggctaccttgacacgtacttcgggattgacagtagaaataaatacgggcggattggcggcaaagcggttaaacatccacttaccgaatcctttcttgtatttcacgaagtcgttatacatccacattttaaaaggaataggcagaaaacctcccaacagagtagtactgggagttttggcaagcgctgcattgatttccgtcaaagcagtttcaccaacccgtgtcgatgatttattgactatcaccgtttttcctccggtatagagtatttcatcttcgggcagatgtttcgtcaccgaacacgccgaaaacaacactatacctataagacagcctgctaatatgttaatacgtatatctttcattcttacttctttttcttaaagatgaacagttcactgagcttatccagtttcttgcgaagtaccagaccgactccggtttccgtaatctccccttcgagtacactctcatagttcttatcgtagaacaaacggacataacgggttcccgtacggtccagacgatattccaaagagatgttgtcaatgaaggattcggcatcattcgtcgcattttcgcccgtcgataccttaccaccgattacaatctggaagcggttattgaagaggcgctgcgaataacggaaactgtaatccgtacgcttgccgccggtatccgaggcgtcatgatcttcgacacccacagagacgctggcattcttcaggttacccatcagtgaatttatctgactgctcagtacggagttcagggcagaacccatattcaacttgccaagtccgccgcctccaccgccgatcggtccggtgccgagataggttttcatcaacatgatataaagtgcctgttttccacgttcttccgctcccattgctgtcagttcattctgtatggtcgcatcttccggggccgctacgtcgaaagcaaaagacaggttgtccaaccggttctttacgacaatggaaacgtcaaagttaaccattctcgttcctccgttctctccttcggatacggaagcacggatacggtcagttgccttgaagttcagcatggggtccatcgggtttccggtccaatctacatagctgccgttatcgatggcaaattccttgactgcaatgataggcagagaatacttcatcagtccaccgctcagtgtgtaacgtccggtcaatgtcaggtctccctgcggagtgtatttcatcgaaagatcgccacctccttccagttcgatacgattgtcactggcgtccaagtccactttcaccctgactgaagggtcgatatgaaccatcatcagcatatccaatccacctaaagatacggtaggcacttcctgacggacaactgtggtggtatcactgaatgaagtaaatgtcaccagacttcccagacgatcctgcacggtcagcggtgaatcggtcagtacatacgagacatccgtattgcccagcaaattcaggtttccacgcatattcaacccgtccaacgggccttttatggttgcccgcaagtccgcaaagacttttccgtagacaaggctttcgcgagtacgcttcgcattcaacaaggtatagttttccgccagcagattcagactcgccatcggtcgggacatatcacggaaatcgacataaccgtcgatcgtaaacggattctttcccgtggtgtaaatggcgaacttatcaaatatcagacgattgttcttcaactgcacagggcggttatcaaacaggaagttagcaccatactggcgtgacaggacagatacgctgtccagtatcagttcaccgtttatcaatggctgctcggtactgcctgttatattcaggtcaccgtccatatcaccggcaagcgtaaccagctcgtcgggaataaaggcgttggcaatacgaagcgggaagtgttccaacgtcgtatttacttccaggctatcctttcccgtcgaggtagggagcagcttgccatctgctatcagcacttctaccttatcatgattcagataagcgttgaggtattgttttccctgttcgcccggcagccatgtagcccccaaagtaatatcaccaatgcgctggcgttcataagtcagttcatcaatggatgcttccgcagagagctgaaggtccttttcggtctgtatgtagtgtgcttctgccgagaacaatccggtgatttcggggaagtaaggcagtacgctcgttatttcatccaagcggattctccggatttcgacatcgatattctgcaaagaaaccgtatctccctgtaccgaatgcacacggaagcccataccttcatcatcccacatatccacattggcatacacgcgcatattcttatgcagataaatccagttatgatcttcgttgaagtggaatttacggaacgcaataatcggttcttccggaatcagtgtaaaagccagtccatccccttttccacgtcctccaaccagcggacgggcattgactccaagcaacacaccggttttccccttttcgttcttatattctgccagcagctcggcatcgcggtcgcgaatctcgcctgtcagaatagtggagaaggaaaactggggattcttcggtccgttgattactccggcacggagattcatacgggtagtatcctgtttgacggtgaaaaagaccgtatccagttgcaaggtatccactttcaaagcatggatggctgctttgccgttgattccccaatcgggagcagtgccgaatttcatggaagcatcatggaacgatatattcttcattgccatatagtatgccaacggattctcctttcctgccgaaaaagagaaaatagccgacggcaatgcttcacgcaaagcagcatgatccaagagtttttcatccacctgcttcatcaacacatctacaaaatgggtagactgacgaatcagaggatatacaccggcacgggcactcagattcagtttcatatcaccggcggtgaaatgagtgaaaacacgattctgccgtgcctctccgcttaaattgaatgccaacggacgcttcatcggcttgggcataagtcccagttcgtacaaatcaagctgagtaacgtcaactgtcactttaccgtctggatagctatgagctaaattatattctgcatccgccgtcattttcaaaagttcattgtcactcgtaagctgagccgttgccaaagctcctttaagatttcccgtcaaatgaacattcgaaagatgatagcgggcgtaatgaagctggtccaaagaaagattcagattggctaaagaatgaaaggacatgacatccagtcccctgcccttggcatctgccgaaagagatagttcataaatcgagtctttcgggagaaaatgatgcagttgcagatcgtttattttcagatcggccgtataaacttctgtcgaactgtttaatgcagcatttacattcatgctgcccttgccttctttcagatcgagttttgctttatactgcgggccgttcatctccatcttcatcttgagactcatactgtcgggaattactaaagagccatcgggtgtgactccagtcaatcctgtcaggaagttcagattccgggtaaccatatccagtccaatagttcccgaacgagtcagactgtccgtcaggttttcaaggattcctcccccctttagcgagaaagctcccggcaagtctaccgtgaagcgcgaaatctgcatctctttcagatttccatccgtaccggcacgaatcactaacggacggaacggatatgcttctttaaacgtttgaggcagtccgccggcaaaaagcatcacgtcctctttgcctatatgtgcgttaaagctggcggataaacgtcctgtcgtcgggatatttacgagttcccaataagtctgggcggacaggtctatttctgaatgtggggtttgcagtttcagttcaggaatgcggatgatagaatcattcgaaaagagccgccctgtcagtgaagtaatactcagtcccgaacgctcttccatcgttatttcacgaatcacagcgttcatatttctgccttcgtagagcagagagtccaatccgatgcggatattccggactgccatatgagaggcgtcaaaaccttccgacggttgggcctctccagtgtcataactggcagaggcacccgacaaaaggaattgcttcaatccataaaactggttctttaaatccgctttggcgtcatcaatggtcgcttcgcctatgtatgccgccatcttcatggagtcggcaggcagtttcataccgaatgatacattcttcaacttcagttgatgaaggttcaccttccagttcacaggagcagatgccgtcgtatctttgggagtggtcgtggtatcagtcatcagaagttgtatatgagtatcggataactctgtccgattgacaactgccgtttcgttcgataaatcgactccatgactttgcagaaagaagcgtcccaaaacgccttttatctgcatcccctctatcagattggcagaattgaccgccacctgacttaaggtaacctcgtcaacttctacttttcctttgagcaatggccatgcctgtacgcggacattcaggctttccaaagacaataaggtatccggctgctgtatgacctccacccctcgtaccagcagattaagcggaaaacgaaggtctatccgttccacctgaatctgcattccggttgctttagaagcatacgcagtaacctcccgtcgcaaaagattctgaacaggaggtatataaagtaataccatcagtattacaaaaagtattataggagtaagcaatatccagcccacccgtcttatccattttcgtttcatgcaggatgtgtcagtgtaaaagtgatacaaagtaaacaaattactttgaaaaaaggtttgtccaaaagctaaaatgtgaaaaagccggaggttatggttgcatttagcgcaatttcatcccgttcattccgttcattcggaaggtgagatatttgtcaaggcagcaccttctcactatgctacgagcttatgcccgtgccactacgttggcacgcttgtgccaccgcagtggcacgactgtgacatgcctttggcacaactgtgccaacagggtggcacaagcatggcactatataggctgttccaaaggagctgccgagagagatttaatgtaaaccgaaactatactcctcagcagcacgaacaactttacgcaccgcctccaaagtctccaacgtagtcttttctatttcttcggagaattcttccccccggcaagactccagccatcttaatgaagcaacagactcagaagctccgatcaaggtgaaaagcggaaggagtttatgagccatagcggctattccatccacctccctgtcagttaatgcctgttgcatccggtcggcattcttgccggtctcttcgataaaagtccggataatagaacacgccgcttccggatcatcttccgagaaggcagtcagtgcagaaaagttgaataaagtatcttcaggcagcgcatctgcaatcaattgcatatcatgtgttatatgcgcctcatcagctgacatttgtccttcattcagagttaccagcaattctttcaccgtaaaaggtttgtgcaggcatccggcaaagccatgttcatgcaaagccttctcatccatttcgctacgtgccgtgacagcaataacaggaatattgcgggcttgcggaatgttagaggcacgcaataatttgaccagatcaaaaccgttgatagcaggcatctgtatatcggtcagcagtacatcaaacgtcgaagagcgcagttgctctatcagttcttccaactgctcgcagcaaacagcatcgatgttgtgctgtttcagcatggcagcagtcaggttcagctgaatcttatcatcatcaatcagaagcacacggatcaccttcatggccggtacggcatctgtctcttccggagaaacatccgtatctttcgatggtttcttaattctgctcccgaaaggtttattttccactattgacttgcccaccggaaagagtggcaacacgacagtaaagcaacttccttttcctaacgtgctttgtacatcgatcgtaccttcaagcagaagaaccagcttatgcacaatggacaatcccagtccgaatccttcttctccctgcgcaccggggaggcgggtaaattcctggaagatgcgttcccgatcttccgatgccatccctttgccggtatccgcaaccgctattgtcagcttcgaagcgttataaccaacagttaatgtgatcttgccctgctgagtgaatttcaccgcattggacaagagattattcactatctgctgaatacgtaaaggatcactgatatatttctccgacaattccggagcgatatgacattgcaagaccaagcctttagccgccgtcagaggttcaaagcaaacacggatttcttcaaacagctgagcaggattaaaaacaatccggttcacttccgctttattgaggtcaagacggtggaaatcaagcaaatcgcttactaacttcagtaaatgctctgaagaacttttcatgttgtccagatagaatcgctgccgttcatcttcggtcaggcgggacaagagttccgtatatcccattatcgagcctaatggcgccttaaagtcatgggtaatggcaagcatcagtttctcacgggcaacaagcaagtcttccgcccgcttattcgcttcttcgagctgacgccgataacggttgctacgagtaatatcccgcataattaagatcaggaaaaaggcggataagaatacggcaccaatggcaattccggcaatgatattagccgaacgcatccgcacctcttgctgaagttccgcatcttgacgggcacgcgcagacatttcctcctcgtatccttttatcagactatccattcttgcggtcagctgtgtattcatccgctgatacctcgtactggtacgccggatcgttcgcctccgctgcaaccgtttctcttcggtagccatgcgaatcttatgctgaagggagtccgccgacttgacaggttccaatatcgtatcggtggcaatttccagagaagtattgaccagcacggcagtatctttcttagaaggcgcgaacacttcccccaatcgtttgaagaagcctttcttcttcggggtagtgatcagagaatcgcgtttggtaataacccggtgttgtacccgttgctgagtaatcaccgagtcctgctgttctgatatgatttcttcaatctccgaggcggaaagcaagctatcattcgcctcgctcagcacccgcagcatctgaagggtattctgatctttctcatggagaagactcagcagactgtctgtccgcagattctgctgatcgtccgcagccgacagcgtctccatctcctgatgcacaaacaccagagaaaaaagaagaatcgccagcagcaatatatagccgatggttattttcagtttggtggagcgaaaggaagccataggcaattaagattttaaattatgaattttgaatggaaggcggtagtttcgtcttgtgatggaaacgccaccataacatcagaccggcactggtcaacccaaaaggaaatgccatccagacacctatgatcccccactccaacacgaatccgcaaaaatagccgaccggaagcgaaataaggaaataagcaatgaaggcaatcagcatcatcagttttacatctgagattccacgcaaggcattggcaaaggttatctgcaatccatctccaaactgatatacaaggaacggaaggataagcgaagttaccatagccgccacttcggtactatcggtaaaccaacctcccagataattgcggcagaggaatacgatggaagaaagcacaacacccaacgccatcatcaaatgaaaaccggcataagccgaacgacgtacattgagtatatcgccctgcccgttaaagttactcacacggacagccacagctgctcccatcccgtaatacatcataaacgtaaactgagaaatagccagcatgacctgatgagaagccagcgcaatggtacccagccagccaatcatcaccgcactcagactgaacgaagctgtctccattcccatctgaaaagcaatcggccaacccagcgaattcaatcgtccgaatatagccttcgaccatcccagacgatagaagccgagcttaaaacgaagaaaacgcggactccgcataaagactatgataaatacgactaccatcatgatacgcgagaacagcgtactgatacctgctcccagcaagcccatttccggcaagcccagctttccgtatatcaggatataattgccgataatattcagcacatttccgccgagcaatatccacatagcggtcttagtatccgtaattccatccgtaaactgcttgaagccattgaacagcatcacaaagacgagcgaagccagcagaaccagataataaggttttatcaggggaataagttcttccggctgtcccagatttcccacattaaaataaaggacagtcataccgatggtaagcaagaatgccaccaacaaatttgccagcaggctgttacgcaacgcctgccccgccgaagcatactgatgagttccatacaaacctcccacgataggagtcagcccgtacgagaagcctgtactgaaaataatcaccagattgaatacattattgacgaaggaagcagcacccagttctatcgtactatgatgaccgatcatcaacgtatcggcaaaccccagcacaataactcctatttgcccgattacaatgggcaatccgagagaaatcagtgctttgtaatgctccttatatatactatagatatttctcatttatttttccgtagttaatcgcatattccggcaactccgcatcctgccgttgcctccaataaatatcccgccggtaaggagaagtcaggatatttgtttcttataataaagtatcactccattctccttcctgaaagcagactgagctaccttttgcaattgtccggcagtaacagcgcgataacgctctacctccttttccatatcttccgccctgcccaacagttcaaaccaagcaagattggtagcgacattcaaataattgatattgccgaatatctgcgtcgattcgaatttattcttcactttttccagttcctgttcgtcaacaggttcttgctgcaaacgttccagttcttcacgtacggccgcttccgcctgttccagcgaaacacctgccgcgggtttgcccgagatatggaacaatccggcatccacactaccggaaatataagcgtcaatactcgaaaacagttgtttttgctgtaccaggcgttgattcagacgactggaacgtccgttgctcaacaaatccgacaatatatcaaaagcgtaataatccggatgatcatgactgcacatatgatacgccatgaatagtgaatcaaggggtacgttacgctctactgtcaaccgtcgttcttctgtctgctccggttcctgcggcagattccgttgaggaacctccctgcgagggatgggaccgaaccatttttccgtcaatgcaactgcttcctcaaaagagatatttcccgttacggcgagcactgcattgttcggcgcataaaaacggaagaagaatgctttcacctcttccagcgtcgcattggctatgtgcgacaaatcttttccgatggtaggccactgataagtatgcgcccgatatgccagaggacgcaaaagatgaccgacgtctccgtaaggctggttcaggcaacgctgcttgaattcttccattactactccacgctgtacttccagactccgttcactgaaatcaaggctcagcatacggtcggattccagccaaaagccggtctctacattctgccggggtacagtgaggtagtaattggttatgtcattattggtccaggcattattctcgccgcctgccagttgcagcggcatatcataatcgggaatgttcaccgaacctccgaacatcaggtgttcgaacaaatgagcaaagcctgtatgctcgggatgttcgtcgcgggctcccacattatataatacattaagagctaccatctgcgtactttcgtcctgcgaatgtaccagacgtaacccattgtccaaaatatgcctgttaatcttcattctacttaatccagtacttctacttttacaatcttcacgtcctcttcggggcggtcgctacggtcggttttcacctgctgaatcttatccacgatgtccatgccttcgattacttcaccgaaaaccgtatactcaccgtccagatgaggagtacctcctacagtcgtataagcttcgatctgttccggcgtaaagtgaaattccggttgcttggcagcttccgcttccgcctctgcaaaaagcttctcctgcaattcatacaaaccgttttcatcgttttccttccgcatcttatagatttctttcatgtgcttctgagccaacgtattgaaaataacattgatcttattctcattcatctggctttccatgcccagcaatgtagagtcgttgtacaccttgcctgtcacaatgtagaactggcaaccggatgattctttcttcggatttacattgtctccctgacgggcagcagacaaagcgccttttttgtgaaaatacttcggataaacaaattcggccggaagggtgtaacccacatctcctgcacccagcatctttcctttcggtgcattctttgaatccgggtcacctgcctgaatcataaagtctttgataacacggtggaatagcgttccttcataaacgccgtcttctgccagcttaatgaaattatcacgatgtttcggcgtctcattatacaacttaaccttgatgtctcccaaggttgtttcaatctttaccaacgtttcgttgtccatatttcctcctttttttgttccggttttgcaggccgtaagtccgcaaaacgatatggttaatagtaagtatgcaatctttttcataacacttttatttaatttaagtttgcaaatatactactttcgcccaaatcctcttacctttgtagcattaaaagaggcaaaagagagtatgatgaaatccatattgataatagaagacgatatcactttcggaatgatgctgaaaacctggctaagtaaaaaagggtttgaggtgtcatcagtcagtaacattgcccgtgcccagaagcacattgaaggacaaggggcagacttaatcctgtccgatttacgcttaccggatcacgacggaatcgatcttctgaaatggatgaacgaaaaaggaatcgatattcctttgatcatcatgaccggttatgccgatatccaatcggcagtacaagcgatgaaactgggagcacgcgattatgttgccaaaccggtgaatccggaggaactactcaaaaagatgtcagaagctttgcaagcgaaagaagcgccgactacgcataccgcagccaaaacttctgcaaagaaaggttcttccatttcgtccggaaacgccaccgaaacccatcatgcttatctggaaggagaaagtgatgccgccaagcaactctataattatgtaggtctggtagctcccaccaatatgtccgtactgatcaacggttccagcggaacggggaaagagtatgtggcgcaccgcatccatcaactgagcaaacggaatgacaagccgtttatcgcggtagactgcggttcgattcccaaagaattagctgcatccgagtttttcggccatgtgaagggctcttttacaggagcactgacggacaagaccggagcgttcgttgccgccaatggaggcactatcttcctggatgaaataggaaatctcagttacgaggtacagatacaacttctccgtgccttgcaagagagaaagattcgtccggtcggttccacgcaagaggtatcggttgatatccgtctggtatccgccaccaacgagaatctggaacaggctatcgagaaaggtactttccgtgaagaccttttccatcgcatcaatgaatttaccctgcggatgcccgacctgaaagaacggaaagaggatatcctgttgtttgccaacttcttcctcgatcaggcaaacaaggaactggacaagcatctgatcggttttgactcgaaagcctcacaagccttactcaattatcactggccgggcaacttacgccaaatgaagaatatcgtaaaaagagcgactttactggcacaaggaagtttcatcactcttcttgaattagggaccgaattactggaaacaagtaccgtttgttccgcaagcatggcgctacgcaacgaagaaacagagaaagaacacattctggaggcattgcgccaaaccggaaataacaagagcaaagcggcacaattactgaatatcgaccggaagacattatataataagctgaaactatataatatcgacttgtaggttatcgatcagtactacccatatatttagaaggagatacgccgaactgctccatgaagtgcttgcgcaaagtacgggtatcggaataaccaaccatttccgaaatttcctgaatagaatagcgattctccagaatcaatgtcgccgccttgcttatacgtatactgcgaatcatatctataacagacaaatcactgcgctgtttcaccttccggtacaaggtaggctgactcatattcagttgctccgccaacatttttacattaaagtccgcattggaaaggttagcttctatgatatgaatcagttgttgcaagaaggcatcttctttctccccctcttccgattcctgtttcagcatcagggctttcgtataaatccgcttcaatcgctcacgctgcaaaatcaggttatccactttggtctttaatatctccggattaaagggtttcatcatataatcatccgctccgctattacagccttgcaggatgtcagcatcttctgctctggcagtcagtatcaagataggaatatgcgcggtttcctgctgcatacgaatttccctgcaacaagtaaagccgtcctttacgggcatcattacatccgagataataagatcgggcaactgttctttggctatccgcaccccttcctcaccattgcaagcttcactgacggcatatctggaaatgaataagctccggatatattcgcggacatcttcattatcttcgatgatcagcagactctttttagccgctgtttcctgtattttgttttccggtattggaagaaacggttccggtttcagctcttcattttgctttgtttttccctgatggctgtcaataagttcataagaatcttttgcaaaatgctctttgccttcgggaatataaagggcaaagatacttccttcgtccggcacactcttcagcgttaccaatccatgatgcaggtccatcgtgttcttcacaatatgcaatcctattcctgccttcgttgacatctcaggtacattatctcccgttacgaacgattcaaaagcatgtttctgcaaccattccggaatccctgcacctgtatccgaaacggtgatccggcaataaccctgcccacttttcatcagatgagagacagaaagcaagacacgccctcccgaaggggtatacttaaacgcatttgaaagaaggttttgcacggccgaagcgatctttccctcatctacccaatacaggaacttcccttcgggcaaatcaatatcaaattgcaaacctttgatttcagccatctgccggaacggttccgacacattgcagaccaactgtaccaaatcagtctcggataactggagtctgaccatcccggcctctatcttttgtacataaagcaactgatcgaccaaggtgtgcagtgaggccgcattcttatacatgacctgcaatttcttataaaagtcatccaatggattgcactgtttcatcaattcctgtaacggggcaaggattaaagtcagcggagtacgcagttcgtgggcaacgcccgtaaagaagttctcgcgttccacacgtatctgacgttctttctcacgctccatactgaccgtcaacagttcatgcttcatctgcatttcgtgttccatccgtttctgccgtagtctgatcaaccgtactccataagccactcctcccaacaataacagggaaacgaaaagccggaaagcaaaagtctgactccaatgaggtagaattatgatcttcagcgaagtcaccgcccctgtctgaccgttcggatgtatattcttcacttcaaatacatactcaccggctgggaggttggtatacgaggctttctctccctcatcagaaatcagccaattcccctgataaggcaaaagccggtaattatatttttgttgttcgtccgagtaggacaggttgttgaaagtcaaggagaaatctttgttatcattatccagtacaatgcgatccgtaaaagggatgaattgattgaggatgatctgattattaatcttttctccagtcccgacaggatggttatccacttccaaaccggttattaacacccgtccgttggtcggataggcatttatatcctccggattgaaataagtcagactctgattatttccgaaaaacaaagtcttgtcactgaataaggcagaacggttactacctgctatgtagtaattgtaaaagagatgctgacgacgaccataccgcgatatgccggagttgcttcccagccagatatgcccttcgctgtcttccgctatgcagccgataaaattactgcacagtccgtcattcgtggtataacgggcactgatcgtgttctgtcgtggagacaggatggcaaagccatccgtatatcctatatataaattcccatccgaagatgccagcaacgaacgtaccgaacgatattccatgttcatcttctgctcatatccattttctacggagatacctccggaagcagattcaactactctgcaaactcccatattactggtccccagccatatcgttccatcttttgtctgagcaatcgcacgaatgaaaggttgtcttttctcatttaaataatgtgctgctgataatttaacgcatatacctgtctgacggttatacaataaaagcccgtcttccgtacctacatagagcctgttcttatcgtccatatacaaagcccataccgaagccctgttggcaacaccgtctaccaacagcgaatgaatcacaaaacgaccggtccggacatgataaacagtcaacgtaccgtttatatttccaaaccacagattgccgtctacatctttcaaggcacacaacatcgtttcttccgatttcccgctacctgtatcgactttagagaaactaagttttttcccttttgcgtacggtatgtcacttcgcatgattcctttgtgataggtcgccaaccataaccgatgactatcatccatgaggatatcacatatttcgttatgcctgtcctgatagtaacggtcataaaactgtgacctcaaatcagaatacatcactcctccaccgttagtaccgatccaaagcaggccgttaggatcgtaacaggcagaaatcatacgtgtttcgaggtttcggtaaatctgtgtatgtgtattgttatatatctccgacgtcagttcttccggctgcttttcatccggcatcaacagtgtatagccaccccatgtcactgccagatagcggttattgccgataaatatagtctgataaacatctgtatgagaaaggagattctcttttcctgtcccgccgtacgaaatccggtccatatgccccgacttcgtgtgataacggacaatgcctttgccgatggtagaaacccagacaactccgtctctgttcaagatggaagtgacttgtaatgtttttccgtctgtcagcggtatcttctgatacgcccccggagtatccggatgaaacaagatcagattaccccggttagttgtcagccatattccgctcccggctttttcatgatagcacagagaagaaaagacttctcctttttcttccaataactgaaaggtcttttgtatgcgtacccgaacagccgttttttcttcttcctttccttgttgtatctcccattgacagagtatcagtctgtttcccgatattccccaaaaagaagaatcgtcagcgggcaggacattaaatacacctatggcagtatctgattcagtatgtatcggaagaaaagtttcccgcttccggttgaaataataaaggtatccatcggatacaattcctaaaaagtcatctgacagtcgcacaatggcagcaatcgaaacatatgtattcgcaggcttgaagttctgaattgttttgccgtcataacggcttaatccgttatccgtcccaaaccacataaatccgtcttcatctttatagatgcaaggaatcgtgttatccgccaatccgtccctcattgtcagcagccgaatatctttatcaaaaaaagcataggcaggatgcagcgggcaacaactcagaatcaggataatgaggattagacttaagtgcttcattctattagacaatttagggcaaataaacgaaattaagtcagaacatacaaaaaaacgaataaagaaatggacttatgaattaaacatgtatgttgaatgaaagaaacaggcatattcggaaccacattgtttgcgtacatttgcagccatacaacaacctgatgtacaccttttaaataaaatacaatgaccttagtttatcttaacctgtcagacacaaaggagaaatttttatgataatgcacataccaaagagtacatattatcataaatggttcatcggagctacactcgtcgttccggttcttccgcttgccgcccagacgtctccgaatcttgtcttcatcatggcagaccagtatcggggagacgcactaggttgtctgggcaaagaacctgtaaagactccttgcctggatcatctggcttccgaaggagtcttattcactaatgcagtcagcagttatcctgtttcatcacccgcccgtgccatgctgatgacgggcatgtaccccctgcataataaagtaacaggcaactgcaattcacaaacagcaccttacggagtggagcttccacaggaggcccgctgttggagtgatgtactaaaagacatgaactaccgtacgggatacataggaaaatggcatctggattctccttacaagccttatgtagacacttacaacaatcgtggcaaagtagcgtggaacgaatggtgtccgcccgaacgccgccacggatttgaatactggacagcctacgggacatacgattatcatctgaaaccgatgtactgggacacgactgctccacgtgacagtttctactacgtcaaccaatggggccctgcatacgaagcggacaaagccatcgaatacattcagacacaaaaagagaataaacaacctttcgcactggtcgtatcgatgaatcctccgcataccggttacgaactggttcccgacaaatacaaagccctatataaggatatagatgtggaagccctctgtgcccaccgccccgacatacccgccaaaggaaccgaaatgggaaactatttcagaaataacatacgcaattattacgcctgtatcacaggggtagacgagcaggtaggacgtatcatcgaaaccctcaaaagcaacggactgtttgagaataccatcattgtatttacttccgatcatggcatctgcatgggagctcacaacaatgccggaaaagatatcttctacgaagaagccatgcgcatccccatgattatctcgtggccggcaaagataaagccacgcaaagacgaccatttgatgatcgccttcgccgacttatatccttctctcctttccctgatgggattccggaaggaaatacccgaaacggtacagactttcgacttatcccgccatattctgggcaagagtaaaaaagaagtggtacaaccttattattatgtacagtttgacaatcatgccaccggataccgcgggctacgtacgtcaacccatacattcgcagtccacgcaaccaatggaaaaatagacgaaacagttcttttcgaccgaaccaaagacccctatcaaatggataatattgccggacaatccccccgtctggtccggcaattcaacaaacaactcaaggcatggctactccataccaacgattcatttgcccattatcttgaaaccgtaactaaataaacaccatgaagaaactttgctatctctctctttttatcctatactcagtttgcagcttcgcacaacaacaggaactccccgtccccaagccccatcaactcaaatggcatgaggcggaaatgggagctgtcttccattatgacctgcacgtgtttgacggcatccgctacggacaaggcaacaaccgtatcaatcccatcgaagattacaacatcttcaacccgaccgaactgaatactgaccaatgggtacaagctgccaaagctgccggatgcaaatttgccgtactgactgctacccacgaaacaggtttcggactctggcaaagcgacgtcaacccttattgcctgaaagccgtgaaatggagagacgggaaaggagacattgtccgtgacttcgtcaactcctgccgcaaatatggtctgcaaccgggcatctatatcggtatccgatggaactccctgctgggcatccataacttcaaggccgaaggagaaggagcgttcgcccgcaaccgccaggcatggtacaagcgcctgtgcgagaaaatggtgacagaactctgcacccgctacggagatttatatatgatatggtttgacggcggagccgatgatccccgtgccgatggccccgacgtggaaccgattgtcaacaagtatcagccaaactgccttttctatcataacatcgaccgtgccgacttccgttggggaggttcggagacaggtacagtggaatatccctgctggtctacctttcccgtcccttgctcacaccataaacgcattgaaagcagtatcgaccaactcgaactgttaaaacatggcgataagaacggtagatactgggtaccggcgatggcagacactccgctacggggagcaaacggccgccacgaatggttctgggaaccggatgacgagaacaacatctatccgctaaacacgctgatggataaatatgaaaagtcagtaggaagaaacgccaccctcattctcggattaactcctgacccgaccggattaatccctgccggagacgcacagcgcctgaaagaaatgggagatgaaatcaatcggcggttctcctccccgatagcccgcatttcgggacaaaagaaaagcctgacactgaaacttggaaaggagcagtctgtcaattactgcatcatccaggaaaacatcaaaaacggagaacgcatccggcaatatcagatagaagccaaagtgaacggtaaatggcaaacagtctgcaaaggagaatccgtggggcacaaacgaatcgaaaagtttgaaccggtagaagccacagcattaagactgaccgtatccgaatctatcgcactgccggatattataaacttcagcgcctattccgtaaaataacacaagaggtatgaaaagaataatccacatctgtttatggctattgacgggcatctttgcggaagtatcgctgtctgcacagaacccgtttatctaccataaagggaagacatacaaagatgttgcagcttatcggatggaagaaatcatcgacctgaacacccatactccatccacccccattttatacgaacaacaagtgccggaacaccaaagcactctttcgtataaggttgcacttcctttgtatgttcgtggcatattcttcagccgtgattcccgccccggcgactatcaatggccgaataacaccaatcggttgctcccttggatgttcaaccatctcgaagacctcacacggagcgattatgcaagcattccttccaatgccctgccgtccgcatcgggcgacgcactgctccttgaacttgcagacggagaatatctgttcgccaaagccattgcgggtagcaacagcctcagctggtttcaggttaatcaggacggcacactcacattgtatgtctccacactaggagaagatgcactgaccggccgactccccctcctgattttccggaaatcttcatccgtctaccatgtattcagtgacgcctacgattcgttaatcgcagacaaagccgtatctgccctccgcaaaagagcggacaaacagtatttcaatgctttcgactatctgggatggtgtacttgggaacattatcattatgacattgatgaaacgaaaatactgaacgatatcgatgccatcgaagcatccggcataccggtacgttatgtcttaattgacgacggacacatagcgaacaagaaccggcaactgaccagtctcgtccccgacaaaaaacgttttccgaacggatggagccgcatcatgaagcgcaaacaagcagataaaatccgatggatagggctatggtacagcctttccggctattggatgggaatctctgccgagaatgactttccgccggaaatccggcaagttctacactcctacaacggcagtttactgcccggcaccagtacagaaaagatagaaacatggtacgaatattatgtccgtaccatgaaggagtatggatttgacttcttgaagatagacaatcaatccttcaccctcccgctctatatgggcggaacgcaggttatccgacaggctaaagactgcaaccttgccctggaacatcagacacatcgaatgcaaatgggactgatgaactgcatggcacaaaatgtgctgaacattgaccataccttgtacagcagcgtaacccgtgccagcatcgactataagaaatatgacgagaatatggctaaatcacatctgttccagtcatataccaatacactcatactggggcagaccgtctggcccgaccacgatatgtttcattcctgcgataccgtttgcggcagtctgatggcacgttcgaaagcgatctccggcggacctgtttacctgtccgactctccaagcgaatttattgccgataatatccgccccctgattgatgaaaccggaaagatattccgtccggcggctcccgccatcccgactccggaatccatactgaccaatcccctgcaaagcggtaaagcctaccgtgtatttgcccctacaggagacgaagcgctctcagtcatttgctacaatctgaacacttctcccgcttatcgggaagtagaaagtttcgtcaaacgggaagattacctgttacgggaaagcaccggcaaatccgcagattcttcttgcgacagcattctcgcattcaactgggaaaaacagagcgccgaagtattgaacgcatctgaaagaaaaataaagttatccggatttatagatagtctgttccatctttgccccatccgtaaaggctgggcagtgatcggcatacaagaaaaatacctttcgcctgctaccgtgcagatactcaaacgtactaccgagaagctgatattggatgtccactgcaccggtacattaagaatatgggcagactcccacgggaaacaggaattacggagcataccgatcaaaaaggccggcagaattgaaataatgaaataacactaaataattaatccatgaacaaaaaaatacttttccccctcgcactcgtgccactggctgccaccggcctgcaaacacagaagtctgcccagacacagcgtgtggacaaacgccccaacatcatccttttcatggtagacgacatgggatggcaagacacttcactccccttctggacacaaaagacagattacaataagctgtacgaaacacccaacatggaacgacttgccaaacaaggcatgatgttcacacaagcgtatgccagcagtatcagttcccccacccgatgcagcctcatcaccggaacgaacgcggcacgccaccgggtaaccaactggacgctgcaaaagaacacaaagacagaccgcaaggataaagtactggatgtgccggactggaactacaacggagtaagccaagtgcccggcaccaacaacacattcgtaggaacctccttcgtacaactactgaaagacagcggctatcatacgattcattgcggaaaagcacatttcggtgccatagacactccgggagaagacccgcaccactggggcttcgaagtaaacatagccggacatgctgccggaggactcgccagctatctgggagaagagaattacggtcacaacaaagacggaaagccaatatcactcatggccgttcccggacttgaaaagtactggggtacggagaccttcgtcaccgaagcattaactctggaagccatcaaagctctgaacaaagctaagaagtacaaccagcctttctacctgtatatgtcccaatacgccatccacgtccccttggacaaggacaaacgtttctacgacaaatacaagaaaaaaggcatgaccgaccatgaagccgcatacgccacactgatcgaaggcatggacaagagtctgggcgatctgatggactggctggaaaaaagcggagaagccgacaacactattattatcttcatgagcgacaacggaggacttgccgccgaatcgtattggcgtgacggcaaactgcacacccagaatcatcctctcaacagtggtaaaggctccacctatgaaggcggcatccgtgaaccgatgatcgtcagctggcccggtgtcgtagcccctggcagcaaatgcaatgattacctgctgatagaagacttctatcctactatcctcgaaatggcgggcatcaaaaaatacaagacagttcagcctatcgacggcatcagcttcatgcctttactgaaacagaccaggaatccttccaaaggacgcagcctcttctggaatatgcccaacaactggggaaacgacggtccgggaatcaactttaactgtgccgtacgcaagggtgactggaaattaatctattactatggtacaggtaaaaaagaactattcaatatccccgatgatataggcgaaagtaatgatctcagcgcacaacatccggatattgtgaaacggctttctaaagaattaggaacctatttgagaaaagttgatgcccaacgtcctacagtcaaagctacgggtaaaccttgtccttggccggacgaaattaagtaattattcacctgtttagtcgggaattacattaattgtatgaaggtgaattctaagtcctctccaaacaatatctataaaatcttacccaagtttacgaacattaacgtatccttgggtaagtttgtatatagacatacctactcttcagaagtgtatagctacttc

SEQ ID NO: 86 - DNA, 32184 bp, Bacteroides thetaiotaomicron
cgataatatcatgaagaaatattggttcttattattagctgcattattaggtggtgcaacttgtatctttgctaaagacacacttgcaacttggaaggctcccgcaggagttgctttaaatagtgattttacggttaaggtccgtttgcaagatggagtctggcataccttatcttcttatctgattaaggtggatgaggtaagagatacacgacattatgtagaaaatgcttcgatggcaatttttgattttacaggaaaagtggaagtagccgtaacctataatttgggagaagtacagacggcaaaagtccgtcctctctcgtatgatatcccatttcagatcgatggtaatacagtaacttttacattagagcatcctcgaaatttgtcagtagaagtaaatggggatatttttcataattttcacttatttacaggatctccggaaagaacgattccggacaaagataatccggaagtaatttactttggtcctggaatacatacagttaaaaatggggaattgagagtgccatccggtaagactgtgtatctggcaggaggagctgttttaatggggcgtgtcctaatcgaaaacgtacatgatgtaaaattgctaggaagaggaattatcgatcattctataaaaggaggtattcgtattgcgaattcccgagatgtctatgtagaaggaattgttgctactcaatgtgcgacaggagggtcggaaaatgttactatccgtaatgtcaaaagtattagttattatgggtggggagatggcatgaatgtttttgcgagcaataacgtattatttgatggtgtcttctgccgtaactcagatgattgtacaactgtttatggcactcgtttgggatttgaaggaggttgtcggaatataacaatgcagaattccactctttgggcagatgtagcccatcctatttttattggaattcatggtaattctaaagctcccgaagttttggaagatctgaattatattaatattgatatattggatcatagagagaaacaagtcgattatcaaggatgtatggctattaatgcaggtgataacaatttaatacgcaatgttcattttgaggacatccgtgttgagaatttccgtcaggggcaacttgtcaatttacgtatcttttataatgaaaaatactgtactgctcccggaagaggaattgagaacgtattgtttaagaatatatcctataccggagagaatgcggaactttctattattgaaggatatgatgaaaaacgtaaggtaaagaacatacgttttgaaaatttgaaaataaatggaaaattgattgatgataatatgccggacaaacctcggtggtataagacttcagatatggcacgcatatatgtaggacctcatgtggaaaatattgtttttacaagtgatgtagctcagtcacaacgtcgttttgttcatccgggtattacttatacgcaaggtgacctcgatcgtatgaaagcaatggtagaagccagacaagaaccttattattctacctttttgaaattgaaggagtcttcttattcatcacttgatgcacctgtggtgaatcgtggagagcaaataaaggaagggcgatttaatgctacaatcggggtggatgggcgtcgtgctcatgatttagctcttctttggcacttgacaggagaagaagcctatgcacgtaaggctgtagaatatttgaatgcaaattcttattatactaatactagtagccgtggtacaggaccgttggataatgggaaaatttatttgttgattgatgcggctgaaatgatgagagattattctggatggacacggcaagatcagcaacgtttcaaagatatgctggtttatccggggtatagtaatacggaaaattattctgctaaatatgctaattatctggatgatacaaaaaatggagtaactttttattggaatatctataattttgatgcagcgcgtttcggtaatcaaggattgtttgcagcacgcagtatgatggcaatggctatctatcttgataatgagataatgtatgaccgtgcttatcgctatttactgggaatgaaacatcgtaaagatgatttgccatatccttcaggaccggctatttccagcgatcaacccattcatgtttctcctactatgattgattataaattgttacaacggaagaatgatattcaggattatggttatgacgaacagcttcaatattatatttatcctaatggtcagtgtcaggaatccagtcgtgatcagggacatgtattagccgggttgcacaattatgttgctattgcagaaatggcatggaatcagggggattctttatatagtagtttggacaatcgtttattgctcgggctagaatggagttatcgttataacctgtcaagtattcaatcttacaaaaaacaggaaacaccttgggagccaacaggattaacaaaggatatgaatgaagtcacatttgataacgggaaatatctccagataaaaagtcgtagcggacgttgggagtctgtgaatatctcctctcatggacggggagatgttgccgggacaggaggaaccagagaaatggcattggcacattatgcggtgcgtagtggattaccggctgaaaaatatacctggttacagcgttatcgtgattatatgatagaacgttatggatgtgagaattggggagtagccccgaattggttttatgagtggactggttgggggactttaactaagcgactgaccccttggatggcaggtgatccggttactttttctacaggtaagcgagtttccggtttgcatcaattgcccagtacaattttggctgctgattatgattattattgtatatcagaaaatcctgaagggcatacctatcataatatagggacagtacgtggaaatgagtatcgtccggatggagcagttgaattacagaaaatagataataaatacgtagtggttcaggtagaagacggcgagtggatgaattatactgttaatatccctaaaagtggagcttacgctgtttatcttacttattcggcaaattcctcttcacatgtagcaatggcctctgatcagggattagaaatctcgtcttcgatcccttcttctaaaaagtggaaagaaacaaaacttggcgaactttcactttcggctggtgcctgtgtattgcgtttacgtgttgacaaggccggacaaaagttatgtctcagtgctttccgattggaaaaagtagaaagggatagataaagtggtgatatgatataagtatgtgtgaagcatttttagggagtaattaacgtattactcaagtaatttgtaggaaaatatagaaaaagaacagaaaaatgatcattatgatattataaattactatttttgtgcactctgttacaggatgatattctgatcctgataattgaaccgttgagcatgttttatattataaatgatagatatatgaaattattaatttttatttcgttatttggaggcttattgttagcctcttgtggtagcagtagttcacaaaaaaatgcaagtacacaagaagtaaatccggcagacactatttatttaggtgatttacgtgaaaaatttgaaggagatagtattttctttaaggtggttgctcctgacttgatgctgatggattaccagtatttctgggcggctacagagtctgaagctgtggagaaaggactgactaaagaatattataagcgtgttaagaaagaaatttcagaaaccaatgaagcaattaaaaaaggtgtaatgaaaggtgcggatgtaaaacgtataccggatttccaagaaggacaaaagaaataaatcgtttcaaagagaaattgattattgctatgatagataaaaagaagggagatgttaaatatgacttctcccttcttttttgcatcaatgtctggtgaaagagaatcataatttcatctgacgttttatttcatcatccactaccgtcatcataccctctacttgcgccagtgccagcatacgtccataaaaagaatagcctggattataccccttgtcttcatctcccagcatcattctcccgtgatcaatgcgcataggtaatcccggattttctttctcaaagattcggataaggtcaatgatatgtcctcttcctgccaggtgagaactttcaatgaagtttccacccggcatggcggctgtgctgcgtaggtgtataaagtgcgtacgtttagcaaacttctttgccaattcgcgggtatcattgtgttcgccggcactcaaggaacctgcacagaatgtcagtccgttgtgcggattgtctactgcattcaggaaccaggctatatcttcttcattggtgacgatacgaggaagaccaagaacctggaatggaggatcgtcgggatgcacgcacatattcactccgtattcttcgcaaaccggcataatggcagaaagaaagtgacacatattttctcgcaggatgtcacggttaatatctttgtacaaagttaacaaccgtttgaaaaggacgaccggttctttgtctccttctttgatgttcccattgacaaatccttgtgtcttaacgataatggtatcaatcagatcatccttctctttttcggtgatcacttgatccagttcggaaactttatgaagttcttcttccgtataatccttttcagccccttcccgttccagtatcttcatgtcgaaataggcgaaacggatacggtcataatacaatgagctagtaccgtcggggcagaggtactgcaagtctgtacgtatccagtcgatgactggcataaagttatagcaaacagtttttattccacatttacctagattggtaaggcttactttgtagttctctatcaactgttcacgttctgtcccaccatatttgatcgcttcgcatacgggcaaactttctactacagaccagcgcagtccgtatgattctatataggatttcagagcattaatcgcttctattgtccatatttctccgttcggtatgtcgtgcaaagctgtaacaatcccttccacacctatttgccggagcattggcaaggtaatcttgtctttcttgccaaaccatctccatgttttttccatcatagtttcttctctttatacgccgctgaatgcactgaatccaccgtcgataggcaacattgcaccggttacaaaactggcagcttcgctacacaaaaattgtacggcaccgttcaattctttaatatcaccaaaacggttcatcggtgtcttggctaaaacctttttgcttctgtcagtcagcgagccatccggattgataagtacgcgacggttctgatcgccgataaagaaaccgggagcaatggcatttacacggatgccgtcaccatatttcagagccatctcactggcaagccattgtgtaaagttagctacagctgtttttgcagccgaataccccggcacacgggtgatggcactataagcagccatagaagacacattgataatgcaaccttttttctgctctgccatcactttaccaaagatcatagacggatagactgtaccgttcatattcagactggtcactttctcccaacaggaaatgtccatatcatagaagttctgatccgattcaagagtggctcccggcatgttgcctccggcaatattcaacagaatatcaatctgtccccattgggcaacaatctcttccgctactttttccagactggcgatgtccagcacgtctccaataataccgataacatcctgaccatattgtttaagttctgctacacggttgtccagttgttcctgacggatgtcgatagctacaacttttgctccctgctgtacaaagtgctgggcgatatttcctcccaacacaccacctgctccggtaattacagctaccttaccggcaatactaaataattcgttcatggttttatttattatttatatgaattgatgcaaaagtagctgctttttgaatgtgatgttgtgcttatttttgcaagatgtttgtttatatttgcagaaatgtatgaaagaaaagagacttttataaaaagaattgagaagtagtgtttctttgggagacagattgagtataataattaattcgttcgtatatattggaaaaacggataaacatgaatttaaatagaatgaagaaaagtatcttgcttttactgttggtaataccgacactgacaaaggcacagaatgtgatgacagaaacccgccgggaactgacttccccagacggagcgtatcggttcaccttttaccagcgttcgttcggagaggataatgcacggatgtattatacgctgatatataagaatcgtcctgtagtggaggagggtgaactcggtgtacagatagagaatcaattgtttgaatcggcattgggagtaccgaacgatacttgccatttttggtgcgagaatctgaaattaacggatactgatcatcggaaaaacgatgcaacatggaaacctgtatatggagaacgtgccgaagttcgggactgttataatgaaatgactttaaagtttcgtaaaggtgagggacaagggatgactgaaggcggttacgacaaacgtaaaaactactttatgaatattatcgtccgtgcctataacgaaggagtggcattccgttatcattttccggaaacgaccaatgggctatttttacatattacaggtgaacggacaagtttcacaatgcctgaaggtacaatggcttactatgaacgttgggcacaaggtccttatgagcttcgtcccctgtcagggtggggaaaagaggaaagtgaacgccctttgactatgaaactgccagatggattgactgttgcattactggaagcggagatggtggattatgctcgtggaaaattccgtttgtctgcagagaagccttcaacactggaaactagcttgtatagcagcgttgacattatttctccctacagtaccccttggcgtgtcattatggctgccgaacgtccggtcgatttgatcaatcataatgatttggctttgaatttaaatactccttgtcggatatcagatatttcttggattaagcctgggaaagtattccgttctggagacttaaaacaggagaaagtaaaagcagccattgattttgcagcggaacgtggcattcaatatgtacatatggatgcaggatggtatggcccggaaatgaaaatgagttcggatgctactacggtttctccggataaagatcttgatatttctgctttatgtaaatatgcagaatctagaggcattggattaatggtctatgtcaatcaacgtgctttggttcaacagctagattctttattgccattgtataaaaaatggggattgaaaggaattaaattcggttttgtacagataggtaatcagcattggagtacgtggttacatgatgcagtccgtaaatgtgcggaatatgaaatgatggtggatattcatgatgaatatcgtccaaccggtttcagtcgtacctatcccaatttgatgacgcaagaaggtatccgtggaaatgaagagatgccggatgcgacacacaataccattctcccttatactcgttttctggcaggcgcaggagattatacactctgttattttaatagtcgcgtgaaaaacaccaaagcacatcaattggcaatggcagccgtatattacagtcctttgcaatttatgttttggtatgataatcctgctatgtataaaggtgaggaggaactggagttctggaaagccatcccgactgtttgggatgaaagtcgtgcattagatggagaaataggtgaatatattgtgcaggctcgtcgttccggaaaagaatggtttgtgggagcaatgacaaatacagaagcgcgtaccattacgttaaccacggattttttgaaaccgggaacgaagtatatagtcaacttgtatgaagatgacgacaagttgaatacacgtacaaaggttcgtactactcataagaagataaaagccggagataagctaactttgaagttaaagtcctccggtggtgctgcactgcattttactcttgctgagtagagttgtgtctgcgataggcctctatcgcagacttaaccgaaccgtgtagcaacagaagtgcctcagccttttcgtagtccagatggagttcttcaatgatcatgcgcgttccccgatcaatgagtttttggttactcaattgcatattgaccattttatttccttgcacgcgtcccagttcaatcatgatagtagtgctgatcatattcagaatcatcttttgagcagtacccgatttcatccgagaacttcctgtcacatactccggaccgacaatcacttctatcggtacatcagcttcggtagccatcggcgaatttggattactggtaatgcagccggtcagtattccgtgttcccgtgctgtgcgcatggctccgatcacataaggagtggtgccggatgctgcaattccgatgactgtatcttcactattgatatgatgctgcaataactcttcccatccgcgggacatatcatcttccgcattctcgacgggattgcgcaaggcggtatctcctccggcgattagtccgataactacggtgggaggcataccgaaagtcggaggtatttcggaagcgtcgagtacacctaaacgtccgcttgttccggcccccatatagaatattctcccacctttttttactcggggaataattaatgtgaccagtttctctatttgtgggattgctttctgcacggcatccgctactttatggtcttcagtattgatatcttccagaatctcttttaccgacttcttgtcgaggtcatcatagagcgatggttgctctgttatcttgataaattccatgattgatcatttaaagcactaattctttgaacaaacgctccaaggtagcatccaaatcctcggaaaatccgggatgcgggcgggatacttgtatacatgagctttttacagcggtcagccaccggaaacgatcggggacatccatgcttgctatcattcccccttccttactacccgaacaaatcctgtcgaagacatgcagtccttctttcagacaattcatatccagttcggaagaaaacagtttcagtttattctcatctatcgtataaagtgatttgaggtatttgcatcgtttggagaacagtacaatacctacattgataaattcttcacgttctactttgggaacgaaacgaatggttgcgtattcatataagtgcctttcttgcatgttgcgcttcatttacaaatagttcggaatgcttgatcctttcctctaaaaattgaatataaatatctctcaggtcttgtggagtttcctgtccttccgtccagttcaaccagtcgtcggggacggtattgactatttcccatatcttatcggaggttagtaactgtctgaatgccatatctgtttctttcagttggtcggcaaatggcaataaaacatgatcttttatctgcacgaatggggtgagtgcctgtttctgccagttggtccagctatgttggaagtaaagggaagctccatgatcgatcagccataattctttatgccacatcagcatattggtattcttgatggtacggtccacatttgtcagaaaagcatccatccacacaatctgtgaggcggttttaccatccacttgatgtacgacaggatcgaaggtcaacgctccggacaagaaatgcaaaccgatattcaatccacggctccattgcagtaaatcctgtatctcttcatctgcttccgttcggccgaaagcttcatctaaattcaggaagatgatctccggtactctgaagcccagagtacgggctatttctcctccgatcaattcagcgataagggctttggttccgtggcctgctcctctgaattttacgacatatttgaactcatcgtcagcttcagccaaagccggcaatgatccgccttcccgcaggggaagaatatatctagttacgtttgctgtacgtaaatccatatcactcctttcttaattgagaataaagatacgacgtttttgtgaaattgtcgatgaaagagttcctataataatagtttttttatatttttcggttgagtatactttggtttcgttacgtattacataaaataacgataaatgaatggaacatgaaactacttcgatttttagtatttggaatattagtgtttatgttatggccggaatgtatagcggcggaatggcagtggtctgtacaaatacccggcattatttctaacgaaactgatgatcatccacaggcatttctgtggataccttccgattgtgcccaggtaagaggtgtgatgataggtactcacaatatgacagaggaaaccctgtttgagaatcttctgtttcgggagaaaatgtccgaaatgggtatgggcttgatctggattactccgggctgggaccagaaatgggatgtatctgccggaagtcagagggcatttgagcagatgttggaggactttgccgctatcagcggttacaatgaattaaaatacgttccgattgttcctttcggacattcggcgatggcaacttatccttggaattttgcagcatggaatcccgaacggacattggctgtcatttcctttcatggagacgcaccgcgtactaatcttaccggatatggccgtgataacatggagtgggggaaacgtactattgacggcattcccggcttgatgatcgaaggagaatatgaatggtgggaagatcgcgtaaatccggcattggcgtttcgcctgatgtatccccggagttgcatctcgtttctttgtgatactgggcgcggacattttgatattgcagaccgtacggcagtataccttgcattgtttctgaagaaagccatggagtaccgattgccggaaacgtatgatgtagataagcccgtgatgctgaagaaattgaatccggaaaacggatggcttgccgagcgttggcatcctgaccaaaagagacgtgctaaagcagctcccttcaaacaatacaaaggcgatccgcatgatgccttctggtatttcgataaagagatggttgacatgacagaagaacgttatcgtcaggaaagagggaaaaaaccgcaatatcttggttttgtacaagagaacagccttcttgcatatcacccgaagtctcatgtgaaagttgccgcccgtttcctgccggaggaagatggacttacttttcatctgaaagctgtatttacggatagtctgcatacaaccatctccgacgaacattcatcgacctttcccgaaataacccgcatctgcggaccggtacagaaggtgaatgatactacttttactgttcgtttctaccgcatgggaatgtataataagcgtcgcacaggagacatctgcctcttggcgagtcatgacggtgataatcaatataaaagtacagtgcaggaacttagtttccggattccttaccgtaacacggaggggaaacgacagtatatacttttcccaggcattggggatgtgaaggcaggggtggagtccgtcactcttcgggctacttccgattgcggactgcctgtatattattatgtgaaagaaggccctgcggaaatcgacggaaacaaacttgtatttactccgatacctcctcgcagtaaatatccgttgaaggtgacagtagttgcctggcaatatgggctggcgggaaaggtacagacagcagagccgatagaacgaagtttctttatttatcaataatatggaataaaacgaaagcttacggaacgatcaatcagaattaatttcattgtattgagtgttgaacagcgcttattcgtatcttattgaaaaggatacaaagaatgattatgaataagaaaaatctagttgtaatagcatggttggcagtgtcgactatgatgtccgcccagtctgtataccccggtcagcatcagggaaaaatgaaaaaagagacagtggctccaattcgggtacagagttttgatttaaaggatgtccgcctcttagcgagtcgttttcgtgataatatgttgcgggattcggcatggatgacttctcttgatgtgaatcgtctgttacatagcttccggaccaatgccggtgtctttgcaggtcgtgaaggcggctatatgactgtaaaaaaactcggtggctgggaatctctggactgcgaacttcgcggacatactaccggacatttgctttcagcttacgcattgatgtacgctgctaccggaagtgagattttcaaacttaaaggagatagccttgtaaatggattgaccgaagtgcagaatgcacttaaaggaggatatttgagcgcatatcccgaagaactgatcaaccgcaatattcagggaaagagtgtctgggcaccttggtataccttgcataaactttattccggtctgatagaccaatacttatatgcagataatcagcaggctttgagtgtggtgaccaaaatgggcgactgggcttataacaaactgaaaccgcttagtgaagagacacgccggttaatgatacgtaatgagttcgggggaatcaacgaatcattttataatttatatgccatcacaggcgacgagcgttatcgttggttggcggaatatttctatcataatgacgtgatcgacccactgaaagaacttcgggatgatttgggaaccaaacatacaaatacatttatcccgaaagtaattgcagaagctcgcaactatgaattgacacagaatgagacgagtaaaaaactttcagagtttttctggcataccatgattgaccatcacacctttgctccgggatgcagcagtgataaagagcattttttcgacccgaagaaatgctctaaacacttgactggttataccggtgaaacatgttgcacctacaatatgttgaaacttagtcgccatcttttctgctggaccggtgattcttctattgccgattactacgagagagcattatacaatcatatccttggacagcaagacccggaaacagggatggtaacttatttccttccgttactttccggctctcataaactgtatagcaccaaagaaaattctttctggtgttgtgtaggcagtggatttgagaatcatgccaaatatggagaagccatctattaccataatgataaaggcatctatgtgaatctgtttattccttcccaagtgacttggaaagaaaaaggactgacgcttcttcaggaaaccgattttccgaaggaagagactactcggctcactcttcgtgcagaaaagccaaggcatactactatttatttgagatatccctcatggagtaaaaatgtgaaagtacttgtgaatggtaaaaaggtgtcagtgaaacagaaaccgggttcttatattgctattacccgtgaatggaaagatggtgaccgtattgcggccacttatcccatgcagatcgaactggaagctactcccgataatccgaataaagtagctttgctgtatggaccgttagtacttgccggagaacggggaacggaaggaatgcaggcacctgctcccttctctgatcctgctctttacaacgattattatacttataattttcatgttcctgccgatctgcgtacatcattgaaaatagacgtgaaacaccccgaacgaacattgcaccgtgtgggaaaagacttgaaatttactacggagcaaggagatgtgatccgtccgctttatgatttgcatcaccagtgttatgtagtgtattgggatttacaagattgatttaatttaatgaacaggcacgaataaattattcgggtgcattgagtaaatacttccgcctcttcgtatttgtctattagcatcagcaaatacggagaggcgactttttagataaggaaccgctctcttttggagatttttgtgtatgtttgtcacatgtttaatatgataaagcccgttggcaggtgaaaagcacgattaaatatttggttcttataataatgtgttgggtttgcggggaaaacttgcaggcacaaccctatatgtttcgtaatgtcgttatgtccgacggcctttccggtttgttggtgaatgctatttataaagactcggaaggtttcatctggttggggacagacaacggcctcgaccgttttgacggtgtgaaggtgaagcatttcgaattccgcggagtagattcgggaagaaagaaacgggtgaactgtattacagaaaccgataacaagcaactatggatcggaaatggaatcggactctggcggctgaatcgctccggtagtgaattgcagagaatcgttcccgagaagatcgactgtgccgtcaatgctttgttggcagatggagatgtactttatataggtacggagagaggactgtttattcagaaagacggtcagttgcttcaggtacagaccgataaaaatatgctggcagcctgtaaccggatcatggacctctgcctgaatgaagataagagtgtcctttggttggcaacagtgcaagggttattttcttattcgctgaaagatggtcagatcaattcctggcatttcagagagaatgttcccgaagccgattatttccgttgtctgacccgcataggtgaaacgctgtatctgggtacaatgagtcagggagtcgtctgtttcgatatcccgaaacagacatttgcccatacggtttctttgggatgtgatgtgatatctgatatttccggtgatggaaaggagacggtgtacatcgctacagatggaaatggggttcatttcctttctcacaaagaccggaaagtggttcgccgctttttccatgatgtgaatgataaagaagggattcgcagtaattctatctactcactactggtggatgacaggggtgcagtctgggtaggacatttccaagccggattggattattcactgtatcaaaacggactgttccgtacgtacgcttatcctcctcagtttaactctgccaatttatcaattcgttcgttcgtaaaccggggaccggagaaagtgattggttcgcgtgacggattgttctatattaacgaagctaccggcatagtgaaaagtttcgtgaaaccggttcttacgtccgatctgatccttaccatttgcttctatgaaggtgaatattatatcggtacgtatggcggtggtatgatggtattaaatccgcagacgttatctctcaaatactttacacaaggtgatacggaactcttccagaaaggacatatcttctgtgtaaaaccggataacaggggaaatctttggattggcacctcgcagggactattctgttacaacgggcagacaaagcaaatcaaaaacttcaccagcaccaactctcagttgcccgaaggaaatgtgtatgaagtaagttttgactctaccggaaaaggatggattgctacagaaaccggtatgtgcatctatgatccggcctcacaaagccttcgttccaatgtatttccggaaggatttgtacacaaagataaagtacgtactatttatgaagatgcagaacataacctttactttatccgtgagaaaggcagcctgtttacttctaccttaacgatggaccatttccgcaatcaatcagtactttctacgcttcccgataactcgctgatgtcaataacagaagataatcaaggctggctgtgggtaggttgcaacgatggattgttgcgtattaaggaagaaggagaagagtatgactccttcaccttcaatgacggagtgccgggaccgactttcactaacggagcggcttataaagatgaaagaggactgttgtggtttggcaataccaaggggttgatctatgtagatccgaaacaggtagatgaggtacgtggaaaggtccgtccgattgtctttacggatattctggctaatggagtttctatcaataaatcgtctttgaagtataatcagaacaatcttactttttgttttaccgattttgcatatggattaccttctgccttgttatatgagtataaactggagggagcggacagtgactggaagttgctgacagcacagagtgaagtatcgtattatgggctttcttccgggacatacacattctgtgtacgtattccgggcaatgaacaatcaatggccatttataaggtgactgtgcagccgatgattccttggtggggatgggtgattctcgctatatcgattattctgatcgttgttctggtgagatattatgtgcggaaatctgctccattggtcacggaagtacacgagatctcatccgaagaagaagaggaagaagaaaagacggcggaaccacatcctgcagaagaaaaatataaggccaaccgtatgagcgaagccgaatgtaaagaacttcatgacaggcttgttgcttatgtggagaaagaaaaaccttatattaatcccgacttgaaaatgggagaacttgccgccgcattgcatacttcttcccattccttgtcctatctgctcaatcaatatcttaatcagtcatactatgactttataaatgagtatcgggttgcccagttcaagaaaatggtagaggatagtgattactcccgttatacattgacagcattggccgaactatgcggcttcagttcacgtgcttctttcttccgttcattcaagaaaagtaccggagttactccgaacgagtatattcgcagtatcggaggaacggctaaagatgaatagtaaatgtgctcccttcattaagatattatgcaggtaagattaatgtattcggtcagtaacaagagatcgtttcacgtatgtgattccatcggttcatgtacgtgattcatcgggcttacgtacatgagctgaacggttcacgtacgtgaaatgaatacatgaaagcacctgaatatattagtcaagccttgtttgtatgttaagcttcccagcctttgtcttaatacatgcagcttacatagaacaatattgggcgtaaacaacgtacattcatggcaaaaatggtgtttttaacattggtagacgttacccttgaatagtctgtctaacacctgataatcaattgaataaatagatcgcttgtcaaaaacaggtgataatagaaatcaagaactattctattatcaccttattatcaccatctattatcacccttactgctttaattataagacacttgtcctgccaaggtgataagtgacaataaccaaaggctttttatttcccaggttactttgctcaaattgatgagatgtgaaccatcggtctgcttattatgcccaaacggagtctcattttataaagtgagactccgtttaaaaagtgtgtaagtgattgtaattcatttgcttaaataaaataaagtctacctagatgcgttgagattcatctcccttgttttttgaaatcattctccggaattgcctttatatttgcatcgtgttcaaaaccgaaaaagatagtattatggagacaacagcttacacttccgacaacattatcacccgttcttacgaggaatatcatcaggtaatcttaaactatattacctatcggattgctcaccgttatgaagcggaggatttaactcaagatgtatttgtgcgtctgatggattacaaacagatgctccgtccggatacagtaaaatacttcctttttacgatcgcacgcaatttagtgaccgactatatccgtcgttattataaaaagcaggagatagatagttacctctatgattttactgtcacttcttccaatgatactgaagagaaaatcattgctgatgatttgatggcgatggaacggacacggttggcagccatgcccgaacagcgacggctgatctatacgttaaatcgttttgaggataaatcttctccggagatagcctccgaattagaattgagttgccgtacagtggaaaaccatctttttctcggacgccgtgatatgcgtgacttcttccgaaactgtatataaaattattcatataataaacaacctttggtgcttatggaaaaggaatcaatactgagtgagaggtatctttatgcctcaacaaattttagagaacaagaatttaatactatttttaaacctcaaatttaatgttatgaaacgaagaggattaatttttaattcgcaacctaataaggcggtcatagttgctttaggactgatgttgatgctgtgtccggcttcccggacatgggcttatgcaaatgttaatgatagcaggactatagcacagtctcaaaaacaagtcaaaggtcaggttgtagatgcgacgggagaacctgttattggtgcaagtatactcgagaagggaactacgaatggggtaatttctgatattgatgggaatttctctttaaatgtaagttctccgaatgctgtgattgttatttcgtatattggttttaaatcaatggaacttccggcttccgatcctaaattgcggaagattataatgaaagaagacactgaagtactggacgaagtggtggttgtaggatatggtactcagaaaaaggaatctttaacaggtgctgtaaccgttgtaggagccaaacaactggaaaataaaggtacgatgtcaagcccgttgcaggcaatgcagggcactgtgcccggagtacttatcactcgtaattccggagctcctggagatgagagttggggtatgaaacttcgtggagcgtcttcatccaactctactgatccactcattattgtagatggtgtggaatatagtgacggtatcaacggtatgcgtaatttgaatccggatgacattgaatctatcaacttcctgaaagatgcttcggctgctatatatggatcgaaagcagcgggaggtgttgtattgattacaacgaagaaggcaaaagcgggtaaaactgttgtccagtataatggttcttttactggaaaagtggtagggcttcaaccggaattgatgtcgttggatcaatgggcggatgcagtgattactgctcagactaatgatggctattctgattcaaactggattcgctatgccagactagccaaattgtataagaaccagtacattgatttgagtcatagtgcacacccgattcccgaaggattcaaggatgtggaagactttgtctttatggataatgactggcaggatattttatggggaaattcatggtctacacaacatgacctcagtgtctcgggaggtacagagaaaaacttgtttcgtttgtcactgggatatatgtatgacaacagtaccttgaaatggggaaataataacaatcaacgttacaatatgcgtttgaacaaccaatttaagctatcggatgctgtgatgttgacatctagtatcggttataaccgtcaggatcaagtatctcccagtatgatagggaaagttctttcccagtcttccccacaaccgggtttgcctgcttctactatcgacggacgtccctatggatggggaacgtggcgtgcattgaactggtgggctgaggaaggtggagacaataaactgaaggtttcggctatcaatatcagcgaatcgttgaactggaagatatattcggatctggatgccgttgtcaatgtgggctataacacttcaaccgctacacgtgagaaagtagagaaatctattgattggtataattatgcaggcactaaattgttggcgacagaacctactcaggaaaagagtaaatactctgattctttttcaagaacagactactatatggtttccggttacctgaattggcacaaaacattggcggaagtacataatctgagtgcaatggctggtacacagtataattacacacagtataaatatacttttgtatctgtaaaagatatcaatccgtctttagagataccaaatggtgccggagaagttctgataaaagatggagacagtaagcctgcaaaatggcatgaggcaatgatgtcctatttcggacgtttgaactatgattataaacaacgttatttggtggaaggcaatctgcgatatgacggttcttcaaagttccgtcccgaaaatcgctggcaattcttttggggagtatctggaggatggcgtttgagtgaggaaagcttcatgcagccgttatcttctttggtcagtaacttaaagctgagactgtcttatggtgtattgggcaatcaaagtggcgtagatcgttacgatggtactcagttgtataatttttcttcgtctagcggagcatatattggctctggaaaagtttcgactattgatacgaatgggaagattgtaactacagaccgtacttgggaacgtattcatagttataacttggggctggacttcggattcttcaataaccgactgactggtactgtagagttatttatgaagaaaaataataatatgttgattgatgcccagtatccgggtgtgttgggagataatgccccaacgatgaatcttggaaagtttgaggctaaaggatgggaaggaaacatgacgtggtcggacaaaataggacctgtacaatatcatattggagggactataacttatactactaataaattgattgatttgggagcaacttccgttctgaaatcaggttttgttggtaagcagcaaggttacccgttgaactcatattttggattacgctatgtcggtaaaattcagacccaagaagaactggaaaaatacaaatattactatttggatggcaatggaattggaatgcaggataatcttcgtctgggagaccacatgttcgaagatgtgaacggtgatggcaaactggatcagaatgattatgtatatttagggacggatgatccgaaactttcttattcaatcaacatcggattggaatggaagggctttgatctctctgctatttttcagggagtggggcgcagaacagttttccgtggtggtgaaggaaatgaaacatggcgggtaccgatgagtgctatttacttgaatactacaacccagtccatcggtaatacatggaacccggagaacagaaatgcctattatccctcttatacaagcattggttctataaataattataattatcagtgttcttcttggtctgtagagaatggagcctatctccgtttaaagaatctgactttgggatatacgttacctgcttcatggttggccaaaacaaatgcgatcagtaaactacggatatactttacaggagctgatttatgggaacatagtaagttaagagacggctgggatccggaagcttcacgtaaaactaaagatttaggacgttatccttttaacagaactttcacggtaggtgttaatgcaactttttaaatagaatagtatgaaacgatcaaaaataacaattctccttgccatagtgttaggaatgacattccactcttgtttggatctggaacctcaggatcagttgggtggtaagaatatgtggacttctgtcaatgattataagcagtttgccaataccttttatagttggacgcgtgatttttcttctgtcgtatatgatggaacacatagtgacaaacgttcggatttgattacttatcagagctacaatgaatttagccgaggaataaattcaattccgtcttcggacgccaactatacggataactacaagcatatccggcgcacgaacttattgttgcagaatgctgaagcttatgctaagccggaagatataaagcaatatataggagaggcttattttttccgtgcttatagttattttgacttacttcaattgtatggagacgttatcatcaccaagaagccgttggacattacagaccctgagatgaaagtaaaacggaatgaccgcagcgaagtagtcgatcttattatcgatgatcttaatcatgccgttgaaaatttaccggcttttaaagaacttacgaccgaagaggaaggacgaatttctaaagaaggtgcacaggctttcctttcaagagtggctctttatgaaggaacatggcagaagtcgcgtaatggtaatcagaatacgcaacgttccgctaatctgttggacatagctgccaaagcagcacggactgtgattgatgctaaatatggatacacattccgattgtttggaacagacagtgagacaaaaatactgggtgacagtgcgcagaagtatatgttcattttggaaaatgagaagtcaaatccggcaggtattaaaaagtcttctaatcatgagtatatttttgctcgtcgtcatgatcaggtattggcctcaatcggtaagaatataacgcaagaatgtctggcaaatgtgcaatgggtcactcgtaagtttgccaatctttatttgtgtgatgatggattgcctattgagaaatcggggcgcttccagaagtatgataaaaaggtctctgaatttttgaatcgcgataatcgtatgcgttatacgttgctgaaaccgggtacccgctattgggggaataaattcggccgaacttcgtggcagtgggatgagacggatcttaaaacatccaaagtttatgatccagcttccggtacatgttatggcaaccaaaaatggagtgctgaacgtgtggtacccgatacgcaagagggatatgatttcccgcttatccgttatgcggaagtcttgttgaattatgcagaagccatatatgagagagatgataaaattgaaaatgaagacttgaatatttccttgaatctggttcgtcaacgtgtaaataccaatatgccggcattgactaacgagcttacacaggcacatgggttggatatgagaacggaaatacggagggaacgtactgtcgaactctttaatgaaggatttcgcattgatgatttgaaacgttggaaaacagcagagaacgagatgccgcagactatgttgggaattaaatggaaggggactgaatatgagtcctggaatacaacctttagtttgaatgatgaaggatgtgttgttgtagagactgggcgtcagtgggcggataagaattacttgtacccattgccttctgatcagttacagttaaatccgactttgggacaaaatccgggttggggagaataatggaatatgaataataaaaaagaaaaaatatgaaacatatagctttcttatcagtaaaatggatgtcagtaggtcttgggatgctaagcttattactgtcagtagcttcatgtggcgataaggaatatggtgatgctatgaatgaggcgcaactaatgaatgatatagaggtaaatgtaggttcatcactacctttagctgtaggaatggattttgttttagattataagccggttccggagaatgtgacgaatccggagattactttaacatcatcggacgaaaatgtggtgtctgtttcgcaggacggcagggttacggctaagatgatcggaaaagcatatattaatttgtctcagagtaccgcctttgagactctcaaaacaatagaagtccaagtaatgccggtggctacagctatagagcttgaaaacgtggaactgtttgaaggaacaaataagaaagtgattgtcaatgtgactccttcagacggatataatgtgtttgattggaaaagtgataatgaagaagttgcaacggtagcggacgatggtacgataacggggaaaaagcctggaacagctaatatttcagtttcaagtcaagatggtagtcaattgactgctacggctgtagtaacagtaaaagaagtgattcctattgataaaatcacattaagtgaaccgggatatgatatgatgataggagataagactctgataaattgtcttttggaaccaattgatgcatcggttggattattaagctggagtactaccaatgacagagttgccacagtggatgctgatggcttggtaactgctgtgggtgcaggtgaagccgaaattatagctcaggatccattgtccggactatcagcatcgatagctgtcaaagtagttggtgaaggagtagtctcattgtcactatcttatgttcgtaatcaggatgaactgaaagcactgggatggggatttggacaaacgcccgcttcggtcaattttgatgctgaaggtatgactgtaaatatgtctctgcaatcgaacagcaaatatagggcagacttaaagatggcttctaatgaccgtccggttgtcttgaatataggaacttaccgctatcttgcctttagaatggatgtgccgggtaacggaagtcttaagttggatacgaacaaaggtgattatggtaacaatccgaccggagttttggctgaagattcgcaggttatatattatgatttgcaggctaagccctattttccaacggatgctccatcggataagttgacgactttccagctgaagatagcggacgttactgtacaaccttattcttataaggtatattgggtacgtactttcaagacattggaagatttaaaagtttacgtagaaaaagaaaataacaaataaatctgaaatatgaaaacgaaatatataagcttattctttagctttgtgatagcatttggtatgatgtcctgcagtagtgaaattcccaatggggataccagtaaattcagtgatttgaaaagtcctgaagaagatatggttaagaaagactatttgccattgaagcatccttgtatgcttcatacacaggccgatattgatcgcgtaaaaagtaatctgacacgatcgccctggaaagatgcctacgctcaactggaagcaagcgattatgcgcaaagttcttatacagaaaaaacgagtgctttgcttgatggatatttgaaacgaatggataagaataattggtcgggtaaatatccggattactctaattacacatcgtgtatgtatgatgctgcggctgcttaccaactggcactccgctatcagttgtcgggaaataccgtatttgcagatgctgctgtaaaactgtttaatgcatgggctacgaactgcaagggtatattgagaatggaaggttatactaataatattccagaccctaatttatatttgatacctattcaggcacatcagtgggcaaatgcggcggaattgctcagagattacaacggatgggataggaatgattttgagaagttcaagacttggatgaaagatacgttttacagtgtttccaatatgttccttaagaatcataacggcggacagggcaatatgcattactggctaaactgggatctggctcagatgacatctattctttccattggaatattgtgtgatgataatgtgctgattaatcaagctatcgtatattttaagaatgaagaaggaagatataaagaagctggaaatatcaaaaatgcagttccttttttgcatcaggatccggattctgatgagattttgggacagtgtgaagagtcgggacgtgaccaagggcatgcgacattgtgtgtgtcattgatgggggcattctgtcagatggcttatagtatcggtgaggacctgtttgcttttgataattatagggcagtagcaatggctgagtatgtaggcaagtacaatctgatcaaagatgaagccttcaataaaggaacattagttggtgatgattttgtatatgattccaattctttcccctatacttcctattcaaatccgtcttataccaatacaactatatctacagaccagcgcggaacgaaaagaccggcatgggaactgttctatggatattgcaaggcaaaaggtatatcttccatttacagcgggaagtgggcagagcaaatgcgccccgacggaggtggtggaaactatggaccgaatagcggtggatttgatcagttaggtttcggcacattgatgtattaccgggaatgacgatacattttggaatatttttgcgaggggattaggtatttacctgatccccttcgtatatataagcaaataggtcagtaataagattgttgaaaagagataaaggattcagtttttgaaagattggttttaatataaggtaaaaagaacctgtttttaggaataacgattagtatgtttgaatgaaattattagtaaggtaatatgcgtaaaaagattctgtttatagcaggaatgatggcttgctgtacttgggcgggtgcacaggaaatatcccagacctgggtggctgataaaggcaatggtacttatcagaaccctgtgctttatgccgactattccgatccggacgtatgtgcggcaggagatgatttctatatgacggcttccagttttaattgcataccgggacttcctatacttcattcccgtgatctggtaaactggtcgctggtgaattatgcgttgccggtacaggaacccaaagagtttttcgataaagcgcagcatgggaaaggtgtatgggctcctgctatccgctttcataagggagagttttatatttattggggcgatccggattatggaatctacatgataaagaccagagatccgaaaggatcatggagcaaacccgtattggtgaaagctggaaaaggaatgatcgacccgacgccactttgggacgaggacgggaaagtatatctgatacatgcttatgccggcagccgcagcggagtgaacagcattctggttatttgcgaactgaatgcggaaggaacggaagtgatctccgatccggtaatggtgttcgatggaaatgacgggaagaaccatacggtagaaggaccgaagctctataaacgaaatggttactattatatttttgctccggcaggcggagtagctaccggttggcagctagtgcttcgttcaaagaatatctatggtccctatgaatcaaagatcgtgatggcgcaggggaagaccaccatcaacggtccgcatcaggggggctgggtagatacaaatacaggagaatcgtggttcgtccactttcaggatcaaggggcttacggacgtgttattcatctcaatccgatgaaatgggtgaatgaatggcctgtgatcggagtagataaagacaaagacggttgcggagaacctgtcaccacctataaaaagccgaatgtcggaaagatgtatccggtaactactcctccggaaagtgacgagttcgatacacggcacttgggattacagtggcagtggcatgccaacaaacaggatacctacggatttacgaccgatctgggatatatccgactctatgcaggcagcctttccaaagagttcgtgaacttttgggaagtgcctaatctgttgctgcaaaagtttcccgctgaagagtttacggctactaccaagctgacgtttaccgccaagcaggatggagagcaagccggaatgatagtaatgggatgggattatagttatttgtctgtccgtaaagccggcgacaagtttatcctgcaacaagtcgtatgcaaagatgcggaacaacagcaccccgaacaagtgaaggaactggcgagttttccggtggaatatctgaaaatgccgggagtggctgataatgagtggaagaccgtttacttacgggtaaaggttgccaagggagccgtttgcacctttgcctatagtctcgatggaaagaagtatacagcagcgggagaaccttttactgcccggcagggaaagtggataggagcgaaagtcggtttattctgcgtcactcctaatgacggaaatcgcggatgggcggatgtagactggttccgggtaactaaatgataagaaagaataagtgagaataaaaaataagaaactaacacgaagatatagaacgaaaaaatgaagaagattgtagcagggttggttgtagtactaggcttttgtgcatgtgcccatcggacttccggtacgttggatgtgaataaagctctggattattgcgcggaacagacccaacgttcactggtagaactgaaaggagactcgggtatagactatacaatgatgccacgtaatgtcatggcagacgaacatcattggaactgtcggaaagcaacgaaggaagaatggtgtgccggtttctggccgggagtgttgtggtatgattatgagtatacacaagacaagcatatactggaagaagccgaaaagtttacggcatccttagagttcctttcccgcattccggcttatgatcatgatctgggctttttggttttttgcagctacggcaacggatatcgcctgaccaagaatcccgcttacaaacaagtgattctggacacagccgattcattggctactttgtttaatccggtagtcggcacgatgctgtcctggccgcgggaagtagaaccccgcaactggccccacaataccatcatggacaatatgatcaatcttgagatgcttttctgggcagcaaagaacggggggaatccttacttatacgacatcgctgtatctcatgccgacaagactatgaagtgtcagttccgtccggactatacctcatatcatgtagcagtatatgatactattacaggtaacctgattaaaggagtgactcatcaaggatatgcggacagcacaatgtgggcacgtggacaagcatgggctatttatggctacaccgtagtctatcgtgaaacgaaagatcccaaataccttgactttgtgcagaaagtagctgatgtctatctggaacgcttgcccgaagacaaagtaccttattgggatttcagtgctccaggcatacccgatgttccgcgtgatgcttcggcggctgccgtagttgcttccgcactgctcgaactgtctgcctatctccccaatgggaagggcaaacactacaaggatgccgctatcgaaatgctgacaagcctgagttccgacaattatcagagcggtaaaagtaatccggctttcctgcttcatagcacaggccattggccggctcattcggagatagacgcttctattatctatgcagactattattatatagaggcattgcttcgtctgaaacgcctgcaggagggagaaggagtattgggatagaaataaaaagggggatgtgtcagacttcccttttaacgaaatcatcctcgccacagatagctgtagcgaggatgattttactggttaggatttaggttgttatttctttaccttgatgatgtcataattcagatcgctgacagcttcctgcaggctatcgtttaccaaacgcagggtagtgtcatttacaatcacaaaatacattggagcctcaccatcattcggagttaacttaacagctttggtaggttttttgttcactactttttggatagtctgttgttttcctttagaagagaaggttttattcttaccctgaccttctgcatcgaggtaagtcatatccagtgtatacgtggtatctacaccgtcagttgcagcgttcagggtcaatacgtagtcgatacccggaccgtcggcagcagggagtgtaccttcataaacttcggtcacttctgtgatcggagccatttctatagaaagactgtctgcttctgcctctgcggctttgttggcttttgactggcaagatgccaaagcagctacgactgctgctaacataattacttttttcatcgttaagtgctttaagttaatataaatatagtgagcttactgctcgggttattttttctttattcttcttcgtcccgtttgatgaccagcagtttgtctacccgtccgcggtccatatctactacttcgaattgcaggttcttgtaggtgaagatatctccggctttcgggataccgcccagcaggaacattgccaatcctccgagggtcgtgaagtcttcgtcctccaggtcttcataagataggattcccatctcttccataaagtccttgatgttcatcgaagcctccaccagcatcgaaccatcctgtcttctgacgatatcttcctcttccgtatcgtcctcttcaaggatgtctccgaagatgctttcggtaaggtcgtgcagggtaatgataccttctgtactaccatactcgttaacaacaactccgaacttgtttttgttcttcttgaacagctctaaaattttatttgcatataaactttcggggataaacagagccggacgggctatttcgcgcagattgaactcttttttattgcctaccatcagaataatatcctttacggataccacaccgataatctcgtctttccgctcgtccaccaacagatatttgctgtagtgctcttcttcgattgtcttcatcaccttgtctttcgtatcgtcgggatggaagatgacaaggtctctgcggtgcgtcatcagttcattggcacgtttgtccgagaagcggaacacatcacgcagcatttccgtctcttccttgtcgatcactccctgttcggagctttggtggagaatcattttgatctcttcctgtgtcatcgggcgttcttcgttctttacgccgatgattctgttcagcaggcgggtggagatactgagaaaccagacgaacggataggatactttcgtcaataaaatcataatcgggctgaacaaggttgcgtaccgttccggattgctgagggcaatggacttgggaaccagctctccgatgataagagagagataggtgatgattaccacagtggtgatcatggccagattacgtgcataggcttccgctcccggtatgagggagaagagcggaacaaggtcgtctgcgatagcgacaccaccataggcaccggatacgataccgatcagggtaataccgatttgaatggtggacaagaacttttcgggttcttccagttgtttcagtactccacgtgcagatttgttgccttttccggcgagagtttcgagacgtgctttgctggatgataccagcgcaatttcgtacatggcaaagatgccattcagtacaagtaagagaagtatgataagaaattccataaatggatttaaatgattattgccgtgaaattaaatgaaatcacgacatcatgcaaatatgtgctgtatattaatgattttttaataaacaattggtgcggaatggtgatgtattctttgaaatgagggggcttaagaacaaaagaacatattccgaggttgcaaagtaaatgctctcggaatatgttcttttgtaatttctgatcttgagtcttttttattgtttgtatttatcagccagttctttagcacgggctacacgtttggcagtgtcggggtgtgaagaaaacattctctgcatgtaggaagatgcgggagccccattggacaattcgagaagcttattcagtgatttgtacataccataagggtcgatgttgttttttacgcagaactctacgccgtaggcatctgcttcgtactcttgtttctgtgagtattgtgcgccggcaagtgcttctgccattgctcccagttcagagtcagtcagtttggcgacctggctgctggctgctcctgccgcattctttacagccgaacggaaatatgcattcttcattgcgtctttagagtcggtatggatgacatgaccgatctcatgaccgattactgccattacttcttcgtcagtcatgacgtccatcagtccggcacagatacgcacgctgccgtcaccacaggcgaaagcgttaacgtccactacttcatatacgccaaagttaactttcataccatctacttctttgatgtttccggtcagtctttccaggcgttttccgtattcgctgtccggtttggtcagtgggttatgcttgtccatccattccatatactccttgctcatagcagcaatgtcggcgtcagatagagagattgcttgtgcggcatcttttcctgcttgaatagctttgcctaaattgaatttcttgaattgtgctgaagcgttaaaacaactcatgcccaaaaataacagggctactaatgcaatttgttttttcatcatagtgaatttttagtttgttattatataatatagtgttagta

SEQ ID NO: 87 - DNA, 31958 bp, Bacteroides thetaiotaomicron
tctttatatatatcatttatataaggtgttctctctgagaatcttaagaggtccgtacttgtgaaagtccgtacttctgcaataataaccctttcttcacttaaatgtgaagattacattggggaatagttggaaaggtggtgcttgcgaaagtactcctttctcttacctatttcctgttggaggatgtctccctttttcccacggacatcctcttttatacaaaaaggcgactcatactgaatgggccgccttttctgttatttaatctcgatttcctccttcatatcgatttcctctccatgtgtatcgtagaacacatattgcaggaaagcgagtttctgacttggaatgatcttgataccgaatccgtatttcatctgccacttccgtctgagggaaacgagtccctgattgatgaaggcggcgacatacggatggacgtgtaacgagaatttctttaccttcagtttgttgaccagataatcaattttactctctaaagtgtccgtaaagagaatggacgatttgatagtaccttttccgaagcaggtagggcagatttcggtcgtgttgacgtccattgccggacgcacgcgttggcgtgtaatctgcatcagcccgaatttgctgagcggcagaatattatgccgtgccctgtctttctgcatgttggcacacattcgttcataaagcttctgacggttttcggcttcattcatatcgatgaagtccacgacgatgataccacccatatctcttaatcgcagttggcgagccagttcgtcggcggctcccagatttacttcgagtgcgttaccttcctgcccgttggcattcttggtgcggttaccgctgttcacgtctactacgtgaagcgcctcagtgtgctcaataatcagataggcaccactcttgtaagagactgttttaccaaacgatgatttaatctgcttggtgataccgaaattgtcgtaaatgggaagctggcctttgtacagtttcacgatgtttgcccggtcgggtgcgatcagtgtcacgtagtctttgatttcattgtacacagcctcgtcgttgacgtgaatattctcaaaagaagggttgaagaggtcgcgcaacaaacctacggcgcggctggtctcttcataaatcaacgtcggatacttggtggctttctgtactttcgccattgcatcttcccaatgcttgatcaggactttaagctctccgtcgagttcggccacgcgtttgccttcggccactgtgcggacaatcacaccgaagtttttcggtttgatgctcatcaacagttgtttcaggcgggcacgttcttcgctcgatttaatcttttgcgaaacggaaaccttatcattaaaagggatcagtaccagatagcgtccggcaaacgaaatttcggacgtcagtcgcggtcccttggtagagataggctccttaacgatttgcaccaccacttcttgtccgacctttaatgtattggccactgtgccatccttgtccaggtcaggaagtagggttgctttactgatggagttcagcttctttttgtcgcttaaagtctgctttacaaacttttcgagtgagttaaattgaggacccaggtcaagataatgaagaaaagcgtctttctcgtaaccgacgtctacaaagcatgcattcagtccgggcatcaatttcttgatacgtcccaaatacatattgcccactgagaaagaaatgtttcttccttcgctttgaagttccaccagactcttgtcttcgagaagggcgatggagacctctttgggctgtacgtctattacaatttcacttgtcactgttttgctttcttattattgattgaatctcatttatatgaacaacttttttgacaaaatgttcatttagggttagctacttaaacaaagaacaaacttgaaagacatgtagcttcgcaagtttgttctttattctgtttgatcagacttaaaaattattttttgcttttatgtctgttctttcttagtctttttttacgcttgtgcgtagacattttatgtctttttttcttttttccgcttggcatagcttcacattttatgggttaatactcttgtttattatttctttactgaaattgtaaatgtcttagccggtttgaaggccggaatgttgtgctctggaatgatgatagtagtattcttagaaatattacgagctgtcttttgagctcttttcttaactacgaagctaccaaacccgcgaaggtatacattctcatcgttagacaatgagtctttaacagcttccataaatgcttcaactgttgtaagaactgttgtcttatcaataccggttttctttgtaatctcgtttacaatatctgctttagtcatttttccttaaaaaaaatattattactaggttcttgctaattttttggactgcaaatatatagctttttggtctcctaaaaaaatatattctgcacatttttctaaaaaagtggaggcattaagttttcttagagacaaaagagttacttttgtactgcttttggatagtatatacgagataaatgttagatgatagatcgaaatcaggaatgaatatttttagtgaggctatagttgaatggtataaagaatacaagcgtgatttgccttggagagaatcgtcggacccgtatcggatctggatatcggagattattctccagcagacacgggtggcgcagggatatgattactttctccggtttatcaaacgttttcctgatgtgaaggcattggcagacgctgacgaggatgaggtgatgaaatactggcagggactgggatattattctcgtgcccgcaacctgcatgctgcggccaaaagtatgaatggagtttttccggaaacataccccgaagtgctggcgctgaaaggagtaggggagtatacggcggcagctatctgttcttttgcctacggtatgccttatgcggtggtagacggaaatgtgtatcgggtactttcccgttatttcggcattgatactccgattgactcgacggaaggaaagaaactgtttgctgctctggcggatgaaatgctggataagaaacagccggctctttataatcagggtattatggacttcggagcgatacagtgtactccacagtcacccgattgtttgttttgcccgttggcggatagttgttcggcactttcaacaggaagggtgactcagcttccggtgaaacaacacaagacaaagacgacgaaccgttactttaattatatctatgtacgtgcgggcgcgcatacctatataaataagcggacggcaaacgatatatggaagaacttgtttgaactgccactgatagaaactccggttgctttgtccgaagaggagtttcttgcattgccggaatttaggtcattaatagcatcgggtgagaatccggtgatacgcttagtctgccggggtgtgaagcacgtgttgtcacatcgggtcatctatgccaacctgtatgaagtggctttgcccgaagacacgaagtccttcgctaactttcagagaatacgattggaggaattggacaagtatgcgatttccaagttggtgcagaccttaattcaggtaataagtaataagtaaaaagtaggtaataagtaataggtaatgggtaataggtaataagctgcgctataaaccgaatggttaatacttaatacctattacttattacttattacctactttttacttattacttaaaatacttgcatactattgttattctgtttaattttggcagcagatttaaataatagaatcataaacttgatacatgtatgtcagtaaataaagtgatattgataggaaacgtaggacaagatcctagggtgaaatatttcgatacaggttcggcagtggcaactttccctttggctactactgatcgtggctatacattggccaatggaacccagattcccgaaagaacggaatggcataatattgttgcatccaaccgtttggctgagattgtggacaaatatgtgcacaaaggtgacaaactgtatctggaggggaaaataagaacccgttcatatagtgatcagtcgggcgctatgcgttatatcactgagatttttgtggacaatatggaaatgttgtctccgaaaggggctaatacaggtgcgggagctcctcaaccatctgcaacacaggctcagcagccgcagcagatgcaacagccgcaacagccgcaacaacaggcgcagccgtcacaggcacagccgatacaagataatccggcagatgacttgccgttttagatactgtgataatgtgtcaataggctgatggctgattggcacattatcttttgtttaactaaaatacatactctttggactcagatggttatttaagccaattggctgaaattttcaacggtattaccgtaaacactccttcaatctctgctattatcgccatagtactggcaggtgtgctcctgcttgcttccggctttgcttcggcttctgaaatagcttttttctcactctctccttcggacttgaatgatattgacgaacacaatcatcctgctgacgaaaagatcagcgcactccttggagattccgaacggcttctggctacgatactgatcactaacaattttgtgaatgtgaccattatcatgctctgcaacttcttcttcatgaatgtattcgtgtttcattctcccttggcggagttcattatactgactgtaatcctgactttcctgttattgttgtttggagagatcatgccgaagatttattcagcacaaaagacattggcattttgccgtttctccgctccgggaatctattttctggagaaactgtttcatccggttgcttctatgctggtgcgttctaccacttttctgaataagcactttgccaagaagaatcataatatttctgtggatgaactttctcatgcattggaattgacggacaaagctgaaatttctgaggaaaataatattttggaaggaattatccgcttcggtggtgagactgtgaaagaggtgatgacatctcgtcttgatatggtcgatctggatgtccgtacccctttcaaagaagtgatgcagtgtatcattgaaaatgcttattcacgtatccctatttattccggttcgcgggataatatcaagggtgtgctatatatcaaggaccttctgccacatgtcaataagggagataatttccgttggcaatcattgattcgccctgcttattttgtgccggagacgaagatgattgatgatctgcttcgtgattttcaagcgaataagatacatattgccattgtggtggatgagtttggaggtacttccggactggtgacaatggaggatattatcgaagaaatcgtaggcgagattcatgatgaatatgacgatgaagagcgcacgtatgtagtgctgaacgatcatacatggatatttgaagcaaagacacagttgactgacttctataagattgcgaaagtcgatgaagatgaatttgaaaaggtagtaggtgacgctgatacgctggcgggcatgctgctcgaaataaaaggtgagtttccggcattgcatgagaaggtgacttatcacaattatgagtttgaggtgctggagatggatagccgccgtattctgaaggttaagttcacgattcttccgaaggagatggatgagtcggagagtaaggagtgatgagtagataagacctgttcgggcggagaaactataatcggagaagaaattataaaccaaaaacgatgggattatttctgcaacataaaacggttgatatgcagtggtctgtctggaagatggaggaatctttggatacactgtttagtcttctgcccgatgtccgaagagtttcttgtgagcaggaaatgcagcgttttacttcggaccgaaggaaactggaatggttgtctgtccgtgtgctgctatattccatgttgcaggaagataaagagataggatattcatcggaaggaaagccgcatttgacagacaattcttcttttatcagtatttcgcatacaaaggggtatgtagctgtgatacttagttccgtagctcctgtaggcattgatattgagcaatatggacagcgtgtgaaaagagtatacgatcgttttatccgttccgacgagcgagtagaaccttatcagggagatgagacttggagtatgctgttgcattggtcggcaaaggagacaatcttcaaatcaatggaaaatgctgacgctgatcttcggaaactttgtttatcacatttcattcctcagagcgaaggggtattccaggtgcgggagtatgcaacggaacggcagcaattgttcaccgtcggttatcgtatttgtccggactttgttttgacgtggactgtcactatttcatgaagcatctttgcatattgataaacggtgaataatgagtggaatggtccaccattattcaccgcttatctttggttacttatctttcttgttcagtctgtaacttaatgctcccgacggacatttactgatttgtgcaattagctcttccgttgtagcattctcgatttgtacccacggcctctctttcgggtggtaaacattgggtaacatttttacgcagattcctgcatgctggcacatttccggctgccatgcaatggttagttcgccattggtatattcaactttttttcccatatctatacttatttaatatgaatgccacgcattacaattctcttccattccggatgtttatgaatgtatccggctacaaacggacaaagtggaactaagcgtaaaccttgtcgttcgatatccgccaatgtcttttctgcaagctgtgaaccgactcctcttcctccaagggaagcggggacttcggtatgtacaagatagatttctccattatttgatttgatatagtctatcttggctatcttgtcatcgatctgaaattcataccgatgtttctcctcattatcgattaatttataatcttctgccataactttacgtattaagtttgattataatataaacacttgaggattgattttgtttataaagaattttcagcttgcttacaaggtcattgccatttgtcttgtctacctgctatacagacaatcgttctaactgaacggtaaaatgccgcatcaagggggcttcccaagcgatgcgcacaccacgggtgatcgtttctctccgttcgaatacgtttctgagggcggcagctattacgttcatgtgattgtccgtatataccctgcgagggatggcaaggcgaagtaaatcaaggccgttaaagcgattttcgtgagtaatagggtcacggtcggcaaggatgtaaccaatctcgcagccgcgtatgcctgcctccagataaagttcgacggttaatgtctgtgcgggaaattcttctttcgggacatgtgtcagcactttggaagcatcgacgaaaatagcatggccgccggcaggtcgttgataggggatttcgtattcgtccagtttctgggcgaggtattctacctgtttgatacgtgtttccaggttatcaaattctgtattttcgtcaagaccgatagcgagggcgttcatgtcccgtccgttcatgccgccgtaggttaagtacccttcgtattgcacgcagaaacctttggcaccttcataccattctttgcgtcgggtggcaatgaaaccgcccatgttgactatgccgtctttcttggcactcattgtcataccgtcggcaagatcgaacatttcacgggtgatttctttgattgatttgtcttgataacctttttcacgcatcttgatgaagtaggcattctcagcaaagcgggcggagtcgaaaagtacaggtttgttgtatttattggcgatagcacgtacttcacgcaggttttgcatggatacaggttgacctcctgcggtattgttggtaatggtaacaatgataaaaggaatgcggtcggcatattcgcttagtgctttctctaatttggcagggtctacatttcctttgaagggaatttccagttgagtattctttgcttcgtcaatcgtacagtccagtgcgatggcgtgccgtccttcgatatgtcctttggtggtatcgaaatgtgagttgccgggtactatattgccttcatgtaccagataagagaaaagaacattttctgctgcccgtccttgatgggtaggaatgatgtattcgaatcctgttattcttgtaatggtatcttttagtttgaagaaggaggtggcaccggcataactttcatcacccagcatcatgcctgcccattggcggtcgctcatggctcccgttccggagtcggtgataagatcaatataaacttgctctgatttgagttgaaagacgttataatgtgcttctttaatccattgctcgcgttcttcgcgggtactttttctgatgggttctaccatcttgattttccatgattcagcaaaaggtaattccattgtcttcgattttagatttttatccgactaaaatactgaatatagatgatatagacaagtttttgatgactttttgtaaagacggagataggacaataaattttaataagaatgaaaagtgacgcttgtatatgtatgaatatccttattgtattaatataaaaagagtcagatctcaggaaatgaaatctggctctttagttacttgataataattatgtggtcatttatttgtaatcatacggtcaattggataagattatatggtcaatctgttacaattgacaggttgattaagcacaaatatatggtcaattttattcaggtgaacggtgctatttatttttcgatgagggtgataccgtcaagacagaaataagaaggagtattcatttgaccattgtcattgttatcagtagaactcatttcgaatgtgatataatctgcttctttaataccgctccaatcaaaccattgccatgtattaactatttcttgcttgttatttcggaaatctgccagatagaaatcgatactgccgattttactaccatcagctttatatcctgttgctgttagttttaaccagtcattgtctttattgctgaatgggcctttgattattgagtaatcacctgctccatcattaccatccttgatggctaagtaatcataagtcgtatttgttacccatgcacctttgaagttgtatttgctagtattaagattcgtgatttgagcaggggtgaaactattggtatttgatgtcagatatactttcccatttttaccttttcctgtgatagcactgaggttgctatagccgggagtctttacatcagtcttgttggtgtaggtgaaacctccaccaaatccccagtctccataataatgagatagctgtatcatcttttgcggatcgctgatttcatatttgaaataaacttctcctttctctcctaaatctgttttaaattcactctctgcttcagttaattggttttcgaaactgataactacttccattttctcatcatcatcactacatccacaaaaagcgaatactgataccagtaagaataaagataactttttcatttttgctttcatttaaattattaattgttttattgattagttctcgaaatgtaaatcctctactgtcattacttccgtggaaatttctcccatccaacctacgttttgattgacagctgtatatattttcacaaaatcaattttgtctaattctacgtgattcccgttttgatcaacagcccagtctattttgaattggctgaactccgatctgttgggatgattatccgcatatccccaaggataacagtaccctacccaagtacctccttcatttattgcattgtctttcaagcgtgttccgcgaaaagtaatttcatcttcttctatccaattgggatagtaggaatcctgttgatggtaactgttgcgatagacgaacccttctcctccttgattgtcggtccagcggacatcaccattggcaggttgaggacgataataggttatttcgtaattacgggtttccgtatctttcccatattcgcttcctgccagttcataccattcatcgtccggcaatccattgccattttcatcttttgagactaagacaatgcccggttcggcacttcctcccaaagctcccgtaccggtattctgattgtatgaggcattgcctaaaattctgaagtcatattcgcctttactattacggattgactgatggaatccgactgtaatcgttcctccgaatccacctaaagaaataacagacttcttctttaatttctccgttgcatgttccaaaacctgtccggcagagaagccgtcttcgtaggcggaggttgttgtattaatgaactgtccgggggcagggatgtattcgaatactttgttggcaaaggcggaaggcgcattcggatcttccggtgtatcgcctgcctcgttctgtgaagccttgtcgctaaatactactgtattaggatttaagccgatatcattcagccgatattgaagctgcccttgttgattgaagcaaaggacatctcctttgactgtataattgtaagcttccgtgatatatatattcccgctgaatggattcagttgaatgctgaaaggcgtttgaatagccgttccgtctgtgataaagttatcccgtatgacggttcctgcattcaggtcaaatactttgatggcggaatctttagtctgatagtcgtaagtatatagataagcgatggggccgtcgatggcaaagctcagtactttttcatcatacgtaatggcgaccgcatccgtccggctgtcgattttgaccagatgatagtctccggcttcaatgtcagttccccgtgtgactacatacacggcttcttccagccccggaagtatttttcccggattcggtccgacttctattttcttggtctccttgaaagtcgttatgtcaatcactgatactgtagtgtctacgcccggtcccgaataatccagtccgccggaattggatacatacaatttcccgttttgtacgcagatatcttccgcatttcttccgactgtgacaatctcttcgatctccagagaagtggtgtcaatccttgcgactgtgccgtcataggaacatatatatgccttatccttatcaaacgctatcgcgcggggctgacgtgaactgccattgtcgcgcaacatactgatctgccggatggatttgcccgtagggaagtcaatcacctctacggtgctcgacacattgactactacataaatcttatttccatagatcgctatgtcattggctgtatctcccagtccccgctgattgtttgcactaaagtagttgttcgtacatctttgccgattgaaagaataacgagcgagcgaactattattctgattgaacagtccttcgcttaatatgtacatctccgctgttccggtttcgaatacatccccattgctttcgggtacaatacttggcttatcttccagatcatcgcaagcgataaagaagagtgggaaaagaaaaaaatacttccccagccgtagcaacatattatataaaagacctttctgcatacctaatacttattacttaatacctattacctaatacctgactcctatcgtcactcttaccgatcttcccggcatggggaaattcttaacgatctcataattcctgttcatcagattcagcacttccaggttgagtgatgctgtaactttctgtattttgaaatctctgtaggcagagatgctgtgatcactgtagctgtccaggcggttgtcgctgatgttttgtcctaacatataccgttttccggagaaaaggaatgaataggaaagattgagccatggagtttctattccggcttgtccggaagcggagacgcgcggggtataggctatctgatgcttgtacactttaccttccggtgagttgggattggagttggtaacgtccagtgcccgttggtaagtatagtttccggaaaggttgatccgtagtttatccagaggctggaggctgaggctggcagttgcatctatccccttgatatccactttgcccagattgaccatactccagatgaataagttcttggtaggagtggctacaatcttgtcggtcactttattatggtaggcgtctacggtggccgaaagataaggtataaagttgttgatggctttactataagtaatacctatattatattgagtagcactttccggcttcagattgatgtttccggccttgtcgtaatataaatcattgaagctgggcagacggaagatatctttgtagaagaaacggaaccgcagttcttcattatgaaacggctttagcgagatgctgacattgggagacagcttccggtggttgccggcattacctccgtttttagctttctcgttgatgacagttgccagagcagaagcggacagcgtcacccattcattgacgtatttcccggcaaaggctgtcagccatgaatagcgggtgggggagacgaagttctgcaaattggcattcatcgtattgatgcttccgtcggtggacaaggagaaagaaaggttgttccatatccggtatagagcggaagcggacaggtaatattcttgctggtaatagctgttgtcagttcctccgacggaggtaagagcatccgggtcctgatagttctgataactccagttccacttggcagaggtctggaatacccattttctgctaaactctttcttgtactggctttggataaaggtgttcttatcccgcagattttgtcgggagaagtcataatataaggtagtggcattgggcagcccccgtgaggactggtaataataggctttcagtctccattgctctttgtcggagagattggcgaaagcgcttatctcagcccgaaggttttctacatccgtattccggcgcttctctttactgacctgaacatcggcatcattcccgtaacgcagggtaaatggataatgcccgtccgaagacatccattcgccgttggcggtcatgctccattttttgttgagttgttgttccagaaaaagggaagggtttactaatccccatgaaccggtcttaaattcggcggctatattagtcggcttgtcttctttgaaatgcggagtcagtgtctgtatgttcagtataccggcagaagcaaaaaaacgggcaggctggaagatgttgtcgctttgtccgttgttgagcgaaaggcggtctacgttgtttaaggagaaacgtcctatgtctacttgtccggtctggcagtcgctgacggtgatgccgtcgtaggaaacagcggtgtgttgtgccccgagacttcggatggagacggtttttaatcctccgatacctccatagtccttcacggtaactcctgcgaaatgttttaccgcatccgatacctgcagtgcctgcagattctttaattcttccttattgaaaacctgcagaggagaggctgaacggacttcacgcgtctgataagggtcggataccatgatttcggggatggagtagatatgtgctgtatccactttttgttgttgggcaaaaagggataaggacaaagcctgacagcagagtagtacgctcatctttttaataaaagtattccttctcattgttttctttcagtctgttcataatgtaaaaagatgtccgggcgaactcacttcgaccggacatcataataaacttggcagagtttattaattagtacacactttctctgaatcagaatggtgaatgaaatgatggacggattgtccggttcattagactcatcgctttttcctcgaaagcagtgaaacgagtttgcatggtaggtcttctgacttgttcctgttgcgaacgccttcccggaatttgctttccagtggctataaagtcgattgctcgcaaccaaaaaatgaacttacagcagcgggactgttcaggactttcacctgattcccttttaattgcttccctcgtgcatgagagttgcaaaccaatgcgcgacaaagatagatagtttatttgtcttttgcaagagaggagcgaaggtaaatccatgactttgaacagctttttaaaaagctttgaatccaaccacctcggttgacacttcacctatcgactcgacattcttcaaaatggcactctgtactttcacaaaatgaatacgttccagcgttacaggattgccattctggtcaacggcgtcatccaggtcaaactgattataccggtagttgccgttgtcatcctttgccatgtcgcttccccagttgtcggcatatccttttccgaaatccttgtttttccatattccgccttcttgctctgtccgtgcttcgagcatacttcctttcaatgtataggagtcctctttaatccagttcggataatacatctgatcgtgatattgagggagatacttgatgattccgctttctcctttgttgtcttcccaggggatatctccggctgcatccggtctgtggtaagtgacggaatagtcgcgttccggttcgtcacttcctttcagctcgtaccatacgtcgtctgcttttccgttgccattagcgtcttcggatacccatacgatgcccggttcggaacttccggagaagggattgccgataataccgaagtcgtatcctttgcggttctttatttctttcggcattttaacggtgatgtatccgccgaaagatcccagtgagacgtagagtttcttgttgaagcgctcttctgcataagcgtttgcttcttccattgtctggcagtcgaagccttcattgataaactgccctggtgccggacgatattccagcactttgaatccttgaatttccgtttcttcctcatctttgttgcaggaagccaaaagagtggctgctatagccatcagataccaatatcttttcatttttctatgttagtttagttattgaataatatttgtgaaggaacgctctcaccacagtctactgtgtggagaacttttccgtctttgctgtaaacgacaattttagattcgtctttccgttcttcggtataagttacatagagttctccgctttgttggttcagctgcaatggagcagtaattgaaactcctgattctgcggcaatgaaaggtgctttgagagagtctgaatcgcctaatatatatttatatatagctccgtcggtcgataccagataaataatattctctgtttcggatgctaccatgcctatggtcggacttgaatgatacggtcccttggccggctggaagtttgcaaagactttttctaaagtaaagtcattctttatttttacgatattacatccgttatcagccgattcaagagtataaacattaccgtctttagccagtacaaaattgattttctgtttttgaatgatatctagctctgtaacggcaggagcttctccttctttagctgcgattagttcgtttacatcgtaatacttcactttggactcatctttataagtgtcattgctcagcactttgccattgtagattatgctattatagaaacaaagcagacgctcattcttgatcctgacattgttaagtgattttaggtcaatacgacgtatgccatctcctgtcactaatccatattgttcgttcagaatggtcagaccgcttaggtttgcgcctactacagcggagttttcgtaataaagagtcttggcgtcgacaatgtagaaatgatctcggttcgatgtgctggtgcccacaagcagatagaactttccgttgctgtgaatgatatttgcagagtcgtagttaccaattcccaaagtttttcctgcatttaaagaagcataacaatcttgataagcagttttcttttcggtatcatagaaattgaatgttccgtctgctacgtagaagaatcctttggaaaagttgtggttagagctgaaacttgtgctcatttctacttttccgtatttattcttgatgatacatgacaggtccgcgcgacatggattgtctattttgtaactaaaggtcggttcggtagaatactcttttccattgaccagccatgaataggtggctccttccggattaagcagttccggagtaatctccaacgtttctcctaattccaacacttggctttctgtcgggaaagttcctttcagtacgttcggataatgtgccagattgccgaggtgcaaatcttcgcaatcgtcgtcgttacaggcggtaaaacctgctgcaaggcaggctattaataaagtggtatatagtttattcatcttgtttcagagtcttgttattagttaaaaatgaatgtagccgggaaataatagccatcgtatgctatttctgatatcttttctcctgtggcggcgttgaatcttaccagaagatttttctgatagtctccggtcaggtacatggccagtaattcgttggtctttggattgacgcggatgcctgcgccatagaatccgtaaccttctttggtgtattcggtcagtgtctcctcaggggcgggattgtcaaaagtggctttgtatatctttcctcctgcgatgtagtagaatattccttcaggagtgccgcagaaactggcttctctgtaagcaccgaacgaggagggagaataatcgtcacgcattgcaacctttttcagagaaaaatcagcattgattcttaccagattgtttttaccgtctttggtcgtttctacagtatagatatttccatctttacattgtacaaagcgagtaccaccataggttgcaatatctaattcctggaatgcgactttgtctgtaggcttgagatcgggggaacataattctgcaatgtctatggtatacactttaggacttccccacccggaggagttcacatttaatatgagttttccgttataagcgattccgctacctgttccggtatacgtatttcctaccgataccagtgtaattgtttcaaacgtttttaaattgatacggctgaaatatcctccatgagtaattattccataatcgtcattcaaaccgataaactcataagcttgataattagctagtttgccacagctgttttcagcatacagagttttagggtccatcaccactaactgattatcttcttttgaacagacatacaacttcccattccacaaagtagccgattgtgaggtaactcccagcacatctccgaaattctgattcttatagcaccagtgttcaatgctgttcttctcataattatagaatgaaatacttccggatccgtgtccgaaccatccctcattgataatcagacatcctttggagtaatccgctcccggaaccatcactttattttctaatgtcacttttcccaagtcattgctgagttctaaaataactttggaacggccgggatgttcggcgttgaatgtgaatgaaggggcggtcgacatatcttctccattctgataccattgatagtatatatccagcggactacttgccttaggggcatatacatattgttctccgacattgagtgtcaaatcctcttcggggaaagtgccggctttcagagctggcaatccttgtagtttgtcaatgtggtccaggtcacaatcgtctttcgagcaagacacaataacaagcgttgttattataaataataacgttttgaatagctttttacaattcatgttttgtatattaagtaaataaaatatgtccatcaaagtgtccgggcgaaatcgcttcgaccggacacacataataaacttggcagagtctattagtttgtacatactttctctgaatcagagtgatgaatgaaatgatagacggatgtccgggtcattagattcaacgctttttcctcgaaagcagtgaaacggattttacatggcaggtcttctgacttattcctgttgcgggcgccttcccggaattttctttccagtggctttgagtagattgctcgcaacatatctatggaacttacagcagcgggactgttcaggatttacacctgattcccttttaatcgcttccctcgtgatgagagtcgcaaaccaatgcggggacaaagatatatagtttatttgtttctaccaaaaagaaaataacagcagttttgctctcatgctctaacaattcctgcgtatccctttattcatcgctgtttcaagcgtggtagcaagtgtggtggcaggtatgagagcaaatggttgctctcactccggtgcatcgaatgacgtgacgttttgtagtgttgtaggttgatttgtaggatgttaacgtctgatacgtcaactattaaagattgacatatcaactattaataattgagaaatcaggtgttaaaggctgataactcatctattagtagccaataaatgagttaatgcttcttgaaagaacgggtgaattggaataactgatacgattgggttactccggtcatgcagtcaagttactctaattgatagttgctttagaaagttccaaagcgttgaaaccaacggtttcaagcggatgaaactctagtttcaagcagaggaaactttagtttcaaactgaagaaactttggtttcaagccgatgaaactttagttccgagcggcagaaacattttgtttcaacggttggaactgatattggaactacatgttaactattgatgctgcattagatatgcttcaatggctggtgcagtggcatctttaagcaatacagtcttgtctttatccaacagatatagagtcgggatagcctttaagtcatagacctgttcttctttgatagtgaacttcttgtcatatccgttaatccattcattgggaaattcgctcagatgctttttccactcgtccagttcctcatcggggtagatggagagaagtaccaacttcttttcctgtaaaagctggttgatgatgggagcgtttttcagaccttctatggtttctgtgcatgcctgacagccggggttattgataaataacagaagatattccgctttcaactgatataatgaaccttgtgctccggaggccagggtataagtgaagttgagcgctttggttccgatacgatttttctgagccagcttaagacgggcctggggacgtatcttctctgtttcgttcaatacaggagaggctatcattgcttccaataccggtatataaaattcttcgttgcgcatgggggagttgggatcatacagatacttgtccgccaggtcggtgatatatgtaaacaccttcttgtccacattggtccggtcgattacattgcgcatggcttgttgggctgtttcaagcggtacgtggttcagcaagtcgcaataatctgcccacgcttgctccgttacttccggatggtggatatagttggtgtcggcaaagtttacattgtcccaataatgcttggccagaaagtcggcccgttgttccggtgctgtcatcatttgcgggatggcgggcatcttaatagccttaatggtatcttgcgatgtttcgcttttgttttgacttgaagcattcccgtttttacaggcgccaagaagaaggcacagaatgagtataaggcttatgtttgttttcatgacaattggttggtttaaacttactttcgaaagcaaaggtatgaaaactatgtgaaaaaacataccgatattccggtaagttttgaaaactggatatgcggcttcgtattttttatcgatacagccgactttgtgtgaatagggctaaataatctcttcccttcgggtggaatctgcatcgaatttgttatctttgcccgtagcattggttattttttaataaaagctgatatgaacgcacctgttaaaacgctccgtaagctcccgatagggatacaaagtttcgaatttcttcgctcggaaggatatctttatgtcgataaaacagaactggtctatcgtctcgtaacgaaagggaagccttatttcctcagtcgtccccggcgtttcgggaagagcctgttgctttccacgcttgaagcttatttcaaggggaagaaagaacttttcgaaggactcgctatcgagaaattggagcagaactggttcgaatacccggtgttgcacctaagcttgaatgctgagaaatatgacagtagggaacgattggaaagaatgcttgaactgcaactggaaagttgggaagagatgtatggagtagataaaggcacaatgacctactccggacgcttcattaccattatccgacgtgcatacgaacagaccggacgccgtgtggtcgtactcgtagacgaatatgacaaacccatgcttcagacattcgataaacctgatttgcaagaagacttccgtaaaacgctgaccgctttctatactgtactcaaagatgctgacccttatcttcagtttgtctttatcaccggagtaacgaagtttgcgcagatgggcattttcagcacgcttaaccagttgaatgatatcagctttgaccttgagtacaacaccctttgcggcatgacacgtgcggaaatcgaaaccgtttttgtgcctgaattgcaagaactggctctccagactgaaaccaattatggcgaagccgtagagcaactcacccgccagtatgacggttaccgcttcactcctgagaaaggatttactcccatgttcaatcctttcagtgtgctcaatgcccttgccaagtcgcgtttcggtgactattggtttgccagcggaacgcctacttttttggtagagatcctaaagaagacaaatttcgaccttcgcgaattggacggtattgaagtctcttccgcctccttgagtgacgacagggcgaatatctccaatcccgttccgatgatttatcaaagcggatacctgactataaagtcgttcgaccaacgctttcgtacatatacactagggtttcctaacgaagaggtgaaatatggtttcctcaattttgtcgcccctttctatactcctgtcgcatccaccgataccaccttttatatcgggaaatttgtgcatgaactggaaacgggcgaaacggaagctttcctcactcgtctgtcctgtttcttcgccgattttccttacgaactgaacgagaaaacggaacgtcattatcaagttgtattctatctcgtcttcaaactcatggggcaattcacgcaagcggaagtccgtaccgctatcggtcgtgccgacgcagtagtaaagactgcggactacatctatgtgttcgaatttaaactcaccggcaccgccgaagaagctctgaagcagattgatgaaaaaggttaccttttgccctacactgtggatggcagacgactggtgaaagtcggtgtgtcctttgatgccgggaaacggaatctgggagattggctgattgtttgactgcactgtgaataaagaaaaaccaagctgtttatttctctttcgccagcgtgaagacaaattccagtccgccgccttgattattcttggcagaaatgtttcctccgtggatgatgacggcattctttacgatggcaagccctaaaccggttccgccgagtttgcgtgaacgccctttgtccacccgatagaaacgttcgaaaaggcggtttagatgttccggagagacaccgatgcccgtatctgcgaagctgaaataatagtaattctcatcttcacggaaacagttgatgtttatctgaatattggttccggcgtatgcgatggcattgtccatcaggttacggaagatggagtagagcagagagtaattgcctttgatctggatacccttctttagtgaatccacgatgctaatgtgcttttcttccagttccagagaaacttcattgatgatgttccctaccagtacgctgatgtctacccgctccatgtctatcatgttggcggcttcgtccatgcgggtcagtacggatatgtcgcgtagcagccggctgaggcgattgctttgtgcgtagcaccgttcgaggaacgtatttatcttgtcacgtgagatattctcgttattgacaatcgtttccagataaccttggatactgcttacgggagttttcagttcatgggcaatgttctgggttaattggcgcttcagacgtacctgctcttcttcctgcgtgacgtcattgatcgaaatctcgaagctggcatcctgaaagatgatacattccacgataaaggtgcgtccgtttttgttgattgtgacggacatacgcttttcgtcttttccccgcgagcgttgctgctggttcttgttgatgaaatgaatgatgtctttcagttcgctgatggcgaatacttcctctgtcgtttccaggttagagtccgaaatcaggttactgtattgagtaaagaggttgttgaccagaatctcttttttgtctttggtgaatatgcccagcccttcatgcgaaatctgaagatgggtaatcagtttctcgcgttcgatgtagagtgcctctttcgtttcgtgcagacgcttgtatatctggatgatgtgctgcgaaatctctcccagctcattatgcggaaaagcggactgcatcgccatctctatcggttcgttacggtctgcacgcatggcaaactcgcggagctggctgatagaggttcccagtttgttggtgaatttgtagaagatcaccatgagcaacagcgacacaatgaccgtaaaccataagtaatgcgggtctgcctgcagattattgatgaggcttacattatatggcagtgccgagcggatgatataatctccgtagcgggttgccgaatagaaatacggtagcccggtggtctccgaggtgcggcgtacgtcaaaaccggttccgtctttcaaggctttctgcacttcggggcggttgagatggttctccagttgctggtcggtagtctgataactgtcatagatcacatttccctgcaagtcgatcagtgtgacgcgcaagtcctccaacgcgtggtcacggatatacttttcagtcgtttcttcgatggcgggattactgttcagccgttcgtacaagcggctgttgtagttctggagctgcgtgttgagtaactcgactttatattctctttcgcgttgatactggtaggcgatgaaacaaaaggcaaataccagaaacagcgagatcaccgaaaggaataacttccggctgaaagagaggaaatgtttttgcttgacaggtagattcatacttcttgattattcggcttcaaagcagtatccgtatcccaggcgggtaacgatgcacttgccatattcgccaattttcttccgtaaacgggtgatattcacatcaatggtacgatcgagtacgtatacttcgtcgctccagatgcgtgccagaatgtcttcacgggagaagacgcgtcctttgttctgcaccagcagaagcagtatctcaaattctttcttcgtcagctgcacttcttcgtcgtctatgcttaccttcttcttggtgatgtcgatcacgagtgactggtaagtcaggcgttcgggcgccttttccgtctccatcgtggcggtacgcctcagtacggctttcacacgggcgatcacttcgcgcagggagaaaggcttggagatataatcgtccgctcccagattgaagcctgttacggtatcgttttcggtatctttggctgtgatgaagatgatgggcactctggctgttttcttgtctttcttcagcatgtttgccatcttgaaaccggagatttcccccatcatcacgtccagaagaatcaggtggtaactgctgatatccatcttcagagcctcttcggcggagttggcggtatccacttcataaccttcgttttcaagattgaatttcagaatctcacagaggtcttcttcatcgtcgacaactaaaatacggtaatcgttcatatgatatatgtattaatgtgatatgacaaagttaagcttttttttatttcgggacaaagatgagaagactttgttacgggcggatgaaacaaatattacaatcgtattacattccgctgaatgcgggcatcgggatgatatttgaaagtttttatgggatatgcgaggaaaaaccgtctgttatttgttatctttgtgtagcgataggataataaatacacagtttgcagatcatgataaaaatagacttgaaacgatatagacgcgaagtggtaggaggggtgattgtactgcttcttctcatcgggggaatctccgtctttaaatatacttcttttaattccggctttgagatcgtagacgatctgggaggaaatatctttccgtcggccatcctgtcggtagccactacggacgcgcaggtgattactccttcggattctacctgtctcggaaatccgaaatcgtgcatcgccattcgggtgaagtcgaggactgcttacagccgagtgcggatagaggttgccgagacccctttcttttcccgttccgtgtcggaatttgtgctgaacaagccgaggacggaatatactatttatcccgatatcatctggaattacgaggcactgaagaataacgcacaggcggaaccggtgagcgtagccgtaaaagtggagatgaacgggaaagacttgggacaacgggtacgtacgttttcggtgcgtagcgtcaatgaatgcctgttgggttatgtggcgaacgggacgaagttttacgataccagtatcttttttgccgcatacgtcaacgaagagaatccgatgatcgaccagctgcttcgtgaagcgctgaatacccgcatcgtgaatcgtttcctgggctaccagagcacggccaaaggtgcggtagacaagcaggtgtacgcactttggaacatcttacagaaacgtaagttccgctacagttccgtatccaatacgagcctttcgagcaatgtcgttttctcgcaacgcgtccgcacctttgacgatgcgctggaatcgtcgcagatcaactgtgtggacggcagcgtactgttcgcttcgctccttcgggctattaatatcgaaccgatactggtacgtacaccggggcatatgttcgtaggatactacaccgacaactctcataaggacatgaacttcctcgaaacgacgatgatcggtgatgtagacctcgacgacttcttcccggatgaacaactggactctaccatggtcggcaaatcgcagaacgaaatgtcactgctcactttcgagaaatccaaacagtacgccaacaaaaagtacaaagacaatgaagcaggcatccattccggaaagctgaactatatgtttctggagatttccaaagaagtacggaggaaaatacagccgataggaaagtgaaattcatttttaattcgtatttttgcccaagtaatcatttaatgaaaaaggatgcaaggcaagaaatttatctcccccggagcatggttttcgatgaattatccgtcggactggaacgagtttgaagatggcgaaggctcttttcttttctataaccccgatgtatggacgggcaactttcgtatatcagcttttaaaggcaacgcctcatacggtaaagatgccatccgtcaggaactgaaagaaaacgattcggcttcattggtgaaaatcggtacatgggactgtgcctacagtaaagaaatgtttcaggaagagggcacttattatacttctcacctgtggataacaggaaccggcaatatcgcttttgaatgttctttcaccgtacccaaaggcggaagcgccaaggaagcggaagaggttatcgctacactggaagcccgcaaggaaggcgagaaatatcccgcagaactgattcccgtccgcctatcggaaatctatcagatcaatgaaggctacgagtgggtagtatctaccgtcaaacaggaactcaaaaaagactttcagggagtggaagaggacttggagaagattcagcaagtgatagacagcggtaagatcagccccaagaagaaagatgaatggctcgccatcggtataacggtatgcgcgattctgactaacgaagtggaaggcatggagtggaaaaccttgattgacggcaatcgggaagtccccgtactcgaataccaaggccggaccatcgacccgatgaaaatcgcatggagcaaagttaaggccggccaaccctgcaacattgccgaagcatatcaatcggcaatcgatcatcactaaatcacgaaccagctaatcactaaattacgtggcagtaccttatttacaagtagacaacctgaccaagtccttcggcgacttggttctttttgaaaatatatcttttggcattgccgaggggcaacgcgtcggattaatcgccaagaacggcagcggaaaaacaaccttactgaatatcatcgccggaaaagaagggtatgacagcggaaacatcgtcttccgccgtgaccttcgtgtggattatctggaacaagacccgcagtatcccgaagaactgaccgttctcgaagcctgtttccatcacggcaacagcaccgtcgaactgattaaagagtacgaacgatgtatggaaaccgaagggcatccgggactggaagacctcttggcacgcatggaccaggagaaagcatgggaatatgagcagaaagccaagcaaattctgtcccaactgaaaatccgtaactttgaccagcgggtgaagcagctttccggcggacagctgaaacgtgttgccttagccaacgccttgatcaccgaaccggatttgctgatcctcgatgagcctaccaaccatctggacctggacatgaccgaatggttggaagactacctgcgtcgcaccaacctgagcctgctgatggtgacgcacgaccgttatttcctcgaccgtgtctgctcggagattatcgaaattgacaatcagcagatttatcaatataaaggtaactacagctattatctggagaaacgtcaggaacgcatcgaggctaaaagcgtggaaatagaacgtgccaacaatctctatcgtacggaactcgactggatgcgccggatgccgcaggcacgcggacacaaagcccgataccgtgaagatgccttctatgaactggagaaggttgccaagcaacgtttcaacaatgacaacgtaaaactggaagtaaaggcctcttatatcggaagcaagatattcgaagccgatcatctgttcaagagctacggagacctgaagattctggatgatttttcctatatctttgcccgttacgagaagatgggaattgtaggaaacaacggaacgggtaaatctacttttatcaaaatattgatgggacaggtcaaacccgacagcggaacggtggatgtgggcgaaactgtccgtttcggctattactcgcaggacggtctccagttcgacgaacaaatgaaggtgattgatgtcgtgcaggatatagccgaagtgatcgaactggggaatggaaagagactgacggcttcgcaattcctgcagcatttcctgtttactcccgaaacgcagcatagctatgtctataaactgagtgggggagagcgccgccgcctttacctgtgcacggtgctgatgcgcaatcccaacttcctcgtgctcgatgagcctaccaacgacctggacatcatcactctgaatgtgctcgaagagtatctgcagaacttcaagggctgtgtcatagtcgtttcccacgaccgctactttatggataaggtagtagaccatctgatggtattcaacggacagggagatatccgtgacttccccggaaactatagcgattaccgtgactggaaagaagccaaggcacagaaagaaaaggaagcggaaaagccgcaggaagagaagaccgcccgtgtccgtctgaacgataagcggaaaatgagcttcaaggaaaagcgtgagttcgaacaactggaaaaagaaatagcggaactggaagcggagaaggcacagattgaagaactgctttgcagcggaatgctttctgtagacgaactgactgaaaagtcgaaacgtctgcccgaagtgaatgatctgattgacgaaaagaccatgcgctggctggaactgagcgagatagaaggctgacatgaatctgaacggaaagaaactgtaataactgaaacaacctgataataaccgaaataacatagaccgatatgacaaacctgaccaattaccatagtcactgcttatattgtgacggacgagctaatatggaagattttatccgttttgccattagtgaaggcttttcttcttatggcatttcttctcacgctcctctgccattttctacagcatggacgatggagtgggaccggatggatgattacctttccgaatttgctcgtctgaaggagaaatatgccgataaaatagagcttgccatcggactcgaaatagactatctgaatgaagagagccatcccgctatccctcgttttcaggaattgccgctcgattatcggattggttctgtgcacatgctctattctccgcagggcaaagtcgtggatatcgatacccctgccgatatattccgtcaattgatagatgcgcattttgaaggtgatctcgattacgttgtccacctttattataagaatctgctccgtatggtcgagctgggaggttttgatatccttggtcatgcagataagatgcactataatgcctcttgctatcgtccgggattattggacgaaccgtggtatgatgcgttggttcgcgattattttgcagaaatagcccgtcatggatatatcgttgaaattaatactaagtcttatcatgatttgggaactttctatccgaacgaacgctatttccctttattgaaagaattgggtattcgggtacaggtgaatagtgatgcccattatccggaacggattaataacagtcgtgccgaagcattggcagccttgaagaaagtcggctttgacacagtagtggagtggcacggcggacagtggaaagatatgcctctgttacaataaaacagagcttctgtttataataaatgcaggctccgtcaactgctgacagagcctgcatttatctataacagagcctctgtttcgatcccctattccgtccttttgcaggcattcgataacaggaactcattcaaagcttcttcataattcccatgaatcataatatgatgattgcctagcgggtttttcaggaaataatccgccggagtattcatgcggatacgcacctgcgtgcggcacatattgatataattcgtattctcggttagagttccggtagacaggtaatactcatccagacattcgcctccgcattttacgatagtcacgtcacctgtcggcagcagtccttgaatggcgatacctttctctgtctcaaaatgattgcggataatatatctttccgtctgtttgagtcctatagtgcaatgtgccagtattaattcattggttcgcgtattgatggtggatggatttgccatgaatccttcttttcctgtcagcgccttaactgccagaagagtgaagatagactggagatctccctcacagcctgccatgataccgtcatcattcagcaatgacaatgccagacagccggtcgtatcaatttgatcgatcagtttgaagcagcttaatgtcagcgcttccagcttctcttcttcgcaaattctcttgatggccctgtataatcgcatcgctttgattaaatcctcgggagttccctcgcggcaggcaagcgcctgcgaagcaacggcggcgcaggacgcgcctacctgatcatctgtgatttgtttaaaatgttcataaaccctttccagcggaatatctatatattcgattccccaacggcgttttgccagaagataatccacattgctggcaaccagccacgaagaaggagtaccgatgactccgatacgcttgccgaacaaagaacgctgcgcgcggaaattattatatagtatatgtacacgttgaataatagacggtaattctccatgaagaatttcactcttcattccccttccacggagccatgtagatatttccaatgccgcagcaagtgagttctgcatgccatcggccaataaaatggcggggcggggaagacgttcgaagtgctggatgaccagtctttccacacctccggtagcgataaaaatgattttgaaatcatcactgcccaacttatccatatcttgataatcgatgagtttgacagtgtaatatttttcaagttcactcagaattgcttcgtgcgaattgcgcagcgaggcttgtttgtgaagtattgaagcaaatgagataaggtgtatggtcattatgatattgttttaagttttccgtattacaaatgtatagctttcttttcatttttccactacgtttttacccttgataaggattttaaagtttttatgtctctgtattcaaattattgcgtacatttgcagttccaaattaaaaaagtaaatagtaattagtaatttgtagttaaaattatgccaaccatatccattcgcggaaacgagatgcctgcatctcctatcagaaaactggctcctttggcagacgctgccaagcaacggggagtccatgtgtttcacctgaatatcggacagcctgacctgcccactcctcaggccgcgattgacgcgatacgcaacatcgaccgtaaagtgctggaatatagccccagtgccggaaacagaagctatcgcgagaaacttgtgggatattatgcaaagttcaacatcaacctgacggctgacgatataatcattacatcgggggggtcggaagcggtacttttttccttcctttcctgcctgaatccgggagatgaaatcattgttccggaacctgcatacgccaactacatggcatttgccatctctgccggagcaaagatccgtacgattgcaacgaccattgaagaaggtttctccctgccgaaagtagagaaattcgaagaactgatcaatgaacgtaccaaggctatcctgatttgtaatccgaacaacccgaccggttatctgtatacacgtcgggaaatgaatcagatccgtgacctggtgaagaagtacgacctcttcctcttctctgacgaagtatatcgtgaatttatttataccggctctccttatatctctgcctgtcatctggaaggtatcgagaataatgtagtgctgatcgattcagtttccaagcgttattcggagtgcggaatccgtatcggtgcattgattaccaagaacaaagagatacgtgacgctgttatgaaattctgtcaggctcgtctgagtcctcctttgatcggacagattgccgccgaggcttctttggatgctccggaggaatattcgcgtgagacgtatgatgaatacgtagaacggcgtaaatgcttaattgatggattgaaccgtattccgggcgtttattctccgattccgatgggggctttctataccgtagccaaactccccgtagacgactcggacaagttctgtgcatggtgtctttctgactttgaatacgaaggccagaccgtatttatggcaccggcttccggtttctatactactccgggctccggcatcaatgaagtgcgtatcgcctacgtattgaagaaagaagatttgacccgtgcgcttttcatcctgcaaaaggcgttggaggtgtatccgggaagaacggaataggaaataagtattaagtaataggtattaagtattaaccgtagacgctggttggcgtatgagatattataagattgataatatatcataaggtaatgacttaatacttaatat

SEQ ID NO: 88 - DNA, 31687 bp, Bacteroides thetaiotaomicron
atactactcttttgttattaccttattttctaatacctaaaaatcttagtagtttcacaactacactgcaaaggtagaggtgttttggaaaacaacaagaattcttatgctaaaaaacatgttttaccttatttttttgatttatgtcaagagaaagagttgaggttgggtataaaacatacatccgaaggctgatttgacacaaattctgtccaaacgctccgtttgtcttctatttcatcacatggccccacacttttccaagtgacaaaaagtaagcctagaatgtcgaaaaagagcatttacatctctttttgaaaggaattgaagccttgacataaaagaaaagaagccagaaacgttacatcttgcatatttccaatccaaaattacggcgattttttgcgcccgccctgcctcctccccgaaatttcggaagcaaaaaccggcagaagatacaactctcgcaacttttccgtaactttgcagcgtttgataataaataaggtagaatggattttaagtacgatgtaattgtaattggtgccggacatgcaggttgtgaagcggcagccgccgctgcgaatttaggttccaaaacttgtctgatcacaatggacatgaacaagatcggacagatgagttgcaatccggcagtaggaggaatcgccaaaggacaaatagtacgcgaaatagacgcactgggcggacagatgggattggtgacggatgaaactgctatccagttccgaatcctgaaccgctcgaaaggtcccgccatgtggagtccccgcgctcaatgcgaccgtgccaagtttatctggtcatggcgtgagaaactggaaaatactcccaaccttcatatctggcaggataccgtctgtgaattgctcgttgaaaacggtgaagtagtcggactcgtcactctttggggtgtcacattcaaagcgaaatgtatcgtactgaccgcaggaacattcttgaacggactcatgcacgtaggccgccaccaattgcccggcggaagaatggcagaacccgcatcttaccagctgacagaatccatcgcccgacatggcattgcctacggaaggatgaagaccggcacaccggtacgaatcgacgcacgcagcatccacttcgatctgatggatacacaagacggagaatgcgacttccacaagttctcattcatgaataccagtacgcgccatttgaagcaactgcaatgctggacctgctataccaacgaagaagtgcaccgaattctgcgcgaagggctgccggattctcccctgttcaacggacagattcaaagtatcggtccgcgctattgccccagcatcgaaaccaagattgtcaccttccccgacaaagaacagcaccaactgttcctcgaacccgaaggtgaaacaacacaggaattatacctgaacggattctcttcttctcttccgatggatattcagatagccgcgctgaaaaaagtaccggcattcaaggatatcgtcatctatcgtcccggatacgcgattgagtacgattacttcgaccccacccaattaaaacattcgctggaatcgaagattatcaaaaacctgttctttgccgggcaagtgaacggaacaaccggttacgaagaagcgggaggacaaggactgatcgccggaatcaacgcacacatcaactgtcacggtggtgaagccttcacactggctcgcgacgaagcatatatcggtgtattgatagacgacctggtgaccaaaggagtagacgaaccataccgtatgttcacttcacgtgccgaataccgtattcttctccgcatggacgacgccgacatgagactgaccgaaagagcatatcacctcggactggcaagagaggatcgctaccaattaatgaagaccaagaaggaggcattagagcagatagtaaatttcgcaaagaactattcgatgaaaccggcattaattaatgatgccctcgaaaagttgggaacaactccccttcgtcaaggctgtaagctgatcgaaattctcaatcgtccgcaaatcacgattgagaatatcgcggaacatgtccccgccttccaaagagaattagaaaaagcaaccgctgcagactccgaccgtaaagaagagattctggaagcggcagaaatactgatcaagtatcaaggctatattgacagagagcgaatgatagcagaaaagctggcacgcctggaaagcatcaagatcaaaggcaaatttgattatgcttccatccagtcgctatctacggaagctcgtcagaagctagtgaagattgatccggaaacgattgctcaagcgagccggatcccgggagtatcaccaagcgacatcaacgtattgctggtactttccggccgataagcggcaacgtttcacgtgaaacaaatcatttaaagaaacgagataaaccaatgattatgagcaaagaaacgctaattaaaagcatccgggaaattcccgattttccgatccccggaatccttttctacgatgtcaccaccctgtttaaagacccttggtgcttgcaagaattatcgaacatcatgttcgaaatgtacaaggataaaggtatcaccaaagtagtaggtatagaatccagaggattcatcatggggcctatcctagctacccgactgaacgcaggttttattcctatccgcaagccgggcaaacttcccgcagaggtgatcgaagaaagctacgacaaagaatatggcacggacactgtgcagattcataaggacgcactcgatgaaaacgacgtagttttactacacgacgacctgctggcaacgggaggaactatgaaagcagcctgcgaactggtgaagaaactgaagcctaaaaaggtatatgtaaacttcattatcgaattgaaagacctgaatggcaaatccgtattcggagatgacgtagaagtagaatccgtattgactttataaacaaattgcttatatttgcagggcgtagagaatctacgcccttttttatttcccgctatttcatctataacgattatgaatacagaaccggaagccaaaacgaatgaatatctgagaggtattgtagccaacctgcccgaaaagccgggagtctatcagtatctgaacacagaagggactattatatacgttggaaaggctaaaaacctaaaaaaaagggtatattcttacttcagcaaagagcatgaacccggcaagacacgagtattggtcagcaagattgccgatatccgttacatcgttgttaacaccgaagaagatgcattattgctggaaaacaatctgatcaagaaatataagccccgctacaatgtattgctgaaggacgacaagacctacccttccatctgcgtgcagaatgaatactttccacgcattttcaggactcgaaagattatcaaaaacggttcttcttattatggtccctacagccaccttccttcgatgtatgcggtgctcgacctgatcaagcatctatacccgttgcgtacctgcaatctgaacctttctccggagaacatacgggcgggaaagttcaaggtttgtctggagtatcacatcaagaagtgcgccggaccatgcgttggactgcaatcgcacgaggattatctgaagaacatcgatgaaatcaaagagattttgaaaggaaatacgcaggatattagccgtatgctggtagaaaagatgcaggaactggccaatgaaatgaagtttgaagaggctcagaagattaaggagaagtatctgctgatagagaattaccggtctaaatcggaggtagtaagttctgtcctgcacaatatcgacgtcttttccatcgaagaagacgattcaaattcggctttcgtcaactatctgcacatcaccaatggcgccatcaatcaggcattcacctttgagtacaagaagaagctaaatgaatcgaaagaagagttactgacgctaggcattattgaaatgcgggagcgctacaagagccattcacgggagattattgttcctttcgaacttgatctggagttgaataatgtcgttttcaccgttcctcaaaggggagataagaaaaaactgctcgatctttctatcctaaatgtgaagcaatataaggccgaccgattgaaacaagccgagaaactgaacccggagcagcgcagtatgcgtctgctgaaagaaatacaaaacgaactgcatttagacaagccacctttgcagattgaatgtttcgataactcgaatatacaaggatcggatgccgtagctgcctgcgtagtattcaaaaaggcgaaaccatcgaagaaagattaccgtaaatacaatattaagacggtcgtgggaccggatgattacgcttccatgaaagaggtggtcagacgacgttatcagcgcgccattgaagaaaattctccccttcccgacctgattattaccgatggtggtaaaggacaaatggaagtcgtcagagaagtaatcgaggatgaactgcatctgaatattccgattgccggtttggctaaggataataagcatcgcacgtcagagctacttttcgggtttcccgcacagacgattgggatcaaacaacaaagttctttattccgtctgctgacgcagattcaggatgaagtacaccgttttgcgattactttccaccgcgacaagcgcagcaagcgacaggtcgcatcggctctggatagcattaaagggattggagaaaagacaaaaacagccctattgaaggagtttaaaagcgtaaaacgaatcaaagaggcatcccttgaagaaatcgcaaaggtcataggagaagtgaaggctcagactgtaaaaaaagggttaagcaacgaataggctcacttctatgtggctatacgctaaattgttagtccatataaatcaagtatcagtatcatatggggcaagcgttagtttcctcggaggaaacgccagttccctttaaaaggaacggtcgtttccattaaaaggaacggccgttccctcgccgggaaacgacagtttccattaaaagaaatcataggaaactatataccattgatttctaaccacatagagtactaccggtaatgttatagagtttatgttcatgtctatacggttctaaggcaaactcaatcaagttatgaggcaaatacatctgtcgtcctaatagatatgcttctgcacaacagacagacacgcttccgaatgacagctacggttaatacttaatacctaatacttatctcctataatatttccttccaatccatcgttttttcttcttaatttcgtaaatttgcctttcgtaacattcaatagaatagagaaaatatcaatgagaatagttgtacaacgagtaagccacgcatcagtaaccatcgaaggacagtgcaagtcttccattggaaaagggatgctgatattagtcggcattgaagaatccgacggacaggaagatatagactggctctgcaaaaagatagtaaatctgcgtatttttgacgatgaaagcggagtaatgaacaagtcgatcctggaagatggaggtgaaattctggtcatcagtcagttcacgttgcacgcttctaccaagaagggcaaccgtccgtcatacatcaaagccgccaagccggagatatctgtcccactctacgaacggttctgcaaagacctgagcagggcgctgggaaaagaaatcggcacaggaactttcggagcggacatgaaagttgaacttttaaatgacggtcctgttactatatgtatggacaccaaaaataaagagtaaaaccttgatgaaaaagccggtaaagctcttcgaagagtgataaacaggctctaaacatcaaactaatcatcataaaccaacagcaattatgaccctggaagaagctcaaaaagaagtagacaaatggataaagacatacggtgtccgctacttcagcgaattgacaaatatggccgtactgactgaagaagtcggagaattagcccgtgtcatggcccgcaaatacggcgaccagtctttcaaagaaggcgagaaagacaaccttgacgaagaaatagcagacatcttatgggtgctcctgtgtatcgccaaccagacaggcgtagacatcaccaaagccttcagggaaagcctggaaaagaaaacgaaacgagataataaaagacatatcaataacccaaaactgaacgatcatggaagagaatagctcacaatccaacaagtatgatgccgcattggcaaagtataacaccaatctgagcgatgcagacatacaggctcgggtggctgacctgattgaaaagaaagtgccggaaaacaatacggaagaagtcaagaaactcctgttcaactgcatcgacctgaccacgctgaacagcacggacagcgatgaaagcgtgatgcatttcaccgaaaaagtgaatgagttcgacaatgaattccccgatatgaagaacgtcgctgccatctgcgtataccccaatttcgcggatattgtaaagaatacactgcaagtagatggcatcaatatcgcttgtgtttcgggcgggttcccttcttctcagactttcatcgaagtgaaagtagcggaaacggcactggctatcgctgacggtgcggacgaaatagatattgttatctctatcggtaaattcctgagcggtgactacgaaacaatgtgcgaagaaattcaggaattaaaagaagtctgcaaggaacgccacctcaaggtaatcctcgagacaggtgctttgaaaaccgcctccaacatcaagaaagcctctatcctatccatgtattcgggtgcagatttcatcaagacatcgaccggaaagcaacagcctgccgctaccccggaagccgcttatgtgatgtgcgaagctatcaaggagtactatcaaaaaacaaacaacaagatcggcttcaaaccggcaggaggcatcaacaccgtccatgatgcaatcatttattacactattgtgaaagaaatattaggcgaagaatggctgaacaaccgattgttccgtctgggtaccagtcgtttggccaatttgcttctctccgatatcaagggcgaagagatcaaattcttctaaggaattacattagcaatcaagtatgccgtaccgcgcttcaccttccgttcctatggaaggaagcgcggtattttttatataataaaaactaaagatacttatggacaaaaccattattttcattatctttgtcatagatgtagctatgctaacatagttaatcatctgtattagagaacgtttcttttattacctgattcctggaattcggcaaaattcaaagttatgagtggtaataagcaaacgggtctcacgcaccttcatgtatatacttttgttatatatcgaacggagcgtgagactgttgcttttatgtcatcataacggcttgccgaagccccaggaaaagacatatagcagcagttctcacgctttttttagttaaccataagcgaaaaagtataaaatgaagtcacacacaaagaacttacgttttaaccataaccccttaaatctgatactcggcaccagaaagaaacaaggtctgcgcatcggttatatggaggctgcactggatggcttctatcttaactgtatggaaaccggagtacacccggaaaaactaagtaaactattatcagataagttccattgcacagatgcaatttcttcctgccagctattcctattcctcatcaacgaaggcgacagagcctcctattctattatggtcccctatttactctctaccgaaaacctaaaccagtttgaaaacaccatccgcgaacgcttctacggagtagaccgattcattcaacagggcagaaatctatacaaattcaaagagtatatagaagaaagaggagagccgattgtatggattaacgacttagagagaggagtgatcggatgggatatggcacaagttgtcgggctggcccgggctgccaaagactgcggctacatcaccaaagaacaagcatgggaatacatcgaacaggcgagcacgttatgttccgaaatcctccgcacaccggaagaaatagacaaaagtttcctcatcggaggagcgatgaaatcgaataaaattgaagattgggaggaattaatcctgtgttactctctgctcaggaacagtggggagtagttatttctcacgggcgaccacgtaatccagataagtccgcagggcaaggcaaatatttgaatccggcaaggcagccagcaaatcaaaggccttctttttatattgttctattgtacgacaggcatattcaatacctccattatctttggtaaactcaatcagacgtacgatttcatcaggagttgccgtaccttccttcaccttgaacgctatctgttccgcccacgcatctttcgttgtattcaatgcatacagggcaggcagcgtcagcttaccttccagcatatcattaccagtcggtttgccgatcttcttgctatcaaagtaatcgaaaatatcatccttaatctgaaaacagataccaatatattcgcccaacagacgggcaaaagcgacttcctcctcacccacctgcactgacaaggcagccgcctcggcacaagcggcaaaaagagccgctgttttcttacgtattacgtcaaaataaacttcctccgaaaagctatgattacttacattcgaaagttgaagcaactctccttcagctagtttctgccccagcgaagataccagacggataatctcataattattagtctgctccgcgtgcacaaggcttgtagccagcagataatcacccgccagtacagataccttattattaaatatagcatttaccgaaagctgaccgcgacgctcggtactttcatcgactacatcgtcgtgcaccaaactggctgtatgaagcaattccaaagaaactgccgcatgaagggtggcaggagtcacagccccataaaggcgtgctaccaataagacaagaataggacgcatcatcttgccattcctcttgcgtatatgagttattacgctgtcgagcaatgcattcgaatcggaaagaggggtgtcaaaaagagccttaaaatcctccagttccgcttctatcggggttttgataagagagatactatccattcacaacactatttgagcacaaaagtaataataaaacgcttaatacggtatttttttgtacttttaccatgaaaaattaattaaatctatggagtcagacaataaattatttcttttagacgcttatgcactgatatatcgggcttattacgcctttatcaagaatcccagaatcaactccaaagggttcaatacttcagctatcctcggatttgtcaataccctcgaagaggtgctgaaaaaggagaatccgtcacatataggagtagccttcgacccctccggccctaccttccgccacgaagctttcgagcaatacaaagcccagcgtgaagaaactccggaagctatccgcctctccgtacctattataaaggatatcatccacgcctaccgcatcccgattctggaagtggcaggatacgaagccgacgacgtgatcggaactctcgccactgaagccggacgtcagggcatcaccacctatatgatgactcccgacaaagactacggccagctggtgacagacaacgtattcatgtatcgccccaaacatacgggaggttttgaagtgatgggcatcgaagaagtgaaagcaaagttcgatatccagtcgcccgcacaagtaatcgatatgctcggactgatgggcgatgcctccgacaatatccctggttgtcccggtgtcggtgaaaagactgcccagaaactaatcgccgaattcggaagtatcgaaaatctgctggaacataccgaccaactgaaaggagccttgaaaacgaaagtggaaaccaataaggaattgattactttctccaaattccttgccactatcaaaatcgatgttcctatccaactcgaaatggacaagctcgtccgcgaacaggcagacgaagattcactccgacaaatttttgaagaactggaattccggacactgatcgaccgggtactgaaaaaagaaaattctgccggcggagtaacaatggcaaccggaagcaaaacggcaacggccaaaagtgctccctctcctcttccactttttcccgaagaaggaggagccatacaaggcgatttatttgcgaattttacgggcaatgaggcaggcgaagccaaaaaatcgaatctagagacgttagaaacgcttaattgcgactaccaactcattgatacagagaagaaaagagctgaaatcattcaaaagttacttacatcgaaaattctctcgttagatacggagactacaggaacggaaccaatggacgccgaactagtcggaatgagtttctctatcaccgaaaatcaggctttttatgtgccggtccccgacaatcgtgaggaagcattaaaaatcgtcaacgaattccgtccggtcttcgaaaatgagaactcattgaaagtcggacaaaatatcaagtacgacatgatcgttcttgaaaattacggagtgcaagtgaaaggtgcactctttgatacgatgatcgcccattacgttcttcaaccggaacttcgtcatggaatggactatctggcagaaatctatcttcactatcagaccatccacatcgacgaactgataggtccgaaagggaagaaccagaaaaacatgcgcgatctcgacccgaaggatatctaccgctatgcctgcgaagatgcagacgtaacactaaagctcaaaaacgtcctggagaaagaactgaaagagaacgatgccgaacgtttgttttatgatatcgaaatgccgcttgtacccgtattggttaatatagaacggaatggggtattgctggatacggaagcgctcaaacaatcgtctgttcatttcaccgctcagatgcaacgcatcgagcaggagatttatgaactggcaggcgaaaccttcaatatcgcttcgcccaaacaagtaggcgaggtactgtttgacaaactaagaatcatcgaaaaagcgaagaagaccaaaaccggtcagtacgtcacttcggaagaagtgctcgaaagccttcggcataaacatcccgtagtagaaaagattctggaacaccgcggactgaagaaactgctaggaacttatatcgatgcacttccccaactgatcaacccgcgcacgggacgagtacacacgtctttcaaccagaccgtcacctctaccggacgcctcagctccagtaacccgaatctgcagaatattcctatccgcgacgagaacggcaaggaaatccgcaaggcatttatccctgacgaaggctgcctgttcttctctgccgactattcgcagatagaacttcgtatcatggcacatctcagcgaagacaagaatatgatcgacgccttcctcagcaatcatgatatccacgcagctacagctgccaaaatatataagatcgacctgaaagacgtagactccgatatgcgacgcaaagcgaaaaccgccaacttcggtatcatctacggcatctccgtatttggccttgcagagcgaatgaacgtagaccggaaggaagccaaagaactgatcgacggctatttcgaaacttatccaagcgtgaaagcctatatggagaagagtatccagatagctcaggagaaagggtatgtagaaacgattttccaccggaaacgcttcttgccggacattaactcacgaaacgccgttgtacgcggctatgccgagcgaaacgccatcaacgcaccgattcagggaagcgccgcagatatcataaaggtagcaatggcacgcatttatcagcgattccagacagaaggcatacaagctaaaatgatattgcaagtacacgatgaattgaacttcagcgtgcccgtcaacgaaaaagaacgtgtagaagagatcgttattgaggaaatggaacacgcttaccgtatgcacgttcccttgaaagcagattgcggctggggcaagaactggctcgaagcacactaaaacaaggtttatcctgccataacaaaacaggataaatcagctaaataatggagaggatgagttataacattatttaacccactatccagaaagctaggaaaaagatcacttccccaacgaagtgtttcattctatatccggcaggttgactgccggatatttttttgtcaccaatcttggcaaaaagcaaggtatcaccttagccatcatctgacattttggtattattttagctttatatttgcataaataccgaataaatatataactttgcagcataatacaagagtattactagacaaatgaaagaataatactaaaatcaaatagccatgaaaacaaaagtatctttaaaaatgtttgttctatccgtagttcttctcatgacctcttttgttgcttctgcacgcagttatgatggtcagttggtttataatccagtagaagaaaatggagtaatggtaggtcagaccgtttacaaaatgaacggaagtacacttgccaactatatgaagtacaactataagtacgatgacaacaagcgcatgattgaaagcgagaccctgaaatggaacagcaccaaagaggaatgggaaaaagatctccgcatcaattatacatacgaaggaaaaacagtaacaaccaattactataaatggaacaataagaaacgcgcttacgtgttagttccggaaatgacagtgaccatggacaatactaatttgtaacagcatttttttaacaacatactctctcattctaatattctaacaaagagaaaacgccgttcctgatgaagaaacggcgttttcgcatctatcttaaggagtcattgtcacaacacaaaaaaccggtcctgcaaccctttcaaaaaacttcgggaaatcaccagatcactcttatcatgaaaaggcggatagagctgacaacacttcccatcaatcatcgccagataattaacattgacaatagccgactggctgatctggataaaagcttgtgaataaccaatgatatcttcggcttttgtatttcgcttcagattcaatcgggtctgattgaacaggactacctgccactgccgcttgtctttcagatattcgaaatagccgatttcttccagtcgcaaaagcttgaatcccgtcaccgtgctgatcataaacattccctgttgcggcatcaaagcactgacagaagaagaaaaagaggaagaaggagttgccggtattgaagctacagctttccggtagcgctctataacgactctcagatctcccgtctcaaaaggtttcagcaagaagtcgaaggcagactcacgcagggcctgaagcaaatatttatcatacgaagtataaaagacaactttcatatcccacagcacctcatcgcgcatctcactcaacaagttaagccccagcacatccggaagttccacatccagaaacaacaggtccggacggagttccattatcatctttttaccttttgcgccattgtttgcagttccttttatttcaaattcctgataggcgcccagttccctgcgcaaagcatcgattgccgtacgctcatcatctacaataacgactttatatttatcttctgcattcatcataaatcataagaaaaatgaaacggtatatacaccgacacttgcgtaccggtctgcccatcgtttcggttacctatattgaaacgtatcttctcatttttattctttgtattgagtagctgtatcgtctgatagagcactttcagccccgttcccgttcctctggtcgaagaagccacttgcggaagatacccccgcccgttgtcacaaatcacgatacggactccttttccttcacgggaaatacggatagtcaattccttctcaccgtcttttccggccagcccgtgctttatcgcattctctaccggaatctgtacaatcatggaaggaatcattatactttttgcgtccagcccctcctccactacgaccgacgccgtgaagtcttcgccgacacgcccgctttccagaccgatatatgactgtacaaaatccagttcgtcctgcaaagatacacttagtttttctgtcagttcaagactccgacggagatatttgaccagttccatcaaattattcttcacctcttccgacccattgaactgattaatctcacgccccagcacattgaaagtgaaatggggagaaatccggctccgcaaattctccatacggacacgatttatctgctggaagaaacgttcacgaagaaactcccgctttttccgcatataccagatgattaccaccgttccggctgccagcaacaggcagacaagcacccagatatacatgctcagtttcaagacacgcacttcacccgcctgccgttgaatctgcatttccttgcgcaatacaatcgtgtcctgacggtaacgcatatccagttcggctacacgggtgcgaatccgctcgctacggatagagtcattcagttgatagtcacgtttcagatactcatacgcattgcggtagtcacctgccttttcataataatgttgcagatattggttgcgtatagtaagcatattggcatccacatgtccggtagaagcagtccgtgctatcatttctctggcacgcgcgatatttccttttttcaggaaaagctcaatcatcagggtttcaatatagtgcatggcggagttgttctttatctccgaaaagtagcggtagccttcattcagattgttttcggcagaatccagccggttcgtcagcagataaagatcgcccagattgactttcgaaagattgctttcgaataccatttgcgggtaatccgctatcagctccgctgcttgccgcatatagaccagggcttcctgataatctttcttgtaatagtaatgatttccccgattattaagatacacccacttttcgctgactgtcatttcatcaaagaactgtcctgccagttcgtaataatgattggacaaatcaaaatcacgcaggtccatgtaagtctgtcccagtccgcaatagaccggaaatttggaatgttccgacaggtgcagggagtcacagataaacaatgctttccggtaataggaagcggtatgtgccagttcgccacgatgcagatgggcatccgccagattcatacagatatctgagagaagatgtcccttctctcctttcagacggtaagcataggatttctcataataggcaaccgccgaatcgggctgattgagttgcatccagacatttccctcaatgttatatacatccgaaagtacatcattccatcgcgggcaggcagctgcacgcttatcatactcttttacagggcggttataatagaggatagagtcgaaatcggacgagatgaagaaagtctttccatacaatcccatcaagcggtaataactcatcgagtcctgtgcctgacgcattgcgttacgcaataaagaacgtgaataaggtaagttggaaaacagagaatcctgggcacggacttctaaagaatcgataagtgactgttcacacaaagcgtgactgcggtgcctatccacgcaactgcagttccacaatatcaacaaccctatcaacccaaatagcttcatagtagatttcgctttattcatcccctttgtccgtgttgaattttgaatgccacaaaaatacattaattatattgaatctcaacgaaatttattattttttttaatacctttgtccccatataaacatgagtaactgacctaatgagtccattgaactttacccacattctgacacaggcagtcgatgagctatcggaaagcgaatcttacaaagggctgtttcatcaacataaagatggcgaaccattgccctctgctaaagttttgtatgaaattatcgagctttcacgtgccattctcttccccggatactacggaaattccaccatcaacagccggacaatcaattatcacatcggtgtaaatatcgaaaagttatttgacttgctcacagagcaaatcctggccggactatgtttcagtacggcagaaggagactgcaacgtctgctcggagtcgagaagagaagaagccgcccgactggctgcgaactttatcagcaaactacccgccatgagaagaatactggctacggacgtagaagccgcctacaacggtgaccccgctgccaaaagctacggtgaagtaattttctgctatcccgccattaaggcaatcagcaattatcgtattgcgcacgaactgctggaactgggtgttcccctgattcctcgcatgatcacggaaatggctcatagcgagacgggtatcgatatccatccgggagcgaagataggcagtcactttaccatagaccacggaacgggtgtcgtgatcggtgctacaagcatcatcgggaacaatgtcaaattatatcagggtgtcaccctaggagcaaaaagcttcccgctggatgccgacggaaaaccgatcaagggtatcccccgccacccgatactggaagacaatgtcatagtctactccaacgccaccattcttggaagaatcactatcggaagcgacgcaaccgtaggaggaaatatctgggtaacggaaaacattcctgccggagcaaagattgtacaaacaaaagcaaagaaataaaatcaataaactatatatgagcgaacaattcgagatgatagccaagaccttccagggactggaagagatacttgctgaagaacttacaacattgggagccaacgatatccagataggacgtcgcatggtttcatttacaggagacaagcgtatgatgtacaaggcaaatttctgcctccgtactgctatccgcattctaaaaccgatcaagaattttacggcaaaggatgctgatgaagtttacaaccagatacaggccattccatgggaagagtatcttgatgtaaacaagacgtttgcgatagacgcggttgtattcagcgaagaattccgccattcaaagttcgtctcatataaggtgaaggacgccatcgtggactatttccgtaaaaagacaggcaaacgcccgtcagtacgcatcaataatccggatgtgctgctcaatattcacattgcacaaacgacttgtacgttgtctctggactcttccggagagtcacttcatcgtcgcggatatcgccaggaacaggtagatgctccgttgaacgaagtattggctgccggtatgcttctgatgacaggatggcgcggtgaatgtgacctgattgacccgatgtgtggttcgggaacgattcctatagaagctgcgctgatcgcaagaaacatcgctccgggagtattccgcaaaggattcgcattcgagaaatgggtggacttcgattcggagatgttcgatgagatttacaatgacgatagtcaggagcgcgagtttactcacaagatatacggatacgacaacaatccgaaagcaaatgaaatcgcaacccataatataaaggcagcgggtgtatccaaagatgtgacgctgaaactgcaaccgttccaacaattcgaacagccgcaggagaagtccatcattgtgatgaatcctccttatggcgagcgtatctccaccaatgacctgctcggactgtaccagatgattggcgaacgtctgaagcacgcatttgtaggaaacgaggcttgggtactctcttatagagaagaatgtttcgatcagatcgggctgaaaccaagcaagaaagtgccgttgttcaatggtgcactggaatgcgagttccgcaaatacgagattttcgacgggaaatataaggagttcaagagtcaggagggagaaggagaagagaagaaagagactgaaggaaactatgatacttccagacccagagaaagaaaggaattcaaaccgcgcggggaaggagaatttaaacccagacgggaaggcgaattcaaacctcgtcgcgaaggggagttcaaacctcgtaaagaaggagacttcaagccgagacgggaagaaggaagctttacccgggatgacagggacagaaagcctagaggcgagttccgaggggaaagagattcgagagctccgagagaattcagaggaaaccgtgagcctaggataccaaagaaggaagaagagtaatttcatagatagttaatggcatctcactaaaaaatgccattaacttattgatagacaatataaggtcgcatcttgcgatcttatcatttgatgagtaagaaagcgaattgaatatctcgaaaaagacgtatcatccgacagagaaagacaactctcctgaacagggtaaaatagaaggatttaaaaccaataaagataaataaaagcaatgagtaaaattggaaaaagagccattctgatattgctggcgctaccaatcggattcaatgttatggcacaggaaatcaaaaagctgacactggaagacttgattccgggcggcgagacctaccgttatgcagaaaacctctacggtctgcaatggtggggagacgtgtgtatcaaaccaagtaccgacaccatctacactgttcaacccagaacagggaaagagacagtgctgactaccctcggacaaatcaacaaagtactggcagacaataaagcagggaaactgccgaccccgtactcaatccgctacccgtgggcggacaaaccgcaaatgttactgaaagtatccggtaagtacatcgtatacgatttcgagaacaaccggattgtcagcacactgaagttgaaagataaagcagccaacgaagattattgcgtcgccaacggaaacgtagcctacacagtcaacaacaacctgtatgtgaacgaacaggcaatcaccgacgaacccgaaggcatcgtctgcgggcaatccgtccaccgcaatgagttcggcatcaacaaaggcaccttctggagcccgaaaggcaacctgctcgctttctaccgcatggacgaaagcatggtgacgcaatacccgcttgtagacatcacggcacgtgtaggagaagtgaataacgtccgttacccgatggcaggaatgaccagccaccaagtaaaagtaggcgtctacaacccctccaccggtaagaccatctatctgaatgcaggtgatccgaccgaccgttacttcaccaatatcagctggtcaccggacgaaaagagcatctaccttatcgaactgaaccgcgaccagaaccacgccgtactttgccaatatgacgcaacgacaggcaagttactgagcaaactgctggaagaaacgcaccccaaatatgtagagcctcagcaccccatcgtattcttaccgtgggacagcagcaaattcatctaccagagccagcgtgacggatataaccatctatatttatgcgacctcacctccagcctcaaaggcgaatggaaaagcgatgccgcaggcggcaagcacatcgaatacatcccgacgaagcaactgaccgagggcaaatggctggtaggcgacattctgggcttcaacgccaagaggaaagaagtcatcttccaaggagtagatggcacaggctccaataactttgcagtaaatgtcaacacaggaaagtgcagcctcccgttcagcttccgttctatcacagaaggagaacataacggaatgctcagcgcatcgggaagctacctcatcgaccgttattcgactcccacccttccgcgccgcattgacatcgtggataccaaaagcctgaaaacagtcaacctgctgacagccaaagacccatacgaaggctacgagatgccgaccatcgaaaccggtactatcaaagccgacgacggaacgaccgacctatactaccgcctcaccaaacccgcagatttcgacccgaacaaaaagtatccggtcatcgtctacgtatacggcggcccgcacgcacaactcgtcaccggtggttggctgaacggctcccgcggatgggatatctatatggctaacaaaggctatatcatgttcaccctcgacaaccgcggcagtgccaaccgtggactggaattcgaaaacgccaccttccgccgcctcggcatcgaagaaggcaaagaccaggtgaaaggcattgaatttctgaaatccctcccctacatagacggaaaccgcatcggtgtacacggatggagcttcggaggccacatgaccactgccctgctgctccgctaccccgaaatattcaaggtaggcgtagcaggcggacctgtcatcgactggggatattacgaagtgatgtacggcgaacgttacatggacactccggaaagcaatccggaaggctacaaagaatgtaatctgaagaaccttgccggacagctgaaaggtcatctgctcattatccatgacgaccacgatgacacttgcgtaccgcagcacacactgtcgttcatgaaagcctgtgtagatgcccgcacctaccccgacctgtttatctatccgtgccacaagcacaacgtatcaggccgcgaccgtgtacatctgcacgaaaaaatcacccgatactttgagcagaacctatagcaatctatagttgacagctcacagcatcataccgaaaaactcataactgaaaactcataacttaatactcattatgaagatattattactaggctcgggcggccgcgaacatgcactggcatggaaaattgcccaaagtccgaaagttgaaaagctgtacatcgctccgggaaacgccggaacaaacgccgtaggcgagaatgtcaacatcaaagctaccgactttgaagcgatcagcgctttcgctctgaaagaaaacatcgaaatggtagtagtaggtcccgaagacccgttggtagaaggcatctacgattacttccagaatcgtcccgaactgaaacatatcgccgttatcggtccgtccgccaacggagcacagctggagggcagcaaggagtttgccaaaggcttcatgatgcgtcatcaaatcccgacagcccggtataaaagtatcacagcagaaaatctcgaagaaggtctggctttcctcgaaacgctggaagccccatacgtgctgaaagccgacggactctgtgccggaaaaggcgttctgatcctccccacactggacgaggcaaagaaagaactcaaggaaatgcttggcggtatgttcggctccgcatcggcaacagtcgttattgaagagttcctgagcggtatcgaatgttccgtattcgtgcttaccgacggcgaacactacaaagtcctccccgtagcgaaagactacaagcgtatcggtgaaggcgacaaaggactcaacacaggcggtatgggcagcgtgactccggttccgtttgccgatgaagaatacatggaaaaagtacgtacccgcatcatcgaacctaccatcaacggactgaaagaagaaaacatcgtctacaaaggcttcatcttcctcggactgatccgggtaaaaggcgaaccgatggtgattgaatataacgtccgcatgggcgacccggaaacggaaagcgtgatgctccgcatccaaagcgacctcgtggaattgctggaaggcacagccgcaggcaatctcgatgaaaagacactggtcatggacccgcgctcggcaggttgtgtgatccttgtgagcggcggttatcctgaagcatacgaaaaaggcttccctatcagcggcctggaacaggccgccgctaccgaaagcatcattttccatgccggaacagccatgaaggacggacaaatcgtaacgaacgggggacgtgtgatcgctgtctgctcttatggcgcaacgaaggaagaagcgctggcacagagctataaagtggcagatatgatcgacttcgacaagaaatatttccgtcgcgatatcggattcgacttataatgagaaacaagagactacaaggtctggtcacagcagggcggtggacactccctgctgcgattttcatctgcaccctttgttgggtgctgacctctgtcctattgcccgaactcaccatgacagcgggcgaagaaggcggttccgtgctttggcagtctgcccgcacgttgctgctccccgcatgggcggagcatcttgtcagtttcttgatttacgcggctatcggctatttcctgatcgagctgaacaaccggttcagtattatccgtatgcgggcttccgtgcagacagctatctattttctgctggtcaccgtctgtccggagatgcacctgctatatgccggaaacgttgccgccataacctttttattctccatctatttcctgttcaagagttaccagcaggcgcaggcgtcaggatatctgttctactcgttcctgtttatcggtgcagggagcattctctttccccagctcaccttcttctcggtgctctggctgtttgaggcgcaccgctttcagtcacttacgttccgcagtttctgcggcgcactgataggatggacaatgccctactggatgctgttcggacacgcttttttctatgatcagatggagctgttctatcatcctttcaaagagctggccacttttggggacatattcaacctacagatactccagccgtgggaactggcgactctcggttatctgcttgtattgttcatcgtcagcgccgctcattgcgtcgttgccggattcgaagataagatacgcacgcgcgcctatttacagtttctcatagacgtgacactctttctcttcgtactgattgtgctacagccgtcacaatgcagcaatctcttgccgttgctcatgataagcaacagcatactgatcggacacctttttgtgctgaccaacaacaaaacatcgaatatattcttcattgttgccacggtctgcctcatccttttatttggttttaacgtatggacgcttttatagattcaacgatacaactcctcatcgaatggggacttccgggattgtttatctcggccttactcgcagggagtattgtaccattcagttccgaactggtgttggtagcactggtaaaactcggactgccacccactgcctgtatattggctgccaccctcggcaatacggcaggcggaatgacctgctactatatggggcgtctgggcaaaataagctggattgagaaatacttcaaagtaaagaaggagaaagtagacaagatggtgaaattcctgcaagggaaaggagcattgatggcattcttcgctttcctgccggccatcggagaggtgatctccatcgcactgggatttatgcgaagtaatatatggcttaccaccacctccatgtttgtcggcaaactgatacgttacattctgcttctgtatgtactggaaagcgcatggaacgtcgttgcaggatgaaataataggtaataagtaacaggtaataggtaataagttttttgagatgaaaagagtgattgaaaagactgatgacgggagcgccaccctatttgttccggaattgaatgaacattatcattcgaccaaaggagcacgtacggagtcccagcatattttcatcaatatgggactgaaagcctccgctgccccctctccgcatattctggagatcggtttcggaacggggctgaatgcttggcttacacttgaagaagcagaaagaagcggacgtaacgtacattatacaggacttgaaccctacccgttggaatggcagatggtggagcaactgggatatatagaacaaccagcagctatcgacctgttcagagcaatccatacatcaccgtgggaagaagaaatatcctttaccccacacttcactctctgcaaagtacaagccgacgtcaatgaatggattacccagcgcagccattctccattatccattatccattctccattatcattcgacgttatctatttcgacgccttcgctccggaaaagcagccggaaatgtggtcgcaggaactatttaaccgtttatatgttttattaaatgaaggaggcatcctcaccacttattgtgctaaaggagtcatccgacgtatgctgcaggccgcaggctttatcgtagagcgccttcccggtcctccgggaggaaagcgggaaatactacgtgcccgaaaactgaaacagaatcaacccccgatattaatacaatagtcatgaaacaacaactaaaagatttgaaaacactccttcttctcggctcctgcctcctgttggcagcctgcacgggtcgcacgtccaaagcaagcggcagcgaagaagcgaaaccggtcattaccgtcactatcgaaccgcagcgctacttcacggaagcgattgccggtgataaattcacggtagtcagcatggtcccgaaaggttccagtccggagacatacgaccctattcctcagcaactagtctctctgggagacagcaaagcctatctccgcatcggctacatcggcttcgagcagacctggatggaccgactgatgaataacacccctcatatccaagtattcgacacttcgaaaggcatagacctgattctgaacaacggtgagcacaaccacgcagcaggacatcatgaccacgacgggcacaaccacgccgtagaaccgcatatctggaactctaccgccaacgccctcatccttgccggaaacaccttcaaggcactttgtatgctcgacaaacccaacgaagcatattatctggcacgttacgactccctctgccaacgtatccagcacaccgacagcctcatccgccagcaactttccgctccagaatcggccaaagcctttatgatctaccatccggctctctcctacttcgcccgtgactacggactgaatcaaatttcaatcgaagaaggcggcaaggaaccttcgcccgcccatctgaaagaactgatagacctgtgcaaatcggagaaagtaaacgtcatcttcgtccagccggagttcgacaagcgcaacgcagagaccatcgcacagcaaaccggcacaaaggtagtccccatcaacccgttaagctacgactgggaaacggaaatgctgaacgtagccaaagctctcacccctatggaccccgaataaaaacgggcttccatagcgttaatgaccgaatgatacataaacgaagtaattctccaaatatgaaaccgattatcgaaataaagaaccttgctgccggatacgacggccgtaccgtactccacgacgtcaacctgaacgtttacgaacgggactttctgggcatcatcggtccgaacggaggcggtaagacaacactcatcaagtgtatcctcggtctgctgaaaccgacagccggagaaatcaacttccatgcccctacagaagcatcctcccactctcaactttccacttccaaccttccactttccctcggctatctgccgcagtatagcaccatcgaccggaaattcccgatttcggtagaggaagtgatactttccggactaagtatccagaaatccctcacctcccgcttcactcccgagcaaagagaaaaaggcaagcatatcatcgcccgtatgggactcgaaggactcgaacaccgttccatcgggcagcttagcggcgggcaactacaacgcgcactgctgggacgtgccatcatctccgacccttcggtactgattcttgacgaacccagcacgtatatcgacaaacgttttgaagcccgactctacgaactgctggcggagattaacaaagaatgcgccatcatccttgtcagtcacgacattggcactgtactgcaacaagtgaaatccatcgcctgcgtcaacgagacactggattaccaccctgacacgggcgtttccacagaatggctggaaagaaatttcaactgccctatcgaactgctgggacacggcacgttgccacaccgcgttctcggtgaacatcatcatcatcactaaacattcatttgccggtgctacatcaaagaacggccgcactgcatatcagtcatttacaacggtcacatcaagcagcaacaactgacttctcaactgttaatgattgagatgtcagatgttaatagttgacatgtcaggtattaacagttgagaagtcagctattaatgtctgacaacgcaagtattattgaccaataaatgattcaatgcttaatataaaagatacaaaattagtatctttatacctactgttgtttatactgtttagtgattcccccgtttcactaaaagggcataagataaagtaaatcacctttctgttacttaatatttcttactttctgcctcattatccttacaaatcactatctttgcgcccacgtaatctgttttttaacgaaaaatctagatagtgctaatgaaacagtacagaactataaacaacctcgtgggttggattacattcatcattgcggcaacggtctactgcctgacaatagaaccgaccgcaagtttttgggactgtcccgagtttataactaccggttataaactggaagtaggacacccgcccggcgcacctttcttcatgctggtagcgaacctgttctctcaattcgcctccgatgtaaccaccgtagcgaagatggtaaactacatgagcgcactgatgagcggtgcctgtatcctgttccttttctggagcatcacccatctggtacgcaaactggtaatcaccgacgagaacaacatcacgaaaggacaacttatcactgtcatgggtagcggactggtcggcgcactggtctacaccttcagcgacaccttctggttctctgccgtagaaggcgaagtatatgctttctcctccctctttacagccgttgtattctggctgattctgaaatgggaagatgtggccaaccagcctcacagcgaccgctggctaatcctgatcgcttatctgaccggactgagtatcggtgttcacttgctgaacctcctctgtctgccggcaatcgtattggtgtactactacaagaaaactccgaacgccactgccaaaggctcattgctcgccctgctcggatcgggcgtactcgtagcagccgtgctttatggcatcgtgcccggtatcgttaaagtcggcggctggttcgaactgctgtttgtcaacggactcggcatgtcgttcaactccggcgtcgttgtctatatcattctgctcgccgccgcccttatctggggtgtgtacgaaagctacaccgaaaagagcagactccgcatggccatctcattcattctgaccatcgccctgctgggtattccattctacggacacggcgtaagcagcatccttatcggtgtcgtagtgatcgcaattcttggcatctaccttgctccgcaagtacaggaaaagatcaaagagaaatggcgcatctccgcccgtaccatgaatacggcattgctgtgcaccatgatgatcgtgatcggttattcctcttatgcactgatcgtgatccgttctaccgccaacacaccgatggaccagaactctccggaagatatcttcacgctgggcgaatacctcggccgtgaacaatacggaacccgtcctctcttctacggtcctgctttctcctcgaaagtggcactcgacgtgaaagacggatactgcgtcccccgccagtcacagacgggaagtaaatacgtccgcaaagaaaaaacctcaccggacgaaaaagactcatacatcgaactgccgggacgtatcgaatacgaatacgcgcaaaatatgcttttcccccgtatgtacagctccgcgcactcctcactctacaagcagtgggtagacatcaagggacatgacgtcccatacgaccaatgcggcgaaatggtgatggtgaacgtaccgaaccaatgggaaaacatcaagttcttcttctcctaccagctcaacttcatgtactggcgctactttatgtggaactttgccggacggcagaacgacattcagagcagcggagaaatagaacacggtaactggatcaccggaatcccgtttatcgacaatctgctggtgggcaaccaggaattgcttccgcaggacctcaaaaacaacaaaggacacaacgtattctactgcctgccgctgctgctcggcctgatcggactcttctggcaagcataccacagccagcggggtatccagcaattctgggtggtgttcttcctgttctttatgacaggtatcgccatcgtgctctacctcaaccagacacctgcgcagccgcgtgaacgtgactatgcgtatgccggttcgttctacgccttcgccatctgggtaggtatgggagtcgcaggtatcatccgtatgttacgcgattactgcaagatgaaagaagttccggctgccgctctcgcatcagtactctgtctgcttgtccccatccaaatggccggacagacatgggacgaccacgaccgtagcggacgctttgttgcccgtgacttcggtcagaactatctgatgaccttgcaggaagaaggaaatccgatcatcttcaccaatggtgacaacgatactttcccgttgtggtacaatcaggagacagaaggtttccgtacagatgcacgtacctgtaacctcagttacctgcaaaccgactggtacatcgaccagatgaaacgtcccgcctacgactctccgtcactcccgatcacttgggaccgtgtggaatacgtcgaaggccagaacgaatacatccccatccgtccggaagtaaagaagaatatcgaccagatgtatgcacaggcagacagcgcgctcgaaaacggaaatccggaagcgatgaacgaactgaaagaacagttcggagaaaacccgtatgaactgaagaatatcctcaaatactgggttcgttcggataaggaagggctgcgcgtcatccctaccgacagcatcgtaatgaagatcgacaaggaagctgtccgccgttccggcatgaaaataccggaagcgctgggcgactccatccccgaatacatgaccatcttgctgagagacgccaacggcaacccgaaacgcgccctctacaagagcgaactgatgatgctcgaaatgcttgccaacgccaactgggaacgtcccatctacatggctatcaccgtaggcagtgaaaaccacctcggcatggacaaccacttcacgcaggaaggtctggcataccgcttcactccgttcgatacggacaagctgaacagcaagatcgacagcgaaaagatgtacgacaacctgatgaacaagttcaagttcggcggcatcgagaaaccgggcatctacatcgacgaaaacgtaatgcgtatgtgctacacacaccggcgcatcttcacacagctcgtaggacagctcatcaaagaaggcaaaaaagacaaggcactcgccgcactcgactacgccgagaagatgatcccgtcatacaacgtaccgtatgactgggcaaacggcgccttccaaatggcggaagcctactaccagctgggacaaaacgaaaaagcgaacaagatcatcgacgaacttgccaacaagtctctcgaatacatgatctggtatctcagcctgactgattaccaactttccatcgccagcgaaaacttcatgtacaacgcaggactgcttgacgcagaagtacgcctgatggagaaatacaaatcagaagaattggctaaacattactcggaacaactcgaccagctatacaatgagtacgttgcgagaatgaaagggaaataaaaactaagtaataagtattaagtaataagtaataagctgcgccataagccgcacggttattacttattacttattacctgttacttattaataaagactcttatgtttatagaacaaccaccttggttcttccgagcgctgtatccacaagccatcttccggatggacccaaacgaacgggcagtctacctgacttttgacgacggccctatcccggaagttaccccttgggtactggagctactgaagaaacacgatattaaagctaccttcttcatggtaggcgacaatatccgcaaacacccggacgaataccggatggtggtagaacacggacaccgcatcggcaaccatactttcaaccacatccgcggctttgaatattccaatccggattatctggccaacaccagacgggtagacgaaattatccactcggacttgttccgcccgccacatgggcacatgggattccggcaatattacacccttcgccaccattaccgtatcatcatgtgggatctcgtaacccgcgattacagtaagcgaatgcgcccggaacaggtactgaacaacgtaaaacgctacgtacgcaacggttccatcatcaccttccacgactctctgaaatcgtggaacaacgggaatctgcaatatgctctcccccgtgccatcgagtttctgaaagcggaaggctatgtgttcaaggtattctagctgccggcaaagaaacattttacctgccgacagcaagttttctaattaccgataaggttttcatccatatccattatgaaaaagctcctctcctcagaccgaattaaagccgaagcactacgcctcggcttttccgcctgcggactggcgcctgccgaagctgtggatgaaactgtggctaccgccttccgtcaatggctggcggacggttgccaggcagagatggcgtatatgcagaattatgaggataaacggctcgatccgcgcttgttggtggaaggggcacgtacggtgatcagcgttgcgctaaactattatccggcaaaaaaacttcccgaaggtgagtatcagattgcatggtatgcctacgggaaagattatcacgatgtgatgaaggggaaattgaaggaactttttgagtttatagaaaaagaagtttcattctccgaagaaacagacagtactatcgcctcgacaaacaatatcggcacatatactgaaaactacgcctcagcaccccaagccccagtatcccaaacctccgcttctccgcttcaaggccgcatattctgtgataccgctcccatactcgaacgttattgggcatggcgtaccggcttgggatggataggaaagaatacacatctcatcattcctcacgccggctcctgcttcttcttaggggaaattattcttgatagggaagctgacaattatgactctccacaacgaaatcaatgcggttcgtgtacacgttgcctggatgcctgcccgacaaaagcgctggaagcccctttcaggctcaattccgagagatgtctttcttatcttaccattgagtatcgtggggaactttcgctcaatacaggaaaaaaaatgggtaataaaatatatggctgtgacgaatgtctgaaagcttgcccttggaatcgctttgccactccttgccggacagccgaatttcaaccgtctccttctttgctaagtatgaagaaggatgattggcattcgctgagtgaagagcaatataaaaccattttcaaaggtagcgcagtgaaaagggctaagtatagtggattgatgcgtaatataaagattattaaa

SEQ ID NO: 89 - DNA, 31638 bp, Bacteroides thetaiotaomicron
cctaatacaatccaataactaaaatagtttttctgcaaatattgaacaaaacggtcaaatgcgtgtttcataatttaaataccccaataaattataaagtcttttttcaaaaaaagtagatttactatgacaatagtttatcgtagattgtgtgtaactgaattttcaatggtgaaggcaattggtttttcagaatcatttgcgaacgcctcagaacagttttcttctttgcctcatcctctgaattggcatacatagacacactatatcccatcagaagagacagacacaaagcagcttcctgctcagcagtcttaccgtgacaaggatacagatcattgatctgttcatggatttcgttgttcagtcgtgcaagatcatcaacatacacacccgccatataattacttttatggagcagagcatgaactgtattttgaagtttatcgattttttcttgtaaacaggaagtcgtcattacccacttagtttttttcacctataggctcaacatagccaatcggcatgtctacgcaggcgcaaccaagcatgttcagtcgaacagcaatcttacttttaccatctacattgacaagctcacccacaagcccctgcagaggtcctttaattacttgaactttctcaccacgtgccaaaggagagctattcatacagactgtttcatccgaataatcaagcatgaaacgaaaacgtgccatctggtcgtcaggaataacagcaggactgctttcgccgcgcatcaccatatagcggctcacagtagtaaagttcaggacttccatacgttctttcggatcagcgtgtacaaaaaccatcatcggaagaagaacggattcaactaatttacggcggtcactccattgatggatttccttctgaacaggtacaaaattctcaatccccaccttgttcaaatactcggaaaccttcttttcatgatgcatacgaactaatgcaacataccagcgttttgagtgtgctacgccttcccctgtcccataaataggcccagcatttagtgatttctcttttgttaaaatcatacttttttaccccatgtttttccgttacttcttaggtaacggatttaaatttgacgcaaagatagacaaaaacacatgtattaaacaaataaaaacctactttttttcgatttaaccctgaatttgaaaaaaaatgtatctgaacatgaaaaaggcctattttcatgcttaggaatttatatgcccaattttcctaagaatctctactttctctaaagccaagatgctctcaaccctcattagtcggtacttttcgactttttcctcccgatttattatgaagtgtacttttccgttacctaagaagtaacacaccagcatcagtgctgattatcaaatttttaaccattcaaattcgacctaaagggcaagtcttcacgtaatgcaaattcttacgatttacctctgtacgctctttcaactcaaaccccttcagataaatttgtgtcgtctttatagacttatgccctaaagattcactgatcatttcaattggaactccacggaacttggcagtagttgcccaagaatggcgaatcgtgtaagaagttaccggagaggtcaagtgcaaagccctcgccaaacttttcaaatgattattaaaccggcgaagtgcagactgatattcacgataagcacgttcatccttacgtttcttatcaccggaaaggatactgaaaaggtaatcggggcaacccggacgcgatgactgggaattgcgaagctgattcatcatttccttagctgtatccaaaacttccacactcattggagttctggttttaattcgattatatcggagcacattacaatctaaagccgacttttccaaatgagccaaatcggcaaaagacatcccacagaattgaaacatcaaagcagcaatcgattgtgtgcgccgcaaacaatccgtcttgggatcttcgtaaagaagccgtcggagttcactcaccggaagagcccttttctgacggatatccactcctgtatacacatcacggaacagaccatgtacatagggcgcactacccaactctaccccacggttatagatactgcgaagcatacgcatatacgttgataccgtattcggttttaagcccgaatcatacagatgttccccgtaacgacgcaatcggtcacgagtgacttgcctgaaagatacactggcattaccacaaaatttattaaaagagaaaagagcattttgatagacatgtgccgtagaaaaacgaccttcttttcgtaaaaggccgatgtatagttccccacatcggctaaatccatttttattcattatttgcatcactagttattttatatacaattatagggcgaaaatttggaatttccatcttaatgccatttattaattttatttaaatcaaaagaaatgacaacgacaaaaaaatgcctgaaaaatgcaactggcacacaaaagaagagaagtcttgaaactgattatcaggatgatgacgaaattattgacatcgatgaggtcagaaaaagaaatggcatcacaggcgaaaaaaaacactatttcattgcctgtcttcgcacttattacgaagatgacgagtttaattcctacgtaaaatctttaacaggactagccaagtacattgcagactggagaatcttttacgtaaacacacatcatggatatagattaatgaaattcaggagtatactcagcgaaattagcagtttaagcaaaggaatcggaataatttcgaagcacgaaaaagaagagaaagaacaatacaaatcaaagtatcacagtagaaaatagcaagaataattggagcgaaaaaatacaacttatacttttgcccccgttttttagataaagaaatgaacgaactatccggcagaaattatagtgtcactataacagcaagatagtgtcactatcccgacaggatagtgtaactatcatcgcacgatagtgtaagcatcctacagatagttccgccttttctttaaatataactattttactaacaaatttataatgtaatgacaaaagaaaaacggctgatagccactaacaaaacagaagaagaaagagatcgattaacagaagtatggaaaaaacgtatcgtatcagagaaaggttattcggaaacgatcgcagaacgaatagccgaaaaagtgaaatcactggcagactacatgcaatatggccatgccatcatcgcatattacagacagaacggtagttttcagttagttacaggcactctcatttcttattccaaagactttcaccactcttatgacatgaagcaggtacacagtaccttcatattctggtgcatggaagagaaaggatggagaacctttcagattgagaattttctcgattggaaaccaattgtataaacttaaaaacaaacaataagactgatatgagcacaacttatttaagcgtagactatttcccgcttaccgtaaactttttcgacagagatgccattgaactggctgaagccaaatatggcatcagagtggatggagctgtatgcaaacttctatgtaaaatattcaaagaaggatattacatcccatggggtgaggaacaatcgttgatttttgcccgcaagctgggaggagaactgaaaggaaaagagatagacggaatcattcaaattttgcttgacaaaggattctttgacaaagaaagctatgagaagtttcagatattgacttcccttgaaattcagcacatctggatagatgctacctgccgcaggaaaagaaagttagaagatttgccctacctgttggtcaatgacacccaaaaacaggaaaaggaaaataatacaaaggatgcaaacaattcgtcagtacaaggtgaattgaaactggaaaatgagaacatttcacccgaaattgctgacatttccggacaaagtaaaggagagaaaagaaaagcagaagaggaagaagacaatacggcttcgccttcgctcgaaatccccggttatgcctacaacaagagtacgcacaacgtcaaaggacttctggacagcctggcacaacatggagtaacaaacaagaaagaaattacagctattctcaagctgtcggattacggaaagaaggggacgcagatatggatcacgctgtctaccaccaagtggggaaagattgataatccgggaaggtatatcatttcaacgttgaggacatagagataaaataaggcacggattacacgaattaacacggtttttagttattcaattcctgaaaccgtgaaatctgtgtaatccgtgcctaaaaaaaattaccacttatagttaataccgaagctcagcaattccttcagctggaagaagctgccattttcaacggttggttttgaactgtcgtcaaaacgggcgtgtacgtaaagtttagtagaaagatagcggttcaaaacaaagttgaatgtattctcccactccacacgcacccattcgtaattggtcagatagttcagacgggattccagcgaaacagccgaaatgattttccagttgaacgttgactgcaactgagaaccgaagtcgtttttagagcatttgcctttctccagaccgaacttggtttcatctacttccgaattgtcgatatatcgcaagttataagtcagcggaccgatgaaaacagaaagattgaatttctgcttattcaatttgtagtccataccgatactgactgccaaatccgccggagacaggaatgcggaaacaagttcttcgctattggctttgtaaccgtgacagaactgagtcttaaactcggaagaaatagtatagtaccagttctttaacgctcttaatcctaacttattgtacagacggaactggtcggtattaatcaggtaatcatggaatttatccgacggtgtggatgtcatacccagtttagcctccaactgattttcgaaaaggactttctcattatcattgtagttggcataaagctgcaaggtagccagaccggcaaagttactttctcctcccttgtaccagttctcagaaaggtggttctggctgatttgcaaagaaccgttacctccggtaacccaccagttaggacggctgattttcatttttgccttgcccacatcgttgctcatttcttccggctggaaaagatggacaacagatgccttcggagaaatcttcggtttcacatccctacgaaagacatcacggctcatgatacggttttccgtggtgacaaccagttccggatgattgagataaagagccatcagtgctttattgaccgattgattggcacgctcggacttcgtatatgccaaagtatcataagggaggagttccgctgtcaactttttcaagttgtcgggcaaagagtcaaactgtaccggtttccaatccacctttgaatactgcgccatcggagcataataataggctaacggagtaaacagacgaaaatagtcaggatcggacggaatataacgttccggtacagacgggtcattcaggtagtccaactgaccgatatacttattatataagattgatacagtgtccaatttaggagtttctccggacagattcaatttaagcattaaatacttctgaagttctgacgaaagcgtgtctgccttcacaattttcgcttttgccactacggtagaaggttgagtggcggtctgtgctgaaagcgataaagataaagtcgaggtaaaaactacgaatgataataactctcttctcataatattcctaatttggtgcaaatctacattattttgtttagaaaacataggaatctttcaaaattgcattttttaataaaattgtagaggggaaagtctgcattcttccccttttttttataattttgcgctttttaagttcgtaagaaactactaagtaaaaataattaaaacagttatagctgtgggagaaacaaagtatattttcgtcaccggtggtgttgcctcttctttaggaaaagggatcatctcatcctccatcggtaaattgctgcaagcaagaggttacaatgtaaccatccagaagtttgacccgtatatcaacatcgacccgggaacattgaatccttatgagcatggagaatgctatgtgaccgtagacggccatgaagccgatcttgacctgggacactacgaacgtttcctgggtattcagactacaaaggctaacaacatcactacgggacgtatctacaaaagtgttattgacaaagaacgtcgcggagactatctgggtaagacgattcaggtgattcctcatatcacggatgaaatcaaacggaacgtaaaattgctcggtaacaaatacaagttcgattttgtaattaccgaaatcggtggtacggtaggtgatatcgaatcactcccctacctcgaaagtatccgccagttgaaatgggagttgggtaagaacgctctttgcgtacacctgacatatgtgccttatcttgccgctgccggagagctgaaaaccaaaccgacacagcattctgtcaaggaactccagagcgtaggtattcagccggacgtattggtgcttcgtgccgaacacccgctgagcgacggactccgcaaaaaagtagctcaattctgtaatgtggatgacaaggctgtcgtgcagtctatcgacgcagaaacaatttatgaagtacctctcctgatgcaggcacagggactggacagcacaatccttgaaaagatggggctgcccgtaggagaaactccgggactaggtccgtggcgtaaattcctggaacgccgtcatgctgctgaaacgaaagaacccatcaacatcgcattggtaggtaaatatgacttgcaggatgcttacaagtcaatccgtgaagcattgtcacaggcaggtacttacaacgaccgcaaagtggaggttcactttgtgaacagcgaaaaactgacagatgagaacgtagccgaagccttgaaaggcatggcaggcgtgatgatcggtccgggattcggtcagcgtggtatcgacggtaagttcgttgccatcaaatatacacgtacacatgatataccgaccttcggtatctgtctgggtatgcaatgtatcgctatcgaatttgcccgcaacgtattgggatatgccgatgccgactcacgcgaaatggatgaaaagactccgcacaacgtgatcgacatcatggaggaacagaaagcgatcaccaatatgggaggtacgatgcgtctgggcgcttacgaatgtgtgcttcagaaaggatcgaaagcataccttgcttatggtgaagaacatattcaagaacgtcaccgccatcgctatgagttcaacaatgactataaggctcaatacgaagctgccggtatgaaatgcgtgggtatcaaccccgaatcggatctggtggaaatcgttgagatcccggcattgaagtggtttatcggcactcagttccatccggaatacagcagtacggtattgaacccgcatccgttgtttgtggctttcgtgaaggcagccatcgagaacgagaagaattgacaattgacagttgacaattgacaatttattattcaaaaatttataattcataattaataggaatggataaaaacaccattacaggtctcgttttaataggtatattattggtaggattcagttatctgagccgtccaagcgaggagcagatagctgcgcagaagaaatactacgattctattgccgtggtgcaacagcagcaggaagcgctgaaagcaaaaacagaagccgcactcgccaatgaaaacaaaggtgcagcggcggcagcagattcttctgccctgtttttcaacgcgatgcatggaactgattccaaagtaagcatccagaacagcgtagcggaaatcactttcactacgaaaggcggacgggtatattcggctatgctgaaagaatacaaaggacaggacaagacaaaccctgtcgtactgttcgacggtgatgatgctaccatgagtttcaacttctacaacaagcaaggagccatccagacaaaggactattacttcgaagctgtcaataagacagacagcagcgtaactatgcgtctggctgcggacaacgccagctacatcgattttatctatacgctgaaaccgaacagctacctgatgaactttgaaatcaaagcaacaggcatggaaggcaaactggccagtacggagtatgtagacatcgactggacacagcgtgcacgccagctggaaaagggattcacttacgaaaaccgcctctcagagctgacttataaggtaaaaggtgacaatgtagataatctgtcggctgccaaggatgacgaaaaggatctgggcaatacagcgatagactgggtagcattcaaaaaccagttcttctcttctgtattcattgcagaccaggacttcaacaaggtttctgtgaagtcaagaatggaacaacaaggaagcggatatatcaaggattattctgcagaaatgagtaccttcttcgatccgagcggaaaacaaccgacagaaatgtacttctactttggcccgaaccacttcaagaccttgaaggcactggacaaaggacgtacagagaaatgggaacttaacagactggtatatctgggctggccgttaatccgctggatcaaccagtttatcacgatcaacgtattcgactggctgtcgggctggggcttgagcatgggtatcgtactgttgattctgacaattatggtgaaggtggtagtttaccctgctacctggaaaacatacatgtcttctgccaagatgcgtgtattgaaaccgaaaatcgacgagatcaacaagaagtatccgaagcaggaagatgcgatgaagaaacagcaggaggtgatgagcctttacagccagtatggcgtgagcccgatgggcggttgtctgccaatgttattgcagttcccgatcttgatggcattgttcatgttcgtaccgagcgctatcgagttacgtcagcagagcttcttgtgggcggacgacttgtccacttacgacgcgttcatcacattcccgttccatatcccgttcctgggcaaccatctcagcttgttctgcttgctgatgacggtaaccaacatcctgaacacaaagtatacaatgacgatgcaggatacaggagcacaaccgcaaatggctgcgatgaaatggatgatgtatctgatgccgattatgttcctgttcgtactgaacgactatccttcgggattgaactattattatttcgtgtcaacactgattagtgtaggaaccatgattttgttgcgtaaaactacagacgaaacaaaattactggctattctggaagctaagaaaaaagacccgaaacaaatgaaaaagaccggatttgctgcacgcctggaagctatgcaaaagcaacaggaacagttacagcagcaaaaacagaataaacgataagaaattatccgaagatatattctgagaaagccgggcaaccgaaaggggtttgtccggctttctttctctaaaaaacaaacttaatatgaagacaaaatatacttataaacaaatctggacgatcgcctaccctattctgatcagcctgattatggagcagctgatcggcatgacggacacggcctttcttggacgtgtcggggaaattgaattaggggcatccgccatcgccggggtttactacctggctattttcatgatggcattcggattcagcgtaggagcacagatattgatcgcccgtcgcaacggggaaggaaactacaaggaaatcggaccgattttctatcaggggatttatttcctggtagtggttgctgcgattctgtttacactttccatcgtattctcgccatttattttaaagaatatcatttcgtcccctcacatttatgatgcagcggaaagttatattcattggcgggtgtacgggttctttttctcatttgtcggagtgatgttccgtgccttctttgtcggtacgacacagaccaagacgctgacgctgaactccatcgtgatggtgctttctaacgtggtattcaactatatcctgattttcggtaagttcggtttcccacaactgggcattgccggtgcagccatcggttcatccctcgctgagctggtatcggtgattttctttatcatctatacctggaagcggatcgactgcaagaagtatgcactgaatatcctgccgaaattccaaagccggacattgaagcggattctcaatgtctccgtgtggacaatgattcagaacttcgtttctttatctacctggtttatgttcttcctgttcgtggaacacctgggagaacggtcattggctatcgcgaacattatccgaaatgtgtcgggcatcccgtttatgatcgccatggcttttgctgcaacctgcggatctctggtcagcaaccttatcggtgcgggcgaaaaagattgtgtacggggaaccatcaatcagcacatccgtatcggatatgtgttcgtactgccgatattgatattcttctgtctgtttcccgacctgattctgcgcatatacacggatatgcccgatttgagggatgcgtccatcccttctttatgggtgttatgcgcagcctacgtagtgctggtaccagccaatgtgtatttccagtcggtatcgggaacaggtaacacacgcacggcactggccatggaactttgtgtactgacaatttatgtagcttacgctacttattttattctttaccttaaaatggacattgcgtttgcctggacaacagaaagtgtgtatggaatctttatcttcctcttctgctactggtatatgaagaaaggaaactggcagaaaaagcagatttaaatccttttttcattatcttcgcaagaaaataaacatttttataaaatatgagacaagcaaatctatttatgatgtcggcagcaatgttgttagctgcctgcggcggaacaaaagacgcgggcaaaacggatcaggtgcttatcgaaaaatccgatattaagatcgaagggaagcgtatgacgcctgaagccctttgggcaatgggacgtatcggaggactggcggtatcgcccgacggaaagaaaattgcgtatacggtagcatactacagtgtaccggagaacaagagtaatcgcgaagttttcgtcatgaacgcggacggcagcgataaccgacaaatcacccgcactccttatcaggagaatgaggtgacctggataaaaggaggatcgaagctggctttcctgagcaacgacaacggaagcagccaactatatgaaatgaatccggacggtagcggccgtaaacaactgaccaactacgatggtgacatcgagggttattctatctcaccggacggcaagaaactgctgttcatctcgcaagtgaaaaccaaagaaagcactgccgataaatatccggatctgccgaaagctacaggtattattgtcaccgacctgatgtataagcactgggatgaatgggtgacaactgctccgcatcctttcgtggcagactttgacggtaacggtatttccaatatcgtggatatactggaaggagaaccatacgaaagtccgatgaaaccttggggcggcattgagcagctggcttggaatacgacttcggacaaagtggcttatacctgtcgcaagaaaacagggctggaatatgctgtttctaccaattcggatatttatgtgtatgatctgaatacaaagaaaacggataatatcaccgaagaaaacaaggggtatgacaccaatccgcaatactctccggatggcaagtacattgcatggcaaagcatggagcgcgatggatacgaagctgatctgaaccgtttgtttatcatgaatctggaaactggagagaagcgttttgtcagcaaagcatttgagtctaatgtggatgcgtttgtctggggcaacgatgccaagaccatctattttacaggtgtatggcatggagaaactcagatttattctcttgacctgacgaatgattctgtaaaggcgattacttcgggtatgtatgattatgaaggggtagcactcttcggtgacaaactgattgccaaacgccactcaatgagtatgggtgatgagatctatgcggtagcattggatggttctgccactcaactgacacaggagaacaaggagatttatgatcagctggaaatgggtaaggtagaaggtcgctggatgaaaacgacggatggcaaggatatgttgacatgggtgatctatcctccccagttcgatccgaacaagaaatatccgacattgctgttctgtgaaggtggtcctcaaagtccggtaagtcagttctggtcttatcgctggaacttccagattatggctgccaacgactatatcattgtagccccgaaccgtcgcggattaccgggattcggagtggaatggaacgaacagatcagtggtgattatggtggtcagtgtatgaaagactatttcactgctatcgacgagatggcaaaagaatcgtatgtagataaagatcgtctgggatgtgtgggcgctagtttcggaggattctccgtatattggttagccggtcatcacgacaaacgtttcaaggcatttatcgctcatgacggaatcttcaatatggaaatgcagtatctggaaacagaagagaaatggtttgccaactgggatatgggcggcgcgtactgggaaaaacagaatccgatagcacaacgtactttcgccaactcccctcacctcttcgtggaaaaatgggatactccgattctctgtattcatggagaaaaagatttccgtattttggctaatcaggctatggctgcatttgatgccgctgtaatgcgtggtgtacctgcagagttgctaatttatccggatgagaaccactgggtactgaaaccgcagaatggtgtcttgtggcaacgcactttctttgagtggctggataagtggctgaaggctcctgcaaaataaatctttgatataagacaaataatgaaggctctgttctcaaatcaaattgagttcagagccttctgcattacatctaaaatccgctagactttactcatgatatatattttcgattgctactatatacttagataaggtctatgattcaatctagacctgtttcataatccttttcaaatagctcaatcggagcctccattaaaacagttttttcagcacctttttcgtctgataaatcaattaatcccattttttgctcccttaattgttctccagtccatctgccttttaaatggtattcttcccctttatttacggccttcagtaccaaataaaaagttaaggtacatcgatatccacattcttgttttgttaactcataagttgaatagggaggtatcttatactttacatttccaatagaacgtgatccattctttacttttaatgtttctccaaaaatcaacggagtcttcgcacccgttccgtctataaaaagcttacctccagcatcaatgaaaggaacaggaatcttcaaatccgccaaattttcagcattaacaggcaaagaaccttcagtcaatacaaataaagagttctcttcctcttccacatcccatgcatatatcattggaagaggttcatctttatcatttactttatgttgcaagactactacaggatattcaacccgctctactacatccgtttcctcctgcacaaacttataggaaacaacctctaatatcgccggagtattggatggagaagaagacacatcatccgaatcactactacaagctgcgagtgcagcacagatacctgcaagaaagaacatttttgttttcataacgcttagttttagttgtgttacaatagtttagtttagggcaaatgtataatatttatatcacttatcaaagctttaccgataaaaaataaaaaaagggagaattaatctccctcccaaatattttcgatttctactatatacattttatgaaaacctccatgagcatcgtcataccatttttccaaggactctttatccaggaaacattcaggtttaatgttatccgcatacagttttcttccttccagactcaggcgggcctgttcgaaaagcacattcccctgttctgtgaagaccggcttcaatccggttgctttcaccttatccgtatcacgaccggactttgagccacaaactgcatgaatcttcttatttgcttcgcccaaaaaagaaagtgtcagataatcacttttctcgatgaactcatacgtatatcgttcggggcggacaaaaacaaaagcaacgggcttattccaaagccagccaatgccaccccagctggcagtcattgtattgaatttctctttggtgccggcagtaaccaacatccattctttgccaatcgcctcaaagaaattttctttcaggtcttttacttctaacttcttcatctctcagtttattttataattactttcttttactcagttttacgatttctcccagataagggatttctacacgaatctttcttttctttgcttctgccgcaaatactttaggcggatcatgcaagggttcatcagacaaatcaaatgtaccgtagtgcatcggaatggttattcctgcgtgcatctcttcggaggcagtcagtgattcataaggagaaatatgattgggacgcatgaaccaacggggtttatatgcaccgatacccaacaaggcatagtccggagctccgaacagatccgggatttccctaaaatgggtagaataccctgtgtctccgctataatagagagaaacaccattcccctgcagcatgaaagctccccacaatcgctgccctccatcacgtacggagcgtttgctccaatgctgtgccggcaagaaagttattttcagcccttcatcttccagttgctgataccagccggcctcaatcactctcatttccggaaaccagctctttatcagttctccggttcccaaaccgcaaaacaatttcatctgcggattattattcagcaaacgggtgatactttgcttgtccagatggtcaaaatgatcatgactgataagcaggtaatcaatttctgtaaaaatgtcgggattggcaggaaactcactctgtcttttcacaaaagggatgtttccgaaaaccggatcgaacatgattcttttacctgccaactgaaggaagaaggaattatgtcccagccatattaaagaatctcccaccacagcatccagcgaacgaagataacagactttcgggtcccacttcaccgttttcttttctttccgctgaggattgggggacaaccgccatttcaacacacttcccataccggggcggaaacggtgctgcctgttaaaaaaacgtccgcgtaccatcggatttcctctccaataaggattaacggtagccaaacgttcgtttctcctgaaacatatatgttcacccattttctttatctattgaataagtcctcacaaacttaattaaaaatctcgatttacaaagagggacaaacaaaaaatgtaccccagacacactatcggggcacatttctcagaaaaagaataaatattattcttttttaatagaacgatcttacattaaaagcaatgcagtccatacaacggcagctgccatccgagagctgacaaattgataatcacgatgaccagtcccaatacccataggataaacagagaccatttcaagccggtccccatcggtgaccaatgaaacaactgacgcattatagtgtacagaaaagctcctaatggaatggcaatgagtgcaattcctgaaatggtgccaagcaatgtcatcacaggagatatggtagctatgggcgtccagtcaatagccggaagcatttcataaagcagagctccgccgccaacaagcgcagcaatcaccgcaaacacaagagctactatcaccacagcgagcacgaacaataccggacagcaaatgatgacaagagctaccaggaatatcttaagaatgatagcggcgatcgtgacaaatacatctcctactttttgcagaaaggtacgcggtttatccgagttcacaaagttattgaccccgtcggcaacccgttcaaatccgtccgtcaccgttttgcctatattttctatggttaccgcttcgccacgcatactcagcttctctgctgccgtacgtgcttcgggaatgataatccatcctataatataaaggataatcatcgggcaatagggaacaaacaataatacgatcatcaggatacgcaccagcgtgatatcccagtcaaaataagctgccagcccggaagctactcctccaagcaacttattatccggatcacggaacaggcgacgggctgtagtggtccgtgtatacccctgaccggaagaagctgtctgttccttcttatgcggttcggattcgtcgtcagatacaccaaaatcttccggtttgcctacccgggcaattatttcttccacatcggcaatagtaatgacttgcttccctgcggacactttctcggcaaacagctcggcaatacgaatctcgatatcattcacaatctcttccgccccctcctgtttgcgaaaaaaatgtttcaggttggacagataatcgtccagcaaacgataggcatcatcatctatatgatagacagttcctcccaaatttacagttaatgtttttttcattattatttcttctttatcgaattatctactagcaatatgattcacggtttcgttcagttccttccaggatatctcaagctcgcctaaaaaagcctctcctttttctgtgagcttatagtacttgcgaggaggtccctgcgtggattctacccattcataactcaacaaatcgtcattcttcaaacgtgtcagcaatggatataaggtaccttccaccacaatcagctgtgcctctttcaacttctgaataatatcagaagcataagccggctctttgtgcagtaaaagcatgatgcaatactccaacatgccttttctcatctgagattttacattgtctacattcattgttatttttctttttgacaggacaaatatatgcattactctagtaccttgcattacaaagtactataatttaataataattaaatcattaagaagttttctccttattataaaaagaaataatagctatatttgcagctcataaaaccacaaaaaagaaaatacgtatgtttactattcgaaaagcaaggatagatgattgcggtctgatcaaccaaatggccggtgaagtatttcccgccacttaccaagagatcttatctcccggacaactggactatatgatggactggatgtactctcccgaaaatatccggaaacaaatggaagaagaaggtcatgtttattttatcgcatatgaaggagatgagccctgtggctatgtctccgtacagcaacaggaagagaatgtattccatctgcagaaaatctatgtcctcccccattttcaaggcgcacactgcggtagttttttattcagagaggctgtcagatatatcaaggaggtacatccggaaccttgcttaatggagcttaacgtgaaccgtaacaacaaggctttactgttctatgaacggatgggtatgagaaaattgcgggaaggggattttccgattggcaacgggtactatatgaatgattatatcatgggactggatatctgaaaagtaaggtaaccatatacaaaatgccccggaacagattgttactcaatcaatgttccggggcattcgtttatttattaccaagcgggcttatttcgctacgcgttccagccatttcagcatgaagatcatggtaaacattgaaatagtacaagctaccacaaatactgtccatgtcatccagataggaatggattcatacaaaatagcaccgatcaccaacagctgattgccaagtgcagttgcacctaaccagcctccctgcataataccctggtatttcggaggagctactttagacacaaatgaaattcctaacggagaaatatacaattcagctaccgtcaaaatcagataagtcagcatcaacaagaacggagtcactttcaccggtgaagttcctacagcgataatgtccttgtgcaaaggcagattggcaaaataagaaccgacagccattacgataaaggccaatgcggcaatacccataccaattgcaatcttcttaggagtagaaggctcttttccacgtctgcgctggctggcaaagattgccataatcacaggagtcaggaaaacaacaaagaacggattcaacgactggaacagctctgcggaaataggcataccaaacaagttaaggtcagtatattcctttgcaaagtacgtcaaagtcaaaccattctgatggaaagagaaccagaagaagataacaactccgaacactgcgaacagggcatacatacgttgtttcacttcttgaatactcatttctacagtagccgaagatgctgaagacgcaacggctctcttgctgggatcggggaagtttctcttattcagcaaatagatagtcaaagaaatgaccatagcaatgatagctactccaaatgcataatggaaacctgtagtaaagacgttcaggtaatcggatgcaaaagctgtataatcctgtaccggagcgttggaagctttctctaccaacgtatgataagtttcagtagcttcgggcgacaaagtaccagccaaatgaccgtgacataatgcaggaagatcagcatcgtaattataaccgaaagtagacaaccaccagttacgtacacctactgctgcaaacggagcaaagattgcaccgatattaatgaacatataaaacaaggagaaaccggagtcacgcatgctggcatattgaggattatcgtacatctgccctaccagagcttgcagatttcctttaaataatccattaccaaatgcaatcacaaacaagctggcgcaagtaatgaccagataaaaggtcttattgtctaccggagtcttggatggaatagccaacaacaagtatcccactgccatcagcacaattcccgtgaaaatagttcctttgtagtttcgtgtcttatcggcgataatacctccaaccaaagcaagaatgtaaatggaaaaatagaaagttgaataaataaatcccgcttcttttccattcattccaaacttagcttgcaagaaaagcacgaggatcgccatcattgtatagaagccaaagcgttcacctagattggctaaagcggctgctatcagtcctttagggtgtttgtcaaacatagatataaatttattaattaatgattgataatttttctaatgacatatattctgcaaatatatacttttttggatttattcctcaaataaacggcaaatttctgccctcgattcgcggattaaatcacccggcgcaagctttatctgcagcccccgtacaccggcacttacataaatatacggaaattgccggcaggtttcatgaatataagtaggaaaatgtttcttcatgccaataggcgaacagccgccccggatatatcccgtcagcggaagaagttctttcaccggtatcagatcacactttttattgccggaagcctttgctgccagcttcagatcgacttcgtgctcacccggaatgacgcaaacaaaataaccgcttttgtcaccgtgaagaaccagtgtcttaaatacctgttctatattctcgcctaagctggcagctacatgaatggcactcagatcgttttcgtcaacttcataaggaatcagttcataagctattttagctttatccagcagacgcgccgcattcgttttattgattttcatcttgttgtttctttttagtaagccgacacttatacttcaatattaaagtcctaattcctcgcgaagaaacttaggagtataacctttctggctcttcgcaacctcttccggtgttccgtagctaaggagtactcccccgcccttaccaccttcaggtcccatgtctatgatataatccgccatcttgataacgtccaggttatgttcgattacaatgacggtattacctttgtccaccagcttattaagtacccccatcaatacacggatatcctcaaagtgaagtccggtagtcggttcatcgagaatgtaaagtgttttaccggtatctcgcttggacaattctgttgctagtttcacacgctggctctctccaccggaaagggtagtagatgactgccctaatttaatatagcccaaaccgacatcctgcaagacttttatcttattcagaatctgcggcacattctcaaagaattcgacagcacggtttatagtcatatcaagcacatcagcaatagactttcccttgaaacgtacttcaagcgtttcgcgattataccgcttgccgtggcaaacctcacaaggcacatacacatccggcaagaagttcatttcaattgtcttgtatccatttccggtacaggcttcacaacgaccgcccgatacattaaaagagaagcgtccgggcttgtaaccgcgaatcttagcttccggaaggcttacgaacaagttacggatatcggaaaatacacctgtataagtggccggattggaacggggggtacgaccaatcggagattgatccacgtccactaccttatctatgttttccagtccttcaatagaatcgtattccagaggatcttgcaaagaacgatagaatttctgtgaaagaatcggctgcaaagtctcattaatcaacgtcgatttaccacttccggatactccggtcacacaaatcaacttccctaatggaaattcaacatctacatttttcagattatttcccttcgctcctttcagccagatagattttccatttccttttcttcgcttggcgggtacttctattttcatctctccgttcagatactgcgaagtcatcgtttcggtttgaagcatttctgacggggttcccgagaagactacctccccacccagacgaccggctttaggccccatatcaatcacataatcggcagccagcatcatatctttatcgtgttcaacaacgataaccgagtttcccatatcacgaagctctttcaacgagcggatcaaacgcagattgtcacgctggtgcaacccgatactcggttcatccagaatataaagcacattcaccaattgcgagccgatctgtgtagccagacgaatacgctgactttcaccaccggacaggctgaccgagctacggttcaatgccaaataatccaatcctacatccaacaagaatttcaaacgcgtacgaatttctttcagaatctcggctgcgattttcttttgtttatcggacagaaattgatctacgttcatcaaccagtcatatagctcattgatgtccatattggccaagtcattgatgttcttgtcatgaatacggaagtgcaatgcttctttattcaaccgggcacctttacattccggacaaacagtggtacgggcaaactgctccgcccacttctgcgcggtagcagaagcatccttttcctgaagcatctggatatattttacgactccttcataggttacaaagtaatcagaagaagttcctatcagcgaactcttgatcttgatccggtcatccgaaccatataatatttcttcaaccgcatcatccgacaattccttcaccggagtttttaaagtagcttcatacttctccagcaaagcaccgatctgccagaaaatcatggcattcttgtattttcccaaaggtgctatcgctccttcatagatggaaagttcacggtcgggaatcactttatcgacatcaatctgattgaccacgcctaatcctttacatttcgggcacgctccctgcggagagttgaacgagaagttatgaggagccggttcccgataagacagtccggtaaccggacacatcaggcgtttactgtaatgacggacactttctgtctgcgcatcaagaatcatcaataaaccatcaccttggcgcatagcagttgccacgctctgtttcaggcgtttatcatctttctcggctactatcagtttatcaatgactacctcaatatcatgattcttgtaacggtcgagtttcatgccgtgcgtcacttcacgcagttcgccgtctatccgtacatagagatatcctttctttcgcacctgttcgaagagttctttgtaatgtcccttacgcgaacgaaccaagggtgcgagcaagtatattttctttcctttataatctttcaggattaaatccagaatctgttcttccgtatatttcaccatctcctctcctgacaggtacgaataagcaatacctgcacgggcatagagcagacgaagataatcgtatatttccgttgttgttcccacggtagaacggggatttttattcgtagttttctgttcgatagagataaccggactcagccctgttattttatcgacatccggacgttccagattccccaaaaagttgcgggcataggccgaaaaagtctcgatatagcggcgctgtccctcggcaaatatcgtatcgaaagccaaggaagatttaccactaccactcaatccggtaatcactgtcaaactgttacggggaatttcagcatcaatatctttcaaattgtgcacacgggcaccatacacattaatatattctgtttcttgcatattcatatccttcataaacggtacaaaattaatgtttccgactgaaatatgctcctaaaaaagcacaatattattttcttaactcaaatcttatgaagatatagggcattattcgtacctttgttccttgatttcaagaaccaatagttataaattgatgaaaccgataagccgaatattcttatttttgctttttataagcgcctcatacgctattagttatgcacaagagaaccaatcttatttcttgcataccatcgaaaaaggacagagtttatactccattgccaagatgtataatgtcacaacaaacgacatcatacgtctgaatcccggatgtgatgaaaaaatttatgccggacaagctataaaaatccctaaaggaaaagaaagccaaaaaggggaaacattccatacaattcaagccggagaaactttatacaaactgactaccatttataatatatctgcaaaagccatttgtgaagccaatccgggattaagcgccgaaaacttccgtatcggtcaggttattctcattccgttggaacaagagcaggaaacggaaactgcacaagcaccggctgaaaaacccgctatacaggggcctgtacaatccagatgcaaagatatgcataaggtaaaacgcaaagaaaccgtattcagtgtaagccgcgaatatggaatcagcgaacaggaattgattgcagccaatcccgaactgaaaaagggaatgaaaaagggacaatacctctgtatcccctatcccagtgcaaccaccatgcaaccgacggctcccaaagaggatccgtacgctatcccacccagtaacaatgagcttttccgcaagagtaaagaagcccctcaagcaatctctactatcaaagcggccctgctattgcctttccaggaagacaaacgtatggtggaatactacgaaggtttcctgatggcggtagacagcctgaaacgtacgggtacttctattgatctatatgtatatgactgtggaaaagatgtttctacattaaatactattctggcgaaaaatgagatgaagaacatgaatgtcattttcggtccgatgcaccagcaacagatcaaacctttatctacttttgcagaaaagaatgatatacgactggtgattcctttctcttcgaaaggggaagaagtatttaataatcctgccatctaccagattaataccccgcaatcctatttatattcggaagtatacgaacactttacccgtcaattccccaatgcccatgtcatctttattgaaccaaccagcgaagataaagaaaaagccgagtttatcagcggcatgaaacaagagctgaagagcaagggaatgtcaatgaaaaccgtcaatgaaaacgcaaccaaggatatgctgaaggaagctctccgctttgacaaagacaatattttcattccgacttccggcaaaaatgtcatgttaatcaagattcttcctcaactgattctactggtcagagatactccggagcagaatattcatctgttcggttatcccgaatggcagacatatacccgggatcacctggaaagtttctttgaactggatacctatttctattcatcgttctacacaaatacattgtttccggctgccatacagttcaccaacaattatcacaaatggtatagcaaggacttggtgagtaaattcccaagctacggaatgcttggtttcgacacaggcttcttcttcctgaaaggcttgtcacgctatggctcggaactggaaaacaatttaccgaaaatgaacctgactccgatacagacaggcttcaaattcgaacgtgtcaacaactggggaggattcattaataagaaagtattctttatccatttcacgaagaattttgaattagtaaaacttgacttcgaataagacgaaaatgacaaagataaaatcacttctgattgccgcttccctgatgatgggacttgcacttcctgccaccgcacagatcggcgaaccacgccagaacttttctgtcggatttaatggaggagtcaacttaaacagcgcttcattcactcctaaaatcaaacagaactcattgatgggtattaccggaggtttgacggcacgctacatttccgaaaagtattttgccatgatctgtggtgcgcaagtagagttaaatatctcccaacgtggctgggatgaattatttgaagtaccgggggagaatggagaacccgtagaagatcctacccgcaaatacacccgaaagatgacctatctcgatattcccttcctcgcccacttggctttcggcaatgaaaaaggactacagttctttatcaatgcaggtcctcagatcggccttctgatcggtgaatctgaaagcatggagaatatagacatgaatgccctgacagacactcaaaaagctgtttacggggataaaatccaaaacaaattcgattatggtatagccggaggcggcggaatagaattcagaacaaagaaagccggtagttttctgctcgaaggacgctattattttgctctgtcagacttttacagcacaacgaagaaagactatttctcccgtgcggctcatggcacaattacagtgaagcttacttatctattcgatttaaagaaataagaagcagtacccaaaaagatcaggcgcgaatctcgctcgaacctacggtttatatttccgtgagtctgcgaaattcgcgcctgttttattctatcaggaactcccaatgcgagagcttcccgcattcttatcgaagtctgtctgcagcctttaccatcacctcgtcacgtccgatagcacgaatagccagcacattcagaacgatagacaccaatggtaagcaaagcgcccaaccaatacggaacagattggcatcgctcttcaatgcaaaataaaaagcaatgaaggcaatataatagcccaccagcaacaagctattgaagattgacatacgaatctgcaacattcggttcttatacagaaaaatagtcgcaaaagctaccagagcgctcagcatcagaataccaaatatcccccaagtagactggaaaattccattcacgtctatccccagtgctttaaaaggatgttctcctgtagtgtcaataaaatatcccatcggtaaacacattgctgtaatcagcaaccctgttacaatcaataagtaaaaactttgaattcgttgaatcataagtattctatagtagttaagttaaacaataatagccaagcaataaggaataggaaaatgcttcccgcttactacttgactatcaattctttcgttagaaaataaattactgaagtttttctttctccttagccggatttctataataaattttcccttcgatgtattcctgtgtagcaatcaagtcaggtttcggcaatttctcataataacgagaaatttcgatctgctctctattctcgaatacttcttccaaattatcgttgtaagaagcaaactctgctaatttcttagaaagatcgtttttaatttccacactaatctggttagcacgcttaccaataatggcaacagtttcataaacattccctgtgtcagcacagagttccatcatgtcacgggttaccgtcgtagcgggagcgttcgtttttttgtagtccataaatctatttaaatttagtctttaattactttctgtgattcattgaatattttttcagcctctttcaggtatttactttccggaaactcgttcttgaaagcataatattcatctatcgtttcacggtaacgatccatcttcttgtcttctacactataaatagccatttcatgtctggcacgcagaatcaatatggaaagttcttcgcgataatctgtataaggataatctttcagagcattctgagctgtaattacacaggattcatagttattacccagatagttacccagattataatacaactttgcagaatagagttctttcaacaccagtttatcctgcaaagcaaaaatcatatcttgtgcttcctgcttcttggtactgttcgggaaatattccataaacatctgcagttgctggatagcctgataagtgcttgattgatccaaacgtggttccggagtatccaggaacagggatttacctgcatggaaacgtgccagttcagtgaaagtaccacggggataagtgttgaaataggtgataaacgtctgggcagctgtctgataatctttctgattatagtaactcatacccaacatatacagagactcctccgctttatcggttcccttaaggattgtaatcaattcgttcagcaaggtagctgagcggttatactgccctttagcaaaatagtttttggcggcctcgtacttgtattcgtaatcggtacttttcagcaacttattgtactctccacacgatgtcagagaggctgctgcgagcaaagttataatgatatttttcttcatccttttaaaaaatattgcgcaaagttacttattcgcggggaattaaccaattaatctatgttttttaatacataaaaggcgttaaacatcgacgaaaagagaaaaaacgacgtcgaacaggaagctataaacagtcaataataaacggtgaacgatcaacaagcgcgctatatgtcattggtataccagcgctatcgttcttcgttcaccgttcgcttatggtccgccgtccggttacagcttgtacaaatcacttgccgccaacaggtcgactttcttttctttcagtacttcaatacatttatccatattactaggacgaatcacaacgtttgccacgttattattggcaaacgaatacatatactcaataaagaccccttctgccgacaagaatcccagcacttttgccagagctcccggcacattcggacagctaatgccgaccacatctgttatattcacggcaaaatgattatctttcaatgctttatatgctttatccggatcggatacaattccacgcaaaatgccaaaatcagcattttcagcgatgcacaaggcagaaagattgatgttctcttttgccagcacttcagtcacttccgtcaaacggccggacttgttttccaaaaagatagaaagttgttttgctaccattatcgtaaagttttaagtattaggtattaagtaataagtattaaatattaggtaataggtaatagccacacggattccatgttgcagctacgataatacctaatacttattacctattacctattttaaatttttctgttatcaatcactcgtttagctttgcccacgctgcgttcaatgctacgcggttctaccagtttcacattgactcccagtccaagtacgctttggagacggcttgccagtttcttcttcaacgctagcatacggttaatctcatccgaatagaaatccgggcgcacttctacctgaagttccatcgtatcggtattgttttcacgccccactatcaacaaataatgtggttcgaattcttccatctcaagaatgacggactcgatctgagtcgggaatacattgacaccacggataatcagcatatcgtcactacgtcccaggatacggtccatacgaaccaatgtacgcccgcaggagcatttatcataatgcaaggccgtcaagtcacgcgtacgataacgaagcaatggcattccttccttcgtcaggtgcgtaaataccagctcgcccgtctgtccgggttctaccggctgcaatgtattcggatcaataatttccgggaaataatgatcctcattcaagtgcgtaccatgctgacattcacattcgtaacctacacccggtccggcaatttcactcagtccgtagatatcatatgctttaataccgagtttttcttcgatttcatgacgcatattctccgtccagggctccgcacccaaggctcccactttcagttggaattcctcccgcggatagccggaatctttaatggcatccgccagataaagtgcatacgaaggagtacagcaaagaaccgttgatccaaaatcatgcatcaatgtaatctgcttttctgtattaccactggacatcggaatcacagaagcaccaatattctcagctccggcgtgtgctcccaggccacccgtaaaaagtccgtaaccataggaaacctgaaatatatctgagcgtcctgctccataagcagtaaaagcacgcgatatacattctgcccacgaagaaaggtctttgcgggtatatcccactaccgtcggctttccggtcgttccggaagaggcatgaatacgcacgatctggctcatcggcacggcacaaagtccgaaaggataattatctcttaaatcatgtttcgtggtaaacggcagtttcacgatatcatcaatcgtattgatatcatcgggggtgatacccatttcctgcattttcttccggtaaaaaggcgtgttgtgataaacgtaatccacaattttcttgagtcgtatgctttgaatcttgcgaagactttcgcggtccatacactcaatggtctcattccaaatcatgttctcttggtattattagttgtatgaatctgtttcatgatattaatatgttgcaaagtaaaggatttatttggaaaaatgatttgttatctcaattattttgccgaatattgctccactttttaggatttaactatgaattttgaactaacatcagcttacaaacctaccggggatcaaccagaagcgatcgcccagcttactgagggggtacttcaaggagttcccgcacagactttattgggggttaccggatcgggaaaaacgttcaccatcgccaatgtgatcgccaacatcaacaagcctacgttgatcttgagccacaacaagacattggctgcgcagctatacagcgagttcaagggatttttccccaataacgccgtagaatattacgtttcatattacgactactatcagccggaagcctatctgccaaattcagatacctatatagaaaaggatctcgccatcaatgacgagattgacaagttacgtctcgccgctacctcctccctgctttcaggccggaaagatgtggtagtcgtttcctcagtctcctgtatttacggtatgggaaacccgtcggatttctataaaaatgtaatcgaaattgaacgggggcggatgcttgaccgtaatgtttttctgcgtcgtcttgtggacagcctgtatgtccgtaatgatatcgatttgaatcgtggcaacttccgcgttaaaggagacacggtcgacattttccttgcgtactcggacactctgcttcgtgtcactttctggggagacgagattgatgggatagaagaagtggacccgattaccggtgtgactaccgctcctttcgaagcctataagatctatcccgccaatttatttatgaccaccaaggaagctactcttcgtgccatccacgaaatagaggatgacttaaccaaacaagtagcgttcttcgaatctatcggcaaagaatatgaagcgaaacgattgtacgagcgagttacgtatgacatggaaatgatccgggaattagggcactgttccggcattgagaattattcccgttatttcgacggtcgcgctgccggcacccgtccttattgccttctcgatttcttcccggatgactttttgctggttattgacgaaagtcatgtaagcgtgccgcaggttcgcgccatgtatggaggcgaccgtgcccgtaaaatcaatctggtagaatatgggttccgactgcctgccgcaatggacaaccgccctctgaaatttgaagaatttgaggagatgacaaaacaagtgatttatgtcagtgctaccccggcagaatatgagctgatacaatcggaagggatcgttgtagaacaagtgatccgccctaccggtctgcttgatcctgttattgaagtacgcccgagtctcaatcaaattgacgacctgatggaagaaattcagctgcgtatcgaaaaagaagaacgggtacttgtaacgacacttacgaaacgtatggcggaagagctgacagaataccttctcaacaataatgtgagatgtaactatatccatagcgatgtggatacattagagcgtgtgaagatcatggatgacttgagacaaggcgtttatgacgtacttatcggtgtcaatctgcttcgtgaaggtcttgaccttccggaagtatcccttgtcgctattctcgatgccgataaggaaggcttcctccgttcgcatcgctcattgacccagactgcaggacgtgctgcccgtaatgtaaacggaaaagtaatcatgtatgcagataaaataacagacagtatgcggcttacgatcgatgaaacaaaccgtcgacgcgagaaacagctcgcttataatgaagcgaacggcatcaccccacaacaaatcaagaaggcgagaaacttgtctgtatttggcagtccaggttccgaagccgatgagttgctgaaagaaaaacacgcttatgtggaaccttcttcacctaatatcgcagccgacccaatcgtacaatatatgagcaaagctcaaatggaaaagagcatagagcgtacccgcaaattaatgcaggaggccgccaaaaaactggaatttatcgaagctgcccaatatcggaatgagctgctgaaactggaagatttgatgaaagaaaagtggggataaacggcttataaatatcaataaatctataagaaacccgagc

SEQ ID NO: 90 - DNA, 31424 bp, Bacteroides thetaiotaomicron
atttaattattttcaactttctattttgagagcttcatcccatcacctattacctgttacttattactctctctcttcgtacagataatctggttgctgaattcaagactgatgcgtgaatatttgttccagcctacctgattgagtcctttttggtagaattctttcaggcgtgccagtttgttttcaaagttttcaagtttgccgagatagacgaggtggtcgcctacacgaggtaccagttcgatgttgcggtcgggcaacacatggatttgttctatctgggcgtcccagaacttattgttttgcaaaaatacaccaaacttatataaatccttcattgcaaacgacttttctacgtttccggtgacaattgcccgatgtgcgacgcattttgcttccggcggcatgacggttcctttattatcaaggtaataattctctccgttggcactcatgatgcgtaatatcggtatacgttgtgtcacttctacgcagactttgccgctgggtgttttgtagcattccgcttcgtcgatcagcggatgcttgctcagttcccgttccagcgacttggtagagatgcgctccatctttttcccgatagggtagatacctttatgctggaggatgcctttcacttcttctttggtgatgaagccggcataagtggtatccttgatgaccagttctacgtcacggcaggtctggttggcaggcttgcggttgaaagcggtgatggctatgccgaggtaggcgataagcatcaacatgacgatagatagaaggattctctttaccatagtttttatttaattgagaattgaaaattgaaaatgaagaattgagaattggctgcgcgactgtatgatgtagcgtagaaattcttagttcttcgttcttcgctcttcgttcttcattttttccagttctttctttatttcggggacataattgtctatgtctccggctcccagagttattaatacttcaatgtttttatctttcagaatgttcagtatttcttcctttttgcacatacttttttcgatgcccggacggaggttgtcgtatatcagcttgctggtgacaccggggatcggtgtctcacgagccggatagatgtctaccagaatgacttcgtccagtagtgacaggctatcggcaaagtcctgatagaagtcgcgggtacgggtgtacaggtgcggctggaagatggctgtgatcttcttgtctttatagagttcgcggatagacagcacgctctgtttgatttcagagggatgatgggcgtagtcgctcagaaagactacctggtcattcttgatcttgaaatcgaaccggcggtctacaccgcggaagctgttcattccttgtctgatctcttcgtcggtcactccgttgaggtgggcgagtgccatggcggctacaccattctcgatgttaatgcttaccggaactcccagttggatattgttgatacgtgtgtcgggggcaacgaagtcgatgaagatttcaccgtttccgatgcggatattctcggcgtggaagtctccttcgtcacgcgaataggtatagacacggactccggcctgtactttcggttgtagtgagataccttttcggataatcagtgcaccgcccggctggatcagtgttgtataatgttcgaagctttcgaggtatgccttttctgttccgtagatgtccagatgatcggggtctgtggcagtgatgacagacatataaggggacagccaatggaaagagcggtcgaactcgtctgcttcgatgacggtataagggcttttctgagagagtagcagattggtgccgtaattcttggagatgcctccgaggaaagcggtacattctatgtgcgattggtggaataggtgggcggtcatggtagaagtggttgtcttgccatgagtgccggctacacacagacctttgctggaatgagtgatcgttcccagtacttgcgcgcgtttttgtatttcgaatccgttgttgcggaaataaaccaattcttcgtgttcctgcggaacggcgggggtcaatacgactaaagtgctttctttgtctttgcaggcttccggaatcagtcgtacgttttcttcgtaatgtatttgtgcgccttcggcgatgaggttttcagtcaatggagtcggggtgcggtcgtatccggctaccacttttcctttggaaaggaaatagcggacaagcgcactcataccgatgcctccggcaccgacaaagtagactgatttgatcgtttcaatattcatttctttatactgtttctttttataattcttgttccaagtaacatttcaagttttaatcagagtcggtactacctttaattggggatgacccccaaagtcggtagtattttcattctcctccttctggaaggaggagaatggagattctactgactttttagtcaatcctaattgggatagttgcgatttttgcattccctcaactagttttctgcttctgccagcttgattacttcctgcgcgatgattcgtgcagagtcgggcaaagccaacttggctatattctcacttagttctttcagtttccggtcgtcagctactgtgttcagggctacatccatcaactttgcttctgcttcgctgtcttttacgtagatggcggcttgtttgtctaccagtgccagtgcattcttggtctgatgatcttctgccacattgggcgaaggaaccagaaccacaggcttgtgcaacagacaaaactctgaaatagaaccggctcccgcacgtgaaatcactaggtcggaagccgcgtaagcggctgccatatccttgatgaagtccgtcacgtacagatttggaagttctcctgctgcccgtacggcttctgtcacctgcggatagtaatattttccggtctgccagatgaactgtatatcgttgttttcttttattgtagctaaggctgcggtcagcgtattgttaatggtacgtgcgccaaggctaccgcctacaatcagaattgtcttcttatccggctgcagattaaaggaacgcagtgccgcgcctttttccggcatatccttcgtcagattctggcgaacgggatttccggtcattataatcttatcggcaggaaagaacttttccattccatcataagcgacacaaatagcctttgctttttgtgccagcaacttgttggtgactccggcatacgagttctgttcctgaatcagagtcggcactcccatcattccggcagttttgagtgtcggtccgctggcgtatcctcctacgcctaccgctacttgtgggcggaagtttttgatgatgctgcgcgctttccactggcttcgtgccagtttgatcagtacggatacgtttttccataaatgtttgcggtcaaaaccggctatcggtaacccgataatcttatagcctgcatcgggaacccgctgcatctccatacggccctcggctcccacaaataagattttcgcgtccggtcgcagctctattatagcgttggcgatagatacggcagggaagatatgtcctcctgtgcctccaccgctgatgataattctaagttctttctccataataatccttttttctatccgttcatcttcatttactgctatcatgttcatcctcaaacttggcatcgctgttcagaatctgtgcagtaggttcggcggcggcttgtgcttctgaagtagctgttccggtttctatctgcatctgaatctgtgcatcatgcgctttctgttcttccagatgagcggtatatcggctcacgcttaatatcattccgatataagcacagttgatcagtgtacttgtacctcccttgctgaccaaaggcaggggttggcctgttacggggaacagtcccacggcaaccatcatattcagtatcgcctgcgataccagaagcaaagcgatacccatgacaaggaaggcggggaaggtccgttcgcacttttgcgcgatgcgtcccgcccgcatcagcagacagaggtagaggaatacgacaaatatacctcctatcaatcccatttcttcgatgacaatcgcaaagataaagtcggagaatgcctgactgaggaaatcacgctggatggagtttcccggtcctttgcccactacgtgactggtagcgatggcaatacgggcatgggcgatctgtgcgtctttgtctatatcgaatttggctgcgggcacttcgtctttatcaaaaaagcctttgatacggttctgccaagtctccaggcgatgaagtccgggggtattgtgcagcgttttggcagggatggcaactaccgtacctacgccgagtgcgacaatcagcacaagtcctcctgccaacagaaggagtttctttgccgctacccgtccgatgaacatcatcatgaatacgacaccgaacagcaacatggctgttgacaggttttccggagcaatcagcaaaaggaccagtccggtaaggatcatgatgtatttaaaggctttggggttggctccttcttcatcctgcctcttggacaggatgaacgaaacggcaatgatgacagccatctttgccagttccgaaggctggaattgcagtcccataaaggtcatccagcgggctgccccattgacacggtcgcctgtaatgatacccatcagcgtgacgaatgccagcagaacgagggaaatcggatacaggaagacggggaatacctggaaccatttgtaggggacgttatgcagaaataccactactacggcacccaccatcaggatgatggagtgctgtgttatcggtccccagtggtcgccgcttttgtacgtcagcgtcgatgctgccgaaaacacctcgataatcgagatgaggcagagacagaggaagataatccagattaccttgtcgcctttaaatatgctctttaataaatccattttataattctcttacatatttcttaaactgatcgccgcggtcttcgtaactcttgaagaggtcgaatgaggcgcagcaggggcttaacaatacggtttctcctttctttgccagtttgtaggctgcttctactgcatctttcattccggtctgcacatcggctacgggcagtccgaaacggtcgaaaaaggcgtgcagcttttcgttgtgcagtcccagataaaccagtgccgagcacttttcacgtaccaggtcttctatttccgtatagtcgttgcctttgtctttgccgcccagtatcagtactgtcttggtggtcatgctttgcagggcataccagcaagagttgacattggttgcttttgagtcgttgatgaagtcgataccgcgtacgcgcgctactttctccaggcgatgttccactcccttgaagtcggagagcgccttgcggatattttctttagtgatacctgccaggtttgccgagataccggcagccagcgagttgtaaagattgtgctgtccggtcagtgccaattcctcctgttccatgttgaaggcgatgggctcggtaatcttcacttcgtgatcttctacgtatgcgatggctccgtcttccttcacggctgcgaaaggatacagatgagctttcagaccgtgctttgccagttcctgtttgatgatcggatcatcgttccagaagatgaaagcgtcgtccgttgtctggttctgcgtaatacggaatttggcatcgatgtagttctgcatacaatggtcgtatcggtccagatggtccggagtgatattcatcagtacggcaatattggcacggaagttatacatattgtccagttggaaagagctgagttcgatgatataatagtcatgatgctcttcggctacttgcaaagccaggctcttgccgatatttccggctagtcctacattcagatctgcactcttaaagatgtggtagatcagggaagtagtcgttgtctttccattagaaccggtgatacagatcatttttgcatcggtatagcgtccggcaaactcgatttcggagataaccggtgtgccttgggctttcagtttcaggatcagcggggcgtcattcgggataccggggcttttaatcacctcatcggcattcagaatgagttcttcggtatgatgtccttcctcccaggcaatatggtggctgtccagaaggtccttatacttatccttgatagcggacatatccgaaacaaatgtttcaaatccttttactttggcgagtacggctgcaccagcgccgctttcaccggctcctaaaattacaattcttttcatttacagtaatgtgctattgctgtccgacaggcagacgcttctctcttccttttcatccttcctttttcgctcgtcggctgcgcacatctttttaaagttaataatcgggttaatactctcaactatattaatgttacaaatatcctgcattgggcagtctgtttgttctcatcgtatttttaatgtaataatcgttatcgctgccagtacaatcgttacaatccagaaacggacggtaatctttgattcgtgaaatagctggtcgggcttcgtgaacttcaccgtacatcccggttctaccagactcatcgaagtacggaaatgatcgtgtatcggagttcgtttgaataaccgctgttttactcccttccgcttacctatcttatagtagaagcgttgcagtatgactgacagattctctaccagaaatacaccgcagagaatcggtatcagcaattctttgtggatgataatggcaaatacggcaatgataccaccgatagtcaggctgcctgtgtctcccatgaatacttgtgccggataggcgttgtaccataagaaaccgatcaatgcaccgataaaggcacaaatgtagattaccagttcttccgatcccggaatgtacatgatattcagatagctggcaaattcgatgtgtgacgatacgtacgccagtattcccagcgtggcaccgataatggcggagtttccggctgccataccgtccatgccgtcattcaggttagccccgttcgaaacggcggttacaacgaagatcgtaatgatcacgaacaggaaccatccggctgtctgtgcatgttcgcccataaagcccaccaggtcggcataatctaagttgttacttttaaagaaaggaatagtggtttgggtagattttaaatcattggttccgtgaatcacttccatttcctgtcccggtgtatgaacctcgatgttttcgcggataactacatccggactcagatacagggttaagcctacaatcagccccagacccacctgaccgatgattttgaacttaccgtgcaagccttccttgtctttcttgaatattttgatatagtcgtcggcaaaaccgagtgatcccagccatacagtggtgatcagcatcaatatcatgtatatattatccagcttacccaatagcaggcaaggtataaggatggctacaatgatgatgacacctcccatgcttggtacgcctactttgttgacaccgaacgggtcggtcttggcgtcacgctgtgtttccgtgatttgcttctttttaagcagattgatgaatttgtctccccatatactcgatataagcaatgcgaggataacagccatcaaagcacggaatgaggtgtaaccgaacattcccgctccgggaaaattaagcttgtgcagccattcaaacagatagtataacatctcttttctatttacaatttatagcctgcaatttacagtttctcattgttgccccacgcttgataagatgctgtctattgcaaataattatatgttgtcaattaaatatttccttcaaaacttccttgtcgtcaaagtggtgtttcactcctttgatttcctgatagttttcgtgcccttttccggcaacgagtatcacgtctcctttttctgcaagcatgcaagccgtgcggatcgcttctttccggtcggcgatgctgagcgtttttttcatatcttccgcatccagtccggcaagcatatcgttgataatctcctgtggctcttcaaaacgcggattgtccgatgtgataatcacccggtcactggctttcgctgcctcctttgccatgatggggcgtttccccttatcgcggttgccgccggcacctactacggtgatcacttttcctttgccttcgagtactccatgaatggcgttcaatacattcaccaacgcgtccggagtatgtgcatagtcaacgatggccgttacccctttcggagaacggatggcatcgaaacgtccggctaccggatggagcgtactgagcgcaagaagtacatcttcctcttttttgcccaataatacggctgctccaaataccgccaacagattggatgcattgaacttgccgataaactgaacggccagctcatgattattgaaatcgagcagcattccttcaaaatgggattctatgacccggcctttgaagtcgctgaggcttcttaatgaataggtgtagaccttggaacgtgtattttgtgtcatcaccagcccgttcttatcgtcaaggttggtgaggctgaaagcgtttttaggcatatcgtcaaagaactttttctttgccttcagatagttctctaccgttttgtgataatccagatgatcgcgcgtcagattcgtgaagatacctcccgcaaactttaatccgctgatacgtttttgagcgatggaatgtgaactgacttccataaagacgtacttgcatccttcgtccgccatttgccccaacaagcggttgagcgtgatagggtcgggggtggtatgttctgtcggaatcggctgatcgtcgatatagttgcagacagtagagattaatcccactttatatccgaagtagcggaatgtattatataataaggtggcgatggttgtcttgccatttgttcccgtcacaccgaccagttcgaattgtgaagtcggattaccgtagaatgtcgttgcaatctttcctactgcatcttcgctgtctttcacttggatataagtgattcctgctacgggttcctccggtatatcttcgcagaggatggcagtcgctcccttctgaatggcagcggggatataggcgtgaccatcggtctgcgtgccgcgcatcgccataaacagctgtccggcttctaccagacgggagtcaatgttgactccggtgatctctatccttgaatctccggtcacttgcaccggctggattgctttcagtaactcgtttaataacatatctgtcctacttaatttaattcttaatgcaacgtaagcgtaatcgtctgcccttttcttgcaacactgccgttggctatcgactggctttttactttcccgactcccaccagattgactttcaatcctttgctttccaatagataaacagcatctttcgctcccatgcctacgacgcttggcacgaagttctgcatgataccccggctttcaagaactaccgcctgaggggcgggatgggtgcttccccatacttcttttcccgaatcggtgatttttccctgtatctttatattcagttcttccagtacccgttgcgtttccctcatttctcctgccttaacgttcgggatgactaccgtattcgtatcaatggcacttgtgagtggcaagcgcaggtctttggcatacactctttctgcgatcttgctgaatacgctacctgccatcaaacctcccgaagcgggcaaaccgggtttctggatcgaaacaatcatactgtacttcggctcttccgatgggaagtatccgcagaagctgacgagataattggttcttcctgtcttgtagccggctgctccctgcgaaacctgtgctgttccggtcttaccggacacatggaactgcttgcttcctgccggtttggcaagtccttcacctaccactttccgcaggatttcccgtatttgtgccagcgtcttgtccgaacagatcttgggattgatgatttccgtcggatattcctttatcacttctccgtctctgacggcggcttttacaaacttcggacgtatggatactccgttattggctattgcattatagaatgtcagaatattgatcggtggaacctgcgtttcatagccgatgctcatccatggcaaagtcgtttttgaaaaatagcgttctttcggaccacgaatattcggctttccttctccggatatttgcaggtggagtggctggtcgatgctcatccgtttcagtccgtccacaaacttctgcgggttgcttccgtaaaagttctcgatgatgctagaagttccgacattggacgatactcccaaaatctcggtaacagtcagtttgccgtatccgcctcgatgccagttgtggtctttcatgacacggccatgcatcggcttttgtccgttgccggtgtctacgatatagtccggagtgatttttccgtcttccagagctaccatgatagaggctgtcttgaaggtagaacccggttcgagcatatcgctgattgcattgttgcgtacttcataatattcaccgtctctgccttgcgtcatattgacgatggcttttacttctccggttgcaacttccatcaatacgactacacccacggtggcgttcaattctttcagcttgtctaccaatgctttttcgcaaatatcctgcatacctacatcgatggtggtgatcaggtcgcaaccgtcgatcggggcgacatcgacaatgttcaggtatttgttcatcaccttttggcggtgagttagcccgtcacgtcctttcagaatcgtatcgaacgcgagttctataccgttctttgctccttgggctgtatcggcatatacatctcccagggtacgggctgccaatgagccgaaaggtttcttgcgctgattatatgccaactccttgaatcctcccttatagcggttcagacagaagacaggcagacgtttcacctctttatattgtatataagagatacgcttcgggtagatcaggtagttacggcttttggcctgacgtcctttttgaaggtgtgccttgaattgtgccgcacttttgtcggggaatatcttatgcagtccgatgcaaatcgaatccatattggctttgaggatggaatcccgacgtgcctgatccttctttcttcttttttcgtccttttcaccggacataaagtccatgtagattctgtattcaggcagtgaacttgccatcagtttaccgtcagaagaaataatgtttccgcggttaggtttcaccgtcacgttttcttttacgaaacgatcggctacatcctgccagtactgtcgttcggcaaacatggtcacgcctgccttgacgacaattgctactcctatcagtgccatgatcagaatgacaaagaagtaacgggtcattatatttttcttatttactgccacagtgcttattctcttttaagactctccacttacaccttatttaataaggtaaggcgggttggtagaggtctgcaaatcactttccttgtttgatatatactcttcgatgcgtgactgacggcttttctccatcagctccgaactacgggtcaacgcatcgtatttaatgtcgattaattcttttttcaaccggtcgatctcgatctgttgttgctggctcgcatagcggttatggatgtagaagatgatgaataccataatcagcaccaacagcttcgtctgccggcggaaaaagtctgtggcgaggatatctcctcccagaatacttttcaatgaggtgcgttttttctttttgccctcttctgcttttttgtttactgcttcttcttccatatctgagattatttcttctctgcgattcgtaatttggcacttctcgaccgtggatttctttctatctccgcttcatcggggacaatcactttattgttgaccaaccggaacggagtttgcaggtttccaaagaagtcggtttccgctttcccttctacgtttcctgttttcattatattcttcaccatgcggtcttccagtgagtgatacgtgatcactacaaggcgcccccccggtttgagcgcttcggtggctgctgccagcatttctttcagtgcttccatttcctgattcacttcaatgcggagtgcctgaaatactttcgccagttctttcttctcccgttcgcgtccgaaaagcggcttgatgatttccagaaactcgccgatagtccggatagactgtccgtttctggcttttacgatggcggatgccagtttgcggctgttcttcagttcaccgtacagatagaagatgtttgcgagccgttcttcttcgtatgtgttgacgatgtcggcggcagttagtcctgcacgtttgttcatgcgcatatccagcgctccgtcaaaacggaatgagaagccacgctcgctgtcgtcgaaatggtgggaggacacgccgaggtcggcgaggattgcgtccacctgttcgatgtcatgataccgcaggaaattctgcaaatagcggaagttgctgcgtacaaaggtgaagtggggatcattgacgatattccgttcggcatcctcgtcctgatcgaatcccagcaggcgcccgccttctccaaggcgtgaaagaatctcgcgcgaatgccctgctcctccgaaggtaacgtctacatacgttccgtccggatgaatattcattccgtcaacgctttcttttagcagtacgggtacgtggtatgtcaactcatctttctccatcttgtctattttcatcgttcataatctcttctaatgctgcaccgaactcttcgggggacatgaacggttgttctgcccgttctttggcccaaatctctatcttgttgtcgataccgataaagcgtatatctccacggatattacaaatctgtaagtaacgcttcgggatcagtatgcgtccgttgctgtcgggcgtaactacttcgacgtcactcacaaactgtctgaaaatgagctggtgtttgctattccatttgttcagcctgcttcggagctcattcagctcctcgttccacacgctctcggggtacagtgtcaggcagtcctgaaatacgtctttacgcataataagtctctcttcggaagcagcttgcagttgcttcctgaaagtagcggggatgaacactcttcctttggcgtccgccctgacttcaatattgcctaaaaaacgtatcatttaccttattataataagagagcgtaaaagtaggaaattccccacaattccccacaattttccataaaaatcttttagataagttttcaaccgattgttaaatgcttatttacttgaaaaagatgcggtttgggaaatgctttattagtgggcgaaaacggaaagatgcggcgcttttttgtttgtattgaggaagaatcttttttatcgaaagagaggctttctttctttgcgagggaggtttgcacgacacccgggtctcggtatgtatgacacccgggtgtcaggacgtacaacacccgggtgtcagtatgctcgacatccgggtgtcatataggagggattagtaaaaaaggcagaaggtatggtaactcttctgccttaaactaacacaattaaaaatctgcactaaaaatatctaacttggaattgataaataatatagttaaaggtttagcgaaagtctttcagttcttcctgcaatttctggcgggtgaagaagatacggctcttcacggtgcccagcgggaggttcagcttttcagcgatttcgcggtacttgaagccggaaacgtgcatagcgaacggaactctatattctttcgggagcgcgttgactacccgatgcatttctttcaggtcgtacgttctttccgtactttcaaagccggtgtcttgcggcaggttcagatgataaagattatcggtctgatcgatgaatgtctggtcgcgaactactttacggtagttgttgataaagatattgcgcatgatggtatacatccatcctttgaaatttgtgtcgggcatatatttatcctcattgtctaatgctttgagtgatgtctcctgcaacaaatcgtttgcttcttcgcggtcagttgtcagtttgtatgcgaagcggagtaactcatcctgtactcctactaaatcttttctgaagcttaaacttttcatatacgttgcttttaaaaagtgaatattcgtttgtatttttcgatggtgcaagtttacggcatttctgataatgagatagggtatgaaccgacaaaatttaggggaaaaactatccgcggatagtttttaggtggtatttgatagtttttgggtgttcttttttcaagttgcaaacttaaatcctgcattttctggcaaattattgcgattaataaaaaagaaccgttaattttgtggcatcatttttatttgaaaagaatgactgatgactctttatttttaatcgatgtcgataagatacttcggacgaaagctccgaagcaatataagtacatccctaagtttgtggtttcttatctgaagaaaatagttcatcaggacgagattaatgtgttcctgaatgaatcgaaagataaactgggagtggatttccttgaagcatgcatggagttccttgatgcgaaagtggaggtgaaaggtatagagaacctgccgaaagaaggattgtatacctttgtgtccaatcacccgctgggaggacaggatggagtggctctaggctatgtgctggggcgccattatgacgggaaagtaaagtatctggtgaatgacctgctgatgaaccttcgcggtttggccccactttgtgttcctatcaataagacaggaaagcaggcaaaggactttcccaagatggtggaagccgggttccagtccgacgaccagatgatcatgtttcctgcgggactttgctcgcggcgtcagaacggagtgatccgtgatctggaatggaagaagacattcattataaaaagcatacaggcgaagcgggacgtagttcccgttcattttggtggcagaaactctgatttcttctacaatctggcgaatgtttgtaaggcactgggtattaaattcaatattgctatgctgtatctggcggacgagatgtttaagaaccgccacaaaacctttactgtcacttttggaaaaccgattccctggcagactttcgataaatcgaagactcctgcgcagtgggcggagtatgtgaaggacattgtatataaactgtaactgatagaacactataacaagaatatggaagagattattaaaccggtgagcaaagaactgctgaaagcagagttgacggaagatagacgcttgcgaatgaccaataaaagtaataatcagatttatattattacccatcagaatgcacctaatgtgatgcgtgaaattggtcgtttaagagaaattgcctttcgtgctgcgggtggaggaacgggcctgtcgatggatatcgacgaatacgacacgatggaacacccatataagcagttgatcgtatggaatccggaggcggaagaaatattaggtggttaccggtatttgcttggaacggatgtgcgctttgacgaagctggggctccgattctggctacttctcacatgtttcatttctcggatgcgtttataaaggaatatctgcctcagaccattgagttgggacgctcttttgtgacgctggaatatcagtctacacgtgccggcagtaaaggtctgtttgcgttggataatctgtgggacggattgggagcgctgacagtggtgatgccgaatgtgaagtacttctttggcaaggtgactatgtatcccagctatcatcgtcgtggacgcgacatgattctgtacttccttaagaagcattttaatgatcgggaagagttggttacaccgatggaaccgctgattctggaaacttccgacgaggaactgagaacgttgttctgcaaggatacctttaaagaggattataagatattgaatacggagattcgcaagctgggttataatatcccgccgctggtcaatgcctatatgagtttaagccctaccatgcgtatgttcgggacggctatcaactatgagtttggtgacgtggaagagaccggtatcctgattgctgtagatgaaatccttgaagacaagcgaatccggcacatccagacgtttatagaaagtcatccggatgcgctgaaaatgccttgtgagagcgaaggggtgtttactcctaaggtggttacaccgcaggaaggctgttgccattaattttccggtaaagatcgagtgcgaagacatcggtcattccagatatataatcaagtaccgcctgtattctttcgtagagtacgggcgattttatattgtattggtcggaaacgcggttggttaaaagttcggagtaagctttttcttttcccggtaaggtgacggcatctaccatcaattccagcaaagtgctgatgatacggaagcctgccagctcgatgtccagtacatcttgcgaacgataaattcttttcagtgatatttccgcacaatgattgtaagcggctgccggaccttcggcgatgtgcttgatgagcgctccttcgaaagttcctgccagtatttcctgctcgtgttccagaaagacacgggtgcactcgcggactaacagaccgataacagaagaacgcagataggctatctgttcattgatatcattgactatttggaaagtacttcggagacgggattgccggtcttcggagaaaaacgccatcaacagttccttggtctcgtctgtagtgataatctttagtttatgggcgtcttcgatatccatcatctgataacagatgtcatctgctgcttctaccagatacactagcgggtgtcgcgcatactttaacggttgttcgctaagctggatgagtcccagctcggttgcgattttgcggtagctttcttcctcactgacaaagaagccgaacttggattttttgcctgcaaggctcgatgaaaaggggtattttacgatggaggcaagcgttgaatatgttaagacgaatcctcctctgcggcgtccttcgaactggtgagtgaggatgcggaaagcgttcgcatttccttcgaaatgtgtcaaatcttcccattccatcggagaaagttgctctccgtccggctgcttttcctgtagcctttgtccttttccttctgaaaagaacgtagagatagcccgttcgccggaatgcccgaaaggcggattgcctaagtcatgtgccaggcaggcggccgatacgattgagccgatttccggcaggaaggaactttccagttccggttggcgttccaggattgctttggctacatcgttgcccaaagaccgtcctacgcaagatacttcaaggctgtgcgtcagtcggttgtgtacgaagatactaccgggcagcgggaatacctgtgttttgttctgcaggcggcggaacggtgcggaaaatatgaggcggtcatagtcccgttggaactcggaacggttctcttgccgttcttcgtgaaactcttccattccgaagcgtttggctgatattagttgtttccaattcatcattttatttactatttggctgattacaatttgcaaattggttgttaccacattatttaactgcaaacttaactaattttcagttcaaaatgtgtattttcgcccgttaaatagtaaatgtgcatttatgaacgttcaagttatcaataaatcgaagcatccgcttccggcttacgccactgagttatctgcaggaatggatatccgtgctaatctttctgaacctatcacattggcgccattgcagcgttgcctggtgccgacaggaatctatattgctcttccacaaggatttgaagctcaggttcgtccccgtagcggattggccatcaaaaagggtattaccgtgctcaactctccgggaacgattgatgcggactatcgtggagaagtctgcattattctggtcaacctttcttccgaaccttttgtgatcgaggacggggaacgtattgcccagatggtgatcgcaagacatgagcaggcagtatggcaggaagtggaagtgctggatgaaacagaacgcggagcagggggcttcggacatacaggacgaggataagtaccataaaaagagaaaatgaacaagaaaaatagtatatggcttttggttgctgtatggacattggtttcgtgcggaacggtgaaaagtacaagggaaaagccagctgtcgctttggcgcagtcttcgctaacgtccgaacagcagcggaaatatgattatttctttctggaagctatgcgcctgaaagaaaagaaggattatgcgtctgctttcggattattgcagcattgtctggatattcatccgaatgcggcttctgcgctttatgaggtttcgcagtattatatgtttctccgtcaggtgccgcaagggcaagaggcgctggaaaaggctgtggcgaatgcgccggataactactggtatagtcaggggctggcatctttgtatcagcagcagaacgaactggataaggctatcaccctgttggaacagatggtggtacgtttccctgccaagcaggacccgcttttcaaccttttggacctgtatggccgacaggaaaagtatgataaagtcatctctactttaaaccgtcttgaaaagcacatgggcaagaatgaacagttatccatggagaagtttcgtatctatcttcagatgaaggatgacaagaaagcttttcaggaaatagaaagtctggtacaggaatatccgatggatatgcgttatcaggtcattttgggggacgtatatcttcagaatggcaagaagcaggaggcttatgacgtttatcagaaggtgctggctgcggaacccgataatccgatggctatcttctcgatggcttcttactataaacagacagggcaggaagaactctaccaacagcagttggatacactgttgctgaataagaaggtgactcctgataccaaagtgggcgtcatgcgtcagatgattgtggaaaatgaacaggccgataaggacagtacgcagatcatcgctttgtttgaccggatcatgaagcaggagcaggatgatcctcagattccgatgctttatgcgcaatatctgttgtccaagaatatggaggcggagtcagtccccgtcttggaacaggtggttgacctggaccctaccaataatgctgcccgtatgatgctgatcggtgctgcggtaaaaaaagaagattataagcagattatcaaagtctgcgagccgggtattgaagcgactccggatgcgctggaattttattattatctggctgttgcctataatcaggcggagaaaccggatagtgtgataagcatctgcaagagagcgctggaacataagacggctgacggtaaaaaagaaatcgtttcggagttctactctattctgggggatatgtatcatacgcagaagcagatgaaggaggcttatgccgcctatgactcggcgttggtgtacaacccttccaatattggcgcactgaacaactatgcctattatctgtcagtagagcgtcgtgatctggataaagcggaagaaatgagctataagaccgtaaaggctgagcccaataatgccacttatctggatacgtatgcctggattctctttgaaaaggggaactatgcggaagctcgtatttacatcgataacgccatgaaaagtgagggcggcgataagagtgatgtgattgtagaacattgcggagatatctattatatgaccggagatgtggacggcgcgcttacctactggaagaaagcactggaaatgggcagtgagtcgaaaacattgaaacagaaaatagaaaagaaaaaatacattgcagaatgaaaagaatcgcttattttttgttgattgcagtcgtattggtaggttgtaagagttcaaagcgtctgacggcgacaaaggtgccggaagttactgcttccgaagcagctattcccagctatctggcttccagacttcagctgacgattccgggtaaaggcggaagtatgtcagtgggcggtaccatgaagatgaagagccgtgaacgggtacagatttccttgctgatgcctattctccgtacggaattggcacgcatcgaggtgactcctactgaagtattattcgtcgaccggatgaacaagcggtttgtacgcgcaaccaaaaatgaattgaaagaaatattatcgaagaatgtagagttctcccaattggagaaattgctgactgacgcttctaaacccggaggaaagactgaactatccgggaaagacctgggaatccccaaactggagaaagcgaaagtacaactttatgatttttcgaccaaagaactttcaatcactccgacagaagttacttccagataccgtcaggtctctttggaagaattaatgaaaatgctggtagctttattatgataaaacgtctctttgtaattctggtaagcagcctttggctggcaattccgctttctgctcaatcgaacaagctgattcgtgagctggaaggtaagcgcggtgctctgcagaagcagatcgccgagacggagtcgattttacagaatacaaagaaggacgtaggcagtcagttgaacggactggcggcactgacgggacagattgaagaacgaaaacggtatatccttgcgatcaataacgatgtggagactatcgaacgcgaattagtgtcattgaaccgccagctgaatagtcttgaaaaagacctgaaagagaaaaagaagaagtacgaagcatctgtccagtacctctataagaataaatcgattgaagagaaactgatgtttatcttctccgccaagaacctgggacaaacttatcgtcgtatgcgttatgtgcgtgaatatgccacctaccagcgtctgcagggagaggaaatattaaagaagcaggagcagatacggaagaaaaaagcagaacgtcagcaagtgaaagccgccaaagagggactgctgaaagaacgtgagaacgaaaaggcgaaactggaagctcaggagaaagagaagcgtacactggtggctaatctgcaaaagaaacagaaaggtctgcaaagcgaagtgaacaagaagagacgggaggccaatcaactgaatgcccgtatcgaccggttgatcgcagaagaaatagaacgcgcccgcaaacgtgctgcggaagaagcccgccgcgaagcggcagcccgcaagaaggcggatacaaatggcaaaggtgcctccaaaaccggaacggctgccaaaccgaagtcggagccattggacgcttttacgatgagcaaggcagatcgcgaactgtccggtagctttgttgccaatcgtggaaaacttccgatgcctatatccggaccttatatcataaccagccgctatggacagtattccgttgaaggactccgtaatgtgaagctggacaataaaggaattgatatacaaggaaagccgggagcacaagcccgtgccatctttgatggtaaggtagcagccgtgttccagttgaacggactatttaacgtcctcatccggcatggtaattatatttccgtttactgtaatctgtcttccgcttcggtgaaatccggcgatacggtgagcacaaagcagtctatcggacagatattctctgatggcgcggataacggacgaacggtactgcatttccagttacgcagagagaaagaaaagttgaatccggaaccctggttgaatcgttaatctaaatataagacacacttggtatgaagttaacaaagatactgatacttttactggccttctggctcgaaccattgtctgcatctccctatttctccttcaagaaatatcaggtggaagatggcttgtcacataatacggtatggtgtgctatacaggatagctatggatttatctggctgggcaccagtgacggactgaaccgttacgacggtcggggcaataaagtttatcggaatgtattgaacgataaattctcattggagaacaacttcgttgaggcactgattgaagaagatcagaatatatgggttggaacgaactccggactgtatatctatgaccgggcaacggaccgtttctcctattttgacaagactactcagtatggcgtatacgtcagcagtgaaatcaagaagattgtaaagacggagaacggacttctctggattgccaccttggggcagggactttttatttatgatcccaagaccgaagtgttgactcagaatagtattcagacctcttttgtctgggatgtctgtcagagttacgataagaagaaggtgtatgtttcttcgctacaggaaggactgctttgtttcgatgaaaacggcaaatttctgcaatcataccgagtctcatcggacgtgaactcttccgatagttacaaaataaactgtgtactcgatgtagagggagaagtatggctgggagcaggcaacaatttgttggggagattgaaccggcaaaccggaacggttgagaattacatggctccttcattgaacttcggggcagttcgcagcctgctgaaatatacggagaatgaactgctggtaggaaccgataatggactctatctattcaaccgcgagtcgaaaaccttcctccgtgcagataatccggctgatccgcgaagtctgagtgatcagaccataaacggcatgatgtgggatgcggaaggtgctctgtgggtattgacgaacttgggaggtatcaactatatgtccaagcagaccaagcgtttcgattactattcacccgcctatctgtcggggatagcgggagcaggagaggtggtaggcccattctgtgaaaataaagacggaaatatctggattggtactcagagtggcttatatttcttcaataccgttacacgggagctttcggaatatcatatcggtggtgtaaagagtcagaaatatgatattcgctctttgatgttagacggcgattgtctttggatcggtacttatgcggaaggaatacgtgtgcttaatctgcgtaccggttcgataaaggaatatacccactcgcgcggaatccccaataccatttgcagcaatgacgtactgtgcatatataaagaccggaaaggggaaatcttcgttggaacaagctggggcttatgccggtataatcctgatgccgataatttcatgacgatcaccagtatcggttccatgatttccgtgggcgatatatatgaggatatgtataacaacctgtggattgcaacgaccaacagcggcgtgttctcctacaataccctgagcggacactggaaacatttccagcacgaacgggaagattcgaccaccattaccagtaattcggtgatcacggtatttgaagataacaaaggcgtgatgtggtttggcacgaatgggggaggattatgctccttcgaccccaaaacagaagcatttattgagtttgattctgcgcttcccaataaggtgatctattctattgaacaagatcagacaggagatttctggatatccagcaatgcagggatatttaagattaatccgatttctaaagctcatttccgacagtttacgattaatgatggtctgcagggaaatcagtttatggcacgttcttctttaaagtcttctgaaggtaaactatattttggcggaatcaacggctttaatgttttccagccggaacgttttgtggataattcctacattcctccggtatatgtgactgatatccgtttatcctatctgaatgacgaacaggaagtgaagaagctgcttcaactggggaaaccgatttatatggctgacaagataaccttgtcttatgaaaataatagtttcacgattcgttttgtggcgttaagctatgaagacccggcacgaaacagatattcctatatgttaaaaggagtagataaagagtggattaccaactccgagaacaactctgcttcttataccaatctgcctcccggagaatacgagttcgaagtgcgtggctccaataatgaccatcagtggaacgagaagacgactactctgcgggtagtgattactcccccttggtggcgtagttctttcgcctattttatttatattctcctgttgatgggctggattgtctggattgcatggcgctggaatcttcgcgtgaagcataagtacaaacaccggatggagaaatatcagattgctaaagaacaggaagtttataaatcaaagatcggcttcttcattaatctggtacatgagatacgtacccctctcagtctgatccgattgcctcttgaaaagttgcaagagatagaacatgaaggaaaagaagctaagtatctgtctgtaatagataagaatgtaaactatcttttagggattaccaatcagctgctcgacttccagaagatggaaaacggagctttgcaactgaatctggtaagttgcgatattaaggaaatagtgaatgatgtatatagtcagttcaccagtcctgccgagttaaagggaattgaactggtattgactctgcccgagcaggaactggtatcaatggtcgatcgggaaaagttgagtaagatactggtgaatctgatgggcaatgcgataaaatatgcccgtacgcgtatcgatttgaaactcgtgacaactgatgcgggatatgagatatatgtgagtgatgacggtcgtggagtaccggatgcccaaaagggaaagatatttgaagccttctaccaaatgccggatgataaagtcgctaccgccacaggtaccggtatcggactggcttttgcgaaatctctggcagaagcccatcaaggcagcctgcgccttgaagataacgaaccgcaaggctcctcgtttatattatctcttcctttaagcgaaaagaaggcagaagaagctgctgatatcgttgaggttcattccgaaaacgaaggttcggcagagaatattccttcagagttctccggaaagaaattcaccgtattgctggtagaagataatgtcgaactgttgaatctgacgcgtgactcgttggttgcctggttccgtgtgctgaaagctccgaatggtcgtgcggcacttgagatactcgaacaggagagtgtagacgtcatcgtcagtgatgtgatgatgccggaaatgaacgggctggaactctgtagcaaagtgaaatcggaaatcgactattcacatattccggtcatcttactgacggcaaaaacgacgctggaatctaaggtggaaggactggaatgcggagccgatgtgtatattgagaagccattctctatcaaacaactgcataagcagatcgagaacctgctccggttgaggcagtctttccataagctgatggttagtttgtccgggaatgccaatcaggcctcggcagaacttgcgatgactcagagagattgtgagtttgttgccaagatacaggaagtgattgccgaccagttggcagacgagaatttctccatcgatactcttgcagagcagatgaacatgagccgttccaacttctatcggaagataaaagcattgtcgggaatgtcgcccaatgattatctgaaggccctccgtatgaataaggcagctgagttaattcagggcggtacacgtatttccgaggttgcggcacaggttggattcacttcctcctcttattttgccaagtgtttcaaggcacaatatggagttctcccgaaggaatatgtcaatcagttgtctgtttccgatacagcggtagaaagcactccggatgccgattctaccatttgatttatcatcagatgtatgaaagaagcatgcagggcttgacaaaccgttttttatgttgtatatttgtaagtgagaaccggaagtaaattcgataacattgataatatagacgaaaaatgagtaataataagtacaatataataacagattgcaagcgtttccacttcggatagtgcttgccggatagtctgatacaagctaaaggctgcgattctttatgggaattgcagccctttttgttgcttaaaattgatatttgttgctgaaataacgatgctcgggtttataataaacttgggggacgtttataataaacgatgaacgaatttattaataaatgattcggaggaagtatataaagggttaatatatttcgtgtgaaagtgtgtaatgataccaagaaactttctgtttttattattaatgggtagtttgtctttacattctcttttttctgttttcctgtcatcagcaggatgtgtcacgatgtaatgacgagaatgatattccaaacttaatttttattttcgctttattaactattaatgaaaaaaaagtcttttctttgtatcatcttaaaaatgaaactatgagaatcaatttatgtttgttattattccttgttttgctgaacatctcttgtaattccaaacgggcgggaaaaaaagaagatgttgaaaaagatacttatgccaatccattatttatggaaggggctaattcaagcgcgatttaccataatggtaaatattattatacccatgaaactaatgagcaaatatatctgtgggtaaccaccgatattaccgatatggctcattccacttgtaaagaggtctgggtgcctaaagatccttcgaatagccataacctctggaatccggaaatacggaatatcaatggtaaatggtatatctattttgctgccgatgatggaaatacagataatcatcagatttatgtgattgagaatgattctcctgaccctatgcagggagagtttcgcatgaaaggagcgatcatgaccaatcccgattggaactggggaatacatccctcaacttttgaacataaaggggagctttatcttctatggtccgggtggcctaatcggaggataggcagtgaaacacaatgcatctatattgcccgcatggaaaacccctggacattggctacggaaagggttctgatttcgaagccggagtatgaatgggaacggcagtgggtaaatccggatggcgggcggactgcttatccgatttatgtaaatgaaagccctcagtattttcattccaaagataaccggactgtcattgtctattatgcggcaagcggttgctggtctccttattattgtaccggaatgttgactgctgacgcggatagtgacttgctgaatccggcttcctggaagaagagccccgttcctgtatttcaacagagaccggaagatggagtgtatggcccggctaacctttcctttcttccttcgcctgatggaacggaatggtatatattgtatcaggcaagaagtgttcctagcggtaatacgggagagtcggaaagtcgcaatccacgattgcagaagataggatgggatgctgatggaatgccggatttgggagtccctttaccggtgaatactccgttacctaaaccatctggcacagttccaaatcaataactcttttggggagaaactcgctcattattaactcgcgctgtttttgatttgctacgaacaggctggttgagagaatctcaccggtggttccatcatccgttactactgtcacttgtcttactccttccagtggtttgccacttgaaggagagataatgtgtttgcgatcatccgagttgtttccggaggtggttaaacattcgttattaaggagtatggattgagttttatggttttttgtagtacttgcctgatcgtcaaagctgactttccatcctgtgccaaccggatgattgcctagagcgagtacagaactgtttcccatatttattaaggcatttgctatgatgtgaacctttaatatttctcttattttgtcgagagcataacctttaagaaatccggaaaggtttattgtagtacctgcttgttgaaagaagacactctgtgcttcggggtataaatgaatggagtgtatggtatcttgattataattatctgagtggatagtaacatcgaaacatcctaaggtttttttatgatattctgtgcacaatgaaatcatcctgtaaagagactgactgatcataacaggagctgtggaagctctttgattgacttgcgataattcactggaagggtcataataatttgcaattctttccagttgtcggagagtgtcatatatactattaactacaagcattaattcattttctgatttctggcagcagagtattatatctacgcgtgtatgcatggataaaaaccaagcataaagcaaaccgtcatcaccatgtgtcttgtataagtgttgaattgtatgctgcattttgttttattgaaatattaagagggcatgccactttgtgcatgcccttctactcttgattttatgttagaaatcggcttttcagtgcaagttatttcagctctttgatttttacatttttaaaccagacttcgtctccatgatcttgaagaagaatattgccttctgcggaattaccaaaattaggccagtttttatatttactgtaggcaaccaaagcattccacatgtcagtattgcgagtatattcgatcagttttaccccattcagccagtgttctacgtggttatcttgcacaataatggtggcggtattaaaatcttttttgttgaaaggcttcttctctggagccggaataagatcatataatgaacccaactttctgttgccttttactccaagtttagcatctggatgtttgtcatcatcaagaatttgaaactcacagccaatagcagagccttctcctttgttcaaatctgggttgacaaagtatttaaccccgctatttgcgccttcggtaatcttgaaatctaccgtgagaatgaagtttttatatttgcgggtagttacgatatctccaccattagctgattctgctcctccgctcttcatcactttcagaattccatcttccatcttccatcctttttccggaaaagcattcaattttgctcctctccaaccattgttggttttaccatcccaaagtagggcccaaccctctttggcttcacgtggagatatggtgttggcaatcatatttcgttcgggcgcttcttccgtttcaggtgtctggtaacgttctacatccgttgtacaaatacggatgtctttccagctgacagttttaccttcttcggaagcattacctattgcgtgtacttgcaatgcaataaatccgctaggtgtcatatcatcccagatattggcacaaggtactccattaatccaggtacggatagaatttccgatagcttcaatcctggctttattccatgcattgtttttaaaagcggtttttgcagccggattcaaagtcagtggatacaaccagtttctgcgtgcttcatcatagatacctcctgaccaagctcgcttagacgggtcaatttcaaactgataaccgtgcacacgaccattctgataatctttcttgctttcactacgaagttgtactcctgaatttaatccgtcatcaattttgaaatcaaattcaagtatgaagtctccatagttcttggttgttgccagaaaagtatttggagttcccattttagaaatacccacaatggcaccatctacgattttatactcggctttgccatttagttttttccatcctttcaggtttttgccgttgaaaagaggttcccaggtctgcgcagataatgaagccgcacagaataaaagtaaagtaaataagaagttctttttcatttttaatgttattcttagtaaattgtttatagctggtttaatgggtggttatgttcatttataatttataaaattcgtcccaacctttgcgtggaggtatccctgtcagcattgcattggcaaactcgttatttgtaatttgtttggtacggctgtcgaagaacagctgagtgttgaggcgttgagccattacaccaagtgagaatacctgacttagcactccattgatttcgaatggagaacgtgttttttctataccgttacatgccaataaaaaattctcgaaatgattggacgggctctttggtatttggggtagcttgtctgccatctctttggctttttcttcgggaatgatggataaggtacttccatgacttcctcctttaaatgtcaggtcttttgtataaatgatctttccaggattcaatttggcggccggaacatctccttggttagtcgtggggatattagggtctaatcctgatactccgtaaccggcaggaataggagggaggttgtctagtccgtcataccaggtgatatctacgggtggcatccctttgcgttgtgggaagcggaaaagaatagtggaagaataaggaaagaaataatcattatgccctttttcatgcaataaagttacttcatagggcaatcctaattccaaaaactcatgaacggtatccagaatatgtgctccccagtctcctaaagctcccattccgaagtcataccaacagcgccattctccctgatgatatttttcattgtattcatgatatggaacagcgccgagccatgtatcccaatccatgtctttcggaagttgctgtcctgaggggagtttataaatgtttgtatcccatttatgccaacgccgtacgttattcatgtgtgcagtgacggcggtcacgtctttaataattccggcatccatccaagctttgaactggaagtagtttgcttcagaatgtccttggtttcctacttgtgtagccagattaggacgtttgagcgctgcttgcatcaaaagttccgcttcatagaaagtacgtgctaacggcttttctacatatacgtgtttgccagatgccaaagctagcatgctaatcggaaaatgagagtgatctggtgtagcaattgcaacggcatcaaattcttttcccgctttatcaaacatctggcggaagtctctgaactgttttgctttgggatacatgcctattaccttttgtgtatgtttggcacccatgtctacatcacagagggcaactacttctaccatgccggtccgggcaaaatcttcaataatttgctgcccgcggttaccgatacctacataagctatcttcactttttcgtttttgttttttgaagatgacaatgtttgtgcattcaatatttcaccagctcctgctgccagtccggcagaagccattgtcattgttttcaggaaatctcttcgtgttaccataatttcttcattgatattgattaagtattctgttgattatatgttataaatctgttattattcttttttctttttgaatagtgctgttatgc

SEQ ID NO: 91 - DNA, 31086 bp, Bacteroides thetaiotaomicron
ctgtttttcttcgggcactttatcataatacctgtgaaaaactgttgcaaacttaacgacttatataagaaatagcaatgaagaatcgtacataaacatggaaaataccgccttttgaacgaaaatacatgctctgaacgcgttttttaaataagaaagagtgtagataatacaatttattccggtttttcttgaaacaagaataaccatatataaaagcaatatggcaaacttttcaaatataattgtgtcgacaaagaagttgacaaattaaaaatatatgcgataaacacaaattcatgtttgcgaagtacaatcaagaactataaagattattttgccattcttattgtcacttgtcacttttacaacttaaacaattgattatcaaagtaataagagtgacaatagacagtgacaatagagtgacaatagagtgacaatagaaataataaagctttctattgtcacttttactttttcctcttttatatcttaaccaccagatacacagtccctttattcgtatgtttgcaaggaatcccctctttctgaagcagccgtccaaagtgatgcgccttgccggaagacagcgtaatggtcgttcttttttgcagataatccaatatttctaccggagataagtattctccttccttatcatcccctgcaaccttgaaataacgatagaataactgaatagccggcggagtctgttcaaactcccgattcccctgtgccaggatagcctcatccttatcgtcaaaccaataccgctcgccatgacaaatctcgtacatagcctgtgcatacaactgctcatagtcaatcgggcgtgccgtatcaatcgtacccgtcacctcaacgcacataaaacgacggctaccggacggatcagtcagcaaatccttctgattgctggtcgcgataaacgaagcataacgccgcaactcctgcaccgaattactgtacgatttacgaagattgactaccggcttttgcagaatatgcttcaaaaagccctgctgcgtcaaagtaatctgatcgaactcgtcaatattgatcagcgcaaagcgattcagatacatttccgcatcccgcttccggctgaaatcaatactatccgtataatatccgcgaagtcccggcggtatcagatcccggcaaaaggtagacttgcgtgtcccctgcgcacctaccagcaaaggggaagtactgttcgcatgctgccggtcatacccacgccaatgagctaccatgttgaggaaccagcgatggaaaagcatcgtccaatgcggattagcacatggcacacggtctgccagttccgtaatgcggtcttttttatcccaattaggaagatgaaaaataaattcttccaatggattataaacagatactcggtttgaatgcagataacggtccacatcccggtcccacaccgcaataccctcactttgcgcatccagcagaatactattctgcgcccgtttatccaacggacggaaacgaaaataaaacgagcatcgttcccggtattccacttcacctatctgtgtattgtagcggaattcataacgacggttcataaactcctctgtctgcatattgagatattgctcttttgtcagcccgtttttcttgccgaagcctttgcattcctgatacacattgcctatcatctcgcgaaccagcacagcctgcttcgaatgataataccgatgaatggtcctcctcaccacttcctcttccggaataccggaaaggaaacaattttccgccaaccggactaccaggggctgcaaatcatcattccgcctccacccctcttccatcgactgaaaagtctttcgcaaggcagcctcatacatcaatgccagcgcatcttccgtatcatatcccggaacggcacgattcaacggagacttttccggggtcagcttctcctgataattcatttctttcggcatcccgaaaggctgagaaagataaaacggcacggaattttcccgatagaaaggttcgggatcgtgactcagccgtgaatattgctccaaaaccggctctttcaactgaatatcaaaggggatttgcggctgatagcatttcaccgccaaacgatacgcatgtgcctgaaaaatttcagcttcttcctgcgtctgcggcaacgtaccgtccggacgggtaaaaagagtccatatcttcacggaatttccacttgatcccatatatgcaaacatagtctgcggcaattcagccgctttcttcttgaccatctccacttctacttttcccgccaacggacctacggtcagttccacgatgccattatatactttcatccgcttcacgccattcacacgtccgaaaacagcagcgggtattactttgggaagtttcccggcaaaactgcaagattctccgggtaaaacaaaatgcagggcttggcgcaatccggtcaccggacgggtcttaatctctgtttttatcttctctatcaacaagttaaaatctaatacacttaatacttcgactccatctttctccctgatttgtgttatcttcattacttttcttaaatatttatgtatatccctcaaaggtaggcataaaacagacagtaaacaacctttctattcattattattacagattatttatccgcctttccattctttcggaagctccttgaattaatagtaaataaaacgttcattaagttgtttagaagcttagattaatgtatctttgtagtgataagaaatcgttttacgtacatggtcccatcggtccacgtatgtgaactattgggttcacgtacatagtccgaacggttcacgtacgtggaacgaaaacgtgaaacagacaaaatatattagtcgagccttgtctacatgttaaggttactagtgtttgtactaacacacgcggtatcaattgagtaacaatcctattaaccaacaaaaaacaagtgacgctatggcagcagattatgactttcggcgaaaaccgaatgaaaagggagacggagaagtacagcctctgtatccccgaattgtatccaaaggaaccattgacagcaaacggttatttcgtgaaatagccgaagcctcttctttcaccgagggagatttggcaggtatcatggtagcttttcaagagaaggtatcctattatttaagtgaggggtatcatgtgaaactgggagaaatcggatatttctcctctagtttgaaagcacgtccggtgatggacaagaaagagatccgttcggtctccatctctttcgacaacgtaaatttcagagctactccctggtttcgccgacgcagttcggggacggtcacccgtgccaaattcggatttcaagaatcatcgaacttgccggaagagacacgccgttcccgactggaagcctttttagcaaagaatcacttcatcactcgaagagaatactctcagattacgggtttattgaagggaaaagcactacgggaattgaatcttctggtagaaaacggagttcttaacactcgcggatatgggaaccgggtggtgtatttaaagcctaataatcagtagattaaatcagcaaaagatacaataagggtgataatagaaaagaggttactattctattatcaccctattatcaccatctattgtcacccgtttttcattgataatgaaccggttagttctacaaagtgacaagtgacattaaaaagtatcattaaactccagtgtgtgacgctcaataacttctaccgaatcgagcccaagcatatagtcacctttggtcgcctcaatcatagctttttgttctttctgaaagtagacaggggcatctttacgtaaaggtaaaatctttagttccacctttttgccgacgagatctgccatacggacccacatctcctttccattccagaagttatctgctacaagcctgccgtcagcatacacacgggccacatcaccccgataatttatacggagaaaaagattatcataattatttattccagatgtatcatagttaatagtgtataccgcagcttttgcaaagtcctcttctacaggttgcgcagccactgcctgacgccccatggggacaacacggggagcatccgcttttttcacttccgtgactgtggcggcaatgacaggagactttgtccatacctcctccacgatgcatgaatcactcttatacagaataccgccattcttggcataaagcagtttaccgtcaattttataggcagtctttgccttttcgtatgagagcacacagacattgagcttgcccgccttctgctgcttgttaagtttacaagtatagaccttgccgtcaacggagatttgaggctttttacccctgatttcgatgaaatagataaggccatccactttgcagaacggttctacagtagtccagtcaatggttgcaccctcagtccgatagtctttaaaagtgacatgggacgtcccgctctcattcttgatacgcacatagtcattatagaattcgaaagcaccccggcgagcataatgcctgcttaatgagtcaacattcatctgcaagagttcactgccccagtctgtcaacatctgatggataaaacgtccttcatgaaagggagtctcgaatacttgtcccacttcgccaagaggagcctgaaaatcataggtcatatgaggcaggtcattatgattagtacccggagaggattgcgtttctcccatagtgtgaagaggattgtatggattggtgccaccgtgatacatatagtatcccggaagattggagccactacccagcttgcatataaccagcggtttaagctcctttccattgatatttatccgacgatgatacgccggcatcataccaccgcccaactcacaagtaaaatagggatatgacaattttgaactgagagagggggaatcttccgacaattcctctttagagaatgtctctgtggcaatagcactactcatacgtttgtctctcataatgaaagcatcggcataactgcccggcatatcctccagtttccggtcccagaatccgtcggcatagtcaccataaagcggcaacagctgcccgaaaacctcttttccccgaagtgcaggccaaccggtacgtgtatagaacgggacatcaaatcccgccttcacagcaatatttttcaatgcctccagataatcccaaggaccgcgactttcgttctcgatctgcacgccgaccacaggaccgccatctttccacaaaagtccgttaacctgagcaaaaatagtattataaagctccgtacaatcttcaaggaatccgggagtacgggcacgtatcttatacttaggattctgcccggctttctcatgtacccatgaaggaattccgccttgatacacttccccatgacagaaaggaccaagacgcaacaccagcatcacattttcttctgcacaaatccggacgaagcggcgcaggttatgattgccgctccagttccattttccctcttccggttcatggtgaatccagaagatatatgtagaaatgatattgataccaccggccttcattttgcggatttcccggcgccattccgactccggtacgcgggaatagtgaatctcgcccatgacgggaatgatatgcttgccgtcaaggataagccccttgctatccaccagaagagttttgccttcgggtgttgcagatgtcccaaaccggaaagtaccttgtgctgaaaccattgacaacgacagtacaaacatcaataaaaatgtgatcttctttttcatggtaatctttcaattgttagtctttcaattattcaactaccttccgattcaaacggaaagtagagagaactttcttgccggaataaatagtcacaaggaagttatagtcctcacctttttcaaaatcagcctttgtcgcaaagcggatgtcagctttttcatagggtttcaaagcaggtacggcagcagaagccactttgaccattttgccttctttcttatactctatcttgaccgaagccttttgtgagctaacttgtccgaagttctgtacttcaatattcccgttccagcctttttgcgattcagagaatacaggggcacgtgcagaaagaatcggttccacataatcaacatacggcaaacgcgcatatccgtaaagcatctttccgtttttatatctgcctatcaatttaggagcaaattctttctctgtaatcccatttccttttccgtcgaaagtaatgatcaggtcatttccatcattctctgttttcaatactttacttcctctgccataattcacttcttcggaagcgccaaaacgcaaagagctgatatccatatcggtttgtggatgaaaaccttcttctgcctgtactttcagccggatagttttcgttccagcggtaatgggcttatcattcaacactgtcagcaatagtcccggattcaatggaatactgatattctttgaactgtgattatcaaatggcttatcttcatgtttcaaagtatcaatgaccgcaaaattagcctgaatagcacggccatacttatcttgatacattttcagacgttcatacttgaaccagccttcagaatgtccgtcctcgtgtacggcaactcccggcatgtaggcctctcccggatcagtaacccaattgactccgtcctttgaacgaagataaaaggcaatacggcccaaccagtcattgacaatcagatgatactggatatgatcgcgccagatgacagggtcttcaaaccgtcctttcacatccggataaacacgacggtctgtcaattggttatattccgacaaaccatcccggctgatccagattccaccgccacgacagaccattacatatgaactgtcttcccgttgggcaaacgaaagattggacaatccttcgatgattctacgatcgcgcgcattgaagtcgaattttccatattcccattttccgttgatatcatccgcaacataacggccgtcgatgacatacaaaacatatcggccgtcttttgcctgaaacatctccggattatgtccttttccgatgatattaatcggtttgaacggaccggtcagattatcactcacggtattgaacacccatgaatttctccactccatgtgtcctttaggagaggcttccagccatccgcaaaccatcagatgatatttaccgtcttctcctttccggatatttccaccccaataggaccagatacggtcttcaataccattatcaacataacgcggacgcacatcggaggttccccacgtgtcggatgacagttgattgcctttcatcggcagaaaacgatccataaaccgggcacctttcaccagttgactccactccttgggccgttcgcgttctgttacttgagagaaagtggatttactcacaagtagcaacattaccattaatactaatttaagattttttccgtacatgtttttcttctgttagttagtttgatagttcgtttgattaatactattagtattacgacaaaagtaaatcaatccctcattagtgaatgataacaaacagggaaaaaggcacgtaatgctttacgtaaataatacgaacattcccagagtcctaatagcccaaccaaacggttgataccaacaactgaatgcaaaatactcttttattcatcatagtaaataacactattttcttccaaactaatattgcagcagaaaactctcggcaacttttagaaaacggtcatgtcctttactgttcagatgcgctgtatcagtattattcttgcttttctggaaatagattcttctgaaagtatcattatcggcatagatgcttccttttcttgcgcaatcaaaaataggaatactataattgccgcagacttcaatcattgcatccactactttttccgagtcacttcctttaaagttcttgcagttccagcgggtaaagaaaaagattttcgctgtcggatatttctcgactaagcctttgcacagaatttccattttatccttgaagttatcaatacctccgatagaatccagtttaaatgcatcattatgtccgccaatgacaatgacataatcgaggctatccgccatctccgcatatcgcagatacatcgcttttccccatcgcgggctggaataagctatgctattcccattctttccataattaaaatactccataccgtgcttctttgcaaacttataatgccatgtgttctcaaacggctctttatgatttctcacatagctgtcacctattactccgatccgcttgccgttaagttcgtcagtaagcgctataccagtctgtgctttcccatccaaaacggacaacgcacaaacgattaacaataaaaagatttttaaatgtgtcatcactttatgtatttttcatttgctagcaaagataagggcagttgtaatgtcagtacatgtaaattcatacgttttcctttaaattcatacacttttcatgctttaatccggttttttacgccccaattctccaagaaacggacgattttccatctttctatacttatttgccattggagcaagttacgactttgcatatctttgccaagaaagttatccatttctacaaaagactacaaacgtatgaaaaaacatctgattgcctggggcattttatctaccatgtttatggcaaatacttttgcccagaaagacatcgaccgtcctattatgggatggagttcatggaacacctatcatgtaaatatcagtgaagagttgataaaacagcaagctgacgcattaatcaaacacggactgaaagaggcaggctacaactatatcaatatagatgacggcttcttcgggcatcgggacgaaacggggaaaatgcatccgcatcccgaccgttttcccaacggaatgaaagtggtttcagactatatccattcgctgggattaaaagccggaatttactcggatgcaggagacaacacctgcggctctatctacgacaacgacgcaaacggagtgggctccggactatacggccatgaacagcaggatatggatttatatcttaaagaatggaactatgattttatcaagatcgattattgtggcggacgcgaactggggctggatgaagaaaagcgctacagcacgatttgccaggctattgccaatacaggaagaacggatgtatctatcaatatctgccgatgggcttttcccggcacctgggcaaaacgactggcacgttcctggcgtatcagtcctgatatccgtcccagatggaattcagtaaaaggtattatagaaaagaacttatatctttccgcctatgctaccgacggacattacaacgatatggatatgctagaaatcgggcgtggactgaaacccaacgaagaagaagtccattttggaatgtggtgcatcatgagttctcccctgctgatcggatgtgacatgaatacgattcccgacttctcattgaagctactgaaaaacaaagaactgatcgcactgaatcaggatgtattaggacttcaggcacacgtcgttcaacatgaaaatgaaagctatgtactggtaaaggacatcgaacggaaacgcggactgacaagagcggtagcattgtataacccttccgaccagccatgtgactttatcgttccttttgaaacccttgaactgggtggtaacgtaaaagtacgagacttaatcaaacagaaggatcttggaaaaatgaaagaagaaatacggcagactgttcagccacacagcgtaatgatatgcaaaatggaagctgaaaaacgactggaacccgtatcttatgaggctgaatgggcatatcttccctgctacgacgatctgggaaagaaatccaaaccaattgtttatgtacctgcctccgattgttccggcagaatgaaaatatcccgactcggtggtcgggaagagaactttgccgaatggagcgaagtatacagcgaaaagggaggtaactatgaaatgactattttctactcttgcgacaaaaaccgcaaactggaagtttctgtcaatgggacgaaaacggtccttaaagatttgaacagcaacaatgaagtgaaatctgtgacgatccctgtcagcttaaaacaaggttacaatacggtgcgaatgggaaataacttcggatgggcaccggacatcgaccgttttacagtatccagacaataaattcctcataatatcaattatagaatgaacaagaaatttagatgcttactgacatctctgattttcacagctatgtggaatggggctaccatacaagcacaagctccccatcccgaacgcatttatctttcgggaacaggcattgacaacaccaagacctgggattttttctgttctgcgggacagaatagtggcaaatggaaaaagatcgaagttccctgtaactgggaactacagggattcggagaatatacatacggtagatggtataccataaaaggacaacaccccagtgatgaaaccggaacttaccgctataaattcgacgcccccaaatcatgggcagggcaacgggtaaagatattctttgacggagtgatgactgatgcagaaatcatgataaacggcaagccggcaggtgagatgcatcaaggaggcttctatcgcttcaattatgatattaccgaattactcaatcttggtaaaaagaatcagcttgaagtgaaagttgccaaagaatcagccaacagatcgatcaatgccgccgaacggaaagctgactggtggttgtttggcggtatataccgtcctgtatggttggaagttctgccacagatacacatggaacatttcgtactaaatgctgatcatcaaggaaaattacaggccgccgtagatatggcaggagatgccaaaggacatgaaatcatcgtatctgtccgttcattaaaagacgggaaaaccgtatatacctccaacggacaaacaacaatcactcattcaatcagtaactccgataaggagcagatgattagcggtgaatgggcaagcatcattccctggtctacagagaatcccaatctgtatgtagccaaattggaattaaagaatcccgaaggtaaaatcgtacaaaccagagaaacacgcattggtttccgtaccgtagagttctttccccaggacggcgtatatttgaacggtaccaaactagtggtcaaaggaatcaatcgccactcattttctgtagacggagggcgtaccaccagtgctgcattaagccgaatggatgccctgctcatcaaagaaatgaatatgaatgctgtacgttcgcactacccgcccgatgaacattttcttgatatgtgcgactcactgggacttgtctacatggatgaactggcaggctggcaaaacggttacgactccagagtcggagcaaaactcgtaaaggagatgattgaacgagacgttaaccacccctgcatcattctttggagtaacggaaacgaaggcggctggaatacgcaaaccgatcctttatttgcccaatatgacagattacagaaacgccacatggtacacccctgggctgactttaacgacttggatacacatcattatcctacttatctgacaggcgtagcacgtttcaccaatggttataaagtattcatgccgaccgaatttatgcacgccatgtacgatcagggaggaggagccggcctgcgcgacttttgggatcgctggtgtaccaatcccttgtttgcaggagggttcatctgggtatattgcgatgaggctcccaaacgcagtgataaaggaggaatactcgactctgacaagtccaatgcacccgacggagtagtaggaccacgtcgagagaaagaaggaagctattatgccatccgtgcacaatggtcgcctatccagttgaaacctcttctcattactaaccacttcgacggccgtttcctcctgaccaatgaatatacttttaccaatctgaaagattgtcgtatgacttataaggttttatcatgcggcactcctctccagggaaacgcagaagcaggaaaggtgattgccgaaggaaaagtccaacttccatccatcaatccgggagaaacaggcactgcccgttttgaactgcccgattcattccggaaaggggatgtgctcgaactggaggcttttgatagagaaggaaaaagtatctgtaactggacttatccgattcatctggcaaaacaatattttgaacgtaacctggcgcaaacgacactcactcctgcccctcaaaaagcagaagcccgacaaacgtctgacgccatcgaactaaaaagcagcaaagtcagcataaccttcgatgcggcgaccggtatgatccgtcacattaaatccggtgagactgaggttccattcaaagatggtccggtagcaataggtatgaagatgcgatatgaaccttcgctcagctatactcgtcattcctccgacggcgccatttattgtgccaaatataaaggtgcggcagattccattgtctggcgtctgacaaacgaaggtttgctctatatggatgcaatcttattaaatcgcggttccggtggcggtggcttcgacgatgctttcatggatgcacaggttttcaatctcggacttagcttctcttatccggaacaaaactgttcgggtatgaaatggatgggacgcgggccatacagggtatggaaaaaccgaataccaggaacgaactacggtatctggcacaaagattataacaacaccattaccggagaaagttttgagaatctgatatatccggagttcaagggctaccatgccaacctctattgggctacactggagggcgagaagacttcatttaccgtttattcgcgtaatgacggtactttcttccgggtattcactccagaagaaccggcaggacggataaaagataccatgcctgcattccctgaaggtgatctttcattcttgctcgatattccggctatctgctcgttcaagccgatcgagcaacaaggtcctaacagtcaaccgggaaatatccgaatcaaatcgggagatgaagggctacatctgaatctgatgtttgacttccggtaaacaattaatgtacgctatatatagctgacaaaaaaatgtaatataaattccccgaatcaagtttcaaaaattacctaattaatgaagaaacttaattcggggaatttatattctctatttacttttaatctttctgtgaataagttacattcttttctaccacattttcaacattacttactttcttcacaaacttcttaaccgaaccgacctttacatcctttatccgcacatttttcacaggaagttcagcatttcctttcagttcatatacagcgtctgccgattcacaagttactttatccatatagatgccatcgatacgagtgattcgcttttcataagtcgggactaagtccttccactgataaagcacctccgtatctatttcaagtacccgctgggctgttccggatgctacatttttcatatagatattctcaataaatcctcccctacgatgatttgtcttcacaaagaaaagacgcatcacagaattgggtgctgtacagtcatgcatatagatattccgtataccaccggagatctcactgccgatgcccagtaaggtatgtcctttcaatatccggcagttacggataactatattctcgcaaggtgtattcaacctccatgcgtcctgattacgaccggctttgattacaacagcatcgtctccctggtcaaaagaacagtcttcgaccagaaagttacgactcatttcaaagtcaataccatcattattgtgtccatgtgcccgcacatccaaattacggacgatccctccgtcacacatatagaggtgaatggtccaaaacggactctcacgtattttaaatccatccagcatcacattcttacagcgattgaaatgtatcaaatgcggacgcaaatgattttcaccgatagccatctggcgttctataacaggtacattggtcgaagctttggtatacaattccttcaaagcttgcagatggggtgcaggacgtttaaaccatactttccatgttcccatcttcggctgtaatgtacctttaccgctgattgccacattttcacattcaaatgcatacagtagcggtgagtaattatagcactccaatccctcccatgaggtcattaccgccggtagatagtcttccggattatctgtaaaactcaatacagcatcttcttctaaacagaggtttatattgcttttaaagtgtacgggtcccgtcagccaaatgcctgccggaacaaccacacgtccaccgcccgctttattacatgcgtcaatagcagcagcgatcgctttggtattatcaacttctccacccggcacagcaccaaaatccgtaatcttaaaatcccggtccggataaataaagactttaatcggttgcatcggaaaaggagcttttactttgacagttttataattaccgcccgccattaccgtagcaacagacaatagcccgaaacacatacataccatccattttaaaaagttctgtttcattatcatctcatattaaaatttgtccaatcaattttatttttgaattttcagtgtcaccttaatcataccgccatacgggtcgaaatcgaaaagaactttatcgtcagtgatctgtaccggcaatcttctttttccttgtttcacagtcactttctttatttccttaccggtaatcaccattgtcaacggttcaacgaacagttcctgatccaacttaagttccggagtaatcaacaaggtattctttttattcacaacttccagtttagtttcctccctttccttgatataagaaaccacttcacggaatgttcctacccatatttcattctctctcgcttttacttgatccagatgatcccacaaacgttgaggattgcggaaagcatcatagccataggttaaaccatgtgtcattcctactccccagtcattggtttcaatcaaggtattcacccatttttccaaatccttcagagtcgatttactcccaatcgaacgctggtgagttctcgtccccacacgattctgtacggcaattctccgtccttccgcttttttattattattgggatagcagaaagtacggggcattacacctgtatttgcaaagatagcactatcattcttaaaaatatcctcttttatctcttcgataggaaaacgtgcgaagtttttatgcgcccagccatgattggatatctcatgcccattatcagccatttccttaagttgaggccaagtcattcttgtagtgtcggtaatgttctcgttatccttatttatattagaaccacagacccagaatgttccccgaaaacctctcttttccagttggggaacaagaagtgtatagtgttctgccaggccatcgtcaaaagtatagctgatagcacaagctttatcctgtttatatctggctatttgcacattccagtctgctcccgacaaatagccaatactgattaataaacttaagataaagagtgaaaatgtcttcatcattctgtcgttttattggtttatcttcacattattcatcgtaaatgaatctattacactctgatccacttttcctttcttagcccgcactgtgagattctcaaaacagaaatcagacaacttatattgatcagacttcttaacattaaagaatacattacaatcaatgtctatattacgcatcgtaatgttattagaataagaaaggggagtatctttacgatctttcaaatcgtaaaactgcgtccaaggagctatattcagacaattctgtacattccctgttatatcctctaccagaatatactcatatttttgcggtgtatccgagcgcatctttagagttagaagagcacgtgctctatctaccttacaacggcggacaatcacattccggctaaggatagactcactaccacaagtaaaggcgctatgacagaatccgtaggtacagtcttcaataataatatcatagttttctccattattggcatctttatctgcccaaggtccttttccccctttcagcgctaccgcatcatcattgacagacatataacaattctttatcagcacattattacaaacatcaaggtccactgcatccgtactaggagcttttacgggactggcaggtgaagtaatgcgaagattcaacaacttcaaaaaactgcatttatagaaatgagtgctccagaaaggagaattcataattctgattccctcaatctgagtattcttacagttggacaaataaataatgcgaggacgcatttcttccatattggtgcaatccggatttatagaacgccgtaaccaaaatgacttccagtaccgaagcccgtttccattcaatgttccctttccggaaattgtaaatccatccagtccgtctgcatttaccaaagccatgaagtattttaaagtctgtccctccatacgggtcattttcaccggaaaatgactaatatcatcgcttccctttaatactgcatcttcttccagatgtaaatgagtattgtttttaaagaaaagtgatccgcttaagaaagtacctttgggaataactataactccacccccattccgggcagccagatcaattacttcctgtatcttctttgtctgcaccaccgtactgtcgttcgctactccataatcggttatgctatatttctttcctaaagcattcacattcacttccttgttttccctgaaccattcagggattgccttgccatcaggaaaaacctcctgagccaccatttgtgtacaacacaaaatcaatactaatcctacaatttgtttcatcacctatttatctttttacacttatctattattaatcaataccttacattgaaaacaccagtactcctgcggttgggatctcttcagttcctaccagcaccttacttccctccggtatgtcgaatgtataagaacgatctgaataattcagtacaatccccagcccgttccggtattccaccgttattccataaggcaaatccatcacaggaatctgtagctgtgcatataatttctttaagatatccttttccaacgcaccattgtggctgtcaactccgacatatgtaacagtgcctttacccagttttcggaacgtgacagcaggaccaccttcatagaattcattggcatacgtcgcccaaacctgcgaatcagatgcgggaatcagtatttctccccatgtattccactcatattgctttccattcatgacaacagtacccggatcttccggtaacagcagatcataaaagttcatttcatttcccgtcagaggtgtgatcatagaaccgaaaggagcttccggcaaacggccataacggtctttctgtgctgtacggcaggtcaacacaagattaccaccatttttcacataggcaatccatttatttactaattccttatcagccagttggtaagcaggagctatcaccacaggatactccgtcaactccttctgttcggagacaaaatcaacgggagcaccaaatgacttcaaagtccggtaatacttctctatatgtgcaaaagtatcccatgtacggttctgtttctgccgctcgatgctccaggaattctcgtggttgaaaaggatagcggtacgacgtgccagatagtcggcaggcttcgtttcgcgcggagcataatgtttccggagttctcttatctcttttataaaggtttcatattcccttccgccgggagtgacggttacgccgtccgttcctactatcccataatgatactgctctgtgccgtacagcggctggcgatagcgatacgtacagataaaatcgcttccaccggcaaatacactccacatccacagacggacagctcccggaagcggttgcggattaatgctcccccaattcacttgtcccggttgcaactccatcacgccatacgtaccctgtataggacggaagaagtcattcgcccatgcaatacgcaacggatttcctacccgatatccacggcgtccgataccttcgttatcgccatacaccatatagcgtgtataactctggaaatcgagtgcaggactaccgccgatatgtccttcatcatagttggggatatagttggtagtaatccactggttctttgcatattttctgatcagcagacattgttcattcagaaaatcattggtctgcgcagcggcaaaacgacgataatccagaatctgatgatgattcataaacatctggacacgcttaggaagagtgatttcatcaaaagacgaataagcctcactccagaaagcggttccccacgcgtcgttcagcaactgaatgttgtgattgtattttgcacggagataatcacggaaagcctgttccgctttcggattatagtcgaactgtacggcaggttcattgtcgagttgccatccgacaatacgggaatcattgccataatgctgtgccagtttctcgatcatcttatacgataattcccgatagagcggcgaagcaaatgaggcatgctggcgggcaccgtgatcgagaaccgtaccatcttcattcttcaacaggatttcgggatacttccggctcatccacaccgggggtgtggcagtcgaagtacacataatgactttcagatcatatttggcagcaagagctactgctttatccagccaggcaaaatcgtatcgtccttcttccggctccagctgcgcccatgcaaactccgcaaagtgagtaaactcaaatcccagttcatgcatcctcttgaaatcacgttcccactgactttcatcccagtgttcgggataataataaactcctgtcaatgtcagttccttatcgttgaaccaggaagaagtttgtgcttttacagattgatgcttccggtcatctaccagagactctacgacggaagcatctaccgcaaaggcagtcccgtggcggattcccttcggaaacgaaacctgatcggatacatcttcccacgtttcaccatgatccagcgaacggacagctccgtaacgatgatcacgatacttatcaaaatacacataaagcgcatcacccacaaaaagaggtgccggtccttccgcccaatattttcccgtaatcggggcggatacctttgtcggaaaacctttggcaatattcttcgtgcgtgtcacacgcaggtttttctccggaggattggagttctcgttcttgacgatcatgatcagatccccctgtgtcggatctttcacgatagccgcgtcgatcacactgaaatcgggattgaaaaacatcttcgtctttgagaaagtacgaaaatccttcgttgtgacatagtacatacgatggttcagtcctttttcgctttcgctggtaggcacttccttgtggcgcccggggatggtggtcgcccaaaaaatgtaatatgtttccgaaggctcgtcataaaagagttccggcgcccaacaattatgagcttccggctcgtgcatcatcacgggaatagcctgttgctcactccaatgaatcaaatcacgggaagaagcatatccgatgatccggtccgtccaactggaagtccagaccatgtgaaatgttccgtcgggagcttggcatatactgggatcacgcatcaatttatctttaccgacagacggagccaaaaaagagcgtccgccgttcaaaggagtccagttcagcccatcataactgtaggcaagatgcagaccgtccttgctgtcattgataaaataagaaaagagataagcagtctcacctgcaaagattgtcattaccgaccaaagagttaaagccatccaggcaaatacttttttcatggttcactttaagattaaaaagtttacttcgcaaagatatggtatcccccagaatttcagaaatgaatgatgatggagatattatcatattcatgtagtttcgtacaccaaccgccataaaagccgtttttgatacaatattctatgtatctgtacatctttctattttatagattactcaaaagctctactttagcagcagatttttaaacgtagtggaaaacatatcaattctacatatcatgaaacaacttttagtaagtattgccattgtattcgcctctgtactgaccgcaacagggcaaaaccattctttcagcctatccggaaaatgggatttccagatagaccgggaagatgcggggataaaagaacaatggttcaataaatcgctcgacgagtctatcaacttacccggttccatgcccgaaaagctgaaaggggacaatgttactgcacgtacccaatggacaggaagtttatatgacagttcttactatttcaatccttacatggagaaataccggatagaagggcaagtcaaattacctttcttcctgactcccgacaagcactatgtaggtgtcgcctggtatcaaaagaaagtgacaatcccatccgactggaaaggggaaaggattctcctttttctggaacgcccgcatattgaaacgaccgtatgggtaaacacgaaagaaatcggtatgcaaaacagcctttgtgttcctcatgtatatgacctgacctcggccgtcacttccggcaagccgtgccggatcactattcgggttgacaaccggattaaagagatcaatgtcggtccggattcacatagcatcaccgaccagacacagggcaactggaacggaatcgtaggtaaaatcgaactgcagacgactcccaaagtctatttcgacgatatacaggtatatcctgatctgagccatgggaaagcgctggtacgcatgaatgtaaaatcctcttcttctgccaaaggagaaataacactttctgccgaaagctttaatacggatacccgccacaacgtcctccctgttcaacagaccttccgtattcaggcaggagataaccgggtagaaatggaactaccgatgggaaaagacttcctgacatgggatgagttcaatccggcactctacaaactgacagccacgctgaacagcggcaagcagtccgaaaagaaacaggtacagttcggtatgcgtgatttcaagatagaaggcaaatggttctacgtcaacggacgcaagacaatgctccggggtacagtggaaaactgcgatttcccgcttacaggttatgcaccgatggacgtagcttcctgggaacgggtcttccgcatctgccgcaactacggattaaaccatatgcgtttccactctttctgtccaccggaagcagccttcatcgctgccgatctcgttggtttttatctgcaacccgaaggtcccagctggcctaatcacggtccgagactgggcaacgggcagccgattgacaaatatctgatggacgaaaccatcgctctgaccaaagaatacggcaattacgcctcttactgcatgctggcttgcggcaacgaaccttcgggccgctgggtaccttgggtaagcaaattcgttgattactggaaagcgaccgacccccgccatgtatatacaggagcttccgtaggaggcagctggcaatggcagccccacaatcaatatcatgtgaaagccggtgcacgcggacttagctgggcaggctcgcaaccggaaagcatgtccgactaccgcgccaagatcgattccgtgaagcaaccgtacgtctctcatgagacgggacaatggtgtgcattcccgaatttcagcgagatacgcaaatacaccggagtaaacaaggccaagaactttgaaatcttccgtgatattctgaatgataatcacatgggcagcatggggcacgactttatgatggcttcgggcaaacttcaggcaatctgctacaaacacgaaatcgaaaagacattacgtacacccgactatgcaggattccagttgctggcactgaacgactattccggtcagggaactgcattagtaggtcttctggatgtcttctttgaagaaaaaggctatatcaacgcagatgagttcagacgtttctgtagcccgaccgtcccgctggcacgtattcctaaattcgtatataccaacgacgagactttccatgccgacatcgaagtttcccatttcggagcagcccctctgcagggagccaaaacggtatacagcatcaaggatgaatatggcaaagtatacgctcacggcactgtaggcactcagaatataccagtcggaaatctttgtccgctgggaagtgtagacatgaagctaagcggaatcactagaccgcagaagctgaatatggaaattcgtatcgaaggcagcgatgccgtcaatgactgggacttctgggtatatcccgcacaggtagaactggctcagggcaatgtttacaccaccgatacactggacgcaaaggcaatctccatcctgcaagaaggaggaaacgtactgatcacggcagccggaaaaatccagtatggcaaggaagtgaaacaatacttcactcctgtcttctggaatacttcctggttcaagatgcgtccgcctcacaccacaggcatcttcctcaatgaatatcatccgcttttccgtgaattcccgaccgaatatcacagcaacctgcaatggtgggaactgctgaacaaagcacaggttatgcagttcaccggtttcccggccgaattccaaccgaccatccagagcatagacacctggtttatcaaccggaaaatcggaatgttgttcgaagccaacgtactgaacggcaaattgatgatgaccagcatggacatcacttcgaaaccggaaaaacgggtcgttgcccgccagatgcataaagccatccttgactatatgaactccgatgctttccgcccgacagcgaatatcgctccggaactgattcaggaactattcaccaaagtggcgggagacgtgaaatcctataccaaagattcacccgacgaactaaaaccgaaaattaattaaacttattaacgactgatatgaaaacaacatttctcggacttctgctcctgacagcaacagctatcagcgctcaggaacaagcccgcacattccaactggcagacgccccccgctacagcgaggaaacaggatacggatatgaccttgcacccactcccgaaaaagggagcaaagcacctttcttcttttctgtccgtgtgccggacggtaactacaaagtaaccgtacgcctcggaagcaagaagcaggcaggtgtaactaccgtacgaggcgaatcacgccgtctctttgtcgataatctgcccaccagaaaagggcagttcacagaggagacatttatcatcaacaaacggaatccacgcatatccgacaaagaatcggtacgcatcaaaccccgtgaaaagacgaaactgaactgggacgacaaactgacactggaattcaacggtgacgctcccctatgtcagagcatcagtatcgagcctgccgacccgtctgtaattaccgtattcctgtgcggcaacagtacggtagtcgatcaggacaacgagccttgggccagctggggacaaatgattcctcacttcttcggcaccgatgtctgtatcgccaattatgccgaatccggcgaatcggcaaatacctttatcggagccaaacgactggcgaaggctttaagccagatcaaaaaaggagactatctctttatggagttcggtcacaacgaccaaaagcagaaagggccgggcaaaggagcttactactccttcatgaccagtctgaaaacattcattgacgaagcgcgtgcacgcggagcgcatccggtgcttgtcactcctacccaacgtcgtagtttcgacgccaacggacatatccgcgacacacacgaagactatccggaagcgatgcgctggctggcagccaaagagaatgttcccctgatcgatctcaatgaaatgacacgtaccctgtacgaggcgctgggaccggacacttccaaacgtgctttcgtccactatccggcaggaacgtatccgggacagaccaggaattttgcagataatacgcactttaatccttacggtgcctatcagatcgcccaatgcgtcatcgaagggatgaagaaagccgttcccgaactggcgaagcatctgaaaatagacccggcatacaatcccgcacatccggacgatgtgaatactttccactggaacgattcaccgttcacggaaatagagaaaccggatggaaattaaaagaatcctatactaaaagactatatgagaattaaaaacctccttcccctacttctggcaggctcgttgatgatagcgtgcactcctgccaaacaagccggcaacagcttcgaatgggggcaggtacctcagcaaccggatttatcgtgggcagacagcgtaggcagccgccaacttcccggagacaagatgattatatccgccaattcctttggcgcagtagcagacagtaccgtactcagcacagaggccattcagaaagcaatcgacagttgcgctgtctccggcggaggaacggtggtcctgcaaccggggtattaccagacaggagccttatttgtcaaaagcggtgtaaacctgcagattggcaaaggggtaactctgcttgccagccccgacatccaccattatcccgaatttcgttcgcgtatagcagggatagagatgacatggccggcagcagtgatcaacattgtcgacgagaagaacgccgccatcagcggagaaggtacactggactgccgtggaaaagtcttctgggataaatactgggaaatgaggaaagaatacgaagccagagggttacgctggatagtggattacgactgcaaacgtgtacggggaatcctcgtcgaacgcagttcggacatcacactgagcggtttcaccctgatgcgcacgggattctggggatgtcagattctctattccgactattgcaccatagacggactgactatcaacaataacatcggcggccacggtccaagcacggacggcatcgacatcgactcctcctgcaacatactgatcgagaactgtgacgtagactgcaacgacgacaatatttgtatcaaatcgggacgggacgcggacggactacgtgtgaaccgtccgacagagaatgtggtagtgcgcaactgcacagcccgcaaaggagcaggactgattacctgcggcagcgaaacttccggcagcatccgcaatgtattaggctatgatcttaaagctgtcggcacgtataccgtgctgcgactgaaaagtgccatgaaccgtgggggaaccattgagaatatctacatgacccgtgtcagcgcagaaaatgtccgtcaggtattggcggcagacttaaactggaatccaagttacagctacagcactttgcccaaagaatatgaaggcaaggagattccggagcactggaaagtgatgctgactccggtagaaccacccgaaaaagggtatccgcgattccgtgacatatacctctcacaggtaaaagcggaaaatgtagatgaatttatctccgcttcgggctggaatgatacattgcgtctggaaaacttctatctttacggcatcgaagcgcagaccaataaaccggggaaaatctgctatacgagaaactttaatctatcggaaataacattggacgtcaaagacaaagatgctattgtattaaaggaaaatgaacaaagtaatatccacttcgactatgttaaaacaactactgaccgtcgtactgctggcaatctgcctcattaacgtacaggcgcagcaactgactcctcccgccggaactttccgtctgggtatatcgaaaggaaccgacagtcattggctggctcctcaggaaaaagtgaaaggaatcgctttccggtggaaagccctgccggatacccgcggctttattctcgaagtagcggtcacctccttgcagcaggccgataccttattctggagcttcggaaactgtcagccggacatggatataaacgtgttcagtgtagaagggcaagccttcacctgttattatggtgaaagtatgaaactccgcaccttgcaggcggtcactcccactgacgatatccgtttgagtaacggccgtcaggacaagactcccctcttgctttatgaatcggggaaacgaacagaccgtcctgtcctcgcagggcgctgcccgctcgcagcaaacagtaaactttatttctgtttctacgagcaaaatgcacgagcagattataattattttatgttgccggatctttttgcaaagattgatgaatctaaacatagtaaaaaatgaataaaacagtagtatctccattctcctccttcgggaaggaggagatttaagatactattgattatcatttagcttaaatccatacaaagatgaaaagaatatatctactactcagcctactggccggttgcctgtttatgcaggcagcaatctataacgtcagagatttcggagcaaaagcagacggaaagacgattgattctcccgccatcaaccgtgccatcgaagctgccgcacaagaaggtggaggtaccgtatacctgcctgccggagaatatgcctgttattccatccggctgaaaagtaacatccatctctatctggaacaaggcgcacgcatcatcgccgcctttccgggaaaggacgaaggatacgactcggcggaacctaatgagcataataaataccaggacttcgggcacagccactggaagaactccctgatctggggaatcggtctggaaaacatcaccatcagcggtccgggactgatctacggcaaaggactgacccgcgaagaaagccgcctgccgggtgtaggcaacaaagcgatcagcctcaaggattgccggaacgtcacgttgaaagacttctccatgctccattgcggacacttcgccctgcttgccaccggtgtagagcacctcaccctgcttaatctgaaagtagataccaaccgtgacggattcgacattgactgctgccgcaacgtacgcatcagccaatgcacggtcaactccccgtgggatgacgccatcgttctgaaagcctcctatgcgctgggacgtttcaaagatacagagaacgttaccatcagcgactgctacgtcagcggcttcgacaagggaagcgtactggacggcagctggcaactcgacgaaccacaggcccccgaccatggataccgtaccggacgcatcaagctcggaacggaaagcagcggaggcttccgcaacatcgtcctcaccaactgtatcttcgaacattgtcggggactggcgctcgaaaccgtagacggcggccatctggaagacatcgttatcagcaatatcaccatgaggaatatcgtcaacgctcctatcttccttcgcctgggtgcgcgcatgcgcagtccggaagggacacccataggcaccatgaagcgtattctgatcagcgacatcaatgtgtggaacgccgacagccggtattcttccattatcagcggcgtgcccggtgcatctatcgaagatgttactttccgcaacattcatatatattataaaggtggatacagcgaagaagacggcaagcgcactccacccgaacaggagaaagtatatcccgaaccctggatgttcggtacgattcccgccaaaggattttatatccgccacgcaaagaacataactttcgacggtgtccgtttccactttgcacagccggacggacgtccgctctttgtgaccgacgacgcagaaaacattgaatactatcatacaccccaagaataatgaacaagaaacaactgatactcctctgtatgctcgcagcaggtggaagcatacaagcgcaacagtggccggatgctccggcagaagcccgtcccggcaccagatggtggtggctgggaagcgctgtcgatgaaaagaacctgacttacaatctggaagaatacgcacgtgccggcatgggcgccgtagaaatcactcccatctatggtgtacagggcaatgacgccaacgatattcagttcctttctccccgctggatggaagtcctcaaacacacacaggcggaaggaaaacgcaccggcatcgagatcgatatgaacaccggaacgggatggcccttcggaggaccggaagtcagcatcgaagacgcggcaagcaaagccatcttccagacttatgatatagaaggaggccaggaaatcgtgcaagatatcaatgtgacagacaagaagcaacaaccttattctgtcttaagccgcgtaatggcatacgacgaaaacggacgctgcatcaaccttacttcccatgtcaggaaagacaaactggtatggaaagcccctgccggaaaatggaaagtgatagcgctgtataacagcaagacacgtcagaaagtgaaacgtgccgcccccggaggggaaggatacgtaatgaaccatctttccaagactgccgtcaagaactatctctcccgatttaaccgtgctttcaaaagtagtaagacgagttatccgcatacattcttcaacgactcttacgaagtctatcaggcagactggacagaagactttctggatcagttcgcccgcagacggggatataaactggaagaacattttccggagtttctggatgaaaaccgtccggaaatcagccgccgcatcgtatccgactatcgggagacgatctccgacttattgctggagaacttcacccgccaatggacggactgggcacacaagaatggcagcatcacccgtaatcaggcacacggatcgcctgccaacctgatcgatgtctacgcagccgtagacatccccgaatgtgaaggattcggtttgtcccaatttcatatcaaaggattacgtcaggattcattaaccaaaaagaatgattcagacttgtcgatgctgaaatatgcctcttctgccgcccatatcgccgggaaaccttatacttctaccgaaacatttacctggctgacggagcatttccgcacttctttatcgcaatgcaaaccggatatggacctgatgttcgtctccggcattaatcatatgttctttcacggcactccttattcgccgaaagaagccgaatggccgggatggttgttttacgcctctatcaatatgaacccgacgaacagtatctggcacgatgccccttcgttcttcgattatatcacccgttgccagagtttcctgcaaatgggtaaaccggataatgatttccttatttatctgcctgtctatgatatgtgggatgagcaaccgggacgtttgctgctattcagcattcatcacatggccaagctcgccccgaaatttatagatgccatccaccgtatcaataacagcggatatgacggagactatatctcggacaactttatccgcagcacccgtttcaaagacgggcagttaatcacttccggcggaaccggttacaaagcactggtcgtacccgccgcccatttaatgccgaatgacgttctggctcatctgctgaaactggcacaacagggagccacgatcgtattcctcgaaaactatccgacggacgtaccgggatacggtcaactggaacagaagcgcaagacttatcagcagacgctgcaaaagttaccttccgtttcattctccgaaacaacggttactccggtaggcaaaggtaagattattacaggtacggattatgcacgtactttggcaagttgtaatattcctcaggaagaaatgaaaaccaagttcggactgcaagccatccgcagagtgaacgatagcgggcaccattactttatctcttctctccaagataaaggagtgaatgattgggtgacactgggaaccaaagccaaagctgccgccctcttcaatcccatgacaggcgaatgcggagaagcaaaggtacgccaggccggagaacagacacaagtctacctccaactgaaatccggcgaatcggtgattttgcagacttatcaacagccgctgcaagctgcccgcccctggaaatatattcaggaacaaccgttcagcctcagcctggatcatggctggaaactacacttcgccgaaagcgaaccgaagataaagggtacgtttgacatcgaccgcccttgctcatggacaggcatcgaccatccggcagccaagattaacatgggcagcggtgtttattcattggatatcgaattgcccgctctgcaagccgatgactgggtactcgacttgggagacgtacgcgaaagtgcccgtgtccggatcaacgggcaggaagcgggctgcgcatgggcagtaccttaccagctacgagtaggtcatctgctgaaatcaggaaaaaaccacatcgagatagaagtcactaacctccctgccaaccggatatctgaactggacaggcagggagtgcagtggcgcaaatttaaagagatcaatattgtcgatctgaattatcgtccagccaactatggtcactgggctcccatgccttcgggattaaatagcgaggtccggctgattccggtagattatttatctttcaagacacactaaagttattatttaaatctactttcagttcaagataaggcaatatagttcgggcctgactaaaaagtcagtagtatctccaattcccctccttcgggaaggaggggtgcccatagggcggggtggtaggtaaaataaggttgtatctaatttgctatgaataaaagcattgcgtgtttacctaccacctccccctacgggtactcctccttcccgaagctaccctttatacacaagtatatattattttttttatctttgcttgatgttattagagacagatcaaattcgtgatcctcggcttttgcggcgtttaaacttaatttgctctcagatggttgt

SEQ ID NO: 92 - DNA, 30435 bp, Bacteroides thetaiotaomicron
ctaaaagaaagaagggcgttctgatagacgtgcgctgtagaatagcggccctcctctcgcaaacggccgatatagatatcggcacatcgactaaatccatttttattcattatttacatcactagttttattacaacctacaaagtaagatgaataaacacgatatcttagttttatcttgtttgactatattaaaattactaaaaagctgatgctcacgaatccgtaaccccataaaaaatgtgagagaaaacctttcaattttctctcacatttggaaaacaataaaattaaactcacttactaattgccaattcgttcgctattgctttcttttaaaacagcaattggcatcattcttcgttcttttcaagagacttcttctcttaagcaatctaattctctacctaattattaatttactccccttaaaattctgtctagccatggacagttcatccacctgttatctattgtctgtttataaatagttccttatatttataagaggagctttctttccttttttaccaagaaaaatagaagaaaaaatagatttaattaaaaaacgccttccagagcactctgagaggcgttttttaattgcagaaatatttcacttcctgctttatatcaaggataatttctcttttttacggtgtggacttctgttcccgtctattctaatatgactttctgcccgctcaactgataattgattcccaaagaaccaaatacttttttcaatgtttcgtgcagatctctcgtcaggatggttccgttatagtacagttcattatatttttcacaccctaccacttccacatcaaagatatgctgaatatctgctactacattgaccagcggatcatcttcataaccgagtacttcgggcagttcttccttttcctgaacaggaccaatcttattctcatcacagcgtacactttcaccggcattcaatgtctgttcgccgattggtgtctctaccttcactgttccctcttcacaattgacagtgatcgtttttccttcctgctcgaccaagaattttgtacctaacaccgtaacatctccggcttccgttcgtacagtaaatgttttacccggagtcacgtcaaaaaaggccgatccgagcagattcagtttacgcccccaaagccaactcactttattataagacaaagttgagttttgcatcagcttcacagaactgccatccggtagcttgtaatcgacagctactgcttcagacgtaatcttctcttccgacagatagtaataaccgcctattccgaaaagcaggataaacagggccgctactctccagtagatacaactgctcctaagaacaatcagtttctgtcttcctgcagcgttcggtctgcttgttaatgcatccgcacgtttttcttcacgaaattcttctaacttcccaccaactacagacttccgtgcaaacaactcacctttcagaggaagtttgccgtcttccatatattgttccagaagttctttcctattctccatatcctcacctcaattaaaaatccataaattagcagctacagtcaacaggaatgatttgctcaatcgctctctcagtctggatattgccatgtgggtagtattataaacagtacgggaagtcagccccatcacttcggctatttcatccgaatccagttttttataatacttcaggtataatacctctctctgctgctttgtcaagccatttatttctttctgcagaacttctaactgctctctttcaagttcggaacggacaatcgctgtttctatgtctatctccaaatcgaatctatattcgcttgaattaacttcgtccaatgatgtgaatacgccattagcagttttcttcaactcattcagcagcatgcgtttcagcgccacacacaggtaagcggatatggactgaggctcggaacaactctgcctcttctcatacagataaacgaacaatgactgaatggattcagttaccagattatcatcaccggcaatcttcatcccatatccgtaaagtaaatccgaatattcattgtagagttgccggaatgcttcttcatccccctgctggattttctcccaaaatgttgtattcatttctccttcccttatttacaggtaacataattcttccccttttaccaattatttttgttaaattccaccaagcagactaaaattcacttgtgaagtggaatttaatgtgcttgaagtccatttgtgccatctgaagcacatagcctgaatcggcaaggaatacgtcacgtccttccctgtccttcgccatatattggtatttacgtttcttgaaagcttccagctcagcaggatcatcgctttctacccaacaagccttgtacaaacttaccggttcccaacggcaagaagcattgtactcgttcagcagacgatactggataacctcaaactgcaactgtccgaccgtaccgataatcttacggccgttgaactgattgacaaacaactgtgccacaccttcgtccatcaactggtcgataccctttgccagctgtttctgcttcatcggatcggcattttcgatatacttgaacatctccggcgagaagctgggcaagccgcggaaatggagcagttctccttccgtcagcgtatcaccgatcttgaaagttccgttgtccggcaaaccgatgatatctcctgcataggcttcgtcaatggtcgttttccgctgcgccataaactgggtgggcgatgagaaacgcatggtcttgccatgacggacgtgctgatagggtgcattacgtacaaatttgcccgaacatatcttgcagaatgctacacacgaacgatgattcgggtcgatattggcggtaatcttaaagatgaatccggtgaatttcggttcgtccggtttcacttcacgctcttctgcctgtacaggacgaggactgggagcaatctccacaaagcagttcaacaattcctgtacaccaaaattattcaaggcagagccaaagaatacaggcgcgcaatctcctgccagataagattccacatccagttccggataaactccttcgatcagttccagatcgccacgcagtttgtctgccagcggcttaccgatctgcttatccagttcttccgtatgtatgtcgacttctaccttctccgtcaccacttgtttggaaggttggtacaagtccagtttcttctcataaatattatatactcctttgaagcgggctccctgttcgataggccatgacagcgggcggacctgaatcatcagttcttcttccagctcgtccagcaagtcaaacgggtccttaccttcacggtccattttattaacgaaaatgatgaccggagtttttctcatacggcacacttccatcagtttacgggtttgtgtttccacacctttcgctccgtctactacaatgataacgctgtctacagcagtcagcgtacggtatgtgtcttcggcaaagtcctggtgacccggagtatcaagaatattgatcttgtagtcccgatagtcaaattccattacggaagttgtcaccgagataccacgctgtttctcaatctccatccagtcggaagtagccgttttcttgattttattgctcttgaccgcacctgccacctgaatctgaccaccgaaaagcaataacttctccgtcaatgatgtcttaccggcatccggatgcgcaataatggcgaatgttcgccgtctctgtatttctgtattatctgccatatttattataaagtatcgatgcatcttttcaggctttcctcccaatgaggtatttcgatgccgaacgttgtttttatttttgttttatcgagtacggaatatgcagggcggttcgctcttgtaggatattccgccgtatgcagcggtttcactttgcatgaagtgattcctgccaaacgatgaatagctaccgtaaagtcataccaggagcagactccttcgttgctgaaatgatagactccacgaacgatgcctttattaataatagcaaagatggcctgtgccaggtcattggcgtaagtaggagttcctacctgatcgaaaatgactcccagactatcacgctctttgcccagacggatcatcgtcttcacgaagttgttgccaaaagtggaataaagccatgcggtacggataacgactgacttttcgcaatgattcagtacctcatattctccttcaagtttcgttgttccatataccgaattcggacatggatcgcattcttctgtataaggaatatgagcggtgccgtcaaaaacatagtcggtagacacctgaatcatcgccgcaccattaaactgcgctgcacatgccagcgttttaggagcttcactgttcagcttgtaagccagttccgaatcatcttccgctttatctactgctgtatatgccgcacaattaacaataagctcaatccgcttttcagcaatatatgcccaaacagcgtccttattacagatgtccagctcctgcacatctgtgaaataatacgtatgttgcggattctcttttgcaagaacttgcatttcattgccaagctgaccattggcacccgtcactaaaattctcatttattcatcaagttttaattcccctttcaggtctttatcgtaatagtttgccaacatggaaagaaagctgctgatagcttctaccgccttcatagtcccctcgctgacaggctttttctgcagacgaagcaaaagtagtccatagagtgcttcgaagcaagtctccagttccggctcttcttttttgccattcttattccgcagttctacaataaacggcaatgctttgaaataagcggcactgtagaaaggaaatttgggagaagaagtcaacgcattatgaagctctgtcagattgatgatgatgttcttgttaatctgcaaatgacctttttcacgtaccccttcctcattcatcatggtgatcaggttgccgtaccactctcgcagggcaggacgctgatcttccggataacgggcgatcacattcgcctcgatctcctccagctcaccatgattggcgcggatcaggtcttcttcttgccacatatatataaggtactcggcaatgtttttctctttaagctgtctggctatctgattcataagttttcttcttaataaagtgactctcccagcaacgtatagattaatcccgccaccgacaccagcatcacaatgctgccaatcacacgattcagtatccagatgccccgtaagttaaacttagtgcgcactttattcacaaaataagtgattccgagccaccacaccagcgcccccgaagcaatggcaagataccccgtaatttcttcgaacaccacgacaccgggctgcacaaaggcaaaacgggcaaatagtccgataaacaggaatataatcagaggattggagagcgtgacaaagaatgcggtaatgaaattgtgaaagtaagaacctttattggacgatgccggacggatggattgtaccggattgctgcgaaaggtatagattccgaaaagtagcagcatgatgctgcccaacaactgcagataaaaaatattcttattaatataatcgaacacaaagctcataccataacctgtcaacagagcataagctatgtcgcttaatgaggctccaagccctgtcacaaatccataccagcgccctttattcagcgtcctctgaatgcagagaacccccaccggtccgagaggtgcggacacaacaacgcctataataaagcctttcactattatatcgaatattgtttcaatctgaatcatgccgcaaatatcgcacttttttatgagaagaggataggatattaacgttttttccacacaagagtcactatatacaccaaaattgcttatctttgcgccacagaaaaatcgtaaaatcaaaaaataaacatgattctttttttcagaaccccttccaagagcgtgattgccgtagagagcaaccatcagctcaccccggacgaaagtaataaactctgctggctttttggagaagccgtgacggaaagtgaagaaaacctgaaaggctgtttcgtcggcccacgccgcgaaatgattaccccttggagtacaaacgcagtagaaatcacccaaaacatgggacttgaagacattctccgcattgaggaatattttccggtaaaagatgaaaatgccgactacgacccgatgctgcaacgcatgtacaaaggactcgaccaaaacgtattcaccaccaaccgccaaccggaacctatcgtatccatcgaagacctcgaagcctacaacgaaaaagaaggcctcgcactctcgaaagaagaaatggactatctgaaaaaggtagaaaacgatctgggacgcaagttgactgactccgaagttttcggtttcgcacagatcaactctgaacactgtcgccacaaaatattcggtggaacattcatcatcgacggtgtagaacaggaatcatctctgttccagatgattaaaaagaccacacaggagaatccgaataaaatcatctctgcttataaagacaacgtagccttcgccgaaggtccggtagttgaacagtttgctccggcagatcactcaaaacctgacttcttccaggtgaaagacatcaaaagcgtcatctcactgaaagcagaaactcataacttcccgacgactgtagaaccgttcaacggcgcatctaccggtacaggcggtgaaatccgcgaccgtatgggtggtggcaaaggttcatggccgatcgcaggtactgctgtctacatgacttcttatccccgcacggacgaaggccgcgaatgggaagatattcttccggtacgcaaatggctgtaccagactccggaacagattctgatcaaggcatccaacggtgcttccgacttcggtaacaagttcggccaaccgctgatctgcggctcagtattgactttcgaacacacggaaaacaacgaagtttatggctacgacaaagtaatcatgcttgcgggcggtgtaggctacggcacacaacgtgactgcctcaaaggtactccggaagcaggaaacaaagtagtcgtcatcggtggagacaattatcgtatcggactgggtggcggttccgtatcttctgtagataccggtcgttacagcagcggtatcgaactgaatgccgtacaacgtgccaacgccgaaatgcagaaacgtgccaacaacgtagtacgcgctctctgcgaggaagatgtgaatccggtagtttctatccacgaccacggttcggcaggtcacgtaaactgtctgtcggaattggtggaagaatgtggcggtctgatcgacatgagcaaacttccgatcggcgacaagacattgtccgctaaagaaatcatcgccaacgaaagtcaggaacgtatgggacttctgatcaaagaagaagccatcgaacatgtacgtaagatcgccgaacgcgaacgcgctccgatgtacgtagtaggtgaaacaaccggcgatcaccgcttctctttccagcaggcagacggcgtacgtccgttcgacctggccgttgagcagatgttcggttcatctccgaagacttatatgatcgacaagaccgtagaacgtcattatgaaatgccggaatacgaattgccgaaattacatgaatacctgaccaatgtgctgcaactcgaagccgtagcttgtaaggactggctgacaaataaggtagaccgttccgttacgggcaaagtagcccgccagcaatgccagggcgaacttcaattgccgttgagcgactgtggtgtcgtagcactcgactatcgtggtgaaaaaggtatcgccacttctatcggtcacgctccgcaagccgcactggctgatccggctgccggctctatcctttcggtatccgaagcactgacaaaccttgtatgggctccgatggcagaaggcatggacagcatttccctgtctgccaactggatgtggccgtgccgctcacaggaaggtgaagacgcccgtctttacactgccgtgaaagcattgagcgacttctgctgcgctctgcaaatcaatgttcctaccggaaaggactctttgtccatgacacagaaatatccgaacggcgagaaagtgatttctccgggaacagtgatcgtttctgccggcggtgaagtatccgacgtgaagaaagtcgtatctccggtattggtgaacaacgaaaagacaacactctaccatatcgatttcagctttgacgaactgaagctaggaggttccgcttttgcacagtctctgggtaaagttggcgacgacgtaccctgcgtacaggatgccgaatacttccgcgatgctttccttgccgtacaggaactggtgaacaagggactgatcctggcaggacacgatatttcagcaggtggtctgatcactacattactggaaatgtgcttcgccaacgttgaaggcggtatggaaatcagcctcgacaagatgaaggaacaagatatcatcaagattctgtttgcagaaaatccgggtatcgtgatccagatcagcgacaagcataaagaagaagtgaaaaagattctggaagatgcaggcgtaggattcgtgaaactgggtaaaccgaccgacgaacgtcatatcctggtatcgaagggcgacgctacttatcagttcggcgttgactatatgcgtgatgtatggtattcttcttcttacctgctcgaccgcaaacagtctatgaacggctgcgcaaagaaacgtttcgaaaactacaagatgcaaccggttgaattcgctttcatgcccggattcaaaggtaaactctctcagtatggtatcactccggaccgtcgtactccgagcggtgtccgcgctgccatcatccgcgagaaaggaacgaacggcgaacgcgaaatggcttactcactctatcttgccggcttcgacgtgaaagacgtgacgatgaccgacctgatcagcggacgcgaaacactggaagatgtaaacatgattgtttactgcggtggattctccaactccgacgtactcggttcggccaaaggatgggcaggaggtttcttgttcaaccctaaagccaaagaggcacttgacaagttctacgcacgtgaagatacgctttcactgggtatctgcaacggttgccagctgatgatggaactgggacttatcaatccggaacacgaaaagaaaggcaagatgctgcacaacgactcacataaattcgaatcgacttatgtaggcttgacaatcccgaccaaccgcagtgtaatgttcggctcattgagcggcagcaaactgggtatctgggtggctcacggagaaggtaaattctctctgccttacgatgaagaccaatacaacgtagtggcaaaatacagctacgatgaataccccggcaacccgaacggttccgattattctatcgcaggtcttgccagcgccgacggccgccatctggcaatgatgcctcacctcgaacgtgctatcttcccgtggcagaatggctgctatcctgctgaccgtaagaacagcgatcagattactccatggatagaagcatttgtcaacgcccgcaaatgggtagaagagaagactaaataagatatctttctatcattgaaacggaggctgttatttgttataaagtaacagcctcttgttttaactccttttccatacccaaagtctgcatattacaacttaatttccctaaataaacaggatatacaaatagctgcgaaagctcctgtatacttcactttgagagcaccgttatcttaacctaaaattttgtagtgtcgaaaaatcttcttaattttgtcaaactttccccctcactaaagattcaataacccataaaagtcctatttgtatgaaaaaatggctttttttattattattgtttcctctgacctgtgtcgcccagacctatcagtatctaggagtggaagacgggttaagcaaccggagagtgtactacattcaaaaagacaatgttggatatatgtggttccttacgcacgagggaatcgaccggtacaacggcaaagagtttaaacggtataaattaatggacggcgacaaagaactcaactcgctgttaaatctgaattggttatatatcgatccggaaggaacgctatgggaaatcggtaagaaaggcaagattttccggtatgaccgtattcatgacactttcgaactcgtctacaagttgccgatagaagactttaaggatttaccggctcccattactttcagctggatcgatcataacaatcatatctggctgtgcaacgaagaaacgatcttcctttacaacacccggacggaagaggttactcatgttaaaaactgcctcagcgaagctataaacgacatcgaacaaatcgacgaatcccactattttatcgggacggagatgggtattcatcatgcccaactgaaaaacaacacactgcaacttctcccctgcgacaagctagacaacgtcaatattcaagttaacgatttacacttcgaccccaaaatccgcaaactgttcatcggtgccttcgaacggggcgtcatggtttacgacatgaacacaaaaaccatcacacaaccggaagtcagcctgaaagacgtaagtatatcacgcatcaaaccactgaatgccaaagaactgctgattgctaccgatggcggaggtatctataagatgaatgtcgatacgtaccagaccgtaccttttatcgtagcagactacaacagctacaatggcatgaacggcaacagcattaacgacatctacatagacgacgaagaacggatatggatggcaaactatccgataggaattaccattcagaacaatcgttatccgagttataaatggatcaaacattctgtcggtaataagcagtcgctgattaacgaccaggtgaactctatcatagaagacagcgagggagacttatggtatggcaccaacaacggaattagcctgcaagactcaaaaaccggaaaatggcgctcgtttctgagcacctttgagaatgtacagaacagcaaaaatcatatatttacaaccttatgtgaagtatctcccggcattatttgggcaggcggatatttctcgggactttatcagatagataaacgcacgtcgaaaacaacttattttacacccgcttcgtatgctcatgaaagtatacgtccggataaatacatacgtgacatacgcaaagactcacgcggttatgtatggagcggaggatattataacctgaagcgaatcaacgtacaaaccaaagacatacggctctaccacggactgcattccgttaccgccatcatcgaaaaggatgacaaaagtatgtggataggtacggcaacaggcctgtttcttctggatatagaatccgggaaatatgaacgcatccaactgccggtagaatctacctatgtctactccctgtatcagaccaaacaaggctcactgtatataggtaccagcggatcgggagtactgatttatgatccccagacaaagttgtttacccattattatacaggaaactgtgccatgatatccaacaatatctacacgatattatcggatgaagacaatgaaattctattaagtacggagaacggactcaccagcttctatcccaaacaaaaaaccttctacaactggacaaaggaaatgggactgatgactacgcacttcaatgcgttgtccggtaccctgcgcagaaataacaattttatcttcggtagctcggacggtgccatagagttcaataaagacatgaagctccccaggacgtactcttccaagatgatcttcagtgatttcaagctgttttatcagacggtatatccgggagacaagaattcaccactggaaaaagatatcaacgaaaccaaagaattaagactaaaatataatcagaatatcttttcactgatggtttcttccatcaactatgattatccttccaatgttctttattcatggaagctggaagaattttacgaagagtggagcaaacccggcaatgaaagtacaatccgttataccaacctcgctccgggaaaatatgtattgcgtgtgcgtgccatctccaacgaagaccaacgggtgatgcttgaagaaagaagcattgatattatcattgcccagcctttctggctcactccctgggcaatgatattgtatgcaatcctgatttccctcattgctgttatcatcctgcgggttcttattctgaaaaaacagcggaaggtttccgatgaaaaaatacacttcttcatcaatacggcacacgatatacgcaccccgttgacattgattaaagctcctctggaagatttgcgcgaaaaagaagctctgagcaaggaaggcatagccaacatgaacactgccatacgcaatgtaaatgccttgttgcgtctgacaacgaatcttatcaactttgagagagcagatgtttattcttcggaattatacatttcggagcatgagctaaacacgttcatgacagaaatattcaatgcatttcagccttatgccaatatcaagcatatcaactttacgtacgaaagcaatttccggtatatgaatgtatggtttgacaaggaaaagatggaatctattctgaagaatataatatcgaacgcattaaaatacacgccggaaaatggtaatgtgcagattttcgtatcagagaacaatgattcgtggagcgtggaagtgaaggataccggaatcggtattccagccagcgagcaaaagaaactgttcaagcttcatttccgcggcagcaatgccatcaattcgaaagtgacgggaagcggtatcggtttgatgctggtatggaaacttgtccggttacacaagggcaaaatcaacctgtcgagcgtggagaatcagggatcggtgattaagatatctttcccaaaagacagcaaacgcttccataaagcacaccttgccacaccaagcaaacgccggcaagagataacaagtacaaccaatgtgcctgccagcatctatgagaatgtgcataaggaacagaatccgaatcatcagcgaatcctaatcgtagaagataatgatgaactgcgcaactatctgtcacagacactggcagaagaatatacggtacagaactgctgcaacggcaaagaagcactgaccatcattccggaatacaaaccggaactggttatctcggacattatgatgccggaaatgagaggggatgaattgtgtgacgccatcaaaaataatatcgagacgtcgcatattcctgttatcctgctaacagctcttaataatgaaaaagacatattgtccggccttcagattggtgctgacgagtatattgtcaagccatttaatattggaatattaaaagctaccgtctccaatctgttgatcaaccgcgcccttttgcgaagcaaatacgggagtctggatatggacgatgaggatgatcatgaagacgaatgcatcaactgctcgcaggatatcgactggaagtttatcgccaatgtacggaagaatatagaagataatatagacaatccggctcttacagtagatgtgctttgcaatctgatgggaatgagccgtaccagcttctacaacaaactcagggcattgaccgatcaggctccgggcgattacatccgcctgatccgcctgaaacgttcggtgaagttgctgaaagaaggtacacacagtataacagaaatagcagaaatgacaggatttagtgatgcgaagtacttccgtgaagtattcaagaagcacttcaacgtaagccccagccaatatggaaaagaaggcaagccccacaaggagggcaaggctggaaaagaaaacaagtccgataaggaaggaggagaaaaagaagaatgaacatttacctcgaatcatttggaatcttttttaaaataggcgctttcaccattggcggaggctatgcaatggttccacttattgagaatgaaatcgtaaccaaacgaaaatggatcgcacaggaagactttatcgacctgctggctatctctcagtccgctccgggtattctggcagtgaatatctctatctttataggatataagctgcgtggcattcggggaagtattgtcacagcactggggactatactcccctcatttattatcattctggccatcgcgctctttttccattctttcaaggacaatccgattgtggaacgcatatttaaaggaatacgacccgccgtggtggcattgatcgccgcaccgactttcaccatgggacggtcggccaaaatcaaccggtacaacttatggatccccgtcgtatcggcattattgatctggctattgggcttctccccgatatggattatcattgctgccggtgtaggaggtttcctatggggaaaatttaaaaaagtggagagtgaacacccaaggctatgattcaagattcataattctaaattaaaaagagatgatttatcttcagttattttatacgttctttaaaatcggacttttcggttttggcggaggttacgccatgctttcgatgatacaaggtgaagtagtaacccgttatgggtgggtgacttcgcaagaattcacagacattgttgccatcagtcagatgactccggggcctatcggtatcaatgcggctacttatgtcggttttacgtccacaggaagtgtatggggatcgattgttgccacattcgctgttgttttcccctctttcatactgatgctgacaatcagcaaattctttctgaaatatcagaaacatccggtagtggaatctatttttgcaggattgcgtccggcagttgtcggattattagcttccgccgcactggtattgatgaatgtggaaaacttcggctcacctacagaagacacctacacatttgtcatcagcatcattatcttcctgatagcctttatcggcaccagaaaatacaaggcaaatccgatattaatgattatcgcctgcgggattgcaggactactgctttattaaaataaagtaataagaggctaactaaaaagtcagtagtatcttaaaatctcctccttcgagaaggaggagtacccgcagggggaggtggtaggtgaacatgcagtccttacagcttgaccttcttacttaccgattttgactcattatgaatacggtctaaagccgtcaccacatagcggtatttggtcttacccgtttcatacggcagtttgtagaaaggatttcgggtgatagctacgatatgtgacggatcatcaagattcaccttttctttgggaccgaaacggtatactacgtactgaatagctttgtccatttcagtctccgctttcggagcagtccagaaaagtatatagccatcttctgtccatacctttttcatcttacgtactttgcccggagctttatcatccataaagtcgaataccggaattaaagccggatatttatgatactcctgtaccaaggcatcccgatattttccagcgttctcgactacggctgccgcataccactggcaacttccgccgatagtctgataagaacgctgcaaagccatctttcgtggaagctggttgatagaagggttcttcggatcggcatgctgaatggtattcatgactgcctgaccgataaacaacggacggttttccgtatgcttcgcccaccagtcaaccagtgtttcgtaatcggctgccttgtgtcctatctcccaataaatctgaggaatgttataatcaatccatccttcacgtgcccaaagcaatacgtcggcataaagatcatcatagttctgcaaaccatttgtgttgctgcccaacggatctgttttctgattgcggtaaataccgaacgggctgataccgaacttcacccacggtttgatgccccgtatcgtttcatgaagtttcttgatcaggatatttacgttgccacgacgccagtccgccttattgctgaaaccgcctccgtaacgggcaaagctcgcattgtccgggaaatcgactcccttgatcggataaggatagaaataatcgtccatgtgaatagcatctacatcgtaacgggatacaatatcggaaacaatcttgcagatatgctcacggctttcgggaagtgccggatcaaaatagatctgatcaccataagtgacaaaccattccggatgttcatgataaatatgtgtcggtgccaattgattcttcaatgaagtcttcacacggtagggattgatccatgcatggaattccatattccgtttatggcattcttcgatcatgaattgcatcgggtcccacatcggggaaggcatttgcccttgtgttcctgtcaggaaacgactccacggttcgtgttgtgaagcatacaatgcatccgcttcgggacgcacttgaaagatgatcgcattaatacccgctccctgaagagagttcaactgaccgaccagtgtctgtttcagcttctctgtcggtatgccacggaactgtccgttgacagcctgtatccatgcagcacgaaactcacgtttaggatatgcattgcccgatggcgcctgcgctcttactcctgccgccagaagcagaactaataagaaaagatagtttttcagattcataatgttcttgagtcataaaataatgtggtgcaaagataatagatgcagatactatctccaactattattgaggccattcgacaacaaatcttgcaccacccgcgtagctggtgtccagatagacatttccatccactaattccatgatctgacggataatagacaatcccagcccggtgccctgagtgaaggtatccgcctttgcaaagcgttcgaaaatcgcatcccgaaagtgctcttcaattccgggaccggaatcttcgataatgaaacgtaccagacgattcggtttgtcttcttcataactcagacgtataaatccggtttccgtgaatttattggcattgttcagcaaaccgagtagcacacgcttcatccagatttcaaccgtacacacttcgaccggagtggaagaaggcatatattgcaacttgattccttctttcagattctgacgaatcaatcctaaacattcctgacaacacgcatctacactcactggcttcttcggtatatcatccgtctgagagtccatgtcggctatatcaatcacattatttaccaaatcaagcagatatgcgttgctgctctccatctgacgggcatattcttccatctcttcctgtgtcagcccaccggcagccatcaaggatgaaaaaccgataatcgaattgagcggagtacggatttcatgtgtgatatgctggataaaagagcttttcatatggctggccttgataacggccttatttgccgcatccagtttccggttcaacgacaaggagcgcatatagtagaacgtgataacaatcaacaatatcaacaccaggcatccgacaatcacggaagttataaagagattgcggttgacctccgcccgcaattccagcttatcgtgctccagcttgtccacttcgaattgcacagtatatttgcttaattgctcgtccagctctgccgaacgaatggaatcattaatatgcgcataagatttataaacctcgcaggcatcttcaaagcgtcccatctgctccataaactgggctttcaacaggtgattggcaggataacagctccccaccgaatgatgataatccatcaatgagtccagatagttgagtgccatctgattgtcattcaacgtccgcgcacaaagaattttatatcccaaccatccttcacggggaaaagcattcatattttcgtgataaaacttatccgcttctgcaataaacggttgcgcctccttcttccctttcaatgccagcgtagcaatcacttgaaactgataataacgcatggtaagctccggtcggacagggatatccttacgcttcattttctcaatcagtcccggcatacggttcaagtattccatcgcattggcatactcccctctagccagataagtctggatgatattcagtgacaccacataggcatcttcataaaaacccgcatcactaaattttttcagtgcggaagaatagtattcaagacagagcttgacgttgttgctgaacacccgatgattatatccgatacacatctcgctgcaagccattccgaaagcacttttggccgcatccgcatccttctgaagaagtccagtctcacgcatggcctcatcctgcaaacctttctcggtaagcaactgaatatactggcgccactgcgtatagcgattattgatattaccacgcttcaggcaccagtccatatattcatatgcaaccactttcaggctatccgtatttctcaaccggtaataatgggaagcaatctgagaataagcatcgtcgattttagcagtatcattctgctgccttgccaatcgcatatattcctgatagaaaggtataaaatctttctgacctattttatttgagacactgtcggaaagggcttccaactgtttttctttgtttgtgctactaaaggctaaagtagatgcaaaacacagaatgaataagctaataaccatccggatgtttttcacgattcaagtcaatttgttattattttgaaatgtttgttgtaaattccggaccaagatacgccaattatcccgaagcaatttctttttattaccaattataacatatcttaacccgaccaaaaacctttcttctatcaataaaatcgctaactttgccgactatcataaaaaaggagtattttatgtcagaaaacaaacatatttcgatcaaaggagcgcgggttaacaacctgaaaaacatcgatgtagatattccacgcaacaaacttgtcgtgatcaccggactatccggttcggggaaatcgtcgctcgcttttgatactctctatgcagaaggacaacgtcgttatgtcgagagccttagcagctacgcacgccagtttctgggacgaatgagcaaacccgaatgtgattttattaaaggaatcccaccggcaatcgccatcgaacagaaagtgaacagccgcaatccgagatctaccgtaggaacttccaccgagatttatgaatatctgcgcttgctttatgcgcgggtgggacggacatatagccccgtcagcggagaagaagtcaagaagcattcgacggaggacatcgtcaactgtatgctttcgcatccggaggggaccagatataccgtattgacccctatccgcctgcgcgaagaccgtaccctgcagcaacaactggagatagacctgaaacaaggcttcaaccgggtagaagtgaacggtgaaatgaaacgtatcgatgaatacaagccggtggcaggcgacgaagtttatctgctggtagaccgtatggcagtggcaaacacgaaagatgccatcagccgactgacggactctgccgaaactgccatgtatgaaggggacggtacgtgtatgctacgtttttatctgccggacggcaccaccaggctatataatttcagtacgaaattcgaagcggacggcatcacttttgaggagccgaacgatcagatgttctcgttcaactctcctatcggtgcctgccccgtatgcgagggcttcggcaaggtgatcggcattgacgagcatctggtagtgcccaaccgctcgctatccgtgtatgaaggggccatcgtctgctggcgtggcgagaagatgggagaatggaaagatgaactgattcataatgcggataagttcgatttcccgattttcactccttactatgagctgacagacgagcaacgtcgcacactctgggaaggaaaccaatacttccatggcatcaacgatttcttcaagatgctggaagagaatcaatataagatacagtacagggtaatgctggcacgctaccggggaaaaacaatctgtccgaaatgtcacggtacacgtttgaaaccggaggcaggatatgtgcgggtagacggaaagagcatttccgaactggtagatttacccatcactgaactaaaagagttcttcgaccatctgaacctcaacgaacacgacagcaatgtagcccgcagaattctgattgaaatcaacagccgcatccgctttctgatagatgtagggttgggatatctgactttaaaccggctcagcaactcactgtcgggtggagaaagccagcgtatcaatctggcaacgtcattaggaagcagcctcgtcggcagtctctatattctggatgagccgagtattggtttgcacagccgtgacaccgaccgtctgatccgcgtattgcgtcaattgcaggaactcggaaacacagtggtagtggtagagcacgatgaagaaataatccgtgccgccgattacatcatcgatatcggtccgaatgccggccgcctgggaggagaagtcgtttatcagggcgatatgaaagacctgaaaaaaggcagcaatagtcatacggtacgttatctgttgggagaagaggagattcccgttcccgaacatcgtcggccgtggaacaattatatcgaactgacaggtgcccgcgaaaacaatctgaaaggagtgaatgtaaagttccctctcaatgtgatgacagtagtcacgggtgtttccggttccggtaagagtacgttagtgcgggatatcttctatcgggcactaaaacgcgaactggatgaatgcagcgaccgcccgggagagttctcttctatcagtggaagcctgcgtgacttgaggaatatcgaatttgtcgatcaaaacccgattggcaaatcgtcccgttccaatccggtgacttacatcaaggcttatgacgaaatccggaagctatgggcggaacagcctctggcaaaacaaatgggatacacagccggacatttcagtttcaacagcgaaggcggacgatgcgaggaatgtaaaggcgaaggaaccatcaccgtagaaatgcagtttatggcagacttggtgctggaatgcgaatcctgtcacggtaaacgttttaaagcagatacactggaggtgaaattccaggataagaacatctatgatgtactggaaatgacagtaaaccaagccgtcgaattcttcaccgaacacggtcagaagaagattgtaaaaagactgcttccgctacaggatgtcggactgggatatatcaaattaggccagtcctcttctaccctatccggtggtgaaaaccagcgtgtgaaactggcattctatctgagtcaggagaaagccgacccgaccctgtttatctttgacgaaccaaccaccggactgcacttccacgacatccgcaagctgctggatgccttcgacgcactcatccgacggggacacagcattgtcatcatcgaacataatatggacgttatcaaatgtgccgattatgtaatcgacctcggaccggaaggcggagacaaaggcggaaatatcgtagcggtaggtaccccggaagaagtagccgcttgcggagcaagctatacggggcagtttctgaaagaaaagcttgcttaatgaataatggataatggctatgcagtaaacagcgcagctcattatccattttcaattatccattatccattgttaaaagtagaatccgaatccgaccttaacgccgaaacgtgacatgtcgctatcgttgaagcgccatttgtaatatacggcgggttcgatggttacggtgcgggaaaggaagtaagcgtatccggcttcgatgcctagcccccagtcagtctggtgatgtcctccgctccaacggaagcggttccagtcgagacctccgcccagataaacaccggtggaattaaagtagaaacgcattcctgttcctaatgtgtattcgtctacgggttttgaccaatcagcaccgacattaaccatcaatgcgataccgtcggcaaggaatgtaccggcttgcgcaccaataccaaacttcgccttatcgtttttactatacgaaaaatccaatcccgttacagaaggattaagaatcatttttcctttctcaaattgtgcctgggcagctattgataccaccagcagacaaatagctaaagctaatttcttcataaatttacttttttaagtgaatagattgttcgtcttttttacggcgttcacgcatttgttccttcttccggagcacgagccaaagcaagagtacgatgacgtaagaacctaccaccgtaagaatcttctccgtctggccgacttccgtgttgcgaggtaacaaataggctgccgttactgatacataaataaggaatgcgatagcaactcctgtcgatttttttattttcttcattctgatagttttctagttttttgttttcccagccagataaagaaccaggcaatagctaccactacgcatcctataccgatgcagtaggaaactatatgcgagagtcccagcccttcgggagcaatacatatataagtagaacaaacactcgtcataaataaggcggggatcagcgtaatccaataaggctttttggctaccacaaggtagactgtgatagcccagagggtgaacaccgccaatgtctggttggcccaggcaaagtaacgccagatcatgttaaatccgtccgcgtcacgcaagctataaagaagcagaccgatagctactgcgaacatcggaatacaaatgtataaacgacggcgcatacttttttgttccagtcccagaaagtccgccacaatcagacgggcggaacggaaagcggtatctcccgaagtaatgggagccgcaattactccaagaatggcgagcactccaccgatagctcccagccagtctttagtgatagcgtctactatcacggaagcattactttcttccattccattttcatggaagaaataagtagcggctgccgcccatatcaaagcaacgatgccttcggtaatcattgcaccatagaaaaccggacgtccatgacgttccgaagtcatgcagcgggccattaaaggactctgcgtggcatggaaaccggatatggcaccacaggcgatactcacaaacataatcgggaagatcggcagttcactggcatccggattggtattctgcaagccgtcccatagttcgggcaaaacagggtgattgacataaagcattaccaggataccgactgccataaacagcaaggctactgcaaacaacggatatattttaccgatgatcttatcgaccggaagcagggtagccagaatataatataggaagaccacgacaatccaaaaagtagcgtccagactttccggagtcagtttggccaatagtccggcaggtccggctacaaagacggaaccgacgagaatcatcagaagaacagtaaatccacgcattatctgtttggtagtcagtcccagataacggcctatgatttcgggaagactctctcccccatgacgtaaagaaagcattccggcaaagtaatcatgaacagcgcctgcaaaaatacttcccaatacaatccataaataagaagaagtaccgaacttcgctcccataatcgcaccgaatatcggacccagtccggcgatattaaggaattgaatcatgaatattttccaagtaggcaacggaatatagtctactccgtcggctttggtaagagccggtgttttacggtcgtccggaccaaagacgcgctccatcaggcgtccatacgtgaaatagcctgctatcaacgccagcaggcacagggtaaatgtaatcatggcgtgttgttttttaactgtcgcaaatgtaacataatctcacgaaacagcccaacaataccgacacttttgctaactttgcagggatttaaaacaaaaaataaagaatatgcaccgaactattttcattctttcacttttgtttcttgttcttccggcaaaggttcagatacaacctcctttcttttcaatgctaatatagataatccaatatatacaccaaggtctgaattactgcttcttcatttcatcagctgtcacgattttccatttatccaagtcttcaatttggccgcttctattgcctaccacctctgtgctgttggcagaagacaaaccaattcttgcttcaggagacagccccaatgaataatagccttcatcatccgtaggtgtcaggaacaatgcatatttaggatcatgcactcgccagtcatcacccggcttacccacaatcactttatctccattattcattacatgaaggttggtcgctatatttctgacacggaggatatgatacgtcaaattctcgatacaaaacaactgggacttcttttccgaatcatattttgcggcagaaatcactttcgaatccggattacaatccagtaccataccggttgccttgtttaccaaatagacctgagatacattatcggttacataaggcatatatttttccttgatagttactgatttcagtttggcatcctgtcctctccattgtacagtcactttatgtttgccttttatccgacggtcgaaaagagcagattgtgtagtgaaattcttagagtcggcacccgaaacatcaaccgaggcaaaaggaattgtttcagtatccagatagaaatccaagtatcccgatttctttttattcaattgcacgtcaacctctactttctcatacgtaggcaatgagccaaaatgtacatcgaatgacaatctcgtaccgttcttcgctttttcaatagcaccattcttcatcttcgccttcgaacccgaaagagaaatatccgaagcagccactgttatcccaccggggttcataacgaattcacccgttatcgccttatacacttccttcgctataatataatgccctctatggtcgggatgcacccaatcgttgccacccggcataaattccggatgtcccttcaagggattatacagatctacacagaccagattaagttcctccgcaatctctcttacggcaggctgaatataattctttgctacattgtcatcaaatgaaccaagaaatcccccatcgccataatacatcggcggaggcgtacaaatataaatatccggtttagtcgaaagagcctggaatttagcgatcaacttcttatagtctgctttaaaagtctctttaccatatttttcgaaattcttcttgttggcatcatttgcaccaaacttaataatgacaatattaggtttatactcaagtgccgctgcgcattgctcagaattaatgtaagcgaattgatattcattaggattttcgggagtagtcgcatcttctcttaattttataaataccccggaagagcctttaccaaatttggtaacttcataatcatcaccgagcatttcagccagaggcatcgcgtaataaccataatcattcgttcccccggtgatactgtttccaacagtagcaactctaatctttcccgtctgggcagtcagactcgccgcaaacaaaagacagagcgacacagatagtagctttttcattgtttattatcttgttatattaatattttatatttcgtaccttattaaaagacggctaagaatgcagataccactaaaagagaatcagtaattttctgtcaaatagcattaaataaaaaaggaataatcaatttacggacatttttgctagctttgcagagatttagcatctaaaagggaataatatgcaccgaactattttcattctttcacttttgtttcttatccttccggctaaggcgcaacccaagcacgaagttcgtgcagcatggattacggctgtatatggtctggactggccccgtacacgggccacgactcctcagggcatccgcaagcaaaaggaagaattggtggatatccttgataaactgaaagctgccaacttcaatactgtcctgtttcagacccgtacacgcggagatgtgctgtatccttcttccatcgaaccgttcaattctatcctgaccggaaaagtcggaggaaatccgggatatgatccgttggcttttgcgattggggaatgccacaagcgggggatggaatgtcatgcgtggatggtgactattccgctaggcaacaaaaagcacgtcgcttctctcggcaaacaatctgtcaccaagcgagtgaaagatatatgcgtgccttataaaaatgaatatttccttaatccggggcatcctgctacgaaagagtatctcatgagactcgttcgtgaagtggtggagcgctatgatatagacggagtgcatttcgactacctgcgctatccggagaatgctcctctattccccgacaaatacgatttccgccgttacagcaaaggacgtactttggatcaatggcgacgggataacatttccgaaatcgtccggtacatatataaaggtgtgaaagcaatgaagccgtgggtaaaggtaagtacttgccctgtaggaaaatacagagatacttcccgctattcttcccgtggttggaatgcgttctataccgtttatcaagacccgcaaggatggctcggagaaggtattcaggatcagatatatcccatgatgtattttcagggaaacagtttctatcctttcgcgctcgactggcaggaacagagcaacggacgacaggttattccggggctgggcatctatttcctccatcccgacgaagggaagtggacacgcgacgaagtggatcgtcagattaatttcatccgtaatcagaaaatggcaggagaagggcattaccgtgtcaagtatctgatggacaatactcagggaatttatgacgaactgattgagaacttctatgcctatccggcattacagcccccgatgacatggttggataacgttccgccgtctgccccctcagcactcaaagttacgtccatcgacaacggatataccgaattgaactggcaaccagcgacggataatgaccaacggaataaaccgatgtacgtgatttatgcttccaatgaatatccggtagatacaaagaaagcggaaaatattgtcgcacaaagtattcgtgaaacaagttacatttatgcacccatccagccttggaatgccaagaagtattttgcagtaacggctatcgaccgttgcgggaatgagagtgcacccataaatggagataagtaggcatttcagacagtattaccacaatatgacttttccgatgttcaccaattccaatttagcagtatcttcaaagagtttccattgcttgaaaccagagtttcatcggtgtgaaactgtagtttcatcggtgagaaactagagtttcatacgcttgaaactttagttccaaacgctcgaaactatctgaaactactgttgatttgattgacttaaccgcatgttccaatcacattgaacgcatcagctacttcaatagtactgctctctctgaaaacattaaatcatatatcagtcaataatacataaattatcagtccttaatacttgatttctcaattattaatatctgagaaatcaaacgttaacagttgagatatcagatattaacatcctgtaaatcaaagaataacacagtaaaaacggtatttatcaggacgatgcagagtgagagcaagtccttgctctcactctgctaccactggatctctaacagctaaaacatcgatgaataaagggatacagacgaactgttagagcatgagagcaaaagcactatctttttcactgggggagagtaagcaaaagaaacgcacgataccggctttgaggcgtcaccggtactaacggcaaatatccggcacacacccgattattctctacggacaaagggaacgaagccgacatctgccgatgttcctccaaagcctgaccggctaaaggataataatcaatccgaaaaactccttccgcatccgcagccaaataacgatccgtcaagagccatgccaccacccccatattcattcgcagattaatttcgacacaaggatgaatccggtaaacaggcgcttcatccggaaaatgacaaatcatcatatccactcccaagtatccatgataaaagccaccgaacaaagctgacaattcttcttccaaacgagtccgcagcctgataaattcttcttgtggcacataagccgatagtttctgcagaatcttctcgtcagacagcaagtcattccctgcatacatcccactcccacccgtgtggaagaccgaatatccggcaaaaacaacccttcctctcccgtcagcataaaactccatagcgaaatcttccaccttattatatataggttcgcctaccaccccaccctgagaagcagcgacacgggcacaccaaccggaaataaaagtagtaaatatgcctttacaccaattcaatcctttcccgcttccggaaagcggagcttttaacaagcacgcttcccgcccttcgacgaacgcactgcactccgccaaagtactcaaataaaaagattctccacagaagtattcattcaaccgcaacccaggcaacaactttaccgcctgcagacgatgcgaatgctctctcagaatattcatataatccgcagaaggcagctccgtctgatctgcccccaatgtcatcaaacgcttccgcaaagcagggtcccacccccacggagagaacttccggtctttaccgtcagccacttccggttccgtcaacaaggccacatccatgcccaaaagttcactctttgttttcaggaagtccgcattataagcagacggtgcaagcaccgcacttcccgcttcggcataccacataggaagcaacgccaggtcactcgccatctgtcgggcggaagccggcgccatatagttcgtctcaccgcttgccaacgccatatcatgctccggattgaatatataaacaggtcttttcgtcatgtcaaagatggattcaacacattattctgcaaatatatacaggaaataatcaggaacttacacaataaagagaaacttataaattaaagcacatttttgctatctctactttgcaaatcctaaaaaaagcactatatttgccagccgaaaaacaaagaaacgaaatggaatcattctatcgcacacacgcctacctcgttgagcacaccaatgcccccgttcgccgcgatcttatggacgagatcgactggagtgaccgtctgattggtatcaaagggacacgtggcgtaggaaaaaccactttcctcctgcagtacgccaaagagaaattcggcaccgaccgttcctgtctgttcatcaatatgaacaacttttatttctccggtcacagccttgttgacttcgccaacgagtttcagaaacgtggcggaaaagtactgctgatcgaccaggtgttcaaacatcccgaatggagcaaagagctacgaatgtgctatgaccgtttccccagcctgaagattgtcttcaccggttcttccgtcatgcgactcaaagaggaaaacctcgaattgcgtgacattgcgaaaagttataacctgcgcggattctctttccgtgaatttctgaacctgcagacaggaatgaaattccgggcatacagcctcgaagaaatcctcagtacacatgaacagatagccaaaggagtactttccaaagtacgaccgctggattattttcaggattacctgcatcatggtttctaccctttcttccttgaaaaacgtaatttctcggagaatctgctgaaaacaatgaacatgatggtagaagtggatatcttgctgatcaaacaaattgagctgaaatatctttcaaagataaaaaaattactatatttgttggctgtggacggaccgaaagctccgaacgtgagccaactggcaagtgacgtacagacatcccgcgctacggtaatgaactatatcaagtatctggcagacgcgcgtctgattaatctggtttacccgaaaggagaagaattcccaaagaaaccgtcaaagattatgatgcacaactctaacctgatgtactccatttatccggtgaaagtggaagaacaggatgtactcgacacgttcttcgttaacactttatggaaagaccataaggtacataaaggagataaaaacgtctctttcatggtagacgaagtgatgccgttcaaaatttgtgcggaaggtacaaaaataaagaataacccggacgtgacgtatgcgttgcaaaaggctgagataggccgcggcaaccaaatacctctttggatgttcggattcttatactaaaaagatttatttacttaaatat

SEQ ID NO: 93 - DNA, 30220 bp, Bacteroides thetaiotaomicron
atattatatatacaataaaaaaggcatatcgcctgatgaatatccgatatgcctgaacgactgatctctagttattatttccgctttcggacaggtaatactatcctgagtacaatgtatcctaataatccggaaagaatagtccccgatagcactccgaacttagcctgattcaacagaacagggtagtttgcaccaaaagaaagattggcaatgaaaagcgacaccgtaaaaccgatccctcccaacagagctataccggaaagattcttccaagtcatgcccggcggcattggagtaagttttatctttatagccaaccaggtaaagaaataaattcccgcaaatttaccaaacagcaaccctgctgccactgccatccctacacttcccaccaactcaccgccgccactaaagacaacgcctgcattgacaaaggcaaacaacggaagaatcagataattgacagctccatgcaaattatcctccaaagactgcagaggactgataacacggtcggaagcagattcgacctctttcagtttggcaatctgctcattagtcaatacgatacttcccgattccaccaccgggaaacctgcaattgtatgacgaatatgctcgatatattttccaacatctagacggggtttcgccggaataacaaacgccagaataactcccgaaatggtactatgaataccggattgcaaaaataaataccatataacgacaccgatcactaaaaagaaaatcttattggtagtcccacgcttccctataaaataaagtaaaacgtaaagcaatgcggctatcaaaatatacccatacgacacatgcgaactataaaaaagagcaattacaaggatacctccgatatcatcaactaccgcaaaagccgtcagaaatatcttcaggctcaacggcacacggcttcccaacagacttaatacccctaacgaaaaagcaatatccgttgccattggaatggccaatccctgacttcccgcactgcccggaggacagattgacatgtaaacaatcaccggaaacagcataccgccacaggcagcaataaagggaagcgccgccttgcggaaggaagaaagctcaccaaccaacaactcccgtttgatttccaatcctaccagcaagaaaaagatggtcatcaacccgtcattgatgaactcgatcatccgcagattctctccgccatgcgaaagcagattaaaattaccgatctgcaaatgaagttcatgcaaaaggaactcctgataaaccggagcaaccggagaattggctatgatagcagccgctattgccgctacaaacaaaaggatactcgccgcaatattcattgacgagaaatttcgcattgtacgcaaaattgtcataatgaaaggtgtttatagtatttgatccgcaatatatggatttttttaatcattatagctccttaaagccaagtttttcacccaaaggacaaatattcctgtcagaataagattcaacaccaatgtaagtacggaaatgaccagtgccggaccgccgagattataacccaatgcaataaatataattccggcacctacctcaccgcgggtaaacataccaatggaaagggccagtcgctcactcaacttccggtcacgatagaagaacatcggacaaagtttgcctatattcgataagaaagagactatgacaacatggaacaaaatcattccccaggacatcatctcctgcgaacctgtcaccgaatgcgttcctgtatgagtttccgcaaagttaactccgataaaatgaggcatactcatacctaccaggaacataaacaggaaggagattccagtagagacttttcgttctacaggagtatcgtgctctttatgcttcatgatcatacccaatacaaatgccggcaacagaacttcgatatggatacttccttcttctccatacagctctttactgccgagataaagtatctgcgtagccagaaatatgataacggaatagaagagaatagctttccaatcctgccgccagttatacttattcagttgtttccatccaatggacaacagcataaatacaataaccaccacaataatcagctgccaacgcaaaccaatcatcatgatctgaagagggatcatcaaaagaatggtatccagatcatcaaaaatagccaggacctgaatcttcttatatatccagctggactttaacccgatagccgccagcatcgtaaacaagatgccggccgacgtaggtgcggcaaaacgacttagtaacagattctctttccaagcctcccaactattccagtaatcaggcggaagaagcacgaatacataatagatagcaatcatgaaccaaggcagggcagctgtagccatcgctataagataatcctcggcataacttttccagcggactttgtcgagcacaaactcccgacccacattaatcattataaaactaagacatacataaagtagtatattcgacaggaccttaacagttccatatccttctcccgctatcatcgggaggaattgtgaaatgacgagccccaacatcaggaagcccgaaaaagacagaacttttctcatatttatagttgtttgtttcaaaaaaggtgattgccaaggaaagctctgcagacagaagacaatcacctggtgtattaaaaaactaaccgcaagccgatttgttcagaataactctctgaaaaatcgcttgcggttcattttttaatccagcttcagtacggcgaggaaggctttctgcggcacttccacattaccgatttgtttcattcgttttttaccctttttctgcttttcaagcagtttacgtttacggcttacgtcaccaccataacacttcgcagttacatccttgcgaactgccttaatagtttcacgagctataatcttagccccgatagctgcctgaatagcgatttcaaactgctggcgagggattaattctttcagtttctcacacatccggcgtcccatatcatacgcgttatcgaagtgaatcagcgtagaaagcgcatcgaccggttcaccattcaacatgatgtccagtttcaccaacttggaaggacggaaaccattgggatgatagtcgaacgacgcatatcctttcgaaatactcttcaatcggtcatagaagtcgatcacgatttcacccaaaggcatgttataatatatttccacacgattaccggaaatatactcttgtttcaagagttctccacgtttccccagacagagggtcataatcgggccgatataatcggtagtcgtaataatagacgctttgatataaggttcttcaatatggtcgatcaacgtcggatcaggcataccaccggggttatgcacttctttcatattgccttgtttatcatatatattataagatacgttaggcacggtagtaatcacattcatgtcgaattcacgatccagacgttcctgtacaatctccatgtgaagcaatccgaggaaaccgcaacggaaaccgaagcccagtgccaatgaagattccggctggaaagtcagcgaagcgtcattcaactgcaatttttccaaagaagcacgcagatcctcaaaatcttccgcctcaatcggatagactccggcaaaaaccattggcttcacttcttcaaaacccgcaatcgctttatcacacggacgggcaacatgagtaatggtatctcccactttcacctctttcgaggtcttgatacccgatataatgtaacctacatcgcccgtacgaagttcgttacgtggaaccagttccattttcagtacacctacttcatcggcatcatactcttttccggtattaaagaacttcactttatctcccttgcggattactccattttcgatcttaaagtaagcgataataccacggaaggagttgaatacagagtcaaaaatcaatgcctgcaacggagcttcctcatcaccttcgggatgcggaatgcgttcgataacggctgcgaggatttcctccacgcccattccggtcttaccggatgcacggataatctcatcacgcttgcagcccaacagttctacgatttcgtcctctacctcttcgggcatggcacttgccatatcacatttattgataatggggataatttcgagatcatgttcgatagccatatacagattggagatggtctgtgcctgcactccctgcgatgcgtctacgataagcagcgcaccttcgcaagcggcaatggaacgggatacctcatacgaaaaatccacgtgccccggagtgtcaatcaggttaaggatatacttttcacctttgtagttgtactccatctggatagcgtggctcttgatggtgatacctctctccttctccaaatccatatcatcaagcatctgcccgttagtcacctgaatagtgttggtaaactccagcaagcggtctgccagggttgatttaccgtggtcaatgtgggcaatgatgcagaaatttcgtatattcttcattctgaattcttattattttgtctttttggtgtgcaaagatacgtaaatggcggaatataaaaaaatgcgttgataacattataatcatgtaccaacgcatttttttattgcttaagtgagttactcgcttagatcaatttgatgaagagttcaccttctacttcttcagcagaaactttatcttctctcaataaccagccaaggccgaggaacaaatctttgtcaaccaatttagttgcttttttcagttgcttggcagtcattccttctgtttcattcagtgcattccagatattacctgcgattacacctgctttttctttcaacatttgcttttgaaattatagttagacatgctttaaaaatcatccggcccgaaagctttcagattttatttcggggacaaagatagttatttttatgttatataacactttattgaatctttttttgctgattttgtaataaaaaagcattttatccccttatttagggtgtttttcgaggtattctacccagattcttgccgcctcttccaccattttagcacacggacgtttgctataatattgagtattacgttcttcgggaacagtcgaaatcggctcttttttctttaatcccaacaattctccgcaaatcaacgacccgttgcgttttttaaattcggcagccaattcctgcactaccgcatagtttgcagcttttccttcacgatctgtcgcttcggtagctccggtttccagtccggctatcaggaacagtccgcaagcagccccgcatgtctcacgcatccgcccgattcctccgccaaaagaggctgacatacgcactgcctgctcctgtgtgaaaccatacatatcggcaaatgcagctactacagactgcgagcagttatatccgctcttaaaaagttctacagctttttgtattctatcttccatgctattttctgtttttattctatttccaaagccattggacaatgatctgaatgtacggcatcgttcagtatgctggcacttttcagcatcggacgtaccggctcactggtcatgcaatagtcaatccgccagcctttattcttggcacgcgaattaaaacgatagctccaccacgtatactcctgtttctccggatagagcagacggaaagaatcaataaatcctgcagaaaggaaacgagtcatccattcccgttcttcgggcaggaagccgctgttcgtggcattccggacaggatcatgaatatcaatcggctcatgacagatattatagtcaccgcaaaggataaggttcggacgagtcttgcgcagctctgtcacatatttctgaaagtcttccagccacaccattttaaatgcctgccgttcgtctccgctcgttcccgaaggatgataaacactgactacggacaagtcgccaaaatccgcacggataaaacgcccttcattgtcataagcttctatccccataccatattccacatgatcgggttcctgcttagtaaggatcgccacaccgctgtatcccttcttttgtgcagaatagagataagccttgtaacccaaagcttcaaatacttctgccggatattggtccggctgtagttttgtctcttgcagacaaagaatatccggattctcctgcaccagccattccggcaaacctttagaagcggcagcacgaagcccgttcacattataagtaataatcttcatcattttatagtttatagatttatgttcgttttatgaaaacagcagcattatattcaataccgaaacaatgactgcaatagcatataatacaaaagtactccaacggctattgacataattccccattacctttcgggatgaagtcagccctacttgcaggaataccgtgaaaggcaactgaatactcaatatcatctgcgaaatcagtaatcccttgaatggatcgccaataaagaaaatcagcaacagcgcaattcccaacgaaaggattactcctacctgcgagtgactgtctttaatatgatatgactctccaaagatacctgcaaagatagaacctgccgccattccgcttgttatagtggacgaaatacctgccatcaacagagccaatgcgaatacgattgccgcattacttcccaacaaaggttcaagcagtgatttggcttgttgcaattcttccacctgaatgccgcttttaaagaaagtagcagcagccagcagaatcatagcactgttaattgcccagccaacgatcatcgagaaaagcgtatcgaacaactcgtatttcaatactttcttgatagacgcatcgtctttcttattatactcgtgactctgtattacttccgaatgcagaaacagattatgaggcatcacaaccgctcccagcacactcataataatcagcatactacccttcgggaaagcaggcgtcacccaacccatcgtcgcagccggccagtctatttctaccagaaacaattcataaataaatgaaagaccgatcaccgagacaaaagcaataatggaacgttctatctttttataggagttggtaaagagcatgatggagacaaaaagtgtggtcagcaccgccccccacataataggcatatcaaacagcatctccaatgcgatggctcctcccagaatctcagccaatgaagtagaaatagacgccaataccgccgtacccaaaataggacgggatacccatttaggagtatatttcgtagcggcttccgaaaggcaaagccccgtaacaatccccaagtgagcaacattatgctggaggacaatcaacatgatagtggataaggtgaccacccaaagaagtgaatagccgaactcggaacctgcggcaaaatttgatgcccagttgcccggatcaataaatccgacagttaccaaaagtccgggaccaatatatttaaaaacatccagtccgcccagataacgtttatgatctttccgtttcaagtcttgaaaaatattcttcatcattgcataatagtttattcagcacaaatatacttataaataacgaccgaaggtcgattttggttcaaaataccgacaaatagggaaaggtacggcacaataaaaaacctccggcaaaatgaattgccggaggccagtgtatattttataaagggagacttccgttaatatcccatttcatgcagtgcatggcacaactgatcgggacaggacgtcggtctgccactgcaacgtactccttcaagtttcttgataacctcttctaccttcattccctttaccagacgtgaaagtccctgaagatttccgttacatcctccccaaaaggcaacttccttcacaactccatcttctacattcagttcgatgtttgtgctgcaagtaccctgggttctataaacatattccataatccacttactcctcgtttccgccttcttccggcttcatgtttgtataaacagtctgcacgtcatcaaattcttcaagacgttctatcatcttatctaaagtttcgcgttgttccggggttacctctttcagatcgttcgggatataagtaaaatcaccgccgacatcctcgaagccacactcttcaagatgtttctgaatagcggcatagctcttaggatcaccgtagatagtgattgttccttcttcgtcatcctgttcgtactcatcttctacgtcgtaatcaatcagatcaaggatcagttcttccatatccatgccgtcctttatcttgaaagtgaacatacatttatggtcgaaaaggaaagccaatgatcccattgttccgaggttaccaccaaatttattgaatacagagcgtacatcggctaccgtacgagtcgtattatcagtcagcgtatctacaaagacagcaattccgtgaggaccgtatccttcgtaagtcatgctcttgtagtcgctctggtccttacccattgcattcttaatcgcacgttcgatattgtccttcggcatattctcacgcttacaagtagcgatgaccgaacgcagtgtcgggttattttccggttccggaccacccgccttcacggcaatagcgatctgtttacccagtcttgtaaatgttttagccatgtggccccatcttttcagctttgcggcttttctatattcaaatgctcttcccattggtttgtattaattttgaattgtgaattttaaatttatctcaattttgcattcagcttatcttccagattcttcaccagtttagacatgatcttatcgatcatcttatcgttcagcgtctgagtttcatcctgaagcaggaagctgaccgcatacgatttcttacctgcttcgatgttcttaccttcgtatacatcgaagagttccacttctttcagcagtttcttttctgtatcgtaagcgattttttcgatttcggcaaactgtacgttcttgtcgagcaacaatgccaagtcacgcttcacagcagggaatttggaaatttccttgtagctgatcttcactgaacggatagccttcatcagttctttccagttcaagtcggcataatacacctcattatctatatcgaatgctttcagcagtttcttcgtcacaacaccgaaagaggcaagacgcttcccccccttggtatgaacagaaagtgcggtagcgaaaatatcgtcagtcagattgccaactaccaggttgtgcaaatccagtcccaggcgcttcaatatattctctacataagccttcaattcgtataccgaactgttttcatccgggtgtgcccatgagttggctactttctttccagtcacccacaaacccaagtgatagtcttccgaataggtagccagtactttttccggattcttcttgtccgcatcgaagtaatagcagttaccgaattcgaagaatttcaaatcggcattcttgcggtttgcattgtgagcgatactttccagtccaccgaacagcaatgtctgacgcatacagttcagatcggcactcagtggattcagcagcatcaccagatggttggatgaatagttctccagaccgtcgtagtaagcggcacgagtcagagaattattcagtatttcattgaagccacagccaaccagctgttctgcaaccagattctgtaatttgtttgatttatcatgctcacccttggttgtcagactggagttcagcgtagtcgggatttctacattattatatccatagatacgtagaatatcttcgatcacatcgcaatcacgctgtacgtctacacgataaggaggaacggccaatgtcagtccgtcaactgtctcattcatgattttcatttccaggctggtaacaatgctcttgatcgtttccacgggaatcactttaccaatcagcgaatttactttctcataagaaagttctaccataaagtcttgtggaactgcaacgcaaacatccttaatttcggatgagatagtgccaccggccagttctttcaccatcagagcagccagtttcagacaatagattactccgttcggatcgatgccacgttcgaaacggaaagaagcatccgtattcagaccgtgacgacgggcagtcttacgcacccatgtaggatggaaataagcgctttcgataaatacatctgtcgtagcttccgtagaaccggaatccagtccgccgaatacaccggcaatacacatcgcttcttctttgttgcagatcatcagatcgcgttcgctcaacttgcgttccacttcatccaatgtgacgaatggagtgccttccggcaatgtcttgacaattacttcattgccttttatctttccggcatcgaaacaatgcaatggctgaccgaaagcatgaacgatataattagtaatatccactacattattaataggacgtacaccgatcaagcgcaatttattctgcaaccattcggggctttccttcacagtaacgcctttcaccgtaacgccggcatagtgaggacaggcttcgctgttttcaaccactacttcgatatccaaatcatgattttccaccttaaatccatctacagatggacgttgcaaagtagcctgcttgccattctgaatcaggtaagcatacaagtcgcgggccacaccatagtgtgagcaagcgtctgcacggttaggagtaatatctacttcgagtacgtagtcactcttgatattataatagtctttggcgagagtacccggaacagcttcagccggcaacacgatgattcctgcatgatcggtaccaataccgatttcgtcttctgcacaaatcatccctgtagattctacaccacggatttttgacttcttgatagtaaagcattcatcaccgtcataaagtttggtacccaaagtggcaaccactactttctgtccggcagctacattcggagcaccgcatacaatctgtacaggttcgccgtctcccagattgacggtagtgatatgcaaatggtcggaattcggatgttcttcgcaagtcagcacttcaccgattacgagtccttccaaaccacccttaatggtttgcacttcttctacaccacctgtttccaagccgattgaggtcagcgcagcagccgtttcatcgggggtcaaatcaaagttgacatactctttcagccagttataagagatattcatataattaaatttttattgtttctcaaaaagtttcgcaaagttaataagatttttcggttgacatagaacgatttgagagaaaaatgtcaagagaagctaaactaacaaggacctgactgtattattccccaataaattcatggttggtgacaaagtggcaaaaaataaaggggtattctttgtcatttttgccacctatccccatcagaatacaacccggctatactctataaaaaataatcgaccgctcgattggagtaaatcgagcggttattttcatctgactaagcggtcatttctattcaacccaaacgaacgttttttagaaaggtaacggtccttccgttgcaccgaacggattatttccctgcggaacaaagtccggttccggcggaggcggaggcatagcaccggcattcagtttagaccccagcatggcacctgcaggttcacccggcatcggtataaccatatcatcttccggattagagaatcgtgtaaactcacctttgaatcggagcaagacttcacctaccgcaccattacgatgcttggctatcacaatttccgccataccgcgaaggtcgttaccacgatcatcctgataaatcttataatattccggacggtgaataaaacacaccatatcggcatcctgctcgatggctccggattcacgaaggtcactcaactgagggcgtttaccgtcaataccttcacgactctccacaccacgattcaactgcgacaaggctataatgggaatgttcaactccttcgccaatcctttcaacgaacgggatatcgtactaacctcttcctgacggctaccgaatgccataccactcgcattcatcaactgaaggtagtcaataataatgattctcaccccatgttcacgcaccagacgacgtgctttggtccggagttcaaacacagacaaagacggagtatcatccacataaagcggagcatccagcagatctttcagtttgtagtccaactgttgccactcatagcttgccaattgtccacttttgatcttctcactcggaatctcacaaacattggtgataagacggttgaccaactggacgttactcatttcaagagagaacaacgctaccggattccgataatcaacagcaatatttttagccatagaaagcacgaaagctgtcttgcccatggcaggacgggcagcgattataataaggtcggagttctgccaaccggaggtcatcttgtccagtttcgtaaatccactttcaagaccactcagaccgtccgttcgtgcagccgctttctgaatcagcttatacgcttcgtcaattaccggattaatctgcgtatagtctttcttcatattctgctgggaaatctcaaacagcttgccttccgcctcctgcatcaagtcgtccacatccagtgtctcatcaaaagccttgctttgaatattactggtaaacgttatcaattcgcgcgccaacgatttttgtgcaataatacgggcgtgatattcgatatgtgcggaagaagcaaccttactgctcaactgagtaatatagaacggtccaccgacctcttccaactcacctcttttgctcaactgctctttgaccgtcagaatgtccaccggcttctgattaacggcaagatcagtaatggcagcataaatcaactgatgacgatgctcataaaatgactccgggcgaagaatctcactcaccagcgaataagcatccttctcaatcattaaagcacccaacaccgcctcttccagctccggtgcctgaggttggatacgaccataatcattgaccggttgtactttagttgattttgtgttacgggaatttcttctttgttcagccatctgcttatatacaattttatgatttacaatttatgatccccggcttttatacatagtaaaatccgaaagggatgacaaagatagaatataataatgaagaaaagataaggaaaaatgaagattttagtaactttgtcaccaatagcataaattcgcaacccataatttaaaattcaaaaataataattcagaacgaatatgatcactttcccaaacgcaaaaataaacctgggactctctattaccgagaagcgtccggacggatatcacaacctcgaaaccgtattctaccccgtcgctctcgaagatgcgctggaaatccggaccagccccgaagcggacaaaaagttctccctgcatcagtacggaatggagatatccggtaatccggaagacaatttagtggtgaaagcatatctgctattagataaagagtttcacctctgtcctatcgagatccatctgtacaaacacattccttccggtgccggactgggaggaggctcatcagacgcggctttcatgctgaaattactcaacgaacactttcagctgaatttatccgaagatcagctggaaatatatgccgcaactttgggagcagactgcgctttctttatcagaaacgccccgacctttgccgaaggagtcggtaacatattctcccccattccactatccttaaaaggatatcagattctgatcatcaaaccggatgtattcgtatcaacgcgggaagctttcgccaatattcaccctcatcatcccgaatactcgatcaaagaagcgatcaaacgcccggtaaatgaatggaaagagatattaatcaatgattttgaagacagcgtattcccccagcatccggtgatcggagaaattaaagccgagctatacaggcaaggggctgtttatgcctctatgagcggttccggttcttccgtatatggattgttcgagccggaagggactttacctgaaactgattggggaactaacgtattctgttttaaaggcaggctgtaaaagagtaacaaaaaacggtaccacgactcccgtcgtagtaccgtcacaacacaaacacaaaataaaacacgacaaaactactatgcaatcatacctgtctatgccggagaggcataagtaccatttactcatattcacatactcacaaacagatcaagctgattagcatctaataaacaaatcgaatgaacgatttgtttaaacttttatgttaattaaaacaaatatctttttactgaatgcctctttcacggagtttcagctgccaattccatgcagagcgtaaagtatcttctaatgtttctaccgctttccaacccagttcctggtttgcataatcgggattagcccataccttttcaatatcacctgcgcgacggcctacaatctgataattcaatttaacgccggtagctttttcaaagccattaatcagttccaatactgaaacgccgcgtcctgtaccgatattaaatacttctactttttctttctgtttttgctccaaaatacgacggattgcaatcacgtgtgctttagccaagtcaacaacgttgataaagtcacggatacaagaaccgtcaggagtatcataatcgtcaccgaatacacttagtttttcacggatacccatcgctgtctgagtcagataaggaatcaggttttgaggaacaccgttcggaagttcacccagcaatgctgtaggatgtgcgccaatcggattgaaataacgcagcaaaatagcattgatcggggcaccggaagctattgtatcacggataatttcttcattaatctgttttgtatttccataaggagattccgctttcttgatcggagccttttccgttacaggcaactcatccggttgaccatatactgtacaggaagaagagaacactatgccttctactccatgtttaggcattaactccagaaggttgattaaagaaaccaggttgttacgataataaagcaacggcttctctaccgactctcctactgctttgcttgctgcgaaatgaataatcgctttaattcctttatatttggcaaatacggcatcaaggccagcaaaatcaagacaatccagtttctcaaaagctgggcggataccggatactttctctatattgtcaacaacgtcagcactcgaatttgataaattatcgataatgattacttcgtatccactgttttgtagttctacaacggtatgagacccaatatagcccgttcctcccgttactaaaattctttctttcatataattttaaaatatggttagtttttcggttttcagtttgtttgaggtacaaatgtatggaaataaaatggaaatgcaataaactatcgcaattttattcacaggaagatacttacgggacgatttgagggcgttttggtatgataaaaaacatattcggtatgaacagatataaagaaaaaggccggaaacaaactgcctgtatgttgccatacgacagagtttccagcctctttatctaattatcaacttagtcttttacacgacgccagagaagcccatgaatgccattgccagcaaacctgcggtaatcaaagcaatcggagtcccctgcattcctttcggaatcttcaccagggtcatctgctcacgcaatccggcaaacaataccagtgccagaccaaagccaagagcagtagagaatgcgtatacaacacctgtcagcagatcaaagtctttctggatgaccaggattgccacaccgagaatacagcagttcgttgtaatcaacggcaggaacacacccagtgcctgatacaaagaaggagaaactttcttcagaataatttctaccatctgcaccagtccggcaataaccagaataaaagtgattgtctgtaagtaccccaatccgaaagcgtccaacacaaacttctgaatcaggaatgtgacgatggtagcgatagtcagcacgaaagcaactgccgcactcatacccatcgctgtttccaccttcttggaaacacccaggaacggacagattcccaggaactgcgacaacacaatgttgtttacaaagattgccgagataaatatcaatatatattccatattcttttcttatttaatagagttaggctttcttcagactattaataatggcaatcagataacctaaagcgataaaggcacccggagccagaacaaagatcagcattccgtattcttccggcagaatggtcagattaaatatcttacctgttccgaggaattcacgtacggcacccaacagagtcagggcaatggtaaagccaaatcccataccgataccatcaaacatagaggccagcggattgttcttcgctgcgaaagcttccgcacgtcccaatacgatacagtttactacgatcagcggaatgaaaagaccgagggtagcatacagatcgggcacgtatgcttgcattatcatctgcaacagtgtcacgaatgacgcgatcaccacgataaatgaagggatgcgtaccatatccggaatcagattcttgatagatgaaattaccacgttcgagcaaatcaggacgaacatagtggccagtcccatacccataccgttgattgccgatgatgtcgtacccagtgtaggacacataccgagcaggagcacaaaaataggattctctttgataatcccgttcatcattactttaaaattattcataactgtctcctcctttcttagttattagtgtcattagcagctgcttcaccttccggtgcaacagccggttcatttttctgggaagctccggaattcgtatccacctcaccgcctttatatgcctgataagcagcattcaccgcattcaggaaagcacgtgaagtgatagtagaagccgtgatagcatctacctgtccattcatgtctttggtcacagccaatggagtctctcccggattcatgcccaaaatagactttgcactttcttcgtgagataccggtttttcgttctttgcaggatcataagctccaaaccatttgtccgctttcgaacccaatcccggagtttcagcgtgcgccaataaagagtagttataaatcttgccttcagcatcaaagcccaccagcactttcagttcaccgccaaatcccattgacttggcttcaacggcagaacctacccacttttcgccattcttggccggatagataatgaaatccacgattttctttccgtctttctcgctgaaaacagtatcgctttcggctaccggattattggtatattcaggaagcacctttttcaaggcctcgttcagcgtctttgcattcgcttcggcaatagggcctttcgtcagttcgttcacataagccagcaacgctacggaaacagctgtaacgcccgtaagtaccagcaacatattctttaaagatgattgtaactttttcatttcttcttcgctacctccccaaagcgtttaggtttacaataggtgttaatcagcggagtgaacgcattcataatcaggatggcgaatgacataccttcgggatatgcaccgaacagacggataaccaccgtcagcagaccgatacaaacaccgtaaatcagcatacctttcttgctcatcggagaagtcacatagtcggttgccataaagacagctcccagcatcagacctccggagagtagttgcaatatcggagaaacatacttttcgggatccaccatgtgcataatgcctgcaaatacaaatacagtcacaatgatagaaaccggaatatgccaggtgatgatctttttccagagcatgtataccagtccgagcaacagtgccagcgcacttacttcaccgatacatccgccgttctgtccgataaacagagtcagcgcatcaggtatctggctcaaagcacttgcatcgccgtgaatagcctgtttcatcaatgccagcggagtagcaccggtggtagcgtccatataagatgtcagctgacctactaccggccatgttgtcatctgcaccgggaaagaaagcaacaggaatacacgtcccgccaatgccgggttgaatgggttgcagcccagaccaccgaaagacatcttgcctacaccgattgcgaacagtgcacccagaatgataatccagataggcagattggaaggtagattgaatgccagcaacacacctgtaatgacagcagaaccgtcacaaatggttgtagcaggtttcttcattaagaatttaacgatcgcccattcgaagaataaacaggctgctaccgaagtagccgtgacaatcagagcccccagtccgaagaaataaagcgacaccagaaaagccggaatcagtgcgatcagcacaccatacatatttttctgtacgctgtctccgccatgcacgtggggtgatagtgatacgattaatttattttccatacttcgttattttttagcttgacgtgcacgaatcatagctcctactttacccttacccaagcggcagtaatcaagcagcggacggttggcaggacaagtgaactgacaggaaccgcactcgatacaatccatgattctttctttttccattgtttcaaaatctccgttttcggacaaagctccgagcaagtacggctccagtcccatcggacaagcgctcacacactttgcacaacggatacaggtttgtgcttcaccacgtttggcttccttctgattcataatcaggataccggaactgccttttgcggtaggaacttcgatattcatcagagccttacccatcatcggaccgccaccgatcacttttcccgtatcctccggcagaccgccacaagcatcaatcagctgtttcatcggtgtaccgatacgcgccaggaagttggaaggtttggccacagacttaccagttacggtaatcacacgctcaaacaacggtttatttttctgaacagcttcataaacagcaaatgccgtacccacattctgcacaactgccccagtagagataggcagcgcaccacttgccacctggcgtttggtaatcgcatcaatcagctgtttctcaccaccctgaggatatttcactttcaaaggaacaacttcgatgcctgcataactggaagcaactttcgtcatcagttcaatagcatccggcttgttattctcaattccgataaatgccttatttaccttcacggctttcatcagaatggagacacctaccatgacttcttccgcgtgttccagcatcagctgatggtcggcagtcagatacggttcacattccaccgcattgataatcacacattctgccttgaacgaaggaggcggacaaagtttcacctgtgtagggaaacaagcaccacccaaacctacgataccggcatcggcaatcttcttcacgatttcttcggacgaaagctcacattctttgaccagtgtcttgctacggtcaatggtttcttcccattcgtcgccttctacatcaataaagatagcaggttttgcataaccgctcgcatcgactactgtatcaatcttcgccacttttccactgacagaagagtgaattgctgccgaaacgaagccggcaggttcggcaatcttcgtgcctaccttcaccatatcaccttttgctactatcggtttggcaggtgcgccaatgtgctgccccaacagaataactgcctttgcaggaacttccgctgtgatgataggttgatgtgccgacaatttattttcgtgtggatgaactccaccaattgaaaatgtctttaacatacaattctgtattttattctgttattattctgttaccttcggagcttctgcagcaactgttttcggtgcttcttccgccttcggtttacgtggagggaagttcagctcgataattgtgttctgcggacaaacttccacgcacttacgacatgatttacacttgttcggatcgatgtaagccaggttgttctccagcgtaatggcttcgaacggacaagtcttgacacacttaccacagccgatacagctcactgtacaagccttacgtgctacggctcccttgtctttgttcacacaagagatgtacacacggcgtgatttcttgccttgcggacgaatctcgatgatcgccttcggacaagcctttacacaagcgccacaagctgtacatttggcttcatccacttccggaagtcccgtttcaggattcatgtggatagcatcgaactggcaggcagccacacagtcgccacatccgaggcatccgtagctacaacctgtttctccaccatacaatgaagcggcaatagcgcaactcttcgcaccgtcgtattgattaatacgcggacggttggcacagcttccgttacatcttactactgctaccatcggttcagcttcagtagctgccagtccgagaatatcagcaatttgtgccatgacaggctgaccgcctacagggcagaatttaccatccagcgaaccggctttgacgcaagcatcggcaaatccgctacaaccaggatagccacatccaccacagtttgcctggggcaacacttcccccacctgggcaatccgcgggtcttcatacacggcaaatttcttggaagctacataaagaatagcggccagcacgagcgctatagctcccaatgaaatcactgcaatcagaatcaaattcataatgttttagttatttattggttttatagtaaatgaaaaatgttgtttcattcgcgttttattgagccacaatacgaaataataaggaataagaactgccagagaaagaagagccgcatacagttcattccctatcaacgccatccatgcgaacagggaaacaatcagaagtacaaaaggaattatgaatgcaagggttacagccatcatgcccatcgacgtttcgccgatcaccatcacccgctctcctacctgataggaagcagctgtaacatccgttatatctatgattttgtctttactatccgccgaagaacagtgtccttttgcgctacaagccgcacaagccgacgtctgaacgattctcaccgacagatgagaaccctgtatgttttccacaatacctagatgctttatagtattattcgtcattttgcaaactcaacattacaaatcgcggcaaatttaatcattatttgtgaactacgaagcattccctcatttttttctacataataaaatgttattttttgtgttttcgttatcgcacacgaaaaagtaacgccaactatttgatattttagcatacaacaaagcaggcgggaaagttcttcccgcctgcctgtcttatctaaccaattactttatttactgaatgctgcttacaatgatgcagcctgtactcccagtactccggcaatcgcaccggctacagcaatgattactttcaaaactacactccaagttttcttcatagatttttcctcctttctttttaagcttttcagattatacagtcggatccggggcttcctcatctcctccttcatttccaccaccgccattttcaccatcatccggatcattcggagtcacagaggcattcaacttcttcagatattcatccagactgatcaaatccagtttttcatctgcacgggtagccgtcttcgtgatacgcagttccttattcgcctgaaagaagatgcgtacgctatccacacttttagcattgacatctttcgctgcatccgcccctttcgaacaagcagtcagcataaatacacccaagccttcgatattcacagacttaccttccagaagttgctctttcattttctccacaaaattctgaatcacactcttgatatcaccgatggataaagaagaatagccctgcattttctgcgcaatatatttcagattgacagactgacctaaagtgatcagatgcggataatatttcttgggagaattgggaacacgcgggtcagatggtcgcgtaacaactttgtaaattacactcataatacgtttttttaaagattcaaattcaagttattttattcacgttttgttgatcaacaatgcaaaggtgaggcttttatttcagataacaaaaagaaaagccccttgcggggctctttttctgagaaaagttataattcatagatattcagatatttatctttttgtatcttgaccatatccatagccgtaaccataacgtttaccatagccgtagtgtttgccatacttaccgtagccgtagtaataaccatattttcgcttcttcaggtctacgccgttgatgacggtacaaagattaggcagcttcttctcaaaagacagttcattgatcaatgtatattctgccttatgagtgtagtcagcacggcatacgtaaactgacaagtctgctacacgacctattaataaggtatccgttaccatgccgataggagcagtatcaaggatgacataatcgaagttcttcttcaaggtttctatcgctctgtccagaccgttacgagccaacagttccgttggattaggaggaacagtaccacccggaagaataaacagattcttattcacatcagaaggttgaacaagttccatcaaatccgtctcaggattggaaagatactgagtaatacctctctccttattagagagctggaatactttattcaaccccggcttacgaatatcgagtccgacaatcaccactttctttcccaaaagagaaagactgatagccaggttcgacgaaacaaacgattttccttcaccactgacagtcgaggtcacaaggataaccttctgatcattatcgagcataaactgaagattggttcgaatattacggaaggtttcactcatcagattattcttgttctcgaagacagcgatagaaccattcttatcattcttctcatcagttaatggaatatcaccgacaacaggaacactcgttagtttctccacatcggcacgaccttcgatcttgaatttcgtcagttcaatcaagtagatgataccaaccggaattccaacaccaagcatcaatgcaatcaaatagatcatagagcgtttgggagataccgggatatcatcagctatcgcttcatcaatgatcttcgcattattcgcagtggcagcaagcgcaatagcattctcttcacgtttctgtaacaacatcagatacaatcctgccttgatctcctgctgacgggcaatactcacataagcacgttcctgacccggagcgttgctgatacgacgggaataacgactcgcttcacggtcaaggctctctttggtaatcatcagtccctgcaaggttccttcaagggtagcctgtacattggctttcatagcacggatactcgtatctagattcacaatcgtgggattattttctgttgatgtgcgtagcaagcgtttacgctcaataagcatttcgttataacgttcaatggctccaatcaaggcagcatcctgtaaacctacattactcggcaagacttcgtattcattgcctcgcaaatacttacgcaagtcattcaccaaactgatttgagtacggttctctacgctcttcttttcatactcagcattaccagctaaggctatctgagcttcactcgtcaaatccgtgatacctgcatcacgcttgaaagattccaaattagcttccgtactacccaattcttttgagataatgccaatacgttcatcaataaattccgccgtcttctgagcgatttcgtttttatcattgttcgtattgcgattatacatttcaagcaactggttgataaagtcctgtccacgctgcaaactggagttcttcaacgaaattacggctacagaagtagtcttagaagtaggggcaatagacaagtttttacaatagtcttttgccactctcatcggtttgtttattgtcgcagttatatagcgtatattcttctctatccgaggaactttcgttccatcctgtaaagttaccgaatcagccgcctgaaagaaggccagcgtgccttcatcagtcggaaagatagcaggcaacttctcaaaatgcttctgataacccttctcacctacagtcacattcacatccatactaccttcaggctgtaaggtcatctccaccatcattggtacattcaattcttcagcctcctgagatgtcagactcacctgcaccggagaagtcttatataaacctttagcaggaaattcatcctcatctttataagttatatacaatcccaactgattaacaacctcttttacgagtgttttcgaacgtaaaacttccaactcgttatcaatatttttagaagaagtcatcacaccacttaaccccatatcctccaattccgaagaaagtcctgcacctccacccttcttctcgtcttttatgagaacagtggcggaaatattataaatgggggtagcccaatgcaaataaaaccacgcgccaacaaaacatagcaacactgcccctacaaaccagggccaatgaataatatacttaaaaagaagcgctcggaaatcaatctgatcctcagtcaattcacgttccttcacgttttgattttcttccttcataaccctttctttttatttcaagatgttaaacaataaactggcaatagaaacaaggattgaagtagcagagaaccacaagcttgtactagttccgatatccgaatttcgtgctttcgctttattaggcgtcacgtagatgatatcattctgctgcaaataataataaggagaaagaatagtctccgccttattcaggtccaacggaataatttcctgcttaccattggcgttctcccgtatcagcttaacatcatcacgcaaaccgtatacagtcatatctcctgccatagctaaagcttccagaatgttcactttttcattagaaatcgtgaacgtaccaggacgggcaacttcgccgattacggaaatcttataattcaccatacgtactgttacaataggagtttcttttatataaggtttcagcctttccacaatcatttgctctgttgctttcttcgttaatccacccacatgtagttcacccaacactggaaaattgatattaccttcattatccaccaagtactgttgtaagactggctgagtggtggcataattcaaagccatattattctgcgttgcaacagtcaaattgaaaggcgccgccaattctggactagtacatgacaccacaatggttaacaaatcctttggcataatctttgcatcgtacagttgttcattctgggtactatacagtactacttctgcatcctgcaagtaaggtacttttttgtaagactggcaggctgttaacagaaaagctaccaataggcaatagcctagttgtttcattttcttcatatatttctttctattgtttttaatactataattataaattttatttactcctccatagataacttcttccaatttacctgcaagacacgttacagcttctccagtattttcatattgataaatagacacttccgtttgtgcctgcaaagcattcagcattcattgtaatgtgtcaaattacataagtcataattacaacgcaaggatggcaattcagccgcctgagttaataacccttttggaaaatctttatcaatcatcttttccattaattattgaactcaaaaactcacatcttgtcttatctgtcctctgtacctaaaagaagtatgcacataatccccctattactacttttttcattggagaatctaaatgagattagagggactttacgatatctacgaagttctcgataacatactctacatcctcctctgtcatcttagtgttaagtggaagtgtcattgtattctcgaacatcttgtaggcattgggaaagttcttaatgtcgaaaccgagagtcttataggcagtcatcataggtagcggcttgtagtgcacgttggtagcgatgccacgttctgccatcttagtgataacatcgttcacctgctcacgagtcttgcctaacaaacggatgatgtaaaggtgatgacttgaacaatgctcagcccctttatggtcgagaacagccacattcagttccttaaaagcctcattgaaacgctctacatacttttgacgtttctgaagcattgtatcgtaacgctccatctgagccaaaccaagcgaagccatgatgtcggtcatattacatttataccaagggccaatcacatcatactcccatgatccgagcttagtttttgccaaagcatccttgttctgtccatggagactgaacaactggcacttgcggtacagaaattcattccatgtctctccctcgaagacaggaatagtagtatctatatccattattataggttcgtttccaaatggtagatgccaagtaagtgcgccaccttctgccgtagtcaaattcttaacagcatggaaactgaaggaagagaagtctccaatctcaccagccatcttacctttccactcgctaccaaaagcgtgagcacaatccgaactgattatcacacgcccaatcttcttctgtaattcattagtaggacggaacaaacccttcttctgctcaaggatctccaaaatcttgtcatactcacataccacaccacctagatcaacaggcacaatcaccttagtacgttctgtgatagcctcagccaacttttgtagatccatctgctggttttcctcgttgctatctaccatcactaagtggcaccccacatgctgagtcacacttgcactagccgtataagtatatgcaggcacaattacctcatcctcaggccccactccaatcagacgaagcgcaagttccatagcagctgttgcagaattcagacatacagtcttatcagtatgtacgtatgccgaaatcttcttctcaaattcttttgtcttaggaccagtagtaatccaaccactcatgatagcctctactaccaatctcgtttcagtttccgtcatatctggaggactgaaaaacacgttcctttttttaaaatcagtactcattttactgtatgttttaaaagttattgtttatctttcagtaattatcactttgaatgtcataaagatcagcttaatgtcataccaaaaactagcgttctcaacatactccaggtaaagcttgatcttctcctgcataatcacattgatgtagtaatcctctggggcctcagccttttccatcagttcattctcattacggaacttgatacttgcaggatctgtaatacctggacgtacatccaacacgtgcatctgctctgaagtccaataattcacataatagcgaacctcaggacgagggcctaccaaactcatgtcgccgataagcacattgattaattgaggtatttcatcaaacttatatttgcggatgtaatacccagagcgtgtaatccgagaatcacgcccaccaatagtcaccaatgatcctttgtccgcccctacatgcatggaacgaaactttaaaatacggaaattcttattgttcttgcctacacgcacctgacgatagaacacagggccttttgaatccatcttgatccaaatggcaaggactaaaaacaatgggcccaacagcacaagcccaattccactcgctactatatcaaataatcgtttcatataacttattattcattctcacaggcaataacatcgaatcataggcttatgtcctccgtactacctatcataacctttatactctttaattctctgttcctcacttctctgacaaataagaatataaccatttttctcagaggcaatatatccatctaaaccctgaaacacaaccttatttgtatcttctacataaaccacataattcttgcattcgtacacgtaaatgttaccaattgcgccattataaattcatctttttgaagtttatcatgtaacgaagcccaattaccaagattgctccatccgaaatcagcaggatgaatatataccataccaacctttgatacaggatacaggctccatgactgcataaacaacagagaccttttctacattcggaaaaatctctcgaacctttgaaatttctgaaacttctgaggcaataatagcatccatctcctctacaatacttggtttatacttactaatgcattctgtaatggtattggcactccataccaatatacctgtattccaaaaataattgccagcaacaagatatttctttgctgtttcaaggtttggcttctccttgaattcatttacgctatgaatcttctcctccctaaggaagactcgacatatccataactagtttcaagacaaaatggcttgatactgatagttacgatatcattgttcttctctgtataaattagcgcattctttataacacgcctgaactcctctcgattcatcactattacatctgtaggagtaacaacaagttagcgttagcttcttccttacagatactccagcaaatccaaacaatgcaaggaactacattgcgtacaacaggttcagctaagattagctgcaaatccctaagttgttttttgatgctatgtctaaaattctgttgaacaatattaggctagctggttatttcattaatgacagagttaagacttcgtctacacaattgctcgcatttattaatattcttcctttaatagcctcaagagcaaaaacttgcactccatgatcaacagcaaaatcaaaccaataattccactcatttgcattcaattgaaatgtaagcaatctgttaaaatcctgcctaaaaagagatactcataataatgctaggagcagatttttcctaactattaattccatttattggaaatcgtcttttcaaatagcttaatattttacttaagattatccttcaagtaatcgtttagacacaagatttgtttaggacgattgaatttattctcagcacaatcaacgcagttctttgccatcactttcatttcctcaggatgagatactgcatacttaatattatcttttaatccttcatagtctttagaatgggccaccaatccgatattgttatccttcacaatacgggccccctcaccttctccaacaaacataataggtaaagctgcagccatagaatcataaattttagaaggaactgctccatagatatttttgactaacggaatcagcgtcatatcagcctctttcaatcgaaaaggtaattcttctctagcaacgacaccatgatatataataccattattgggatgagaagctataaatgcttcaatctccttctgctcgccacctgaaccataaatatgaaattccatacccatctcagcaaaattgatggacttgcagatatcagcaaccccttgagcgaatccaagcaaaccagcataaaccaatctaacttttccatcattaatcttatgcaccttaatatctgcaaatcttgtaggatctactccattccgaaacagataggttttattgccaccgtgggaagcaatatgatcaacaatctcctgagattgccccatagaaatataagcccccttataaattctatgctcaagattctcaagaatatgataaagctttccttctgatatcgcacccaattctttcgcagacaaaggccaaatatcagagatatttgcaataaatttacaatgtgcgtgcttggctaaccattttccaacaagccctaacgtcaaaggaggactttcaactattaaataatccaattgcttactcttcagatagcgtaaagagaatagcaccataaatgagaaagataccatattccaaattctaggaatcaccttctttgtatttgatgcatagagccaatatcttttaatctctacaccatctatttgatcagtgcatgtaatcttacctctataatcatcaaatatcttccccatagggtaattgggcatacctgtgattatgcatacttcattaccacattccttaagaccatgaatcatttcatacaaacgattctgaggtgcacccatttctggtttgtagtattgtgtcaataatgcaattttcatttctgtatatttaataattgtttattttctatatatactaatag

SEQ ID NO: 94 - DNA, 30198 bp, Bacteroides thetaiotaomicron
aaacagtggttccagccgatggaatgaatgaaacaaggcaggaaactgatcccttacttatatgattcaattaacttgaccgcaccaactgttcgattaacctgctcttccaagaaacaataaatcacttatcactcaaaaacagctgagttatcaactattaaaggatgatttatcaattattaatgtctgaaatatcaatcgttaagaattgacacctcagacattaacacactgtaaatcaaatgacaacatcaaacaaatgacagataatgatacatggaagagtgagagcaaacacttgctctcatacctgctaccacaattgctgccatacctgaaactacgatgaataaaggcatacagacaatctgttagggcatgagagcaaaaacgcattcaaattacgtggggagcctgattatctctaggagaataatatgctagaccaagaatcagtttacaacacaaaaagtgacggcaaaaagcgtaaaactcttgccgtcacttagccatcagcatttgccgtcaccgctattggtctatatattaatactttattctaaaaagtgacgggtgacgataaaaaacatagtttcaactctaaaataattattttatcttaagggcaaaacctcctcccggtgccagatgaactttcagtttaccgtccttctttatcgggaaggactcacacttataatcacgacctgcccgatgagcattcacaccatctttaaacaaagtagcatgataagatttatcacccaggaaagaacaatcgacttcaatatcacgtgcactccaatctgtaattccacctacataccagacatcccctttccggcgtgctgtcacaatatactctcccattttaccgtcaagaacgatactttcatcccatacagttggtatttctgcgataaatgccgttgattccggttcgcgcatatagttgctcggagtatcgcacaacatattaaaaggagattcaaacaccacgtacaaggctagttggcggcaacgggttccctgactcatcggttctgaataacaaggataatagttacccttggaagcattcctcatcgccccctgcgtataatccatcggaccggaaacctgacggatgaaaggaatcatcacatcatacttcacctgatctactgacggtgaactccatttcatctgctccaacccattgactccttcgaaattcaacacattcggataagtacggttcaatccggcaggcttatgagtgccgtgaaggtcgagaatcagcttgtatttagcacacatttcagcggcacgatagttgaatgcagtcatttcctgatcgtcacggtccataaagtccactttgaaaccctttactcccatttcggcataatgacggcacacattttccatatcacgctcgaatgcatgataaccggcccaaaggatgatacctacatttttagaagctgcgtaatctaccagttctttcaggtcaatctccttgacaacctgcatcaaatccgcctgtaagttcactgcccatccctcgtcaagtatcacatactcgataccgtttgcagaagcaaagtctatatatgccttataagtcggattatttactccggtcacaaaatcaacgccatccagattccagtcattccaccagtcccaagcaacctttcccggtttaatccatgaaagatcggacatacgtgaaggcgcacctaacaggtagctgagattggtagcggcaaggtccttatcggtggtagtaaccacggctatacgccaggggaagtttctcggcttatccactttggcaatatagtcttcatgctccttcaccaacatctgaagctggttgtgaccaccctgtaccgtacgcttcggataaggagcatgcatactgctcagacgattcgcgccttccgaagcagaaagataaagtcccggataattttccagatcggactctgtgatacagactttcactccatcgcccgcatctactaccaacggcaagaacatcaagcgctgtttattcagcttcgacagtttgtccgttgtatacgtattctcgaaagaattaaaaaactgggagttataatcaccgtctttaccgctttttacataaggcacggaggcagtcatatccgatggaaaacaataatcagatacttccgtcaccacacgaaaaggcttcttcccctgattcacaaaacggtaggcgataccgtcattgtatgcacgaaactctacattccagtcttttttgaaacgcaaggtcagtccattataatgatttctcaattcgctggcacggtagaaaggagatggtatcatctcgtccacactcttcctggaagttccggataatttcgcattttctccccagacagtcccgttatccaacgtcattgatatgggagaaggagtcagaatctgcctgccgttgcatgtaatgtcataagtcagccggtcgccaatggttattgtcgttttcagatttccatcaggtgaggctagtgtaaattgcttctgagcttgcaacgaaagcgtacacaagacacataataataaaaatgtaagttttttcatggttgtaactaatatattagatttcaaaataattattccgcaataaagcgctttgtctgtacatcacgactgttcgtacctatcatcacgtcaaactctcccggttcgtagatatattgcagcccggaattataaaatttcaggtcatcttccgtaagtacaaacttcacttcacggctttctccttttttcaggaagatacgatcgaagcctttcagctctttcaccggacgcgctacttccgcatagatatcacgcaaatagatttgtaccgtttcatagccgtcatggttccctttgttggtgacggtaacggaagctgtcaggtttccatttttcggcaaggtttccgaactgagctgcaggtcgccatatacaaagtcggtataactcaaaccgtatccgaaaggataaagaggttcgttactctcatccagatagttgctggcataccggttgaaaacacggttgtccgggtccggacgtccagtgttcaaatgattgtagaacaaaggaagttgccctaccgaacgagggaaggtagtagtcagcttaccgcacgggacggctttgccaaacagaacatcggcaacggcatcccctgtctcactacctccgaaccatacattcagaatagaaggaatgtgttcgctttcccagttcaagatcaaaggacgaccggtgaacaggagcagtaccacaggcttacctgttttcaccaatgctttcaataagtcctgctgagcgtcagggatttccagattagtacgggaaggagattcaccactcatttccgcacattcacccacagcagccacaatcacatcggcacgggcagccgtacgcaatgcctcggccagcagttgctgatcattaccacgttccaacggacggatgccgacagctcctttttccatttccgcatcataatatacattgctgcctttggcataaagtatttcagccttgtctcctactgccgaccggattccttcgagtaatgtaccatgtctggacggagtacaggtcatgctccacattccgcacatattattgcgtgcatctgccatcggacctattaatgcaattttccctttttcctccaacggaagcaggtgattctcatttttcagtagaacaaacgtctctgccgcaacctcgcgtgcaactgcacggtgctcaggtgtataaagttctttttccgcacgtaacgtatcgcaatatttatatggatcggcaaacaagcccagtttatacttagcctccagcacacgacggcaagctgcatcaatctgtgcttcggtgactttcccctctttcagcgattcttccaacgtattgagaaagccgcaggaaaccatgtccatatccgtccccgcctgcaaagcacggacagaggcttccttcaaaggagccacaccatgaatggacatttcagcaatggaattgtagtctgtgaccaaaagtccctgaaatccccattcgtcacgaagcacgtctgtcaacagccatttatttgccgtagccggtatgccgtctactatattaaaagaactcatcacactaccgacaccagcctcaaccgccgcccgataaggagcaaaatattcgttatacatacgcagatggctcatgtcgactgtattataatccttaccggcttctgatgctccatagagggcgaaatgttttacacaagaaaggatttcatcttttccctgcatactgtcaccttgataaccgtgcacataggcctttgccaacagtgaagccagataagggtcctcaccgcttccttcggcaatacgtccccaacgggcatcccggcagatgtctaccatcgggctgaatgtccagcaaatgccatccgcactggcctcaatggcagaaatccgcgccatccgctgaatagccaacgtatcccaactgcatgagagggccaacggtatcgggaaaatcgtttcataaccatgtatgacatccgccccgactatcaagggaattttcaatcgggtttcttccactgccagccgttgcaggtcatagatttttttgattccttttacattgaaaaagccaccgatctcttctttgcgaatcatatcactaagctcacaattcatcaccgagcctgtcaccaagtcgccaccggaaggaaggttcaactgtcccagtttctcacggatcgtcattttacccatcaggtctgtgacaaagcgatccatctctacctcttttcccccaccagactccgaacaggaaaagaatgtaatgccacaaagggcaccaaacaccagatttcttattttcataagctcttcaaattatttatttacttttctgactttaccttctatacaataacggcaacatcggtcaacagaatctatttcgccaaagttaacacttccttctaaataatgagacatatacccgcaaaatagattatttatttctgtcaactgaatctatatacaatagacggttcagaaagaaaaagccacattaattcagagctacaaattttccatccttaatataaataggtgttatcaccggatgttccgtctgcgaattcggtgcatgataagaaatcatcagcctgcctttaagatccttgaataccatcgcgtgtccgccatcgtcactatttagcgtttcgggctcctgcacccaaggaccaagaacattacccgatgccgagacagcctgcccgatggcatattttccatctgtctttcggaaactggaccatagcataatcagttttccatcatccagacgatagataaaaggagcatccgtaacattgcccgtcaccccggaacttgtaatagagcctacccagggagcttccgaagccttgaacaacagatacggatcaccttctgtcgttttcagatctttcgccagccgttgggcataaatttcaccgtcgatggtctccagccactcacgacagaacaacagccagggatttccttctttgtcaatatacaaagatccatccaggcacatccagccggaaggagtaatcgccttgtttacaagtggagtgaaagggcctttcggactatcggaaactagaatagaagttccccgcttcactcccgcattactgaatgtagtaaataaataataacgtccttcatattcatacacatccggtgcccaaaagtcctgttgcccccagaaatcacttttagctataaaagaatagccttcgtctttccacgtggacaggtctttacttttataaactctgattttcaagttattattgaaatgaagataatacatcgaagttttcttgtcgaccagaataaacgggtcccgcaaacgcaaactcgatacaggaatcgtgaaactttctccccccacttcatccggctcggtggaggaagtctgtccatcatcattactacaactgacaatacacgctcccatcaataacaagagcgaaagaatagaatgctttaactttttcatatctcaatgattatttaataaaatacctattgaaaactgataaataaattgttcaagatcaataatgaggattctgctcgatatgagaattttcaataatgaccgaagtaggaatcgggaacaaaagattcttctctgagaaattagtactatacttctttccggtttctacatatttccccatccggatcaaatcttccctgcgctttccttcataccagaactcccagcctctttctttcagaatccagtctctcaacgactccttatccgggaaatcggataattgctttatgatagcatctccaccatcagcagcctgttccatcgctgtaaactctatttcatcaatccagagttcatatccgcttccggaatttcccaaagcaaggaacagagcacaattttgatcttccgtagctttacctgtctgtgtggagaattcccttacttcgcctgctttcaaagagatagattccatgtggctcaatggtccttcaacgcgtatttcaaactgaatgtctttcgaggctttcaacttcatctttattgaatacttacgcccttttgcaaccaaaggctctgttcgcatctgcaaagtccagaattccgtacccgaagattcaacttccacacgtaagctgtttccgttattcaacgtgttgtttttatccacatcatacttccaggcagatccaccggcctgatcgtagttattcatcgagaatatccctataacattgtcaacaaactctccgtcaaagctctctttaaaaacgggtattgcaggcagagaggtgccaaagccaaaagcacgtttccggatatcattaatcagatcgacacttccctgattaggaccattcagttcattcaatgcttccgccttaaataacaacacttccgcatatcggtcgagtaccttatcattgcctgcccatgtacctgtagcttcaggatcaatcccatatttcaaaggcaaagcgcctacatcaccactggctctcaaatcaactgtagcaccggactttgatgtatattcggcctgtgccaaagctcttcgccggtcattttcatcaaacgtatcatagaatccccacggcatccggtgtccggaccagccttcaacgatgtttccagagggtgaagcgtagtcacccggcaaaatatttgcatatgtatgattaccataatctgccagtggttcagctctcacaacaaacatcagttctttattaccttcgttctgagctgaaaatatacttgcataatccttctccagttcatagtaattcagaccgataatctcatttgccgtttcgagagcattctgccactgcttttcatgcatataatatttcagtaaataatgcagggcagctccctttgtgatacgtccgtattcagcttgttctaccggaagtgcgtcggcagcagcacgtagttctgtcgtcaggaaagttccgacttcttcagacgtaggtctgtaaggtttataatccgggtccggattgattgcctggtcggcttccagaatcattggcataggaccataaagccgatataaatcgaacatgaaaaaggctctgagcgcccggacctccgcaatatacaagtctttcaccgactgggttaccggagactcttccattttcgctatcgtataagtgcaacgggtgatattaggagcagtccagttataaaatcctttcaccatctggtcagcatccgtccacgaaccattcagaaaagcaacccatgaccacttggtagtccattcttcggttgaaacttcatccattacaaaagaacttccatcacaaaacaaataaggtccccagcctttttggcgtaattcataataaagggcaaccgttgcagccgaaaggtctgcaggagtattaaacgcatttccagtatctacaactccatacaagtgaggttccaagctcccctcacaggctacaaactgaatgcttataaatagtaataatagttttttagctaatttcttcatgacattccagtttaaaatttcacatcaagtccaaatgaaaaagtcttctgttgaggatatgacgcccggtcgttttcaacttccggatcgagtcctttatatccggtaaacgtcagcagattctgaccggaaaagtaaaatcttactttcaacttatcagctttaaacagtctgctcaaatcatatcccaacgttacgctcttcagacgtaaatatgtattcttctcccagttcggagcaccgtagctatcatagctgttcacttcgccactaggcatagcagaactcatgttgtcggaagtccaacgattttttatatccgccaaaaagttattattgtctttcagcctctggatgccgtttccaccatacaccccgtgttctacctgagtgtaaggataggagtatccgccaaccgaagcataaagatagatattcagatcaaatcctttgtaccggaaatcattcgagaatcccatagtaaacttcggtgcacgtgtccccagatatacgacatctgcctggtctattttcccatcaggctttcctgtcagattcccttcctcatcgagtccgttcacatctttatatttgcgctgtcccggtaacaagtccggcatagccggcgtatcttcacccgcctgctttataccgtccggaatcagcgtatagatagcacttaccggatcgttttctttgacataaggagccaggattactttcggatcacgttctttccatctgtcacgataggaagtatacgtcaatgtcgattcccaatgtaacggtccttccaggttcactgtattcagcgtcagttcaaaaccggtactttttgtttttccaatgttggaccatataccggtagtgacagctgtatgcggcagcgaacgccagctcagcaggtcttttacctctttaaagaaaacatctacactaccattgatacgattccggaagaaaccgaaatccagtccgaagttaacttctgtagtcgtttcccactttaaatcaggattaccgaactttcccagatttactcctctcttttctgtatctcccagataataatttctgccgtcaaaggcaaagtactcggaagcagcatcgttaggcagattttcattacccacctgtcccatgctgacacgcaacttggcatcggagagccagttgacatctttcagaaaatcttcctgattcattctccacgcaaatgctcccgaaggaaagaaagcataacggttgttctttccaaaacggtcgctaccatcgatacgggcagtaaaagtaaacagatacttgtctttgaaagagtattgggcacgaccaaaataagaagccaacacgtgtttatttttataagaactgaccaccggacgcgtttcacctgcctgtagtttataatacatcaacgcatcagacataaatcccatagcacgtgcatacgctccgtcatcattctgcacctgatacgaatatcccagtaatgcaagaagtttatgtctctccttgaaagtcttctgaaaattgaaaaccatatctgccacatagtcttcacggttggcggaattgatattcgcatctccattcacactacttccatatttcgtagtcatcggatagtagctatggcgggacccgtcgcggatatccgcaccggcagacagtttcaaccagagcacatcttttataaaatagaaattagtgaatgctgttgccagaaaacgcttggtctttgtctcatcctcaatgtcgagataagacaaaggatgattgagcaatgcctgcttaggatcttccatccatttgccggtcgtcgggtctcgttccgccttcactgtcggactataacttaacgccgattcaataatacctgccgtactgtcatatcctccccccagtgtcgcattctgatcgactacataagaggctgtggcagaaataccataatcccaccatttcgttattttatggtccagattataacggaagctatagcgtttataaccggatgttttcaccactcctttctgatcgaagtagttcagcgaaatcaatgatctcatcttttcattaccataagtcactgtgaggttatgttgctggataagacctgtacgggtaatcatatcataccagttggtcccttttccggcttttgctatttcttcatccgtgtacataggcacataagggctgacagcacccggatctgtattcccataaggatataccagattctgcattaaatactgttctttatagtaactgttctgagtagtcattaactctccggccgtcaataattccggtcgtttatttatagtctgaaacgacatattcatgttatactctactttcgtatcctgagtacctctttttgtcgtaatcagaacaactccattagcaccccgcgcaccataaatggcagttgccgaagcgtccttcaaaatctctatggattcgatatcgttagggttaatactgctcaaagggctgttgcttcctgccgtccactgattaccgcttcccggattgacaccggcattcactatggggaaaccatcgaccacatacagcggatcattccccgcaccggtagaagccgcaccccgaatcagaacttcaataccaccaccgggctgtgcactcccctgttttacagtaagtcctgccgcacgtcccatcaacatttcagagaagttcggtgaagctgctttattgagtttctcagactttacagaaacaatcgaagcattcaagtcacttttcttcattgtaccgtatcccactaccacaacttcatccagcaattcttgcttttcatacaaaacgatggataaatctgtctgatttccaactttcacttccagaggctgatagccgatgtaagacagttccaataccgctcccggtgatacttccaacgtaaacttcgcatttatatccgataccgttccgttagttgtccctttctccttgatggtaacaccgataataggctcgccgttaacatcattcaccacacctgtgatcttacgctttttaccatcctttgaagtattctgcctggcttgtcctttctgaacaattacattcttccctttcacttcatagacaacgtcttgtccgtacaatatctgatcgatagcctcattcagctctttcgcctttacagttataatcttctttgtatccagatctccgactttataaacgaaagaatatccgcttttattcttcaactgggtcattgcttctttcactgaaacgttatccattttcaatgaaacagcctgggctagtattgctatgttaaggcaaaacagagccatgaccattaatatggccttcttcctgtaattcataaaataaacaaattattaattaaaacttgaataactcgttttaaaagagatgtattttgctaactttgcacattctcttttgaaaacatattcacactagatgattgttgaaagaagagattcaaggagccgggagatgtccgaaatcttccggttttttatttgtctctccttatttgtcagctaaagattattctgtatttttctctttattcatacttttcattttttaaggttaaacaatcatagcattataatctctggtaaccggttaatagatagttatattacgttcttcaatcttatattgcattttttccgtagaagccagtgcttccagtacttcctggatattttgttcgcgacgaacgaagttgccatagaagcggaatgtttttaaggaatcattggctatgtgaatctttacattatagctgcgttccagttctttagcgatatccggcaagagttcttcatcaaaaaacaagtaaccgtccgtccactgagacgcattggatgcggtaaccgactctacagtcaaaagcccgttcgccttatttaatacggccctttcatcaggtgaaaggacagcttctttttcttctctcaacaagttgttcaatccgaccttaccttccaacaaagaaacgaccacttcatgatcttccggatagtcacggaaattgaattttgttcccaacacctgtaattgcagatctttagtctttacgaaaaagggaatcttctcattccgctttacctcaaaatatccttccccttccagttctacttttcggttatcgacaccaaacccctgcgagtatgtcatgcgtgaaccggcattaagccagaccaatgtgccatccggcaaataaagttttgtttttgatcctaaaggggcttctaccgaaatatctgcaaaagtatctttcacattcacctctccctgccaataagaaatacatcccaccgctattatgattgcaacaaccgcagcataacgccacaacgctgacaggctaaaacctcgacgggaagtgctctgaatttccttctgactttcgacacggtttctaaaattctcaaacgctttatccttatcatagacagatgcggcctcacgacttacagctgaaaaccagatctcccgctgacggataaaatattgctgattttcagccgatgcggcaatccatgtttttagttcatctaaagcattcttatccagaccttcagtcagatagttggcaatcagttcatcaatatgtttattttcttcttccatatttatgctttctataaaggagacagttgttttttaattaagggtagtcagaaaatgattttttttcgctttacctgaaaaaaaatagtaatagagaaatcaggtacttactcaaatgagcgtgtaaagaagctaaagcattctttatatgatacttaactgtattaatagatattcccagttcaccggaaatttcttcgtatgattttccttcaaagcgacttttagcaaaaacccgacggcattcgtccggcaatttatcgatagccttatatatttcgttttcaagttcacgttccagtaaaatacctaacggatgcgaatcggacagtatgattttatcatccgttatctcatcgggcataagagcagaaaatgctatttctctcttttcacgttccgaattaagatagttaatgcaacgattacggacagctctcagcaggtaactacggatagagactgaaatatccaaagtctcacgtatctcccataaatgaaagatagtatctcctacaatggtttcggaaaggaactgatcttttagataaccattggcaacataacagagcagggcatagtgatgatcatatatgtaacgataagcattttcattgcctatcttcagttgttccactattaaagtttcagtattctccatgaatgtaccagtcagattaatagcacaaatttagagaattattcgaatttaaagcatataaagccaaaaatccctccaaagaaaaaaactttggagggatcttctttatactactctgtatacagtctatttcatcttatatacgagtgtaccacctttcagaatatcttcatgagaaatcgtattctttgtataaggttcgccattcagcgtgatactatccacatatttatgttccttcgataagttttcagcgatcacagtaaaggtctttccatcagccagatgtagcacaatcttcggtaactgaggagctccgaatacataatcaccgcttaccggatctaccggatagaaacccattgcactgaacatataccatgcggacatctgaccacagtcatcattaccacaaagtccgtcaggcttgttcttatattgagtatcaaagatttcacggattagttcctgtgtacgttccggacgccctgccaaagcatataaataagtaacatgatgactgggctcattaccatgtgcatactgtccgatcaaacctgtcacatcagcctgggttgtttccagtttcactgtaaacagggaatccagcttgttcaggaaaggttcttctccaccaaagagagcaatcaaaccgggaacatcgtgttgcacatgccaggtatattgccatgcatttccttccgtatagtcaccgcctgtactttccgcatgtcctacatcactaggattaaacggagatttccaggttccgtcagctttacgcggacgcataaaattcgtctgtgaatcgaataagttcttataataatctgcacgtttcgcaaagtaagcagcatcttcttcttttcccatacgacgggccatgtcagctgccgcataatcgtcatataccgattccagagttgaagagacggattctgcttttgtcaggtcggtcggaaaatatccgtatttcgtatacacttcccagtcggacttcaacggatgagatacagtctgtgtcttcttcaccatattgaaagcacgttccgcatcaaaaccacggaaaccttttcggtaggcttcagcaataacagatacaccatgattgccgatcatacagaagttttcttttccccacaatgcccaaataggcaggaagccttgtacttcaccttgttctatcaatgaattaacaaaatcatccacacgttcgggaaccattaatgtatagaatggatgagcggcacgataagtatcccataaagagaaggttgaatagaatgttcctgttccggccttcacaatcgaatcggcagcattacgatacataccgtctacgtctgaaatctggttaggctgaatcagtgcgtgatagaaacaagtatagaaattcgtcttttcatcatccgtaccctctacgtccatgcgactcagatagctgttccattcgtcatgggcagccagcttcacaccgtcaaagttccagtctggtatttcagcctgcaagttcttctttgctccctctacgctggtagtcgaaagggccaccttcatcatcagttcatctcccggcttcaagtcgaaagtagcaatgattcgctttcctttctcagtttctcccatcggaaggtaaagcgaatctattaccggacgattaaacttcatcacaaagaagtagtcctgatcaacccagaccgtgttattcacgtgtccggccagcgtctgagcatcttcccagttcacctcgcaactattcacttgtgaatgatattgttcttctctccaggcaggtccgtgctgcaagtcaatcagcagagaagctgaatccgctttatgatatgtataacgatgaagagctgcatggatagaagcagtcagttccgcctttacctgcggatcggataattcgactgtataatatcccggagtagcagcttccttgtctttcgggaaatggctgcggtaagcatcccatgcacgagcacgggtaccggtaactggcatcaccagaatatcccccaaatccatacatccggttccgttcagatgagtctgagtgaagccccagatcagagagtcctgataagtatattccgaacaatatctccaacctactgcacccgtcaccggactggtctgtatcattccgaaaggatagcaagctccggggaatgtatgcccattgtcagcagcaccaataaaggtattcacatactgggtgtaatctttcgtttccgcttgctccgtcggagaacaggaagtgtacataaacagtcccgccaaagcaacggccatcacaggggattttcttttcatgataatcataatgttaagttaatgctacaaatttagagaataattctcaatgctacactaaaatacaatagaaaaatggtccccaagtccgatcattcaaaatttatatctaccctgttccgggcagcattctaaaagcaaataaacctgattcattgtgacaaaacaaaaattcgcacgacttattgaataaatatcaactcaattatttatctttgttagctttaaaacaagctgactcaaaaaaacaatagtataatgaaagatttcttgaaatttacgctcgccactgtgaccggtatcatcctgtcaagcattgtattatttattatcggcatggtaacattgttcggcattgtatcaaccgcggatacagaaacaatagtgaaaaagaattctgtgatgatgctcgacctgaacggtgtattagtcgaacgcactcaggagagtccgttaggtatcttatcacagttgttcagcgacgactccaatacatacgggctggacgatattctttcttccatcaaaaaagcaaaagaaaatgaaaatatcaaaggaatttatctgcaggcaagtatgctcggaacttcgtatgcatctttgcaggaaatccgtaacgcattgctcgactttaaagaaagcggaaagttcatcatagcctacggagatagctatacacaaggactttattatctttccagtgtagcggacaaggtattgctcaatccgaaaggaatgattgagtggaaaggcatcgcttccgctcctctgttttataaagacttactgcaaaagatcggggtagaaatgcagatatttaaagtaggtacttataaatccgccgtagaaccgtttatttctacagaaatgagtcctgccaatcgtgaacaggtgacagcttttatcaactcgatctggggacaggttaccgaaggggtatctgcttcccgcagcctccccgtagattcactgaatgctttagctgaccgtatgctgatgttttatccggcagaggaaagtgtgcaatgtggcttggcggacacattgatttaccgcaatgatgttcgcaattatcttaaacagtgggtggacttgaaagaagatgaccgccttccggtgctagggttgagtgatatgatcaatgtgaaaaaaaacatgccgaaagataaaagcggtaacatcgtagcggtctattatgcctccggagaaatcacagattacagcggttcttcaacttctgaagagggaattgtaggcacaaaagttattcgtgacttgcgtaagctaaaagatgacgaggatgtaaaagctgtcgttctccgtgttaattcaccgggtggaagtgcttttgcatccgaacaaatctggcatgccgtgaaagaactgaaaacagagaaaccagtaattgtttctatgggtgattatgccgcatcaggtggttattatatctcttgtgtagccgatacaatcgttgcagagccgactacattgacgggatccatcggaattttcggtatggtaccgaatgttaaggaattatcagaaaagatcggtttgacctacgatgtggtaaaaacaaataaattttcagattttggaaatatcatgcgtcctttcaatcaggatgagaagacactgatgcagatgatgattacccaaggttatgatacattcgtcaatcgctgcgctgaggggcgccatatgagcaaagaggccattgagaaaatagctgaaggtcgtgtatggacaggagaagctgctaaagaacttggactggtagacgtactcggaggtattgatacagctttggagattgctgtcaggaaagcaggaatcgaaggatatacagttgtttcttatccggcaaaacaagacctcctttcttcactgctcaatacgaaacccactaattatgtggaatcacaaatattgaaaagcaagttaggagagtattatcaacaattcggtatgctgaaaaatttaaaagagcgttccatgattcaggcacgcattccgtttgaactaaatatcaagtaaactgtactgcatggacgaacactttatcaagatacataagtggctttaccctgtctcatggatttacggggcagtggtaacagtaagaaacaaactctttgactggggattcctccggtcaaagagttttggtgttcctgtcatctgcatcggcaacctgtctgtaggcggcacgggaaagacgccgcacaccgaatatctgataaagctgcttcgtgataactatcatgtggcagtattaagccggggatataaaaggcatagccgaggatatgtgcttgccactccccaaagtactgcacgcagcatcggtgacgagccttaccagatgcataccaagttcccgtctgtcacactagctgtcgatgagaaccgttgccatggcatagaacaattactatccatcaaagaaccgtccattgaagttgtattgctggatgatgctttccagcaccgttacgtcaagccgggactaagcatcctgctgacggattatcaccgcctcttctgcgacgatactttacttccggcaggtcgtctgcgcgagtctgtcaacggtaaaaaccgggcacaaatcgtcattgtcacaaagtgtccgcaggatattaagccgattgactataatattatcacaaaacgactgaacctttatccttatcagcagttatacttctcatcgtttcgttatggaaatctgcaaccggtatttccatcagcaaattcagagattgattctacagtgaatgagttaccgctgagtgctttaacgaatacggatattttgctggtaacgggcattgcatcacctgcgcctattctcgaagagttgaaaatgtataccgatcagattgattcgctttcattcgacgaccatcatcatttcagtcatcgggacatacaacagatcaaggaacgattcggaaaactgaaaggtgaacataaactgattgtcaccaccgagaaagatgcaacccgcctgattcatcatccggtattgagcgaggaactgaaaccgtttatttacgccttgccgattgagattgagatattacaaaatcaacaagataaatttaaccaacacattattggctatgttagagaaaatacaagaaacagcagcttttctgaaagggaaaatgcacaccagtcctgaaacagccatcatccttggcaccggacttggcagtttggcagacgagatcaccgagaagtatgaaataaagtattcggatattcctaacttcccggtgtctactgtcgaaggtcatagcggtaaactgattttcggcaagttgggcaacaaagacatcatggcaatgcaagggcgttttcattattatgaaggttattccatgaaggaagtgactttccctgtacgtgtaatgcgtgagctgggtatcaaaacattgtttgtatccaacgccagcggtggtacaaacgaagcttttgaaatcggtgacctgatgattatcaccgatcatatcaactacttccccgaacatccgcttcgtggcaagaatattccttatggtccacgcttcccggatatgagcgaagcatatgataaggaactgattcgtaaagctgacgagattgctcaggaaaaaggcattaaggtacaacatggaatttatatcggtacgcaaggccctactttcgagactcctgctgaatataaactattccacattctgggtgccgatgcagtcggtatgtctaccgttcccgaagtgatcgtagccaaccactgcggaatcaaggtattcggaatctccgtcatcactgacttgggagtagaaggaaaaattgtagaagtatcgcatgaagaagttcagaaggcagcggacgcagctcaacctaaaatgaccactatcatgcgtgaacttatcaaccgtgcttaatactaaactctatttatgcgaactgaaatagcaactctcggcgagttcggtctgatcgaccgcctcaccgagggaattaaaccagaaaacgaatcaaccaaatacggagtgggtgatgatgccgccgtcctctcctacccttcggagaaacaactattagtaacaaccgacttattaatggaaggtgttcatttcgacctgacttatgtccctctgaaacatctgggatataaatcggccgtagtcaatttctccgatatctatgcaatgaacggtacgccccggcagatcaccgtatcgctcgctctttccaaacgcttcagcgtagaggacatggaagagctttattcaggcattcgtctggcatgccaacagtatcatgttgacattatcggaggcgatacatcctcttctcttacgggacttgccatcagcatcacctgtatcggagatgccgataaagacaaagtggtctaccgcaacggagccaaagacactgacttaatctgtgtcagcggtgacttgggcgccgcctatatgggtctgcaactcctggaacgtgagaaaacagtactgaagggtgaaaaagatatccaaccggacttcaccggcaaagaatacttactggaacgccagttgaaaccggaagcccgtaaagatatcatcgaaaaactggcggctgccaatattgtccccacatccatgatggacatctccgatggtctgtcgtccgaattaatgcatatctgcaaacaaagtaatacgggatgccgtgtctatgaggaacatattcctattgactatcagacggctgtcatggcagaagaattcaacatgaacctgaccacttgtgccatgaatggcggtgaagattatgaattgcttttcactgtccccatcgccgatcatgagaaagtatcacagatggagggaatccgcctcatcgggcatatcaccaaacccgaactcggttgcgcattgattacccgtgacggacaagaatttgaattgaaggctcagggatggaatccgctaaaagaagataaatagattttctcagttatatactgaaaaatatttcattccatacaacactgataataagcaaagtagctttttatcagtgttttttatttatagaagccttgcagaatccaaaactttaactacctttgcaaccgcaaaagagaaacaactgagttgaattagccttacggtgccatagctcagttggtagagcaaaggactgaaaatccttgtgtccccggttcgattcctggtggcaccactatcaactcagtaacaaaaatcccttgaacttttgaagttcaagggatttttgttttatctcttttcttattcactctatcggtgtttaagtacacacatagcttccatcagcatacaaccggtcagatgcgatgtcaatcccacactctcatcatcagcaggtgcttttctccaacgaccgctatataacatagtcttctgattcactccttgctctgccataaccgtagcacaatgagttatgtagtcgcgaaacttattataattggcactatccagtgcagggtcattaatcagtttcacaaaataacggaagaagatgccatgaaacaagccaccgtcaccaccttctgcatcggagagtacaccttcattggtcgacaaatggtcaatcacaaaattggccgcttttactgcatctgccagatattgcttatcaccggtaatcttatacagttcatgagctgctcccaggaaagtacccgagttgtacgaaaatacccatttggtaatcttgccttctccattcatgctgtcatacactgcccccgtctgacggtcgaacaagttattcttctcccatgtatatattttaatggcctcattcagataagcctgtttgggttttccggcctttttacccatagcatcgtaaaaattatacaaccgggcagcaataagggcagcaggaccattggaacaagcgttcttagattttgccacatccgtcttccaggtaatgccaccaaaccacggagcctcatcttccggtccccaagtagaccaaacccaatcatcgtaggtctgtctcgcctttttcagatacttggtattcttagtgctttcaaacatgcgaatctgtgccagagcaatccattccatatcgtctacaaacacattccaccacgggtcttcctctctgcccgcaaaattgaatttcggtgcaccttcccaccataacgggtatatattcaaatactgtttgcttccggtacgcatatatgcatctaccatgacatccatagcatgtgcctgtggccaataatgattggtagtcatattggaaagatcactaccataattaaaataaaaccgattctcataccctttgaagtttgcgccccaaaaatgcttgataagggcttgcgacataccatctgccattttctgccaataaacaggcgtcttttccgccggacttgctgtagttttttctacaattacagcattgcttcctcctgtctcagcagagagctgcaaagtcaagctgagaaaaaataccgtaatcaataagttcttcatgttttctgcgtttaaaagttaataatatttcagactcagcgggcaaaggtatgaaatagtagagataatgaatcattatttcttgccatttttgtacgatatactgcattcttcttccggttaccctctgttcccctgtctgcctgcaatactatttttacgcataaaaaatcccttgaacctctgagactcaagggatttttattttatcatattacacttaagcaaatgaatatctaaaaataagtttcaatacttacattttttgtttttgttttaattctccaccggtttcttttcgagacagatattgaccgcattcattcctttcacaccacgttcaagatcgaatgttacaatattaccttccgagatattaccaacgacattattaacatggaaaaagtacttatcaactccggcaaggtcctttataaaaccaaagcctcttgcctcattaaagaattcaactctccctctcaatataacgggttcctcgtcttctttcttcggagttgcaatgattatctcatccaggtttatctcttcctttttaatgttttcagccggaggagtcgaagttatcattccattctcgtccacataagcaatcatatcatcgaagctgcttttactggataacttcttgctatcctttttcttttgtttttcttctcgtttagcgagtctctttttttcattttcacgtttacctaccgtaatggattttgccatagaacttatatttaatttatactatattttaatgaataatgtaagggaatgaccttaaattgtaaaatcagccctatttagttttttgcctgtcaatttctgaatatcattaatctgtttgcgttcttcctgagagcagaatgtaagtgccatacctgcatttccagctcttcccgtacgcccgattcggtgtacatatgtctcgggaacatcaggaagatcataattgataaccaacggcagttcattaatatcaattccccgggaagcgatatcagtagcaaccatcactcgcgtcttacccgacttgaagttacccaatgcggactgccgtgccgcctgactcttatttccatgaatagcctggctgccaatgccggctttacccaatattttaactatcttatcagcattatgcttggtacgcgaaaagataagtaccgaccggtcctccgatttttgcaaaattgaaatcagcaacaggctcttttctttcttctcaacaaagtaaaccaactgctttatagaatctaccgttgatgatttcggtgtaacataaatcttcaccggattcttcaacaaggaattagtcagagcaataatcgtatcaggcatcgtagccgaaaagaacaacgtttgcttttctttcggaagcttcggcaatatccgtttaatatcatgaataaagcccatatcaagcatacggtctgcttcgtccagaacaaaatactgaatattatccaatcgtatatgtccttgattcatcaaatcgagcagacgccccggagtagcaaccagaatatcaattcctttatgcagcatatccacttgcggacgttgattcacgcctccgaagatgactccgtgacggatacgtgtatactttgaataatcttcaatacattcactgatttgcaatgcgagttcgcgggtaggagtcaaaatcagagctttgatttccgaacgcttgccctctcccttattgagatgcaaatgttgtataataggtattgcaaatgaagcagtctttccggttccagtctgcgcacagcctaaaatgtctttttttgccaatgctacaggaatcgctttctcctgaataggagtaggtactgtatatcctttttcttcaattgcttttaaaataggttcggttatatttaattctttaaatgtcataaatgttatttttgctgtttcagcacagcggttaattttatatatagtaagagagcacaacacattcaatactgaatatgcaaggtctccgatattaaaccagtttgtgagtcgctaagaaaaactcgcgttccagtgtattcatcacttctttcacactgcttattttatctgcgagaaaggcgttgctaccggcaaaagcataaccttttttcatatttcctttggccgcattatacagcgctttaataatgcaataaggactttttgtatagtcacacgtcttaatgcaatggaatgagcatttcctcggcttttccagaccattattcacactatgaataaattctccgtcaatagcccgtcccggcattccgacaggactttcaataataagaacatcttcggatttggagtgaatatacacttctttgaaagtttccgaagcatcacattcaagggttgtcacgaaaatacttcccatctgcactcccgaagctcccagttccataaagtgcgcaatatcttcacctgtcgaaattccaccggcggcaatcaccggaatatgtttctgttctttataactggccgcaatcgccactacttcgggaatcaatacatccaacgcataattctggtcttgcagctgttctttcttaaaacccagatgccctccggctttgggaccttctaccactatcgcatccggcagatagttataattcttttgccatttgtcacagattattttggcagctcttgaagaagatacaataggtactaatttcgtaatactccccgtagtcaaataggaaggcaaatcaagtggaagtccggcaccggaaaatatcacatcaatcttttcattaatcgcagtacgcaccatatcagcataattcgataaggcaaccatgacattcacaccaataataccttttgttttcatgcgtgatttgcgaatctcttctttcaggccactgatgcatttttctgtataagtgcctttttctttgggataaagcaaccccagacctgcacacgatataactcccactcccccttcgtttgctactgctgacgccagaccggacaatgatatcccaactcccattccaccttgtataacaggtactttaatttcaatatttcctataaaaaatgatttcatatattttattctgtgcttggccatttcaaaatcaacacactccgaacatactctattcaagtattcaaagtcgccttcatcattggctgttcgcttgattggatattatttattaaactctcactcctgtttcttccaagagcattgtattacaaaaaagcctaataatctattgtcagaatggaaagtgcaggattatatactcctgatattgcgcataaaagaggcagaattagcagaacttaaatgtaaaatgatttttcgttttctccgtataacagaaattcctccgttgaatcatgaaacggtaatagtctgtataaaagcagaagacattatcttctgcttttatttattctgatattaatatcttcttgaattgttataaccacctccacggttaccaccgtatgacggtttttcagcgcgaggacgtgcaacgctcactgaaataaccttctggtcatattcaactccattcaattcgtcaatagctttttgtccttctgcatcattcgtcatttctacgaaagcgaatcctctggatctgccggtttctctatcaaaaataactttggctgaagaaacttctccatactctgcaaataaatttgtcaagtcagcatcatttgtgccataacttaaacctgaaatgtaaatgttcatctaaaattttattaaaaataaatactaatttggagtgaggaggataattacagaagaggactacttactaataatatattataaagaagaactacacaataatgattcgtgactcaaactctgggaacaaagataacacaattaattagataactatctttttattatttatttttcaagagatgttcaataattatcatttgttagcacgattattgtatggaaacaataagaataagcaaatctctactccttccttgataatatcacggattatatctacttttgtcatacttcaatcaaaaaaacagttccatacatgcgggaaatcaagctaacagatatcacacgggaagaattgtgggcaaagcaacgtttgtcctttaccgacatcgactatgccgtgtgggaacggaataaatccatgcttcatcaattctcgaagatgaaccggaactgtacatttgtagtagacgtatataaatgcagatatgcctatgcttctccgaactttgtagatttactgggatatgatgcccacaagatagcaacattggaaaggcagggtgattatctggaatcgcgcatccatcccgacgaccgcgagcaattgctcatcttacaaataaaattaagtcagtttatatacagtttgcctccggaacaacgaaatgactattctaatatttacagttttcgtgttctcaatgcgaggcaacaatacgtgcgtgttgtcagcaggcatcaggttctggagcagaccatcgatggaaaagcatggctggtaattgggaatatggatatctcacctgatcaacaagaggccgaaacggtagactgtactgtactcaatctgaaaaatggagagatgttctctccttctccgtcactgcagaccttcaatcctctcaccaaacgggaagctgaaattttacgcctgatccaaaaaggactgttaagtaaagaaatagcagacaaactgtgtgtcagcattcataccgtcaatattcaccgacagaatctattacggaaattaggagtacaaaattccattgaagccatccgaataggatatgagacggggatattaagctgattaaggcatccattccagcactcctcccaccggatgctcttttcgccattcttcaaacccggcataagtccgcactccatcccgtatgacagcctgataatattctacccccataatcttttcactttcgggtgtctcatttttcaattgaagaattgtccgcttaatctcatctgtcaagacggaagaaatacgttcggctactttctcaaaatacccatcgtatcgggaacctttccggatatgtatcatatcaatttgccagagtgcattatccgaatcctgataccaggcatgccattcaacacacgcctcaacagtatgcagcagattcacgcactctatcttcttcactgacgtgttttccgccagcttcgccatcgccctgaaactatcggctaaacttaaagaagacgtatatatatgaaaatcaatatcccggtgtttcatcagcaaccccatacgaagagaaccaaccagattaacctgtgcaccaatactttcccatatcgggataacattgactttctctattatttcccatgctttctgctgatttcgtcttgcaacatcaaggatatccatctttcttctagattaaatgagcacgcaaaaataagaaaaaggcttgatatatagctataaataactatttaataccccaccggatctagctaactttgccaccctttcaatcaacttttaatacccaaactgaatttatatatgatattcaacgaaacagaagagcaggaaaaagcatatttgcaacaggtgctcaatatcatcaatgatacgataaacagcacagacaagtctgttaaagagcacatagatactctgcaggaatacaaagattatctatggtccaataaagacatcgatcctcatgaaatccgttccatgcgtgaaagtatactgaatcattttgcacgaggcgaaaatgtgatagacaaacgcaatcgcctgagtaagatattggatattccttacttcggacgaatcgactttaaggaaaatggaagcagcggcaaaaaacttcctgtatatataggtatacacacattctacgatttcaaaaacaaaagaaatctgatatatgattggcggtcacctatttcgggtatgttttatgactatgagtcaggtgaggccacttattcttctccgtcaggtgaagtgcatggagagatttcactcaagcgtcagtaccgcattcgcaaaggtaagatggaatatatgattgaaagttccgtcactgttcatgatgatatcctgcaaaaagagctctgttccaatgcagacgacaagatgaaaaacatcgttatgaccatccaacgcgaacaaaaccggattatccgcaacgaagatacgcccgtactcatcatacagggagtcgccggctcgggaaaaacgtctattgccttacaccgtattgcttacctgctctatgcacaaaaaggaaaaatttcatccaaagatattctgatcatctcacctaataaagtatttgccgattacatatccaatgtccttccggaacttggtgaaacgactgtaccggaaaccagcatggaacaaattctctccaccgtcctcgataacaaatataagtatcagaatttcttcggacaagtttcggaactactggaaaagccggctccggattttatcgaacggatacaatacaaagcttctttcgaatttgtttcccgactggacaaattcatcctccatatggaaaatcactatttcagagcgactgatgtaaaactcaccaagtatatcactattcccgcagaattcgtaggggaacagttcaaacgattccatcgttaccccatacgccaacgatttgaaaccatgacagattacattctggaaatgatgaaaatccagtataaccttacagtgactaccgctgagaaaaatctgctgagaaaagaaattaagaatatgttttcaggaaataacgacctccagatctataaagactttttcgaatgggccggaaaacctgaaatgttcaagatgcgaaagaatcgtatgctggaatatgcagatatggctcccctggcttatctgcacctcgcattggatggaaatagaactcaaactcatatcaggcatcttctgatagatgaaatgcaggactattctcccatacaatacaaggtgatccaaaaactttatccctgccggaaaacaattcttggagatgcttctcaatctgtcaatccctatggttcttcaactgctgccatgattcaaaaagcgtttaccaccggagaagtaatgaaactatgtaagagttaccgctctacttttgaaattaccagtctggcgcagaaaattcaggcaaacaatgaactggaacccattatgcgacatggagaacaacctgaaatttttccattcaagaatgcagaagaagaaacgacaggcattgttaatttggtatcggacttcagaaactccggatatacatctttgggaataatctgtaaaacagaaactcaggcaaaagcgcttgctcagaaactccaagtccatacagataacatatcgtttttgtcaagtctaagttcagcttatacaaaaggcattgttgtcacttccgcacacatggcaaaagggttggaatttgatgaagtgatcgttccacaagctgataatcagaattatcattccaccatagataaaagtatgctttatgtggcggtgacaagggcgatgcataaaatcacattgacctatagcgggatacccaatcggttcatcgaataattcccatcaagatggtggttatttgcccgtttaccgcttctttgcatatagtataccctggcttaacctgtttatcaactaaatgtcttaccctggatttggttgactactataagtatcaactaaaatgaataaaagatgaaaaagagtgacatgacctttagtccttatcagcttgaacttcttggcgatttctatcgttcgaatttctcagtttctcgttttgcccaagaaaaagggattgcccgcattacattttggcgttgggttcgtatctttgaggattctaatcct

SEQ ID NO: 95 - DNA, 29787 bp, Bacteroides thetaiotaomicron
gtgtaatatatactttttcataattttgttatttaatgatcatgtttagaaatgaacgattgcctggaaactaacgcggcccggaatcggataagcacgtccattacttgtggcgagttccggatcgaataatttaacgctgtcccaagtgtgcaaatcgtttgctactacagcgagatcgatcgaatttattccaatactttttaataaattacagttacagttatagttcaggctgatttcatcgagccgtaaatatttgcgattgcctttccagaatgtagatgcctgcgcattgttctgattgctaccgtaacttagccgcgggaacatggcattgggattttctctcatactggctggtatgctgggatcgtcataatcggccggaatccaacggttggcaggattggctgcaatagtgagtacattgcccagtttaccatcatagaaaggaatatatcccacattattgcttccccatgtccatattttgtaatagtctgtattacctattccactgaaacgtacgcccaatgtcagctttttccatcgaaattctcctccgaaaccatacatcagacgcgggtaatcctgatagctgactggtacctggtcgtcactgttaacaacaccgtcaccgtttacatccttatatttgatatctcccggcaggtaacttccgaaatcttgtttcgggctattgttgatctcttcttggtccttgaaaagtcctaaagcgatataacctttcatgtagccattagggcgtcctgttgctgatgtatattcatacttggtatctccttcctcatagtagttcaccttattggtagagtatgtgaaattagcacgaagcgtgaattccatgtctttattgatgcgttggttgaaggtgatattgccgtcgctaccccagcttaccatactgcccacattaccgaatggcatatttacgagtcctacaaaatcaggaacttgtttgcgttcttggaaaattccgtcgcgagtatcccggaagaagtctattacaaactcaaatttatcgaataatttaccttccagaccgacgtcaaacttctttgctttttcccactccagattatctgccccgatcgagttttcccaaatacctcccttggtatacttccagtttgtggtagcggaaccatttacatttatgctggtcagatatggaaaacgcttgtcggtgatacggtcgttaccaactaaaccgtatgaagcgcggattttaaaatagttcaaccatggcattttatcttttgtccattgataactactcggtacccatgcaccagatatggatggaaagaatccgaactggcgtcctggctggaaattctcggaacctgtataaccgaagttgccgtcgactatatatgtatcattataattgtagccgactttagcggaaagtccttgataacgaactggaatagccgacatcgtgtcattggcatcagttgaccgcttttgatcactcatttcataatgcgccagtgccgtaagcgtgtgtccgtgtcctaaatcatgtgcccagttcatggtagcctgaaggaagtatttgcggtattgcatttcccatttactgtactgggtcgttatgcgttcggtctggcgttttcctgcgagttctccagttgcattacgcttatcatatgaccacagttcggggatgatgtagcgtgtttcatgaaaagcgttgtcgttggtataggctccttgtatattcagcttcaatcctttaatcagcatacccaggtcctgatctaaacttaatgtataagtagaagtgaattcttcttcttgtttcaatcctgtgtggttcagaagtacataaggggacatttcatctgtcactccattggctgaaggaagcattccgttagagtaaaccactggtatggtaaccggagtcagtttgctgcaagcagaccagatcagattagtatctgcggcacccggcaggtttctgattgtcttattggcattgacaccaaaatataatttggtagttttagttaaatctatatcaatattagcacgtagcccgaaggtattatatgccaaacctttaaaatacttactggatttatcctgttggtaagcagaagtctcgttagaaccatttaagctgataaagtatcgtgctatactaccaccgccccgggcactcaaataataggtttgttgccaataagaccttttgagaacttcatcctgccaattgacatccggatataaatccgtatccaggccgtatttaatgatatccagttcctgattcgtatatttagggtcatcgccacgtacaacgagtgcttcattcgccaattttgcatagttatatccgtcgcaatattccggtaggcgctttagccatgaaatagtagcatttgcacgtgcagtaaagcttaacttttcttgttttcctcttttggtggtaacaagtactacgccatttgccccccgtactccatacatggctgttgccgaagcatcttttaatacggagaaactttcaatatcagccgggtctacatcattcaggctaccttccagaccgtcaatgaggacaagtgctgatgcgtttgctccaaatgttccgataccgcgtatccagaaatctgagatatttttacccggttcgccactgccttgtgtcgagataataccggcaactcgtcctcccagcatattagccagactggtggcaggagtctgtaatgtcgctacgtctacggaagtgacagcacctgtcgttgttattttacgagtcttgcttccataagcttctactaccacttcatcaagtgcacttacatccggtactaattggataaccagttttttttcagtttttaatgctagatactcgtgtctggtatatcctataaaactgaactgcactttatctccacgatcgactttcaaaacaaattttccatccatatcggtgttcgtacctatgcctgttttatcttttacatatacgctgactcccgggacaggctgtcctgtttcatcttggactataccggatatctcaaacttttgctgtgcttgtgccattatggtaatggagcagaaaaacagcataagatatattctatttgttatataagctttcatttttttcttctttaaacgattactactcatcattacataaatgccagtttcattattactttattgcctgcatctgcaacgtaaatgtcattttcgggagttatacagataccataaggtctgttcattcttgaaactgtaggatttccggcagcatatccggatttcccgcctattcctgctacggtactcatcaattttgtctccatattgtacatacgtacacagttattgttggcatcacagatgtatatcaccttttctccggtttcagggtcgtgcattgacaaaatctgttgaggattgttcaatcttgccacagaaacgtgtccatcttgatatgctcctggtccctgtatgccgcagacatctgtctcaaagccgctgtcttccggattctttgtcaaatcaatgcaggttattttgttgtattcattcaaggcacagtaaatcttggtcgggtcgtcggggtctgtagccagacatgcatctgatttggcaaaagtggtgacataatcgtagacacgatcttcaagtttgaaacggaagaattgaccttgccacgtccggcaatagataaaactttcgccattagcatctgttgcacgagcataggaacacatatactccaacttctgaccgcttggtacgggacgatatccttttgcctggtaactggcgtcgggggcaatcaacttccttttcacaaaagaccatgaatccttaggatcaacttcccaaaaaaatggagcatggtgcgcacagaagtaaaccttctctgttttgtcatcataatacggagtgctaggcgagcctccgttttcagtagatgctccataatccaaaaacttagagtagttctcaggttcattaatgtaaataagactgccactttgacctgtatttttatggttcatatatatgacgccactgggatcgcacgctagatgctgcatactattggcaaatgttgtggtttccaagcttccttctacaaatgtttctgtattggagttgagctgtccggctacatatatcaactgataattcttttcataggcgaaatgcttttctgcgaaaatagtatcggtggtgttaccgtttaaaagcatacctatcttacaatcatcgcccgggagtttcgggacatgaaccagcacccgatcgccggatgctcctacaacaatcgcttcttttttattaaagaatacacgtacctttttagggttgttgccaaagttttcaccctggaggattactttatcaaagtatccgccttcctggggagacaattcgctaattctgaccggaagattagggttatacccgtcttctcctttgtcatcgctgcatgaaacaattgtaaacgctgtggtcacaaaaagaaaagttcggagtccaataagaggaagccatgtgttttttctcatacttttcataaatattcctattagattatataccgcaaatgtaacaactcggcagtccacattgtaggactaatacgatttagagtaatacaatatcgacatgaacgactatagcaggatttattataaaacaatatcgatatattatttaaaattatcgacatcaaaagagttatatttattttttatatatctttatcttcacattaataaaccctatatgctatggcttcatttgttgataaattgcacccgcttgttttgaacataggtttggctattcataatgccgattggaactggaaaaatgtcaatagcccttttacacgtttatattatgtgacagaaggtactgcacaagtcttaatatcgggtaaaactcagattctaaaagctaaccacatgtattttattccagcttttaccaaacatagctatatctgcaactcttatttttcccactattatctgcatatatatgaagaacaccagtcagacagcaacttactggacaattgggattttccaatagaaatccccgctgtcgaaatagatttggcattatttcagcggctctgcactataaatccacatatgaccttacagaaatcagacccgacttcttacgataacaattacacccttatgcagaatctgctaaaaaacaaacaacggaccttgtctgataagatagaatcaagaggtattgtatatcaattgctagcacgtttcctaaaaagagctcaagtaaaaatggaattaaaagacaatcggatagaagaagccattcactatatccgtaaacatataaatgaaactattgatttaagagtactcgctgagaattcctgtttatcaaaagaccattttattcgtctattcaaaaaagagacaggagatacccccttaaaatacattaaccgtaagaaaatagaaaaagctcaactcatactaataaccgatgatatgtcaatcaaaaatgttgcattaaatcttgcttttgaagattattcatacttcaacaggttattcaaaaaaatcacaggtattactccccaagaatatcgcacctcttatcactcttaagcagaaaaaaaggaatagcaactttcacactattccttttttctcaacacgtagtaaacgattacgttatcctcaactaatcttcatacagataaaacatacgttccatcaacttccatttttcagcagaagaactcaaatacggacagtcttgaaatttagacacatacttttcccactcagcctgccgcggaagattagacagtttatccatagctatctcccaatcaaagtccagtggagtttctataatcataaaaagttgtgatcccaatatataaatttccatttccagaatccctactgcacgtatccccgcccttatttccggccatgccttttcttcactatgtatcttacgatactcttcaatcagaatcggattatttttaaggcttaaagtttggcaatacctctttgtaggcatgctatactctttcattttgtatccctgaatagacgacatagtaataacttttattttctaattttcaagacaggggctatattcttcaacgatttagcgggtatatcaacaacaagtcccttatcagtacgtgtaaaagatacttttccgtaaccaagcaactctattctgcctattttagtgggatataacccgttaccttccgctaaagacctaattaagattttcccatcttcaggccatcctaaaactgtagcatacaaatttttatctgtttgtgtaaaacgtatttcctttgcatcagctttactataggcccattcgttaaacccctgggcgttgagttgaacatctttatccgctataggtccctcaccaaatattttccatggacgcgtttgatagattgcttccttattgatattcatccaattaccaaattcattcaatatcttttcttctttttcatcaaatgtaccatctgcacgcaacgggacactcagaagtaagttaccatttttactgacaatatcaactaacagcttcactacgtcagctgccgacttatattgattattattataaatagacgtattataatgccacccgccaaggcacgaacatgactgccaaggttcatctattattttattaggagctccacgttctacgtcccataccaaagctttacgttgatttgcatcaagaatcttaccaaacattacggcattcaatttacccttttgcattgacatattatgattataaaaatgagccgcaatttttaagcctgcatcacttataggataaaaaggtgcaacagttacatcaaaatacaacaaatccggattataacggtttattacatcaagtgtacgattatagaaattagtgcaatattcctgtgttggtaaacaaactccatttccccatgcccattgcctatgaattgtaccattatcccaactatcctgacttaacggatgattctgagcatacaagtcctgaggatcatatccttcccaccactttccttttccatcagctttcgttaatttcccatcatacggaataccttttttaggaccttgagtatcgtgtctttgggaagtctcataccaactccaggcatggtctgcatgcagactgaccccaaaataaagtccatgtttacgcgctgctctttcccatcctttcaatatatcttttttaggccccatattaaccgagttccatggttgatacttactatcccaaaggtccatattatcatgatggttacccaaagcaaaaaaatactgagcacctatttttttataaaatgcaaccaacttatcggggtcccatttttcagccttccataacggaataatatctttaaagccaaattcagaaggatgaccgtagttcgctatatgatgtcgatattcaggcgaattttccatatacaaagaacgagccatccaatcgccagatccttccacacattgggggccccaatgagcccaaatgccaaactttacatttctaaaccattccggtattttataattagccaatgattcccaagtaggctggaatttcccttgcatcataggttcatcttgctccgaaacaggaacctgatagttttgagcagataaagtctccgctataaataacaaggatagtaatagtaatttttttgctttcataaatattacgattgaattatataatgcaaacgtagcgcttttttagtgaaaaaaaataggatgaatacgatttacaataaaacaatatcgacttttaaaacaatatcatttattatccttactttattactgccacaaatcctccacgaggaagacatgacatatccattttatcgtttgataactggatgtcttcttcgatggcaaaactcttatcgtccaccccatccttaaatacatccatcgtttttccttcaacttgcagaggaaccaatgaaaaagaaagagttttattctcgttagttccgttcaatcctccaatataccatacatctcccttacgtcgtgccagtacgatgtcagcacccggatagccacacaacagttttgtatcatcccaagcagtaggtaatcccgaaaggaattctcttacttttcgaggtaatgaactgtacacctccggcctatcaggcatatgctgcaatgctgactcaaacacaacagacaaagctagttcatgcccacaagtagtgatatgaggatgttgggaatcagagaatgtaccaggtgtataatccattgagccaatgacatttctggtaaatggcaatgttacattatgttcagcagcacgatctgtaagtattggcttattgttataccactctgccccataaacggcttccatagtcatcagatgaggataagtcctttgccatccacgaggaatagtagctccatgaaaattgaccattaatttatatttagctgcatcttccagcaaatcaatataataatccatattagacgaataatcatcaggaaaaaaatcaatcttaacccctactacacctgacttttgaagccaagtatattcctttattctgttttccttactattcaagcggtaaagaggacccggccccatccaagcagttgacgaattataccaaatcataggctttatatttcgactaagagaataggttatcaaatcttcaatatctccaccgtttgacatttcattccattccgcatctatcagactatatggccacttcatatcaacagccaagtcaatgtagtcttttacaatcttgaaatttttggaaccatgattatgcgcccagtatacccatgatgcagagcccggcataatccaacttgtatcagaaattttgttaggttcagagacatctgttaccaaagtagattctacaatatcagacaaagaacctatcataagaactctccatggcgatgtgaatgaatcacccaaggctaatttatcatctgtcatccgcacttgatattgattcatatcatttccattatacaatctggaaccactatgtccacgaagtatattggcctcagttatcaacacaaacaatgaatcggctggttccaaaagtaatggatagccccacatattgtctttgcctctttctgctctggttttcaatggatagaaaccttcataaccaacagaataattctgtatccatcttttcgttccttctggaatatagtaagctgtatgttcagatgtcagactatccttatcttgaacagatggtaagctatatcgaaatacaatcccgtcatcgtaagccctgaaaacgatatctaaggtttctgccttctcattctcaaaccgaaatatcctttcatttcctctattctgacaatgacttcttttaccggtaagcatcacataatcatcttcaattagtttagtaccggacacagatttcaacctgatgttatcggtaaatgacataagctgggtttccaagccaattcgggtatcagatagaacccttctggaagttttaccatctttgtactctacattaaaaaagactttgccaaaaccgtctttttcagtatcttcctttatttcaacagaaagacatatcttcccattaggagaaatcacacctgtatctttttgagaacaagaacagaatggaatacaaatgagcacataaagcagtaattcataacttaaacaattaaaggaatgtttcatacactaaacagttaatataaataaataaactcatccacatcgatataccccgcatccgctatattattaaaacagtaaatcccaatgcggcttccccggtaatatccccattcaagttgatatacctctccgaacggggtaaacttcctgccatctgtactatatgaaaattggctttttccatccagcccccatacagatttaatccacaccttgtttccctttatcgcaggacctgtgattttctctttattggtctgaaattccagattccggtctttgccggactggcgtacccccaccatggcataactcttagagtaatgacacagtccggctttctgtccgtcaaccatgccctcaatgttcatttttacaataacctcatttttgtttgtacgaaaacaacgctgagtcaaggtatttcccgctttcagcaaattatccgtgactaatggacgaaaagcttttaaccgcaaattgcctggtctttccgttaatgaccacatctcgtcccggggctggtagttccattcccattgaggagaaagtaccgacttgctaaaatcatcagatgattgtggagtccgaaccggatactcattggaaggcttggccgcttgccataccattgtgccaatgccatcctgcccaacctcaccaataatcggccaaccatcgacccaatataccggtagcagactagcaatccgacctgcccagtcacccgtaccatggtgggtaaaaaaataccacttcctgtcaggaccttcaacaagtccgccttgattaggctcattatattcacgctgtacatgacttaattgtttcctttcaagatacggtcctgtaattgaagaagaacgttgcatcatgatatatctaccgccatttttaacttcactgaaaaaatgataatatgttccgttgattttataaagtttacttgcctcgcgaccatacccctcattaattaatattttagagttttcgatcaaggtcttcccatcaggtgtcatccggtacaggtaagttttgtatttatcagcaaaatgggtacctacaaaatatagttgcccgtcatcgtcaaagaaaggacaacagtcatcccatcccttttctgcttttacacagtgcaacggttcccacggtcccgcaggatcggtagctgtcgacataaaataaccttcatccggtgtaccgaaatacacatagaattttccctgataataacgaattgcccctgcccaaatacctcggccataacgattcatacgcgtccagttcatttcttcactgatctgtctcagatcagaaaccacatgacctttaatcgtccagttcaccaaatccttggaatgtatgatcaccatacctggggaatattgaaaggtagaagaaatagcataataatcatcccccacacgaatacaatcaatgtcactgtaatcggaaggaaggacaggattacaataggtgccatctccctgatcgccccaagttgtccattctcctcacttgtaatcattctgtgcaaatacatttactgttgacaaagtaaaaatcaatactacaatacatgtggggactttcatattcatttttatattcatacacttttggcttattaataaatattccattcccagataccggggactccttttaggattttaattctcagataacggaaccttttattcaagacatcggtatgtggtgaacacatcttcctatcttgatggacagcgaactcttgccagacttttccatccatcgatgcttcaataacataagcatgtccggcagtagggcgtacaaaataaatttcactgcgtctgaccttctttacagtacccaaatctgccacaatccatggattaatactatcttcggcagcagccatccatcgggaaccatttgctccgtccaccgcaaaagaaggaacaaaatattctgtccgcagacatgtcgggtctttcatcggttcaatcttcaacggcacttcaatactagacgcataaactgtatctattttcatttttttatctgatttcaccttcttcaatgcccccactccatccattgttagttcgacagggcgaatcgtaccgtcttcattaaatttcagttgattcacatatgtctgacggtttgtacttcgcctgccaaactctaaatatgcgaaataataattatccgtaccctcaggatgaaagacacaaccatgtcccggtccgaagattccccgttcataattggtagtagatattatatcctgttcaggagcttcaaaaggtcccataggggaaacccggctcattacatacgcatattgatatttctcatcccctccgatagtgtacaaataataatatattcctttacgtttgaaaaagataggtccctcagagtactccttgcgaggagtagaaattacctgtactacagaatccaccgtaatcatatcctcgttgagtttggctacatgccttcgtccccaaaacacataagcctgcccatcgtcgtcaacaaagatttcagcatcaatcccgcccggattcttactctgcaataaagtagaaggagtaaaaggcttatagaattcgtctttcccacgtgccagtttaaacggtccttcaggcttatcagctacagcaggatacatatacccattgatagtgggatatatataatatttaccattagcaaaaattgctttactgggagcccaatacttctcctttgcagccgaagggaagtaagttccatcaaaactccagtgtacaaagtcttttgatttccatactaccggagggcctgatgttttaagtccctgcccatagccatcagtagtggcatagcaataaaagacaccattaatttcctgaatactcgcatcggcaatcatatccggaatcaatgcattgccaaaaggattattgtgctgagctttcactttccctaccaacatcattaccagcacaaaactaaaaaagatctgtttttgcatactattatctattatccaaagttaatgcctgattcatacaaaaattacagttgaataagacaatgcaaacgtactttttttctggtaagtttaataggataaatacgatttacgataagacaataccgatatttaaagtaacagcatttacaaataaaccatattgacaggctactttatacaaagaatacctccttgagggcggatttccaactgcaccttaccgttttccttcactttcagtgacgttaactccggttctccctttttatcatccttataaagagccaccgtctttccggcaaacatttccaaatccagttttagtttcagcggttctttgccggcatttacagctgccagataccaggtatctccctgacgacgggccaacaccacatacttccccggatagccatcgacaaaccgtgtctcatcccacgttgtgggcacccgcttcataaagtccatgcaaacagccggaacatctttcagattgttaggagccagtgcaaagttttgaaccggattctgcaacagaacggtagtcgccaactggaacacgtccgtagtccggcgtgttgtaccgccgtcgttattacggttcaggcgcttattcagaaagcagccgccaaactccatcgatcccaccgtattgcggataaacggatgcaggcaagtattgaacgcttcctcatcacagaaatgctgattgaacaccatattttccgaagccagcactgcttcactgcccacataattcggatacatacgctcccatccgcgaggtaatgtgcaaccgtggaaaatcaccatcaatccgtgatcgtccgcatcactcagaatatcttcatacagccgcattgtctcctgcttgtcaccgccgaagaaatcaaccttgattcccttcacaccgagactttgcagccatttcatttcacgtttacgaatgattgcattatccattcggttcaccggtccctgttcaatgtcattccaatagccggaagaactataccacaagaacaactcgacacctttatcgcgtgcatactcaaccagcgacttcatacgctgatgcccgattctagtatcccaccagttatcgatcaacgcatactcatatcccatagccgaagcaaaatcaatgtaacgtacctgatcatcatagttgatactgccgtcctgccaaagaatccagctccacgtgccacgcccgaaacgataatcatgttttgtttcataaagcgggcttaccacatcccacggaacggttgtttctacaatcggcttcagatgatctcccactgtgatggtacgccacggagtagcgccgggcagtgcaaaagcaggagcgaccgttccgtttccattattttcttccgccatcggaaaggcgaccgtatataaattcccttcactcacatcactcaaacgtgaaccgcaataacgactgtccacacccgtctcgctgaccagcacccaaccgtcatttcctatacgaaacaaacaagggaacgtatacccatgtccgtactgcgaacggtcgctcatcggcgcatccgctttatattcttcttcataactgggtttcgtacgtttccagccaatcatcgcatcgctctgcggacacaagaaagtagtagtctgctccggaaagcggaaacctgtttgttcttccttcaccgtcacactcgcttttcctccctgatgcggcaaagtatagcggaaagccacatcattatcactcacccgaaaaataactcccagcttttgtccctgctcattctctaaatgacaagtcagttcattggcacggtaatgtacgttggaaactttgatacgtgtctgttgataaacagtatcgatcttgtcgacggaatgtccggtcagtttaagattcttcgtaaaatcaccgatattggtattcatgcctaaaggagacttttccaacatcgtctttccgttgtaactcacagaataacaaggcttcgtctcgttttgcacaaataccgccaactgcaacttttcgtccggtccttttacaaccacatcctgtgctgcaagagtgcttataccaagaatcgctgtcaaagtgcttacaagtttcttcataatattatttttcttttatgattaaatgtcctcattgtaacaaaagcaaaaatagagaatataattatattcgcatacaaactttcatcgtttgcatgatttccccccttttttgattgatatgcagacattccctcccgaaaccctttacaaaaagaacagtttatccaagtataaccccgactttttttatctttgcatcatcgaacatcataatccttatcccaatggcggcaaataaccagaaaaacacccgaatactactattcctcctcctgtgtatcaggatgacactgacggtggacgccaacgacttcctgtttacatcgatcaacacggcacaaggattgagcgacaaccaaatacgctacatactccaactccccgacggaagaatggtattcaccaccaacgggaatgtcaatctgtatgacggcttacatttcagctaccttcaccgcacggcagaagacgtttccccgctgaaacagtatgaaggatgttaccgcatctatcaatgcggagattcactcctatggattaaagattatcataaactgatgtgcatcgatctccatcaagaaaaatacatacctcaccttgactcctatttccgcagaaaagagatacacgaaccggtagaagaccttttcgtcgacaattcgggacgtatctggctacttacttcccaagagttgcgggaactggaaacaggcatccgtctcaccctgccggagaatgaacatcgaaagctacaggacatacattcggatgaacttgcggtttacctattctatcataccggtgaagtcgtttgctacgacccgaaaaccgggaaacagttgtatgacagagctgcttatcccgcctccgaacaggagaacttcaaccgtacttctctcgttgtcaaaagcaaaaaaggattctaccagttacgcaacggccgcaaaggaggattcttctactttaatccccaaaaccggacatgggaaaagctgttcgaacagaactacacgctcaacaccctgatcatcactccacagggcgataaagcatatatcagttgtgtccacggtttctggatcatcgacctcgaaagcagggaacagcaatacatccccgtactggaaacaaagaagggaaagctcgtttcgaccgaagtcagcaccatctttcaggatgcccaaggcgggttatgggtcggcacactcaatcggggattactctatcatcatcctgccacacacaaactgattcacgtcagccgcactgctttccccgcatcaccggaagaggatgtcgctgtcaaagcttttgcagaagatgataacggcaatatctatctgaaaagccattccacaatctatcagttagctgtcgatcaggacggttcacggactctgctacctgtaccagcctcatcggtctctgcagaattggcaaaggaattagatcaaagggggggaaacaaatattacagaggccaatcatacaccgctctatgcaccgacacacggggctggacatgggcagggacagccgatggactggaactcttcaccgatcaagagcaaacaccggacagcaaaccgaccacacaaacagcagataatcaatccgcctcacctaataaacaagcccaccgcattttctatcgtgaaaacggactgagcaataacttcgtacaatcaatcatcgaagacagaaacaactatatctgggtaactaccagcaatggcatttcacgcatccatatcaatccggagaatcaggaaatcggctttaccaacttcaatcaactggacggggctttagaagaggaatatatacagggagctatctttgagtcttcggacggtacactctatttcggaggcatcgacggctttaccattttccgtcccgaccataaatccgccactccgggcctgccttacaaaccggttttcaccaacttacatctctacggtgaaaaagtaaacacgggagaaaagtacggaaaccgcatcatcctgccacaagccgccccttacacaaaggacctagaactggactacaaccagaactttctgaccttcgaatgttcggcactgaactacgtgaacagcgaacgcacctactaccgctaccaactggaaggcatcgacaaacaatggatgaacgctttcgccagcggacaagggaatgcaacagtcggcaacggcatcctgcaggcatcctataccaatctaccgccgggagattatacattcaaagtcgctgcatccgacaacctgttacaatggaacgataacatcacaaagatacacgtcactatccacgctccctggtggaaaacgactaccgcctacgttctgtatacggccttcgtgttactgattgtcttagcaagcatccgcctctatatctatcagaccaagaaaaagatgaaacagcaacataaagaagaaatcctgctgctccgcatccgcaacctgatagagcaatgcaacagctatgaagccgaacagaaagcccgttcggagaagaaaagccacccttccgtctgcgacaggaacgaaacggcagatgataatgaaaagccaaacggcatagaaccggacagtgcagaatccgcctttttagtgcaagcgatagaactggtagaaaagaaccttgacgtcaacggctactccgtagagcaactaagccgtgacctctgcatggaacgcaccggactctaccgcaaactggtgactttgctcgaccagtcccccagcctctttatccgcaacatccgcctccaacgagcagcgcaactacttgccgaaggcaaactgagcgtaaccgaaatagcggagcgtaccggcttcagcagttccagctacctaagcaaatgttttcaagaaatgtatggatgccgtccctcggaatatacggagaaagcgaagaaatcaacctgattgttgtttgtttcaacatagctattgtccgcaaaacgtccttccatcctacctttgccgtatcataaagcacttaaagaaaccatgaaaatgaatctaagaaaaacaggcatcctgttggcatgggccatgatcattgccgcaaacggtacggcacaaaacgtacaacgcacttcccaaggcatcaagtatgcagcacaagggatgaacgtcagtgtagaattttattcgccttccatcatccgggtatataaaacgcccggcgagacagcttccgacaaagaaagcctcgttgtcatcaaagcaccggaacaaaccccggtttccttcggtgaaaacgggaaaaatgtaacattgagcagtcagatgatacaagtggaagtgaaccccgaaacaggcggcatccacttctttgacaaactagggcaacggctgctgaccgacaaagactacggtacacagtttacccctttcaatgacgcaggcgtcccctcctacaatgtccgtcaggctttcctgctggataaggacgaagtgatctacggtctggggcaacagcagaccggcaaagtgaaccaacgcaatcagaaactctttctccgcaaccagaacatgagtatctgtatccccttcatccactccatcaaaggctatgccctctactgggacaattactctcctaccaccttcctcgacaatccgcaagaaacctccttcgactcggaagtaggcgactgtgccgactactacttcatctacggcggcaacgccgacggagtcatagccggagtacgcgacctgaccggacaagccccgttgtatcctctctggacactgggcttctggcaatgccgcgaacgctacaaaagtccggacgaactgtgcgaagtcgtagacaaataccgggagctgaaagttcctctggatggaatcatccaagactggcaatactggggctgcaacgagaactggaactccatgaaattccagaatccccgctacatcaataagatgggtgacccggaatacatgaaattcctcccgaacggagaagacaaaaacgccgactacggcactccccgcatcaaaagccccaaagaaatgatcgactacgtgcacaagcagaacgcccacatcatgatctccgtatgggcctccttcggcccgtggacagaaatgtatcagaagatggacagtctgaaagcactgctccacttcgaaacgtggccgcccaaagccggagtaaaaccttatgacccgtataatccggtagcacgggacatctactgggaagcaatgaaaaagaacatcttcgacctcggcatggacgcctggtggctcgactccaccgaaccggaccatatggatatcaaagaccaggacttcaacacgcagacttatctgggttctttccgcagggtacacaacgccttccccttaatgtccaacaaaggcgtatacgaacaccaacgcgccactacttccgacaaacgcgtattcctgcttacccgttcctccttcctcggacagcaacggtatgcttcccattcatggagcggagacgtaacttccgaatggtccgtcatgcgcaagcaactagcggcaggactgaactatgcgttatgcggcatcccgtactggaacacagacctaggtggcttcttcgcatggagatataacaataacgtaaacaacatcgcctatcatgaactgcacgtccgctggtatcagtggggagtattccagccgatcatgcgttcacacaattccagtccggtagccgtagaaatctaccagttcggcaagaaaggcgactggtcatacgatgcactggaaaaatacactcacttacgttaccgcctgttaccatacatctacagcacttcctgggaagtgaccagcaaagcaggcagcatcatgcgccctctcatgatggacttcccgaaagacaagaaagtgctcgatatggacaccgaatatatgttcggacgcaacttcctggttcgcccggtgacggattcattgtatacatggcaagacaagaagcaaaacggtcatcagaaagacatgagcaaaatcggaaagaccgatgtttaccttccccaaggtgcccgctggatcgacttctggaccgggcaaacactggaaggcggacagaccctgcaacgtgaagtcccgattgacattatgccgatctacgtccgtgccggctctattctcccctgggggaccgccgtgcaatactctacggaaaagaaatgggacaatctgaccatccgtatctatccgggagcgaacgcggaatttaccctttacgaagatgagttcgacaattataactacgaaaagggagcttactccaccatcaccttgaaatggaacgaccaagaccgtacactgaccatcgacgaccggaaaggcagctataaaggaatgctgaaaagccgcaaattcaacctcatagttgtagaaccgggaaaaggctgtggcgacggagattcaaccacctttgacaaatccatctcctatagaggtaagaaagtgattgccaagctataaactgacgataatcagataactaacacgagttcgatatggtccatcttgttggattatatcgaactcgtgttccttagtaaaaaacatacttcttattgtcacttatcaccttttgaggataacctactgattattagccatcattgggtgataataagtggtgataatagggtgacaatagccatacatcacacattttattgtcacctttccccatcctattacttgttacttattacgttcccctatatccagcccctaaccttatacaacaaataccatatactaccggtatctttcacttatagtgcctttattcttccattaagacactgatattgttagttgttcacggccgtggcaagagttgatcacgaccgtgagcaatgctcttcacggatgtgatcagacctgttcacggccgtgaacaactaaagatatcggtgtcttattcctactttccctataggaaaaagcaaagatgcaagaggttaaagagaactttagtactatcttacggctgattacactatagacagcaaacgaactacccattcggtgaaagatgaaaaccatcttttctattatgaagaagaaaagagaaggtacaaaagtcaataatacctaaacctggactgactaaaaagtcgattctatctcgaatctcctccttcgggaaggaggagtggtcgaagaccgaggtggtaggaaaaataatgtttgttcctatttctttgtaaatgacaggattatgtattcacctaccacctccccctacgggtactcttccttcccgaaggaggagatttaggatactattgactttttagtcagcccctacccacagggggagatgataggtgagcacccctcccccaaaataaactaacccctattgaaaaccagtttattgcttattttttcccttttgtgtcttcaagcggatgaccgtgaacgaataagcaggcaattcctgcttgaagctggttcctgcctctatcgtatccgtcaccggaagcggagtcgtctcgggtgcacctgccagtacagtccgcgtagcggaagactggataccatccattcccggcaaccggacatccgtctctatgctgacgggcaacagattcaccagtttcacaatcacatcccccgtcttactatcacgaacgatggaagaaccaacacggagttttacgcgaccgtcctgattatcaaggtttatctgtgaagggatgtaatggtcgcctgcgttctgaccgtacagtttctgcacatagtatcccgttgtcggtcttacttcccgattgttgaagtagatcaggtccggattccactgcgtccgcccgtcttttgccagcagaggagcataagaactcatgtgcactacatctccattccgttccaaagcagccagataaagtgcttcggtcaaagctgtttccatattcgctctgcgtccggggatgtgagtggcatattcgcccagatatactttcgtctttttagagcggtcgtacttgtcatagaagtcctgattgtgcaggaaccatcccggagactgataataatgttcgtctaccatcggaacaccgagtttgtccgccagtttccagccttccacatagtctgttccctcattgaaaggacctactgtgccgacaacgattatctccggatatttctctttgatagcaaggtatatcatcgtgaagcgttcttcgaagacatcggtgatcaagtcttcattgccgatgccgatatatttcagattgaaaggcttcggatgaccggattcggcacgtatcttgccccatttggttttctttgcatcaccgttcgcccattctatcaggtcgaggatatcctgaatgtaagcacccatctcgctcatcgggataccgccttgctgaccgcctctcaaatcgccatgacaagcggaattctgacaaggtacacctgccgccagcaccggaagcggttccgcacctatatcttcgcagaactggaagtattcataataacccagtcccatgctctgatgatatccccaaaggttacgggcaggtttacgggcttccagcggtccgatggtgtttttccattgatagatgttcttcaaaccgtctccatgagccacgcagcctccggggaaacggacaaagcgcgggtgcatatcggcaagtgtctgtgcaaggtcgggacgcaaaccgttctttctgcctttgaatgtattctgcgggaagagagaaatcatatccagttcgatttcacctgccgattgcgggtgaagttccagatgggtatcggcggacgctttcgctgtcagcactgctttatacgttttccacgaacgggaagagacggtaactgtcgtttcaccctgtacggtgccgtcggcatctacgaggcgtaccagtagttttccggacttgctaccttccgggatacgggcaaacagggagaaatcatatttctcgcctgctttaagggcgattccgtcaaaaccggtgttggtcagggcggctcccggctggttcgtcttcaagacggcataatgcggattgttcggatggatagggtccgaagtcgatatggtaaaggtggcgttttctccttccagcttccatgaatgggtgctgttccagttcttgtccccttcacggtcggacggctcgtattcgaagtcccggttctggatcagttcggcatacaggccgccgtcggcggagtagttgatgtcttcgaagaagatacccatcaataagtcgctgatttcttttgtttcttccggttgtgctgtgacggtggctttgaccgatttcagtccggcaaagcgttctttatcctgtacagggcgttcgccatacagggagttacggtattggttccgttcgtaggtttgggtcagtccgtccactaccgaccagggcacttggctgacagttcccgtttcttcgtgtccggcaatctttgctttgactcttgttccttcaaaatcggaagtcgtacggggatattgctgagcttcccagtagatcaggtcttttgatctggcctgaccgtatccatcgtggtcgttcaacttccagacacagagccattccccgccggggagttgtttcagattcgggtcgagcatcttcttctgcgatccccaacggctgtaatcgcaacgaagatagccgtagtttcgtcctatttcaaaccaatgttttccgtccatgctccatgcaaagcggagtccgctacggccgtcgtcacctcgggtggcgtaggcaaaaagggatactgaatcgggagtagcagtcgtttcatgcgttgcggcaaatgcggccggctgcaatgataataataatacactaaatagtagaagtaaatgtttcatggtataaattataatataagatctctgcaaaaaaagagtatgtattcactaaaaaagatctgatactctgttatttcctgttttcccaatgacttctcagtttggcggcttcttcttttgtcaaatggatcaccgcgccgtgtttgggcgacgagaaattagtcgtcttcatcactccttcgttgaaacgtcccaggttcttgaaattcacgaagtcggaagtctcgatgaaagcgaagttatgggggttgatgccgtagacgtcgtacatcaatacccatttgtcttctccgatacgcttccagaggttgggagcttcgcaggccctgggttcgaagtcgtaccagcgagggtcatattcgtaatcaccgttgattcggtctgacacggcctgtttgattccggcgcctccgtcgtgcgaaacgtagaacatgcgataccggtcgcctaccttggtgatgtcaccgtcgatagccgatattttctcgttgggatactcgaagaggatttgcgggagtgtctctatccggtcgaagtcatcattgacatagacatagtacagtttgttcgcctcgttcttgaaacgcatggtgaagtaaatcatcagtttacctttcttgtcatcgtaagtcacttcgggcgcccatacgcagccgatttcacccaagcctgccgataacaggtcgaaacgggcattggtacgtttccagttgatcaggtcccacgatttcatcagtacgagtccgcggttgtttccccagccgtattcttttccgtcacgttcccattcggtatcacggaagccgtctttctgcgcatagatgtgcaggtcggtcatggaaaggtagaaagctccgtccggtccacggaagatgtgcgggtcacggatacctttttgcagggcgatggtatctccggcgatcaccggtttgccgtcgttcaaggcagtaaatgtatatccgtcgtcactgacggccatataaaggctgtgcgtctcgtctttatggaagaccatcaagtaagcccccatgtccttttcctgcgggatggcgttacggtaacggaactgacggaagccggcgctgccttttccggaggaaagcagtccgatgcgtaaagcgtagaagccgccgtagttgttatggtgcagctgagatacatccatgttttctaccagcgtagtccattccttgccgtccttgctgactgctatccggacactgtttccctgattctgtatcttggcgaggaagcgtttgcccaacttgttagggagggtaaagctgttttccgcgtttctgtagatagtgaagttctttccgtcggacacgactccagcgtatgccttttcgctgtaatatagaagaagtccggctgtgttacccttgcctacgttgacttccacctgtgtttcgtaattcttgtcttcggcggtggccagcagtaagcgggcatcggaaggggtacttcctttcgcatctatccataaggtctgtttcttgaagctgagcgactgaggggcatattctttccagaaagtccattggagtcccggttccggtccttcgaagtcatccgagaggctgagtccgtgtttgatggacggatcggtcttgatgggagtggcggtggatttggtacgataccatccatcggcggtccattcaatcggttcgatgagggtggagcgtcccagggtgtgatagcctttggcataggcatgatatacgatccaccagttgccgttcacatcgtcgatcagtgtgccgtgtcctttcgaccaccagttgtcatgggcactataggtatgcactaccggattatagggagaattttcccacggtccggtgacactcttcgaacgggcggcaactgccatgtggcttgttgccggaccggccgttcctccctgtgcggaagtcaggtaataataaccattatggtaattcagcttcggcgattccagacacatacattccgtttcccagtgattgggatatcgccagccttcgtacactttctgtttttggccgatggtggccagtccgtcgtccgtcagtcggatgacttctcctttgtcaacatataaatatctgttcccctcctgatcggctatgtgtccggggtcgatgccactcactttcaggtcgatgggtttgctccacgggcccttgatgtcatttgcccagatcacccagtttgttcctttggccggataatagatgtagtattttcctttgtacttcaataagtcgggcgccattgcagagccttcgtattcgggcattacgcgacagacgggttcccagttcatcaagtcacgggagtgccagatgagaaatccgggagcgtagtaaaaaggagaatgagtcatgtaataatcctcaccatcgcgcatgacagaagggtccggatagtcacccgataaaacgactttcgggtattcttgcgaataggcctgtactgttgcacagacaagcaaaatgaacaacaggagttttttcatggtatttatttatgggatattagatggtgtatctgatggctttacatcttgtcgggctttccgtaggccttgtacaagcgtttcagttccttgtcagtaatcggcattacggtgccgtggcgcggatggaagtccatgctaatggcattgtctatgactttgaaattctccaaatcggtgctttccgtaaactgatacttgcctttcatatatacatcgtacatcaggatgtacttgtccgtacctatcagcgggaagatgccggcaccttctacagcttctttcgtctgttgcttataatcttccgattctgtccattgtccggaagtcagggaggcggtggttgcttttttaattccattgccgtctccttccgttttatagaacaggtggtaaagtccgtctttataaatgatgtctccgtcaatacaggatttgccattcttcgggaggaacaaagttttgggttctccttctatatcggtgaaatctttgttagcgtatgcgtaataaataatgtccggaccattaccatgctgcattgaccagtagaccatgtatttcttcgcttctttatcataaatagtttgcggtgcccatacccgcttcaaatcttcctgattcgggtatttcttctggatattcacgatgttggaggtccagttgacgagatctttcgatttcaacagtaccatggcacggttggaactccatccattgccggagaccatgtcagttacgaccatgtaaaatgtctttccgtcttcacaacgaagaatgtgcgggtcacgcactccacccgtagaactgatttcacgggaatcgatgaccggttggtttccgtttaatgcatagtagttgtatccatcggggctgacagccatccggatggcttcctcactcatcctgtttccggtgaaatagacaaacaggtaggcagattgctggctgtatcctgtcagcactcctactaaaaggagtgccaggagtaaagtatattttttcatattcatttgagagtaaatgcttatttataaagtgaatgctttattatcaaaaggccgatattggcttattattggtttaatacttgaaatcagacggtttcacatagacgcggtattcacgaatcatgcccggaaagtccttttcggcacggggcagataacggaagcccgtcactgtttccactttgctcaggtcgattaccagttggtggggataagcgacattgtcaacagtcatccagaaagtggattcctgcaagtcgaatatcttatccgccgtacggtttccgctacgtgtctcttcgctatcggcataacggattttccaatgttcgcgggatacgggtttgccgtcggctcccagcacatcgaactctgcaatagcggcaatattgttattggcttgcggagagagtgcttccagacagaagaaacgtcctttcaccggagcggcgaaacgtacttcctgccagccgttgcccggagtgaaggctccttcgtgcgcaaccttttctcctgtcagcttcaacttttctccatccttgcggtgtgtttccggcgctttctcgcggagtacgtcgaggatcggtttcttcagacctttgattgatgatttcgtcggacctttcaggtcgaggacgaggatttcattctcgccttctttcagccagcagcccggtatgaaaagtgtctgctggggaccgatttcccagaaacgtcccatcgcatgaccgttcacccataccatacctttgccccatgtgctcatgtcgaggaaagtgtcgcctactttatcgagtttgaaagatgaccgatagtaagcaggcataatcggtaatattttcgtatccttgtagttcttgttcttgataaatgagtagtctacggggaagttatatacagtccagttcttcagttctttcacctgattgcccgaaaggagttctaccttttcggtgattcccttccggtcgtggatggacttatcaaagttgacacgtcccattgcctctaccagaatatccagttgcgtacctttcttcaaggccggcaaggtagtggtaaattctcctttgcggcggtcgagacgggccagcagcttgccatcagcgtagatttgtgcccagtcgtgcacttcggtgattttcaatgtagtgcctgaggttactgcttcgggcaatgtggtacggtacaggattgttccccacccttggttgaattgctccatcggctggatatccaccgactgcttggcatccggcaagttggagaaaagcggagctactttggtaaaatgaaattcgggtacttcaatgaccggcattgcggcagggacttccggcagtgcttcaccggcaggaagatacgttttcagcaggtcacggaggagatagtatttctctgtcgtccatccggcttcgctgatcggggcatcgtagtcgtaagaactgcacatagcggagtaggcaggattgttggcaccaccccaatgtccgaaagtcgttcctccgtgagtcatataaaggctgaaggagatgttgcggtcgagcatttctttgatgccctgtaccatatctttggcaggacgtgtttcatgtttccgtccccagtggtcgaaccatccgctccagaactcgctgcacatcaacggagtttccggacgaagttctttcagtttcttgaattgctggtctatattggcgcctgttccgaagttgatggtccagatcaggtcgtcgagtgcattccgtgtaaagttactgctccagtcgcattggaagagaggtacatcggtaaaaccggattcgcgcaccaagtcgcgtacggcagaaacataaggcttgtcagtgccgtaagaaccgtattcgttctccacctgcaccatgataatatttccgcccttatttacctgtagcggcgccagttgcttaccgacttctttcatgaagatgcctacccgttccatataataaggatcgagcgtgcgcagtgccacatctttcttcttcaacaaccaccagggcaggccgcccatttcccattccgcacacacatacggaccggggcggacgatgacatacattccgtgtttctgagcggcacgacagaaggcagcgatatcattctgacctgtaaagtcaaacttgccttcttcctgttcgtgtatattccagaagatataaatacaaatagtgttcattcccaacgccttacacatctcaatacgatgatcccaataggcttgcggaatacgggtatagtgcagttcggcagcttttactacgaacggcttcccgtccagcaagaaagtattcttgcctgcctcaaacttacgggcagtagtctgcgcctctgcactactgaaaaagatgactgtaaaaagtactagtaaagcaataaatctgtgtctcatggcttttatctcaatatagaat

SEQ ID NO: 96 - DNA, 29527 bp, Bacteroides thetaiotaomicron
actttgccataacgaaaaactttatgcctaaagatacaaaaactttgggtaataacaaagcccgggcttgtgaaagtctgggctttgtgcataaaaaaaggttgtgccagcgttttgacacaacctcatagcagtgccaacgcagtggcacaactgtgccaaaggcatggcacaaacattaagaacaaaaggggaaacaccgttcgtggtgaatcccctttctcatacaataaaacaatcaactaatcttcaatcgttacagcagttccgttggcagttaccatcagcatactaccgctgcctcctactgtttcataatccagatcgacaccgatcactgcattggctcctaactttgctgcctgtgcctgcatctcctgcaaagctgtatcttttgccatacgtagtacttcttcatatgcaccggaacgacctcctacaatatcccgaatacttgcaaacaagtcacggaatacattggcaccaatgattgtctctccggaaacaattccgtagtactttactattcgttttccctcaatgatgggagttgtagtcactaacatgatctttttcttcttttttagttgtttactatcctattagacgcaggatacccccaaaaggttgcaatgtcaccctaaaaaaattgcggctataccgcaagaatatgcgatatagccgccaattagagttaaagagagagagaatttatagaaagcgcggtctcacgaccaacttaatatacctaaaatgatttttattctttcttattagacgcaggaaacttcaaatcactgcacttcaaagagatttttttagttaaagaataaaaaaaatcgctattcttgcaggaatagcgattaatatctttagaacatctggctgacgcgttcgatcccagccactaatgcgtccacttccgatcgtgtattgtacatggcaaatgatgcacgtaccgtaccttcgattccgagccgctgcatcaacggttgcgcacaatggtgccccgtgcggacagcgatacctaaacggtctaacaatgttcccaaatcgaaatggtgaatatctcccaccagaaatgaaatcaccgctccccgatctgccgcctcaccgaaaatacgcatattgggtatttccttcaatcgcttcagcgcatacgtcgtcagctcgtgttcatgagcggcgattggatcgagtccgataccattaacatagtcaagggcttttgccagtccggtagtaccgatgtagtccggcgtaccggcttcaaacttgaaaggcagttcgttgaaggtagtcttttcaaaagagacgtgctgaatcatttctcctcctccttgataagggggcatacgatccagccattcttcctttccataaagcacaccgacgcctgtcggcccataaaccttatgtgcggagaacaccagaaaatcggcatccaagtcttgcacatccaccttcatatgggggatagactgtgcagcatccactagaaaaggtactccatgcgcatgagccgtcgcaatcatttccttgacaggatttacggttcccaatacgttcgacacctgaactacactgactatctttgtacgctcggtgaataacttttcatattcatccagcaacagttcgcccttgtcattcatcggaatgaccttgatggcaattcctttgcgggcagccagaagttgccagggaacgatattactgtgatgctccatcactgaaaggatcacctcatcgccttcctgcataaactcatctccaaagctggaaacaagcaaattgatactttccgtcgtaccccgtgtaaagacgacctcattcgtgctgccggcattgataaactgccgtaccgtttcgcgggaagcttcatgcagttccgttgcctgctgggaaaggtaatgtactccgcgatgcacattcgcattcacagagtaatactcatctaccagcgcatccaccaccagacgaggtttctgagtcgtcgcaccgttatcgaaataaaccaatggtttaccatacaccgtacggctcaatatcggaaagtcttcacgtatcttttgaatatccattttacttattcatcatttacatattgcacatccctggcacttgttcaattcgccacggaagcgtttttctaccaacaggtgcagacggtctttcaatgcatccagacgaatcgtatcgatgacttcattgacgaatgcaaacatcagaagcaagcgtgcttctttctccgctattccgcgtgcacgcatatagaacaaagcattctcgtccaactggcccacagttgctccgtgagagcatttcacatcgtccgcatagatttcaagctgcggctgcgtgtacatacgcgcatcgcgtgtggcacaaaggttgcggttggtctgttgagaatttgtatgctgggcatcaggacgtaccaataccagtccggcaaaagcaccggtcgactggtcatcaagcacgtacttgaataattcattactggtacaattcggtactgcatgatcaatggaggtattattatccacatgctggtttttatcagcgattgccataccgcaaagattaatctcagccccttcgccggctagcagaacttctgttgtattacgggtagttccgttgtgcagcgtcatgccattcagcaaaacattgctgtttgcttcctgcttcacgtacaggttactgatacgaaccgtacttgtatgtgtttcttcaagctcatacatatcgaataccgcattctctccggcaaatacttcgatcacctgtgttgcaaggaagttcacattatccatcgcatgatcacagatcaacaggcgtgcctgcgctccatcttccaggatgatcagcacgcgacggttcaccatgaagttgacatctgcacgaaggatattcaccagttggataggcttctctacgattacgttcttcggaacatagaagatgactccatcctgtgcaaaagctgtattaaaagctgttatgccatccttggaggtatcagccagcttaccgtagtacttcttcaccagttcgggatgttccgcagcgacttctttgaggctgccgaagatgacgccttccggcaaatgagttttaggaagcgctttattataaaatgcgtcgtttaccacaaaatacaaggctgtgctcatattcgggacatcgcacttaaacacttcgtacggattgaccggaatctgaagacggttaaggttcaggccgtaatcaggctcgaaatacttacttatatccgtgtatttatacttctccatcttacgggtcgggaatccgagacgctcaaaatcagcaaaagcagccgcacggggtgcattcagcacttccgcactatgcttgcagatcatggcttccgtctgagagaagagatctatgtattgttgttctacattcatcgttattctcctacttctttcttaatccaatcgtatcccttttcttccagttccaaggctagttccggcccggcagttttcacaatacgacctttatagagtacgtgcactatatccggtttgatataatcgagcagacgctgatagtgagtgatgacgatcgtacttgtttcgggagtcttgagcttattcacgccttccgctacaatacgaagggcatcaatatccagaccggagtctgtctcgtcaagaatgctcagacgcggctccagcattgccatctggaagatctcgttacgcttcttctcaccaccggagaaaccttcattcaccgaacgattggcaagtttattgtccagttcgactacggcacgcttctcacgcatcagtttcagaaattcgctggcagtcaacgcaggcagacctttatacttgcgctgttcattgacagccgccctcatgaagttcaccatgcttactccggggatttctaccggatactggaaactaaggaaaataccttcatgactacggtcttccggactcaactccagcagattcttgccatagaaagtgaccgaaccttttgtcacctcaaaagcaggatttcccaccagaacagaagaaagcgtactctttccggaaccgttcggccccattatcgcatgtacttcgcccggtttcaccgtcaggttaatacctttcaatatctctttgccattaatgctggcatgcaggtcttttatctctaacataagcttatttattttttatcccacgcttccttccaacgaaatagtaagcaacttctgtgcttccactgcaaactccatcggaagtttatttaatacttctttcgcatatccgttaacaatcagcccgatagcatcctccgtcgggataccccgctgattgcaatagaatatctgatcttcgctgatcttgctggtagtcgcctcatgctccaccacagccgtctcattatggatatccatatacgggaaagtatgcgcaccacatttgtcgcccagcagcaaagagtcacactggctgtaatttcgtgcattatcggctttttcagctacacgtaccagtccgcgataagagttctcgctatgtccggcagagatacctttgctgacaatcgtgctgcgggtattctttcccagatgaatcatttttgttccggtatctgcctgctgataattatttgtcacagctacagaataaaactcagccgtcgaattatcgcctgtcaatatgcaggaagggtacttccacgtgatagccgaaccggtttccacctgtgtccaggacagtttgctgtccacccctttgcagttgccgcgtttcgtcacaaagttgtagactccacctttaccttcggcatcacccggataccagttctgaaccgtactgtatttcacttctgcacgatcatgtaccacaatctccacgatagccgcatgcaactgattttcatcacgcatcggtgcggtacatccctccagataagatacatacgaatcgtcgtccgccacaatcagcgtacgttcaaactgtcccgtattacgggcattgatacggaaataggtagaaagctccatcgggcagcgtactcccttcggtatgtaaacgaaagaaccgtcagagaacacggccgagttcaaagcagcaaagaagttatcccgatagcctactaccgagcccatatacttcttcacaaggtccggatgttcccgtaccgcttcactaaaagagcagaatataatgcctttctccatcagtgtctctttgaaagtagtctttacagataccgagtccatcactgcatccacagccattccgctcaatgccatctgttcttccaaaggaatccccagtttattgaatgtctttatcagttccggatctacttcatccatactcttcggtccttctttcttcttcgtcggatcggcatagtacgaaattgcctgataatcaatctccggaatacggagatgtgcccaagtcggcatttccagcgtcagccaatggcgatacgctttcagtcggaactccagcagccattcgggttcatcttttttcgatgaaatcagacgaactacatcttcgttgagtccacgctcaataacatcggtgtgtacttccgtggtgaagccatatttatacttctcctgcgtcagttcctttacatatttattgggttcttcttgttgcatctttattatctaatatatattgttgcgttatattcttagcagcagggaaaaagattcccgcaaacgtttccataggataatataacaatgattcgctcttttttgttgcactaattaacttattatcgctatcgataaactctatcacacagatcacaaggctcgttaacaacagaaatttgagtgctcccaatccactccccagccaacggttcagccaccccagtgaaatagcttccatcgctttcgtcagcaaggacgccactaacgtgaatatcagcggaacagcgatccagatgacaataaaagccaatacctgtgcaaccgtcatcgagtctgtcacagccggacaaagcttctccgccaacgttgcatacaaagcctttgctgccagcaaaccgacgaccaatcccagaatagaagccagctgacggataaagcctttcataaagcccgccaccacaccggcacctattataataaggataattatatcaatcgttgtcattatctctttttaaaagaaaaaggaggcacggagttgtaaatccactctgtgcctccgtatattctcgattcagtacaatttataacgtctgtttcacttctatttcttcgaatgtctcgatcatatcgcctaccttcatgtcgttgcagttcaccagactgataccgcactcgaagtttgtacctacttccttcacgtcgtccttgaagcgtttcagtgcattgatgtttccggtgaagataacgataccatcgcggatcagacgagccttgtcgcttcgtttcacctttccggtcttcactaccgcaccagccacaagtcccactttcgtgatattgaacacttcgcggatttcgatcgtagccgtaatctgttctttcagttccggagctaacataccttccatagcggccttcacctcctcgattgcatcgtagatgacggagtacttacggatatcgacaccttcctgttccgccatcttagcggcagcacccgaaggacgtacctggaatccgacgataatcgcatccgaagcagcagccagtgatacatccgattcggagatagcacccacgcctttatggatcacatttacctggatctgttcagtagacaacttgatcaacgagtcgctcaatgcttctacagaaccgtccacgtcacctttgacgatgatgttcaattcctggaagttacccaaagcaatacgacggccaagttcgtccaaagtcaggatcttctgtgtacgcaagccttgttcacgagccagctgttcacgtttattcgtgatttcacgggcttcctgatcactttcaactacatggaacgtatcacctgcagcaggagcaccgttcagtcccagaatcaatgccggttcggctggtcccgcttctttcacgcgctgattacgttcgttgaacatggctttcacacgtccgtagctggttcctgccaatacaatatctcctactttcaaagtaccattcgataccagcaccgtagctacataaccacgtcccttatccaatgaagattcaatgatggaccctgtcgcattacggttcggatttgccttcaaatcaagcatttcagcttccagcaatactttttccatcaaatcttccacacccatacctttcttggcagagatatcttgtgactggtatttaccaccccattcttccacgagatagttcattgcagccagttcttctttaatcttgtccggattagcagtcggcttatctaccttattgattgcaaatacaataggtacacctgctgccatcgcatgattgatcgcttccttcgtctgcggcatcacgttatcatcggctgccacaataatgatcgcaatatccgttactttcgcaccacgggcacgcatagcagtaaacgcctcatgacccggagtatccaggaacgtaatacggcgtccgtcttccaactgtacgttgtaagcaccgatgtgctgtgtaatacctccggcttcaccggcaattacattcgccttacggatgtagtcaagcaaggatgtcttaccgtggtcaacgtgtcccatcaccgttacgattggagcacgtggctgcaaatcttccggagcatcttcttcttccacgatagcctgtgccacttccgcacttacatattcggtcttgaaaccaaactcttcggctaccagattaattgtttccgcatccagacgctggttgatggaaaccatcataccgatactcatacaagttgcaataacctgattgactgatacgtccatcatcgttgccaactcgttagccgttacgaactcagtcagcttcagtaccttgctttctgccatttcctgatcttccagttcctgcatacggttggaagccatttcacgtttttccttgcggtacttagaagtcttgttcttacccttggttgtcagacgtgccaaagtttcttttacctgctttgctacatcttcttcgctaacctcctgcttgataaccggcttcttgaagcgatccttattattattcttcttgttgttgttattattattgccctgtccctggccttgaccctgaggacggggatggttgccaccacctttaccggtctgagtattgggtctcggagcagcaaagttggaagttgccacattgttgacatccaccttctctttgttgatacgattccgtttctttctggcagcatcggcattattatcttttacgcccggttttgcctgtttactgtcctctttacggatttccttgatgatagcttccttcatcagtttcttctgatcctgacgaactttttctttttcttcgcgttcacggcgtttttcttccttcgatttcttcttaggacgggtagactgattcaatgcagccaggtcaatctgaccgatgacattgatcttcgctcccagttccggttgacggattttaaacacctcattttctttcgacgcattttcttcagtcggagttgtcactgttgcagttacttctgccgttctttctactttacgttcttctgccttcacaggtgcagtttctaccaccttcggctcttctttctttacttcttccactactactttctcaacttctaccggttttgtctccactgcaggtttcggcgctactactggctgttctactggtgcaggtttcggtgcaattacttccaccttttccactttcggctcttcctttttcacttcggattcaaccactggtttctcaacgactgttttttcagcaacgggttgctctaccacaggttgttctactacaggttctactttcttttccggcgctttttctactttatctgttctccgaccgctgaatttatccaaatctatttttccgacaggtttaaacttaggacgtgcatcctccggtacgactgtcttaatcacatcttccgacttcggtttctcctgctgcttctcgaagccctcgatagataccgatgccttattacgttccttattctgacgttcctggatgaaacgctccgattcaagtctaaggttcttgtctgtactaaactctttaacgagcacagcgtactgctcctcactaattttggtattaggattagcctcaacggtataccctttcttttgcaggaactcaactaccgtcgcgattcctacattcaaatctcttgtaactttgtttaaccttatcgtcatatttaaaatttaatgaataaatggagcgaagaaaattcaatcgtaatgcatattactcttgtgttggttcagcttcaggttccgcctctgtctcaggctccatctctgctgccggttcttcttcaaactccgatttcaaaatacgtattacctcgtccactgtctcttcttccaggtccgtcttttcaatcaacatctcgcgaggcgcattcaacacagccttcgcagtatcgataccgatagccttgattgcatcgatcacccatccgtcgatttcatctctgaactcgtcgagatagatatcctcgtcagccacattctcatccaattcacggaacacgtcgatagtgtactcagtcaacatactggccagtttgatattcaaaccgcctttaccaatagcaagcgatacctcttccggtttaaggaatacctcagcctttttctcttcctcattcagacggatagaagaaatcttagccgggctcaaggcacgctggataaacaatgaaatgttcgatgtgtaattgatcacgtcgatattttcattgcgtaattcacgaacaatcccatgaatacgactcccctttacacctacgcaggcgcctacgggatcgattctgtcatcataagattccactgcgatcttggcacgttcgccagggatacgggcaatctttttaatggtaatcaaaccatcattgatttcaggcacttccatttcgaacagacgttgcaggaaaacgggagaagtacgtgacaaaataatcttcggattattgttcttgttgtctacgcgggcaaccactgcacgggctgtttcacctttacgataaaagtcgctcgggatctgttcagtcttaggcaacagcagttcgtttccttcatcgtccagaagcaacatttcctttttccagatctggtatacttccgcgttgatgattgtacctactttatcaatatatttattataaatactgtccttttcaagttccagaatctttgaagccagtgtctgacggagattcaggatagcacgacgtccgaacttggcaaagatcacctcatcagtcacttcttcgccttcttcgtatgaagcatcgattttctgtgcttccgtcagcgaaatctgcatattggggtttgtcaaatcttcatcggccacaacttcacggttacgccatatctcgaagtcacccttgtccgggttcacgatcacgtcgtaattctcatcggtgccaaacattttcgcgattacgctacggaacgactcttcaagtacgctaaccatcgtcgttctatcgatattcttcagttccttaaattccgaaaatgtatcaatcaagctgattgtttcttcttttttggccataactatttaaagctaattaagtatttagtatattttatttgctcataagtgaaggtttcgtcctcttcgatcaacttcggacgcttggaaccttcgagttttaccttcttctgtacgcctactgtaaacttctcttcatcggcatctttcaggatacctgccagtttacgtccgtctctggtcactacttccacctcttgtccgatgtggatgtaatactgttgcagcactttaaagggttgtccgataccggcagagcccacttccagttcataatcttcctcttcacggttcagtttcgactcgataaagcggctaagctctacgcagtcttcaatccaaactccttctgcgtggtctatttcgaccacgatcttgtcatccgggctcacggtcacctctaccagaaagtagtcttttccttccagccactcttcaacaatctgacaaacagttttcttttctatcatttattaactatataagaacaaaaaaaggagcttaatcgcccctccacctttcatccatttcggttgcaaagatataaataatctattcgactacaaaacattaaagaaaaaaagtatgaattaatagtcgtatatcaggcacaaacaccaatatctaatcatcaacccaggaattcagatagttttgagaatccttacagccttgagctgcggctttttggaaccactttttagccttggctttatctactgccactccctgaccgtaaaacaacatggtagcaaccgtaaactgagcggattccacccctctctctgccgcacgacaaaaatatgggaacgatttcgcaatgtcttttctcactccatgtccgttataataaattgagcccaaattattcagcgccaacggatagtcactctttaccgcctcttcataatattcacgcgcgacatcgtaatctatttccacccctttgccaaaatggtacatcattcctaaattataagcagcggcagcttctcccatacttgcagctttcaggaaacactcctgggcatcttcaaattttccttcatccaggaagataattcccaaatcattgatctgcccggaagttatatttttagctttcatcagatattgcttttcagccgtagccatatccacagaaataataactgtcgaagaattggaaaaagatccgctatattcacatttcacttttttcccgtactcacagctataaacttccagctgatagaaatcctcactgacagaatagttaccagtttcataagcatccagttttccttttctctcaccattcaggaatatttcggcagcatgatcagaagttactttcactctccgcttaacgaacagctgattgagcagttttccgaataacccctgcgcaccggcattactaccgtctgcagaagcgacattcgaagccggttgaaagccgggaggtgaaattgtatccacagccggatgttgcaacagatcaagtatgaccgcagccagctcactaaacttctcttccggattaggataagcattcagccagtgtttatcattcagcatcagtttcatagaccctttcagatcagtaggatctatgcggaaaggtataataggcttattgctgctaaagccaatattcagttcactacgcacccagcgggatatttgagacgtttcagaaaagacaatcaggaacactttacaggtcacaatagcttcttcaataatatcaccatactccgctccgggtcttatgtcacgcggagccatccaacacttgatcctgttactttctaatgcatgacatattgcctgtgccgtctgtatattggcacttgaatagctaataaacacttcatgatccataatctttattgtatatattcaacttaggtttacacactccacgacaccgatacaatcctgaattcagacggatgttggttgctaagataatgaaattcttagtaatacaaaaaataattgtatctttacaccgcaataattaaaaatacaacggctatggcacatcatctcaacaccaacaaacagtttatggtcggcaatggcattctggcttttgccgtcatttttgtcgtagttattttcatttatatgagcttacgcctgcaacgggaaaaccaggcagaacgacattatattgaaacttatacgatcagcctggtaaaaggatttgccggagattccatttcgctgttcgtcaatgacagccttatcgccaatcaagtcatgcaggaagaagcctttacggtagaggtcggtcggtttgcagaacaaagcgcactgatgattgtagacaataaaacggaaatagcatccgttttcgatctcagcgagaagggaggaacttatcagtttgaaaaagaaacggacggaatcaaacagcttgctaaataagagtctgcttaatatcaggagttccttatcccaagcatcttatatctctgtgcgatacttcttcaattctttacgcaaagcaagggccttgccatctgtgaaccggttcagcaagtcccagaaacgctcaccgtgattcatctcacgagtatggcacaactcgtgcagaagcacatagtcgatcaggtgggagggcaacaggacaagataataggacagatttatattttttctcgccgagcaactcccccagcgtccctggctggagtttatcttcacgctggcataagacaatccacattgcgccgaaagatgctccaaacgaggaggaagaatacttttcgcattccgcctcaaagattcttcaatcactttacgcaaccagttctgtaaattttcatcagtaaaatccgcttgaggcggacaaacgatctgcatgacacccaatcgcgaattagccaaaaactgctccttttcacctaagatgagagatagtttgaaatgctcggcatcaatcttatagtccaagtcaatcaacggacgggcaaccttctgacgggaaagcagcaacttactacgaagattctcaatagcacgcttcacctctttcgtcgtggtgccgggaggtacagaaacgtagaccgcatcgcttttggtacggaacaccaaactgcgggcacgtggattgacacgtactatcaaacttcccaattcatcatcttctatcactgtatccattttctcctccttaaccgatgctgcaaaaataataaaaaaagaagccggtggcgaaaaaagtgatattcaatgcaactttatagtaactcgcaacgtctaatccatataaactcatattaaaatcaactatcaattatgaaaagaaacacattgactgcatggctgctcggaataattctgatattctccgccacctcctgttttaatggccctattgtgaaaggcagtaaaaactacatcaccaaaaaagagaatctggaacatttcaatgacatcagcatgtccggaagtgccaacatcatctaccagcaagactcctcctcccgcatcgagatttacggttcggacaatatcgtagaactcctggaaacaaaagtaaacggaaaaacattgaatataaaatttaaaaagaatgtcaatatcatcgacaagggcaaactagagatcaaagttttctcaccggacctgaacggactgacactcaacggatcgggtggcattctctttgcgaacggcattcacaccgagggagatcttaaagtaacgattaacggttcgggcaatttaggaggaagcacattcgataccggacatctggccatctcaattcatggttcgggtgatgtcagactcaaacaaatcgacagcaaaacctgctctgcaagcatttccggatcgggcaacatcacccttgacggcatgacaggcgcagcaaagtacaacatatcaggttccggcaatatcaaagctgccgacctggaagctacggacgtatatgcaggtatctcgggttcgggtaacatcagctgcttcgtcaacggcaaactaggcgggcacgtcagcggaagcggcaacgtcgcttacaaaggaaatcctcaggctattgatttccctcacaagaagctccgcaaactagactaaatccataaacatcccaaaaacataaaagggctactgcatctcgcggtagcccatttatttagttagtttcattataaaaaatttgagagaattgaaaacttcacagtttcgctttcgatgttgttttaattaaagcacactaactatattatatgtttaaagcaaatgaaaatgtctattctttcataacctgcaccttgttgatcttcgcaaggctgtcagccaatgcctgatctgctttcagctcatttgacagagctaccgacggtgcggtcagctgtttaccaatggtatccgttgccaatactcttccatcatctccggaaaaagaatgttgcgctacatttcctaatgaaaggatgattgcaatcacagcagcgaccttgaacagggggatgaatcttcctgtcagtgtcagacgctttgccttcactaccggagtttccacctgtgccagaatacgtgcgtcaaagtcttcgcccagtcctacctcctgctgaacctgctgataaacaaacaagtttttatagcggagcaaatgagcgggtacttcctcctttgtgaagaagtcgcgcaacacagattcctcctccacggaagtttcgcattgccaatatcgctccaggagctgttctatatccttataatccatattcgtcaatttctaaatacctttgttttaccttttgtctggctctgaaaaggttcactttcacttgttcctctgtcagattcagaagggttgcaattttcttatagctttcaccttcaatgtccctcagttgcatgataagccgctgtttttcgggaagttcgttcaccagtctattgataatgttcattttctcatcatgaaccaactggtcatacggactgtttgcatcaggttcttcctccatttcgggggtgatttccacattctgagcttctttcttctggctccggtctatagccagattctttgccactatcaggcaataggcttcaaccgattcaaattgcgaccactcatcacgcttgttccacacccttatcatggtgtcctgaacgacatcctcggcttctgccctatccagggttattctgagcgccagtcgaaagagtttatccttcaacggcaaaatatcgtttcggaagctgatctcttgcatctctataataatgacgggctgggatacgaaaagttacagacgcccattacttttttttgaattatttttttatccgcgttccttcgttgtctttaatcgctgatgctaaggtaattacaacttctgtaactcctgcattaattgcttcaaaagaattctccaacttaggaatcatgccaccttgaataacgccgtcagcaacgtattgttcgaattcggcacgggtaatctcagggatcacactatcgtcatcattctcgtcacgcagcacacctttcttttcgaagcagtacaccagcgtcacgtcaaacagcgccgacaaagcctttgccgtctctccggcaatggtatccgcatttgtattcagcatattaccttgaccatcgtgtgtcaacggtgccatcacgggcaccactcctttatgaatcagatcagccagcaaagaagcatctaccttctccacatcgcccacgaaaccataatcaacctctttcaccggacgctttaccgatcggatcacattcatatccgccccagtcagtccaagagcgttcactccacgggcctgcaacccggcaacaatattcttgtttaccagaccaccatacaccatcgttaccactttcaacgtttccgcatcggtaatacgacgaccatttaccattttgctttcaatacctagttgtgcggcaatctttgttgccgagcgaccgccgccgtgaaccagcactttatgtccgctgatggcggcaaagtcattcaacaactgaagaagggtggcttcctcttctacgatttttccacccaccttaattacagttagtttttccctcattttttattcaattctaataagtttgccgaatggagaactcagctccggcaccttgtcggttattctaagtaagtatagccgtaaagtcccgaacgatagttggacagaaactctttaccctcttccaatgatatctttccttcttttacagacttggtcacccatgtttcaagggtacgtaccagttttttaggattatattgtacgtaatccaacacttccgctactgtctcaccatcaataatctgttcgatattatatcccttttcattcacagaaacgtgaacagcattcgtatctccaaacagattatgcatatctcccagaatctcctgataagctccgaccaggaaaacagccagatagtaaggttctgttttcttcagactatgcacaggcagataatgagccacattccgggtagaaatgaaatttgcaatctttccgtccgaatcacaggtgatatcctgcagggtagccgaacgctccggcttctcatccaaccgctgaataggcataatcggaaatatctgatcaatcgcccaagagtcgggcaaggactggaacaatgagaaattacaaaaatatttatccgccagcaacttggacaatccccggaattcatccggcgcatgtttcaagcctccggcgatctgattaatttcccgcgtaatggaccaatacaaacgctcgatctgagcacgggtcttcaaatccacaataccatgactgaacaagtcgagcgcttcttcccgaatctgttgtgcatcatgccatgcttccagcatcttattctggttcaacgaatcccagatactgtacagttcctgcacaagctcatgtgcatccggagcgatttcctcttcatcatcccattccggaagagtagctgtttcgagcacctcgaagatcaagacagagtgatgagccgtcaatgcccgtccgctctcggtaatgatgttcggatgcgggatgccgtttttatcgctgacatctaccaatgtagaaatggagtcattcacatattcctgaatagaatagtttacactaccttcactattggaagaacgggttccgtcataatcaacgcccagtccgccgccgatgtccacaaactccacattgaatcccatagagtgaagctgcacgtaaaattgagaagcttcgcgcaaagccgtcttaatgcgacgaatcttcgtcacctggctgccaatatggaaatgaatcagtttcaggcaatctttcaagcccttgctttccataaagtcaagcgcttcgagcagttcgctggaagtcagaccgaacttgctggcatcaccgcccgattcttcccattttccactgccggaagaagccagtttaatacgaataccgatattgggctgcacattcaactgcttcgccattttggctatcagtttcagttcgttcatcttctctactacgaggaagatacgtttgcccatcttttgggcaaggagtgccagttcgatataactttcgtctttatagccgttacaaacaatcaatgagtcagaatccgtattgacggcaatcaccgcatgaagttccggtttggaaccggcttccagtccgagattgaatttctttccgtggctgataatctcttctaccacaggacgcatctggttgaccttaatgggatagatgataaaattctcggctttatacccgtactcttcggcagcctgcttaaaacaggaagacatcttttcaatacggttgtccaaaatatccgggaaacgcaacagcatgggagatgccacatcccgcaattgtaactcgtcaaccagttccttcaggtcgacggtcactccatctctccgcggtgtaacaacaacatgacctgcgtcattaatactaaagtacgaagtaccccaacccgtaatgttgtagagttcttcagaatcttcaatacgccactttctcattttctgttattcagtgtttttagtaaataattggatggcaaaaatacagatttatctacaggctgccaattaattggatattatttcttccaattggtttatataaccggtcttaatttataattccagcagttcctgcagacgttgcacagatgattcaatctgccagcggtcttccagttcgtccgcattaaagatatattgcgcctgcgtataaaaaggtgcgcgcttttcaagcgcctgaatgatgaaatccattaattcatcatcttcctttccctgaagaatgggacgttgctgcttggcaatacgcaagcgtctgaacagcacatcgggatgtacattcaagaaaacggttttccccgtccggttcataaactccatattgtcataaaagcagggtgctcccccgcctgtagagataacgacgttctcaaactcagctacctcatgaagcatatttctttccaactctcgaaatccggcttccccccgttccgtgaatagttctccgacagttttatgaaaacgttcttcgatataccagtccagatcaatgaacgggacattcagtttgcgggcaaaagccttgcccaaagtagtttttccggcacccatatagccggtaaggaagatacgaaccataaatgattaattttgctcacaaaattaatcatttaatgaataatgaagaatgattctctattatttaaaaacttttatccgttcttccagtggctggaactctttttctcccggcttattgacgggcactccaaacggcatttccgcaatcagatgccaatgtgcaggcaaattccatgcccgacgcacctcatcatcaatcaacggattataatgttgcaaggaagcaccgaagcccacatcttcaagcatgacccaaacagccagctgatgcatcgctgaggtttgtaatgaccatccggggaaattctcctgataagacgggaaagcttcctgaagccccttcaccaccttctgatcttcaaagaacaacaccgtaccatatccacaggcaaaggaattgtcaatcttttcttcggttttcgcaaacgcttctcccggcacaatcttcctcaacgcatcttttacaatgttccataactttttatgagacttgccaagaagaagcaccacacgggtagattgagaattgaatgccgacggcacgtgtctcacagccagattgataatgcattctatctcctgatccggaataggtgactggtcggtaatcgaataataagtccgacgattcttcaaagcttcactaaaagttctttccataatggctcctttcttaattttattttcttaaactccttataaattagaacaagcttctctgccaacttgttcgattccggaatatatttgtaccttcgcaccgtcaatgctgttgacataatcattcattatcagaaaatggctaaagaaaagttctacgtagtatgggaaggagtgacgccgggagtatatgcttcctggacggattgccagctccagatcaagggttatgaaggtgcaaagtacaaatcgtttgacacccgcgaagaggcggaacgtgcactggcctcgtcaccttacgcttacatcggcaagaatgcgaagaaaaaaacggaagctgcccgaaccggttccgatacactgcctgcttccgtcattgacaatagtctggcagtcgatgctgcgtgcagtggcaatcccggtccgatggagtatcggggagtacacgtggcaagccgccaggaaatttttcatttcggcccgatgaaaggtacaaacaatatcggagagtttctggccatcgtgcacggactggcattgctgaaacagaaaggatttgatatgcccatttatagcgacagcgtgaatgccatcagctgggtgcgacagaaaaaatgcaaaaccaaacttccccggaatgaagagaccgaagaactgtttaaagtgatagaacgggcagagaagtggctcagagagaacacttacaccacccgtattcttaaatgggaaaccaaagtgtggggagaaattccggcagacttcggcagaaaataatagccggaaagtctattctgcgacttgatcagcagcctgttccttcttatgtttaaacacaaagcggagcatcagaaaattagtgggaacagccacagcgagcacacacaagggagctatctcctgatctacattcaaatagaggaacaaattgaacaatcccatatgtatcagatagttcaccaaatggctgcctccaaatcccaaagcccttttcaaagaagggttgctacggaacgtgaaataagaagtcagaaagaaattacagataaaactcgtcacatagcctatcgtgtaggcaatattcaagttggtcatttcgtattcctgcaacagataataaaccccataatgtattccggcggccaacgttcccaccgtgcaataacgaataaactggtaacgtttacccttcgattgaaatactgattttacaatttccattagtaagtagttttagttttatagttcagttcagatgtttcattttcattcagtcagatggacgcgcaaagtcctgagtcagttgttcccacactattttcagccatatcaaggtacaaggcagagccttcagagcataaggtttcacatattccgctcttatgaatcttggaaaaagatcggtagtagacaaagaagtcagtagaatacagaatataagcaatgacagattcaatatcggtgtggcagcttttgtcggtgtctttacataccagattccaacagcaatcatggcagtcagatagccataggtttcagtgccggtgctaaatagcaccataaacaaaagtgcagaggatagaaacaagaatctgaaagattcatttccgtattgccggatgcgtaaataaggaagggcaaacaaaatcattccgggcacgattatccataaatcgctgaatgaagctcccgttatccgatgtaacatacccagcaaagatatgttttgattgatgctaaactgattcagcccattcttatagacaagcacatcgagccattccttatacgaatgaacgacatattccggagaagcatagagcatcggaagcagaaaaacgatcactgcccaaaagactaatccgccggcgagtttcattttgtgtttcgagaataaaaagaaagccagtccgactatcccataaagtttggtcatagtccctaatacaatcatcaaagcagcccaaaaatccttttctttctcgatcagtacataggcaaaaataatcatagccgtaatacctatgctatattgctgagacaaaacagctgtaaaaacgtcatttacagaaactaatataacaacagcaaattgccactttttcaaatctaacttgctgatagcataataaaggaaaccacaattcaccaggcaccaaaggatcatccccaacggtctgggaagaaccgcaaaaggagaaatcaacgcagtgaaagaaataccatacagaaagaaatccttctgttcctgaagatattctacatataaaggagaagaagatatcgcatgccaaaaagactggctaaatataacataattgctatatgtccccttcatcatcaatgataaactgcaagctaatcctactcccatccacaagatgaatagaaagacgggattctgcacatatcctttcaacctctccaacatatcatcaataagttttttagttcatttacaaataccccctttttcatatcaggcaacatcacttcgcctcttaagtctacaggaacctctttgatgaaggtggtatcatcaagagaggccttatatataaactccgtatcaaacaagaactgtttaatacgagtggacgcaagaaaagcttttcccttacagttaaaaccttttaatcccccctgtgtatctgtgtgagtcagccctaacagcataaagttcaagaaacgtgaagcatgactcgccaactttctgcgggtagaaagttgtgaataatacgtatgattacgatttgctacaactacatcatacccttcctcaagatatttaatcacctgacaaacagactcaatcttatatggaaaatcataatctgtataaagagccagctctgaatcagaatgtgctataccatcacgaacagcagctcctttcccttgatttatcttattgtctacaatgatagtgttgggtaagttatttgtcaaacgaagtacagcttcttccgtaaatccgcgtttggaaccatcatttactacgataaagcgaatattgtacccgttcagcatcccttccaactctttatgtttttcaatcagttgctgctcccatccttcatgaggattataacagggcaatatgacatcaatccgttcatcatcttttttatgtagaaaaggagttggagttcttgatgtatagtcctgagttaattgttcccagatgattttaaaccaaataatagcacatgggagagctttaagtgcaaatgaagttatgtattcagtcctgaaatgttttgaaaaaagaatactgcttgaagacgctgccgtcaacgcaaaacagaatagcaataagcatgtattcagcacaaacgattttttatacgttggcgtacttacataccatatacccacaccaattagagctcccacatatccacattcttccgtccccgtactaaacaagaccataaataacagaactgatgccaaaaacgaaagccgaaaatttctattctcatattgtccaatacgcaaataaggtaataagaataaaacaattccaggaattatcagccacatatcgctatattcaacagcatgagtaatctttcgaaccattcctaataaagagatattctgataaaagctcaactcattaacatcattcttaactacaagaatactaacccattctttataagaatcaaatacatattgtggagaagtataaaacattggaactacaaatagaacgaatgcccaaaatagaattccccacagaaaatataattttcttttagagaaaaggaaaaaagctaaccccacaatcccataaattttggttaatgtgcctaacacaatcatcaatgcagcccaaaaatctttttttctctcgacaagaataaaagtaaaaagaatgaaagcggctactgctgcattatactgctgagtcacaacagataaatataagccattatatgacaaccaaacaataatggctgttttccatttttcaaactctaacttttttatagcaaagtacaataaaagagcattacacaaactccacaaagcagaacccaccattgttggcatgattgaaaaaggagcaatcaataaagtaaaaggaatgccatatagaaataaatcaaaatattctttaggatattctacatataaaggcgtttgctccaaagcatgaaaaaatgaacgggaaaatatcaagtagttatttgcaagtccttctgtccagcttacccaaaatcccctgatagccaccccaaaccacaaaattgctaatacaataggattttgcactaaccttagtataaatcttattatatctttcatttcattatatccttgtttagttttatataatctataaaacgaccaaaactaacattctttttcctaaaatataggatgaaagcatccagccttttttccattccttctcctgcatgattccttataataaatggcagtttccattccggatgttcatttaacggataaaattcccacggatgaaagtatgtcacaaaatatccatcatgccgatgagtgtatttacacagccaacgataaagtgaagcaggcaaattatggcaggaaagccaaaataaaggaaaacgcagcaaaggagtaactgatgccggcatttgcatcacacggtcttttataaaaggagtacggggagtagaaagccgcatatatcttcctgggataaatgtcggattcaaggaagaattatatatataccccgcctcatatacagctttttccgacacaggcatcatgcgtgcctgccgatagccataaactttggttccggtgatttcctccaactgatccttcgaccttttcagatcttctacttcaaaggtccaatgatagaagccatgagaagcaatctcgtgacctccctcctgaatgcgctttattatatcaggagcatgaagagcaaaatttgccgtacagaaaaaggtcgcttttacctgattccgttctaagcaatccaaaattcgggtagtcccctctacagaaactttaatttgctcttccattgatatgtccacctgatgttctttgggcacatcaaattcctcaatgtcaaaacttaataaaatcattccaatatcagtctagtttacgtttgttgctgtgagttgctgcaaatatgcagccacagcctataatgcttgcatatcgtttagtcttttataataaccgtctaattccaataattcttcatgacgtccacgctctacgatttccccttcatagagcacacaaatctcatccgcatttttgatagtagaaagacggtgagcaattgcaatcgtggtacgcgtcttcatcaatctctccaatgcttcttgtaccaaacgttccgattcagtatccagtgcagaagtagcctcatccagaatcaggatgggaggattcttcagaatagcacgggcgatgctgacacgctgtctctgtccaccggaaagtttgccgccacggtcaccgatatttgtattatatccttccggcttttccataataaaatcatgggcattggcaatcttagcggcctctatgacttgttccatagttgcattttctacgccaaaagcaatattattgaaaaatgtatcattaaaaagaatggcttcttgatttacattgccaatcaaactgcgcaaatcggcaatacgtacatctttaatacttgtaccatcgatggtgatatctcctccttgcacatcatgataacgtggcaataaatctacgagcgttgattttcctgagcctgactgtcctaccaaagcaactgtctttccctttggcactgttaagttcacatgtttcaacacttctcttttaccatcatagctaaagcttatatctttaaactcaatccgatcattcattccagtcaatggtttcggattaggaatttctttaatattattttcagccttcaatattttgtccacacgttccatagaagcaagccccttggggatattgtaaccagccttggcaaagtctttcaacggatttatcacgctatacaaaataaccatataaaatataaacgttggtgcagttaatgacgaattatgccctaaaatcaaagcaccaccaaaccataatacagatacaatcaaaattgttcccaagaactcactcatcggatgagccaaagcttgtcgcatagccactttattgactgcatcacggagttcattactacacctcgtaaaacgatctatcattctgtcttctgcaataaacgctttgataatacgcaaaccacccaatgtttcttccaactgagacattgtatcactccacttaccttgtgcctccagtgattgacgctttagttttcttccgaccttacccatcagccagcccatagccggcaataccaaaacggtgaaaagagttaacttccagctggtagcaatcaatgttataaaatacaatataatcatgatagggctctttatcaacatgtccaatgaactggtaatagagttttccacctctcccacatcaccactcatacgagctataatatctccttttctctcctctgagaaaaagcccatcggcaaacgcattaccttcgcatataccatgatacggatatccctgacaactcctgtacgcaatggaatcatcacagctgaagatgcaaaataacaggacgttttaaataaagtcatcaaagccagaaacagtcccagaaaaatcaaagcagtagtaggaccattatcctgaatcatttgggaaacataataatagaaattatttatcgcaacatctttaaaaccggcagttccccattccatatactcatataccttattattctctcctgttttaaacaaaatatccagaatcggaattaacaaagtaaatgaaaacacattgaatacagctgacaagatattcagcaaaatagcccatccgatatacttcttatatggcgacacaaaacgtcgcatcagttgcaaaaattccttcattatttgaaataaaataagttaaggctgcaaagatacaataaaactgtctaacagttgaaggtttctttcaataattaatacgaattatataatagccaccttcttgaccatttattcgtctatttcactccaacactactcattatcaaaagatatgggcaccacatgataataaaccccatgagatctccggtacgatttcactcccaacttttgcagaatacgccccaaataagatacttgccgaggtgaaaacttcatcttactagccttctgtattcgttgtagcaaatccgcagcaagcaaccattctcctgcctcttcgtcggccgccgcccgataatatacctgaaacaattgctcgatcgcaggagactgctcaaactcctgattagactccgtcataatagcttcctcttcttcatcaaaccaataccgttcatttttataaagcgccgtcattgcttgtgcataaagctgctcataatcaatgggacgcaccacatcaatcactcccgtcacttcgacgccgataaaacggcgactaccggaagtgtctgtcagtaagtctttatgattactcgtcccgataaaagaagcataccggcggagtgattccacagctgacgcattcgggcgacgggtattaacaaccggtttttgcaaaatatgtttaaggaatgactgctgattgacacctatctgatcaaactcatccatattgataagaagaaaacgattcagatacaactcggcgtcccttttacggctaaagtcaatgctgtccgtataatacgcctgcaaacacggaggcagaatcagacggcaaaaggtagacttacgataagcctgcggaccgattagaataggtgaagtactgttcgcatgatttttgtcaactccacgccagtgcgccactgtactgagaaaccaacgacgaaaaagttgtccccaatgaggattatcacaaggaactctttcagccaggtcacggatgtggtctttaccgtcccaatggggaagatcataaagaaattcctcgacagggtgataaacgggaacatgatcggaattcagatatcggaccacatccttatcccaaagtttgatgccctcatacatcgcattcatcgtaatacttgccatcacccgtttgtctatggggcgaaaataaaagttgaaactgttccgctcacggtattccacgctcgaagtcagcatattgaaacgaaactcatatcggcgtttcataaactcatctgtctgcatgacaaacaattgctccggcagcaaactacttttatcggcaaaaccctcgcacgtaccatacacgttcttcaccgtctcgcgaatcaggaattcatctttcggtaaacgataatgagcacgtgcccatcgcacggtgtcttcctgtggaataccggcacgaaaacactgctcagccagacaaacaagcaatgagtgtatatcatcgcctgggcggtatcctttttgctcggccaatgcccgggcaaatgctgcttcaaaaagaacagaaagtgcttcgtaactatcatatccgggaacaagccgctgtaaaggagaagcctgcgcctgtacctgctctcgataggtggtttcccccggcaaagatgctggctgtttcagataaacaggcatggcttcgggattaaaatacagctctgggtcgaaagtcagtcggcaatactgttccagcgaaggctctcttaattcgatatcaaacgggagttggggctggtaatatttcacagccagacgataagcatgcgcatgaaagacttccgcctgttcgcgattatcaggcagacgattgtcaggatacgtaaaacgaacccatatctttacagactttcctgaagaaccgataaaagcaagatacgtctgaggcagttccttcacacactccttcacctcatcagcttccatacgtccggacaacccgttgacctgaagcataacgattccattatattcggccatcgccatcaccccgttttttctgacaaaagctgccgccggaagtatcttcgggaccctctctatataatcatttttatcaccgggaagtatataaggcaggacttctctcatattagagaccagttgtgctttagtttcctttttcatctgctctacgagctgttcaatcttcaacgtacgcatcgtatttactttgccatcgtctctcacttgtgttattctcattttttctttcgctgtttgtcctgcttgcgttgtagggcaatatatattttgcacaaaagtactgtaaacattctatgtaaacaagtttctgatcataagtttcattcccatctcctctccctctactagaaaagaaaaaatatattttagtctcacggtctcactacttttacataatcatcaaataattaatatattataggatgagagatactttttacagaggtatctctcat

SEQ ID NO: 97 - DNA, 29262 bp, Bacteroides thetaiotaomicron
atttcatactactataaggggtcgtaatggcacttgggtaactgccccattctccatctacctgccgctcaattttgtatgatatatataaatactccaatgaatttatttccgatgtataggcactcagatacgcaccactcacactggctctgacatttatcctgttcggcaccagcgtgttccttgcacttgtttcctgcgctccatcaaccgttactgttacgcttcctcttctgtccgacagttctttcatgtccggcaacttgtcccatgtgaccttgaactgcccctcggcatccgttgtaaatgtctccgtggaagatacgccgggtaagccgctcacatttacgcctgccgcgacttttttgccggccttgtcatacacggtaaagagcaccgatccgtccgaaggtattacatactctttcaataaagagttccagtattcgggaataacattatattttccgatttccacctcgatcaccgaagatttgcctgtgaggaaatcccaaaagtccgtctgcttattccggtctgccggccatttctggtcaggattatgcggattgtccacttcaccggatgaaatgtactctttccaaagttcataggcacttttaccattggtcccgtttgttccattggttccgtttttgccatctttgccgaaagcggacttgccggtatccttaccgttaatataccagtgtccattctcgccaatggccacctcgggagattttccgtcctgtcccacagccttcttaccggtgtccgtgccgttcacgaaccagttgccgttaccaccgatggtgactgtcggtgacactccgtccttgccgttcacgccatcctgacctacagccttcttgcctgtgtccacgccgtcaatgaaccagttgccgttattgccaatggtgactgttggtgacacgccatccttaccattcgttccatcctgccccacagccttcttgcctgtgtccacaccgtcaataaaccagttgccgttatcgccaatggtgactgtcggtgacactccgtccttgccgttcacgccatcctgacctacagccttcttgcctgtgtccacgccgtcaatgaaccagttgccgttattgccaatggtgactgttggtgacacgccatccttaccattcgttccatcctgccccacagccttcttgcctgtgtccacaccgtcaataaaccagttgccgttatcgccaatggtgactgtcggtgacactccgtccttgccgtccgctccatcctggcccacagccttcctgccggtatctacaccgtcaacaaaccagttgccgttatcaccgatagtgaccgtcgggggcacggcatcacgaccgtccttgccatcttttccatccgctccattctgaccgtcacgaccgcgtgcgccaataccagtatcctcattgccaataaaccagtttccattatctcccacatggggtgtctgtccgtcctcgccactggcaccggtcaggaagcgccagaagtcctgtatcgtattattttcgggagaccactttttatctggatcatgcggattatccacactaccgtccgcaatcatctctttccattgctcgaaggcgctttgcccgtcttgaccgtccttgccatccttacctcttaaatatttgaaaaagtctgccacttccgtctgatccttcggccagtttacagttccgtccgccactttttccttccaaaactcataggctgaaagccccgtatcacctttgggacccttgggcatggtgatatctacatccgtacaagaagctattaacaaaaaaacaactatcccataccactgcataattcttaatttacacatttgaactttattttttagttaatttatttataaattaaattagtatcctgttatgttccaatgatgtaggtatgaactgcgaatcacacgtcatttattgcccaaattttacatttgtgcaaacaactgataaaaagctcttttttcattgctgaccgtaacattgattcggtctgatccctaaaaacataatgttcatttataatcaaaacagacttgaaattcatgggagctattcagattctgaacagccttccctcatctatataaatacatcagaattggtaaatcctgaataaattaagggatcgcgcaacatatatcattcgataaattagcttttttcatattatagttcatgctaaaaaacatcaattttcgacgcaaaaatagaacaagaatacagatctggacaaacaaaggaaacaaatatgaaactaaaacacagatgatataaaaccaaaaatcatattgatattgcagtctattattcaagtacggaatgttctgcaagtaacttcagttacatcatttcttttccaaaagcgagtgcacgttctatgcttcggagatagattgtaaattccgcttctctatctcccgttggcaaatccaaacctgcgtaaggcctatatttgctaaaatcaccctctgtagagaataggtctcaatggacgcaacacatgcctgatacaatagacaaaagcaatcagagcagtgattccccggcataaccgatgtatgcaatggatgcatgtatacacaccgctcctccgatagtagtaccgcagccgattccgagattgaagaccgcagaataaatggtcatcgaaatggtcgaagcctgcggcaatacggccataattttcacctgaggcgacaagttgaagagggtataaactattccccaaaagaaacacaaggcaagtaccgctctcataaaaccggaaagcggatacaataacagaaaagaggccgccatgcccgaagaggccgtaaacaggagcaaaccggacttccgaccggaatatcgggaaaacaaaacgcttcctactataccggacagtcccacaagcatcagaaccaacgtaatgagattctcgtccagccgagcaatctgcaccagaaacggctctacgtaactgtatcccgtataatgtaccatagttgccagcaaggcgaacagatagatacttatcaacgccttgttgcggaacagtacaggcaaccggtgcagcgtcatcggtcgggtgttgggcggtttcgggaagaccatgcccagaaacagagctaccagtaaccctatcgcggtaatgcttgcgaaagtcatccgccacgttatgtacagaccgacggcacgacagcctccacctgctaaaaaaatatgtacattcaccggaacaacaagagcacatcgattcgctgtgcttgctgcttgaaaacaaggaacagcttctttttacggcaatgaggaaccttcaggagtagcagaacatagccgacatcgtaggggaaaggattccggttgtcctgtccgaggtcaggaaacagtcacagggacagactatttctctaaaaacggaagtctccgatccagatggaacggtttccaaaaaacggaatttctgggatatattccggcgtaaagagaaaaagtccgcttacctgcaacaaaaagaacagatagaacggaagcaggaacaacagaccgcctcttccccggttgtgaccgcaagacgcatgctgctcaccctgaacgaccgggtcattgaggaataggaaaggcggaaagcatacttgtccgtccagatggatagcctgtatgggaacaatgcggaactgaaccggaaaatgaacgcgctcgttaccgagttcaaaaaggaaacaaatacacggttcacatctaaatatgaggcattcattcttgaccgtgacacgtcctaccgtaccgtggcctgtcttgcactgggtgtttccctgctgacaatcgtgttctatgccatcatacaccgggacataaatagaaaataccgctaccagaaagagctggagacgtccgacaggaagaaccgggaactcctccagtccaagaaggacatgatgctcgccatcgcccatgacctgcgttccccgctgacaacgataaccggttccgccgacctgttgccgggcgagaaggacgggcggcgtaaggcgaagtatgtggagaatatccgtcacacctcggagtacatactctccctagtagataccctaatggacttctatttgttggatacgggacaggcacagtcatacgagcgtatcttccacctggaatccctgttcaaggagacagtggacaattacgccccgcttgcgcagaggaagcgcctgcttctctcctccggtttctccggcacggacgtggtggtctgcggtgacaagagccatctccagcagatcgtcaacaacctgctctcgaatgccttgaagtttaccaaggaagggagcgtccggctggaggcagagtacaggaacggcgagctgcatctgtgcgtccgggatacgggcaccggcatggatgaaaaggacgcggagaggatattcaccgccttcgagcggctggagaatgcccgtggcgtatccggtttcggcctcggccttgccatctgctccaggcaggtctcccggatgggcagctccatccgtgtggaaagccgaaaagggcaaggcagcgaatttatcgtcctgcttctccttccgccggccgacgggaaatcccccttggatacggaaaaactctcccagcaccttcatatggaagggacacgcgtccttgtgctggatgacgacctccggcagcttggcatcgtgaaggaaatgctgctccgccatgccatgaacctgcaaaagaaggaagaatgaaaaagatactgatcatagaggacgacattgttttcggccgcagcatcggcaactggctgaagaaacagggaatggaatgccgccacgtgacggcactggccccggcaaagaaatccctcgcctcggaggagttcgacctcgtccttgccgacctgcgcctgccggacgggaacagcacggagctgctgcgctggacgcatgagaaatgccttgccgtcccgttcctgatcatgacgaactacggacaggtggagaacgctgtggaagccatgcaactggacgccgtgaactatctctgcaagcccatacaaccgggcgaggacagccaggatgctggacatcagccggaccaccctgtatgaaaagttgcgcaaatacggaatcatataaccaacgagaaaacaggggagggacgtgaaaacaggcctcctgtttctgatgatttttaggatacagaaaggctataatcttgcttttctcacccgcaaatcttatatttgcactacgataatcgttctttgaatgtatgcaagatagaacaaaccgttgaatctcgctcgtttctaaatcgttacctattaaatgaaaataatatggtaaccatctaaatttcaattagataacaaatatattgtgtttcgcctgatgataacacaaatcatccttgatgcctgccagtgccgccaacgctttcatgtgtcgtctgagatttgaccaatgcagcaaagggaacagggtgtccctatcctcactatgatatttttcaatcagcgcaatcgcttccggtaacagtttcacacaggcacgaagttcgtttttctttcttcgatacttcaaccacaaagcaccgtcctcatccgtatataggttctcgtgggtaatcgagacaacatccgcataacagaccccggtgtagcacccgaagagaaacatatcccttgccagtatatgggatttgcggtaagcgggtatttccacatcacggattttctcaaacgattcacgactcaatgcccgtggtgtcgtttccgtcttctttggtaaggtaaaatgctggaagtggattctgtcggcatatccatccttatacgccagacggcatatcttcttcaggatggcaagatgatggcggacagtatcaatcgcatagcctttctcttccgtggcaaaagactgatagtcgtggatgaactgctctgtcagttgtccaaatgccaaatctttcaccttgtacttgttctcgatgaactccccgattgtcaggcgcatatagtgataaccgggataagtcccttttgccctgtctatgccgatacgggctttgaggtcatcgcagacaacatccgtcattcgcatgagcgtcatctgcgtttccatgctgccctgaaaaaggtttttcacatcggtagcatcaaaatcaaccttgcgattcacaaggttgtcaaaggcattgtttaccgctaacagtaacttttcaatcttagcattgatctcaaccgcttccttgcttttgccgttcagacggctttcacgtggattccataattcgggagtgcaggacagtttgcatccgaactgtgccattgtcctgtttaccgtaatgcgtcccatgatgggagcttttcccgacttgtccggtccgctctttttgaggtagagcaataccttgaatttttctactttcatacgcttatactttttagtgcaaaaatacttgccatataagcgttccttgatatgcaaaatactgtgtatgagtgcaaataaaacggtgaggatttcttttcatcgcttaccgttacctgtttttgtttcggtaaccgcccggctaacggtttggtaactgaacaacctcaatattctgttgtcgtttgcattttccacattttgcagaatacagaaatacagctcatttcaaacgacttacgtttaatctttacctgttcattattgcttgcttcgccttgtatattccatatggcccggcatacgttcgccactactattaccttgtctcatggcataccgattgaaaccgtatcgaaaatgcttggacataccagtatcaagacgacgcaaatctacgctaagattttggatacgaaggttatggacgacatggcagccctcaaagaaatgtacgcccggaaagaatcacaagaatcacccagcaataaagcagcaaacgaatgaaaacaaccgcaaccctcatccagcaagccctcgaacaaaaagcaatcgacagcatgatagcatacgaacggaacctcatctccgaacagaagatggggaaagcgctcaatgacgcactgcagcactatagcaacgtcgaaggacaccgcagcattgtcctcaaaggatggattataaaaacgatctacgccctgaaaagcaaccaactgaatgatctcgaccgaatagctttcaaatacataaaaaatgaatattaatccctataaagaagtagaacaatgaaaacaaagaacaataacatgaaaatcatgaaaaccgaaagtacagccaatgaacaggaacggaaagaagcgaagtacaagcccgttacccccgtcatactcgacaatgtctccgaagacgtgacatttattcgctctgcagatgtgtgtaagctactcaacgtcagcaattcaacattgagaaacctgcgcgcagcgcaggctattcccttctacaagctgggcggaacgttcctttacaacaaagaagaaatcatgaattatctggcatccaattatagcaaaagattatgagtaagaatggattctcctattacaaagcggagacagaccgctttcaggacattaagataaagcgtctgaaaaagaaatacggatgcgacggatacgctgtctaccaatacgcgctgaacgaaatctaccgggtggaaggcgcatatatccgctggacggaagaccagctctttgactgtgccgactattgggacatgaacgaagcacgggtgaaggagatcatcggttactgtgccgaagtatgcctgttcgaccccgtgatgtggaagacgcaatgcatactgacctcacgtgccattcaaagccgatatctcgatatctgcaagatcagcaagaagaaatcatacataccgctcgaaatcctgcttgtagaaccggaacagccgatgagggagcctgtagcgatgccactcttcgaaggcggggccggggcggcggaacacgatacaccgaatcaggcaacattggccgaacaaaaattccggagtactccggaaactttccagaatactccggaaagttccggaaacattccggaaaaaacagacaaagaaaagaaaataaaagaaaaacaaagaaaatcctcctctactcccccgcagccttccggagcgcttacggaggaggaagcgagagttttactttcttctaccgtattgggtgaggaccgtagctccaaaccggatatcgccaggcatcaaccgtcacaggcggatgtgaaggcggatgtgaaggcggaggaagagaaacagcgcaatccgcaggggctgataaacacgctgcgtccctacaatctgtcgcaaagagagctggaggaggtactgcagctctcacggcatggagaaatcggaaatcctgtctggtctattcttgccgaaatgcacggaaacaaacgtctcaaaatgccgcgtctattcctgttgaagcgactgcgggatgcaatgggactagtggccggaggaagcccgggcggtaaagcgaaagaagcctcctgattgatcactcaaaagaacgaaaaacaatgaacgaaaatacaacaaaagaaacgctgtactatccccgcaaaatgcgtataggatggtgcgtggcccatgaagtgacagccgcaggcgtcaagatcgagcgttacggaatcaagtgccggacgtatgccgaagcattcgacagggcggcgaaactgaataatgaaaatcgggccggcaaagcggctgttaatgaatcggcaagtgaaggaggcgggcaattatgagcgaaaaagtgagcatcctcacgctacggctgacagccgaagaggccgcacagatggaagtgctcaaatccatcaccggaaagaaaagcggcagtgaagcgataaagtatatcgtgaaggaatacccccgattctgtgcccactacaagcaggaggcacgggagaagggagaattgcaacgcaagtaccaggatcagaaaatcgctgtgggagatttcctcaaagcattcgaaagattgcagcagacgatggaggatgaccggaagtagagcatcctgccgatgtcagtcggaaaggtgatagctgatttctccggaagaagatctcgatctgaataaatgtgatagcaaatggtttctccaggaacagctgccggcgaaagatctgctatcataacgagtgagatatcgggatgatcaggtgtagatcctgccaggtgtgtgatagcaatccggcaatccgggccacaagcgacagcctatgcgatggtagcccatgcggtgtgtactcagtcgttttcaatgcccggtgcggtttcgctctgcccggcacttgttgccgggacaaggctcaatccgctaccttcctgcgtctgaacgacaggaaacaggcagtcggtccgaagtgcagccatgcggtacggggttcccgtgtttatcgcaaacgcatttgttctacggaagtcagcgcccttcgccgtcctccgggcgcgtgcggtcgtgatgctgcgtgcgcggggtgcttccggtgtttctgtcctgctgcagcttttgcgcggaaaatccataataggcaattatgtttaataagttgcggagccgttccggattccgcccttttattaaacataacagcgcattatggatattcccgctgtttgggtagtttcccgtttctcggtaccgggctcaaagttaccccttgcggaacattaccgcctccacacagccgccccgtagcttctcacatgggacggcggctgtccccgaccaccgccccgaagttacttccgtctttccgctcctccttcggactgcgcctgtcggcgtgcccggctgactgtttccaccctgcggcataccgaagtttcccggcggggcgtgccgccccgctccgcggagcggacggcgaagccgaccgccgaaagttgtgacatttgcgccattgtcacaacttccagcctttaacaagcatatataactatatctactcagtttccggatgacaactacacattaaaagccctacctttacgactgtaaaccaatattccgaaccatgtatacaaacgtacactcacaaaacaactatcaagccaacctgagtaaccgaagttatggctttaaagagctggccgtactttacttccccaatatagcccctgcctctgcgagtatccgccttaaacagtggataaaggatgacgtagaactattgggatcactggaagaaaccaactaccacctcagcaaccgtattctcacccctaaacagagagaccttattacgaccactttcggttcacccttctgaccccatagcgcagccactcccacggctacagcccgacacccctttggtgggggaacgcccaccgactgagcgcctcccccaaagggggacgggaggggggtagatgagaaatacacaactagaaattactcacataatcacccacaaaacaatgatcaaacaaagaaacatttccctgatcgtggtgcattgcaccgcctcccgctgcaccagtgatctcaccccgccctccctcgacgccatgcacaagcgtcaaggcttcaccgaatgcggctatcattattacatcacaaaagacggccggatacaccacatgcgcgacattaccaagatcggcgcacacgtcaaaggccacaacagcgaatcaataggaatcgcttacgaaggaggtcttaacgcatcaggcaaagcaaccgacacacgtaccaccgcacaaaaacaaagccttgaaacgctcctgcgctttctgttactcacctatccgggagcaaaggtctgcggccatcgtgatctgagtcccgatctcaaccataacggaatcatagaaccatgcgagtacatcaaagaatgtccctgcttcaatgtccggaccgaatacggttatttaatggaaaatggaaaatggagaatggataatgtaccatgcggtatataagcgcatgaaagcgtagccaattattcattgctcattatccattatccattcaccctacctttgccgggaacaattaaaaaggaggtcaatatgaaaccattttggagaaacacgttgcgagtattgaaagtgatcggtaaaattttcgtttggctgaccggagcggacagcccggtcaacgataacgagaagaaggactaactcctgtaatacccggcaatgggaaaacccctgttttgagggctgcggacataccccgcagcccttttttcatgtacataaacgcatcatgcatcacatatcatcatagataagaatgcacgcccgcagccgcccgcgcgtatatataactttgcccgcagaatgaatcattaatcactaaacactaataaacatggcaattcaagtaaaagcatccttgcgtaagaatccgcaggacaaaaaagcagccggaaaatactacgctcaggtagttcttgctccggaaatgacacagagacaaatcatcgaccagatcgctgaccgttgtaccgtaactggctcagacgtgaaagcggtgctggacgcattgatgacagttatcaaacgtaaccttgccaacggttctcctattcgcttaggcgaccttggctcattccgtccttccgtatcgggtatcggtagcgaaaatgtggataagtttacggcaagtaacgtgaagaaagcccgcgtgatctacgtaccttctgcagaaatcaaggaagcggtagcaatgtatgctttctctaaggttggcgcgactgccgaaggcgggaataccgaaaagcccggtggaggggatatcgacaaccccgggggcggagacgaagaagcaccagacccgacagtttaaagcggtcatccgctacgtatcagtaaccatttgaaaagaaagcctgatgaacagaagaagttcatcgggctttcttcgttttcagctgttagagactgtctgcagggcttgcggaatatatcaggagtttttcaaaaaatgtctgacgttttttagaaaactcttgttgttttcttggagatgtttttcgcaatttccggcatatagctgactgttttctttctgattgggtgttcttctatccataaataaacgcaggaagaggaatagaaacgctgttatctataaatttataaagaggtatttttgttctaccccctcccgtccccctttgggggaggcgcttagtcggtgggcgtggtcgccccccttgccgcagggcgttcccccaccgaagggggtgggctgtagccgtgggagcggctgcgctacggggtcattcatgtgttcgttatgtgatttattccttctatactttttagtgatattcgcccgattgtcacggatttcccctgttcgttacttttcggcggggcgtttcgccccgctccccggagcggacggcgaagccgatcgccgaagatttccggcacgccgcagggcggaagcggtctgccgggaacgccgcaggcgcaatccgcaggaggaacgaaaaacgggagtaacttcggggcggtggtcggggtggcggcttgccgccatagtggaggcgtaaacattccgcagggaaacatccggaaggggtaactttctgcccggttatgccaaacactgtctttccggggcgacgtgcagaaggccacattatgttgaatattcctcacgggcggaacgcgccggaggatattaaatataatgttccttctgcatctcgcccaattcaactatttctctgcaaaccactgctacccatagcgcacgcaggcatcacgtcagcacggcggcggacgcttgcgccgccttcatggtctaatcgctcaggaatggtcaatcataaacacgggaaccccgcaccgcatggcggcacttcagactagtagcctgtttcctgtcgttcagacgaaagaaggtagcggattgagcattgtcccggcagaaagtgccgggcagagcgaaaccgcaccgggcattgaaaacgactgagtacacaccgcatgggctactaccgcataggctgtcgcttgtggtccggcttgccggggtgtgagcgggagccggagccgaatgcaccagacggaagtaacttccgggaaacgtccccagctgtacttcctttgtatcaccgccaaagggcggctttctttgcgccaatcggatgactacggggaaagcaagggaagcggcacggtgcacggaaatactgtccgaccgataaacgctggcagtgaaggagaatcccggtagtaacactggaggagcagggcgagcgcatggggtgcagtcctgtaaggctgcgccctgatgcggttgcgctgcggtgggtattcagacgaactgatgttcgcctgatcacttccgtactcctgtgtccgatctgccgggattgctatcacacacctggcaggatctgcacctgatcatcccgatatcacctgttagctgatagcagatcacggcggccggctttttcctggacacaacttttgctatcactttgattcagctcaggaactggatccggagaaatccgatagcagatactaaaccacctgtgcaatttaaacagcaagaggttcttctttaatgatcgagattccgagtgcattttcaatcttggccaacgtttcaagcgaaaggttttcccgtcctttcaataccttcgaaatatactgccggctacaattcatcttctcagccagttgcttctgattcatttccagttcctccattctatcgagcatcagcatcgctatatgttgggaataccgcaaccaagtttcattagcatccatgtactcaaacacttcacgccatttcgacggtgttggagatgcatgcttttcaagcctctccacaatctttctcatgttctcattcatatatctacctcctataattacaattcactcatataatcaataaacccgtcatcatcaataatgttctcttccagcaaatatcgtctgaccttatccattttcacaagttcctttcttgtatgctctctttcctgcatggtggcggtcagtttgatagctccccccgtaatgatgtatacgccagaagtcaatttgatagcataaagacgcagccaggacgaatgcccgatggtacgtttcaatcgggccttttctttctgaagcataaaatccgatgcctggttattatccagcggtcgaaacaatctgctcaaatctgcctccggagatatgtccataatgacgcatctcaatctcttgctgtcttcaatcgtatccttaatcgcctgattgatatcagtaattttaaaataggcactcaaatcgtttatattttctttgaaaaacgaccgtagccacatcacatcactccaatcgtagaacaatttgagaaactcattatcttcctccccatccaggcgtacagaccacagttttttgcttcctgtaatatcgtcaaatgtcatatttttcctgttttgtttccacaaagatacgaaaaagaatcgaaactgtcaacttataagttgacagttttagttaattaagattgttttatacaggctttgcgtgtgactgataagtggtcgtatcagtttcccattcattaatatctaaatcattctttgtactatctaatggtgaggccaccgtttcgcgattgctttcatcaggaagcatcggctcacaaccactcaacagatggagtacaaacataactatagcaataatagctcccgccgtcaaatgcccctttatatgatggaaatatcctctcgcatacgcttcgccccgactataattcttttgcattttttaattttttagtccgacaaagttaataaattaaatgcgagatttgtctctttttgtcactttaattaggtttatccgattaaaaacaatacctttgtaggagaaaacttgaatcctcaattggatattaaaagagggtttttgccaaagtaggtgtctaattcggtgacactactaaaaatgaaagctgttatttcattgaaaatgagattataaagaaactaaagtttgagggcaggtagcccaacaagatcaacgtcaatgatgaatacgaaaatcccgctaaaatgaaagttttagcgggatttttgctttttgcggtatactttcatagctggtaaggctcaaaaaaaagagtcttccaaaatgaatggaaaactctttttacatcagcaccgtttaggtgatgtttttctgcatctatgatgggatacctattgtgtctgtgttatgacatttggctgctaccaacccggattctgaacaagtttgctcgacttctgaatctcgtttaacgggataggatagaggtacatgcgtctttcaaaaatacgggtttcaaatgcggtacgctccataaagtcctccaggttatcggcattcatattcataccatgtaccggtccgccttgcttatatccttcttcatcggcacacatccagcgacggacgtcgaaatagcgttgtccttcggcgaatagttcgatccggcgttctttgcggatggcttcttcctgtaaggcttggttgccttttatttcaggcttgatgtcctttagtaaagggatacctgctcggtagcggacactgtcgatatgtgcaatgatacgttcatccgaaggatttacatggttcaacgcttcggcatataataaatagaagtcggcgagacggaacaacattcctgctctgtattttgatttggcattacttccttggtttaaaagatcacggttcattcccttgtaaagcagatagccggagtagctcatatccgctttggagttatcgtctccgctgcctttatagaaataaatctgtttcgttgttttttgccatgtcttgccggagtaagttatggcctgataaaaacgtggttcgcgattcttatacatattaggaatgccgtcttcgccaatgccttcttctgaataaagtcctgactcgtgaatactcttgccgtcattcatgtagaaatcgtcaatggcttcctgcaatacacctacacaaccgaatccgctatatatcgcacgtggagtgcatctgcgttctcttccttctccacctacatcgccccatgaattcttgctggtttgccagatagcttccgggttgttcaaacttacctgaaagagttggtatagagattcttctgcattcaactctccatctttatctttttctttataaaggtgatagtgagtttttgcataatcaatgaagcgctgcaacgcgtttaaggcagtttgccattttttgtcatctttcgcaggaaacagttgtttgtcctgattatccctcaatgcgattgcttccgaatatcctccgttaagtaaggggcttgcggcatacacgtggagttttgccagaatagccaatgctgcccctttggtaggtgctgcgcttcggttctcgtttggagtcccgtcatcgttcacttccttttcaggcagttcattgtagcattcattgagttcggaatcgatgaattgcactacttcgtcgacagagttccggtaatagtccagatcacttgcggacggttccgatatttctgtcataatggggataggaccatacaattcaaataacaagtagtgatagtaagcacgtaggaaacgagcttcgtttttcaatcttgccaattcgtcttcgtcaatgtaatccgtaacgtcaccttgctgtgggatcgtatgcgagtatgccagaaattcgtttgcctgacggatttgtttgtaaagactccagcgcgataaatccgccgatccggcatggtaacctactgtcggaattgtcttgacattattttgtgcactttttaactcgtcggaaactgccggccagggattatccaatcccgtcaaggctgcataagaactggttataataatgtttgatacatccggaattccggaatatatatatcggtggaagcgacgggcataaccggtattattgaatacttcttccatgcttaattctgccgacaggtcgtccgatacatccagataatcgctgcaacccgaaaagaatatcgtgcttagtcctacggccactatgattgatagttttttcaatgtcttcatatatataatgtattatatgtattattagaaagtaaagtcaagaccgaatgtgaaagtccggctcagtggatatgagaagccgccgttggtgtttccaagttccgggtcccacattttgatatcatcccatacacaaagattgtttccttgcagataaacacgcaaagcttgtataccgatttttttcagtgttttctccttgaagttgtaaccgacttcaatatttttcagtcgcaggaaactggcattgcgcagccaccaagtgctggcagctgtattgttgtcataattggtagagtgcatgcgggggaacattacattttggcttgggttctgttccgtccatctgttggctacttctgatcgtacggcagactcttcgactccccattggaacgggaaaaatgctccgttcgagctggctcctaatacggtcgatgtatttcctgaaccttggaagaagataccgacataggctcctttccattcggcattgaggccgaagccataaactatttccggaacggaaggatttcctacatcttccatctggtcattgctgtcgatcttaccgtctccgttcaggtctttgtatttgatatctcccggacgtactccgcttgacagaccggatacaactcccggtttcagttcatactggcggttcagaccttcacctgttatgttgaagtcgtcggcggtataaagtccgtcagcaatgtatagtttccatgagttgaggcgagttcctttcttttcgagccacggataaacttgtggcacctgatcatattcgaggatttcgttgcgtgcaaatgtaaagttaccgcgtgcgctcaggttaacttcacctactttataattgagattcagacttgcatccacaccttggtttttcacgataccgaagttttgccatggcatttgctggaagcctgtcacattggaaacggtattacgttgcaataggatgtccttacgtttgttgttgaagtagtccacttgcaggtcaatgcggttgtcgaataaccccaagtcgataccgaagttgcgtttgtcttcgatttcccaggaaagaaacggtgattcgaactgggcttcggtaattccattgcctactccgcctaatgcgccgctgttgctgaatccgatattatagccgctattatcctgtttcatggttccacgatataagaagcggttgccgccggtatcgtcgttaccggtacgaccgatggagaatcttaatttcaatttgcttactacctttttcaaggcttccggataataatgttcattgctgatataccatgccaaacccatggcggggaagaaaccgaagcgatagccttttgcaaaggtttccgaaccggtgtagccgaagttaccttctaagaaatagcgtccgtcatatccataagttacacgacctaccaaaccttgctttctataaggtaaagcgttattgtgatactgtgtttctttttgcatgtataggaacatggcccctacatcgtgtttctctgcaaatgtacggttgtaattgaaggctgtttcaaagtaaatcttcttgtttgaactgttactcaggttttctgatagtacatcgctgccttctactacagtcttatataacagtttgccattttcgtcgcgtcctgtggctagatattgtgtcggtgttttggtacgtttggcgatatatgacatgtctgcgtcaaagctgataagtcctttccatgtcaatcccttggtcaggaagtccagcttctggtctacttccactttcgactggatggaagttctccattctttggcgtatcctgagttaacaagcaggttgtacgggttggaacgattgcctgacggacggggatgtccggccacagttccgtcggaataaactgccggcatgatataagacggagtacggcacatggtagtaaaaatagtgctggttcctgttcccggataattggtttgcaggtattgtccgctgaggtctacttttactgttgtggttttagttgcgtcaaagtcaatgttgctgcgcagattgtagcgcttcaatccgatattgttatcatagtcattgccgaaatccttgaatataccattttcctgatagaaggcgccggatacgaagtaacgggcacgttcagttcctcctcttacgttcagggtataccgcatattataggtgtggtttcttagcattgtacccaaccagtcagtgtccggatataaatcacggtcggctccgggaccgtatttggctatctcttcgtctgtgcgtatgctggcggtcccttcgttgttcaatgcttcgttgtataggtttaacgtttctactgagttcatgaaagtcggcagacgtgttggttcgagaatagttccttcggctcggaaagagattttaggtttctgtgaatttcctcgtttggaagtaatcaagataactccgtttgcgccttcggctccgtaaacagctgtggcggcagcatctttcagtaaggtaaatgattcaatttcatccgcttcaatatcctgcatttgccgggggacaccgtcgactaatacaagcggattggtaccgcctttgaaagaactttgtccccgaatccaaaagtcggcattgtcatatcccggttcaccggaacgttgcactgcgatcaagcccggtacttgccctgccagattattggtcatattacgactggaagaaacggacaactctttgggaccgatggcgttgatggaactcactacgctgttcttcttttgttttccgtagccgataacaacgacgtcctccagcatctctgtgctcggaagcattttgattgctaataccttttctcctttataagtgattttttgctgttcgtaacccacataagagaaaagaagtatattgcctttttgggctttgatggtgaaattaccatctacgtcagtgatggcaccgactgtggttccttcgatttttatctgcactccgatcatcggctgcccgttttcatcgactacgagtcctgtcggactttgtccttgtgcataaattgtgtttattcctgcaaataaggcaaacagaatgaaacacattacttttaatatcttattcataaatgtttcttttaagtaagaattagaaaataattaaggttacttgtccgtgccgtatacatatatttctgccaggtgtcctacagatgaaccactgcccagagtggggatgtaaatacgtatccagcgtgcatcacatgcttttacggggaccatttgctctgtttttatgctaccgtcaaagaagtattttccaatcaggttccatgtttcaccgtcatctcctgcataaatctcaaggttcatagaagtaagtgcattttgtctggcgatgagtcctaattggctgacactgttctctttgcccatgtcgagtattatttcgtatggtggagctacttctcctccctgccatttactatgccagaaagtgtttatctctccgtcaatcaaagatattgtctgaccgttgtgggggtaagcggctgaaacttcgcctgtcttttcttccgtgttggcagtcactgtccagtggtcacggttaatagggccgccttgtttgattacgaaatagttggctaccgtttccttgtctatgttgatgctggcgtctccttgtccgctaagtccgccgagtgaaaccggaagaagataatttccggggggaagtgtttcacccagcaggctaatagcagagcctcccgttgtctttcccttggcgatagtgacatcgggaagagtgtagaagtcggaaggtaaaggtatgtaataggtcgaatttgccgaattgtagttgtccacatagtccgctcctttggttgcaaacgaggtcgtcagatcccattcgttctcaaagcttatctctgtgtcgagattcataggtgaagtagtcgttcctccttctactacgaagtctcctccggtagatgcaagtctgacgatggcttctttaacgataaatccgtaaagtgttgccgttcggtcggagttcataggagtccctgtagaggatacccgtaatggaagaacgtatttaagttcatcaaagccgcacaggttgtagattttgtgaggatcatacaccagactgcctcctgttacgcgcctgtctccgccgggagagacggaataggttgcattttcaatcgtatagcattcgggaggtagtaattgataggaagtgccgtccgcattattcagagaatccaacagggattgttctactgaaaaagtcaccgttcctccggtatcctctaatcctgccttggcaatggatagatcaatcttgttgagagggcctaaatcgtaaacttcaatggtggagaatccactttgtgatgctgagaacattcccttagaacgttcgttatcaacatcttctacgcagctggtaatgcataagaatgccagcaagcatggtgttagttcaaagcattttttcataaattaatattagttttattaaaggtaaaaagggtaaaaacaagttgaagtacttgtgggtactcttggatttggaatacttatttctttctcataggcattaaaattagaagttaaaacttttatttgtgtgctgaactatgctgatttaaagtcagaaaaataataggttctatgtcttagttcttgtagaactataatatagtagatgataagatggaatagaatgcatgttgttgataatcaatgggaagtattgggggctgtaaacgtgtaatagtgaaatactcactctgtttctacccgttgattgattaaatgagaataattgaaaaacttatttgtaatttaaatatgaaatattattgaaaaatagtatgactttttcaaactaattagtatatttgcgcacgaatcgttgatttttagcaaaaaagatggtaaatctattgcttagttagatgcgttagtttagatacaaatggattaacagactgttttttgtgctaagttctacaagaacttagtttaattattcctctattcctttttaattggttgattgtttcggtcagaccgggcgaaaaactcacttcttaaatataaagcattttggcagtcgtttaattacgggtgtaagggagaaactatttaattgctatttggatagtacacagcgtgataaaggttgttatattctcaaagagttctcatgcctttgagaaaaaattctcaccacactgagaaaaaattctcaatgcaatgagaaaattttctcaaaggcatgagtattttttctcagtgcagtgagaatataatgaaagcttcaataaaaaagccaactaaatccataatgggttagttggcttttatattagaggatttatcctttgtttcgggaatatttattcttccgctttcaatgattcatcgataaccttgattttctgtaataccagttcaaggtcagctttcagtttatccacttttcgattcagttcagtcagcaggctgctacctttcttggaagaagaagtaaggaatcccaggttattttcataagtctgaagttcattcttcatattctcataaatacgtaccagtttttcccgttctctatataaagactgagagcctcctccttggatattgctgatgtttgaacggaaattgcttaatttcttgttggatgcactgatgttgaaacggtcgaacagttgatcgatcaagccatgatattgcttatacaatttgtctttctccttgaacggaacatgaccgatggtattccactccttcatcagttcgcgtaccaaagtgctggcttcgtcagtatccatgttttcatcgattgaagctaatttttcaatcaacgctttcttcttctccatgttctctatttctacagaacgttgtgaagaagtagccttgtttttctggtcgaagaaatagtcacaagcagtgatgaaacgtttccatacggcatccgagtatttcttggctaccggaccgattgttttccactctttctgcaatttggtcagcgcatcagcagttgctttccagtcggtgctgtccttcagtgcttctgccttttcgcaaagtgctttcttcttttccagattctcgttcattccttctttcagagccttgaagaattctcctttctttttgaagaagtcatcgcaggcatgacggaagcgttcgaagatcttcacattcatcttttggggagcgaatccgattgtcttccatttgttttgcagagcaatcacttcctgcgtcttgttctcccaagccgagaatgttttcagttcatcatattcaattgcttctacaatttcgcaaatgacagttttttgatccagattgtgctgttccgattctttcagcgcttcgaaatgttgctggtgacggcggtttacagccgtagaagcagccttgaaacggttccagatttcgtcacgcagttctttagctaccggacccgtatcacgaaattcctgatgcagcttctgaagttggtggaaagcggaaactacatcttcttcgtcagcaagcttttcggctgcttcgcaaagatgagtcttgatctccagattctttttgaagtcgtattcacgaaattcgttgttcagtttcagcagatcatagaatttctctacgtacagttggtaattcttccaaagttcattcaccttgccctgcggaaccagtttggtttcgttccattgttgttgcagctttttgaactctgtataagatttattggcatcatcacccgattctaccagttctttaagttcttcgataatggaaagcttgacttgcagattttcttctttctgacgttcctgttcggctacaagttgacttcttttctctttgatcgatcccatgaggcgtttgaattcctcttctgtcggatcatccttcggagtgaagtcttcggcagcgcctccattgtcgataaattgctttttagcagcttctaactcggcgttgtgtaacttgtagaatgattgttttagattgtcaatttcctgcttgtttgcgttttccgagtcttgcgcaagctctttcaatcggttcagtacgtcttcctttgtggcaggtttaggtgctgcttcagtctgaacttcggcagtaacttcttcagtaactttttcggtaccttcttcagtcggagtctctgtaatggcttcagaaacctcaactgttttcttttcttcttctaactccccttggttcaagggaagattagtgtcatgagcgtccatcattgtatattagttttgggtcacaaaataatgaaataaaacgattacttcatactcttttgcttatttttttttgattatcgcatttttatgataataaaacagtaattcccatgtacagcatcataccgattatgtcatttgtgatggctataaacggacctgttgcgatggcgggatctatttttagtttctccagtgtcatcgggaccagtgtgccgaagatggaggcgaacatcacaacggcaaacagactgatggatacggaataagtaaccgtagccgtcgcaccgaaccggataaagttgtaggtatataccagcagggagatgatggtagcattgattaaggctactaccgcttccttggtcacttgcttgaaagtgtttttggcgtccagtgaactattggcaagcccttgtacgatgatagcggaagactgtgtaccgacgtttcctcccgtaccgccaatcagcggaatgtataatgccatttcggggtgtgcggcaaaggttgcgtcgaaatttcccaatatcatggagtttccgatacctccgatcatgccgatcagtagccagggcagtcgggctgtggtctgtcttagtacgttgtcatcggtttctacgtcctgcgaaagaccggatgccaactggtaatcacgttccgactgttcacgaacttcgtccatgacgtcgtcgacggtgatctgtcctatcagtcggccgatgctatccaccacggggatggcaacaaggtcatacttttcgatggtttgcgccacttcatcgatggaagtgtctacgtgtacggagatcgggtctttctgcatcacgtgtttcactttggagacagaaggggaggtgatcatcttcttgagcgggaagattcccctcaggcgttcatcgtcgtcaatgacatatacataatatatttcgtccagttcttcggcttgctgacgcatttccttcagacactcgggcatactccagttctcgttcacgactaccatttcggtgcccatcagaccaccggcggtgttttcgtcatatttcaagaggtccacgatgtctcctgcctgttcgatgtcttcgatgtgcgaaagaatttcttcctgcttgtcttcgtcgaggtcacgcatcaggtctacggcatcatccgtgtccatgtagtccacaaagcgcttggcgattgtttccgaagggatcatttcgaggaactctttacgaacgtcctcatccatttcgacgagtacgtcggccgcggtttcattgttgagcaggcggtagacaaaccgggcttcttccgggttcaggtcatcacacaattcagcgatgtcggcgggatgaaggtcgacaagaagttctttaaccttatcggcatctttttgctcgataaggtgttttacgttgtcaatgtattcctcgttcatctttttgtttacgattaaacgttttacaaattacgggtttcgctcactatcggtcagttaccggatgcggtggctgttttcagcgcttcttccacctggttggtcagactgatgaattcttccaccgacagttgttccgggcgcttgttaaataatgcatcctccgtcagcgggcagtctttgcctaaaatcggcttgatagagttgcgtaatgttttgcgtcgttggttgaaggtggtcttcaccacttgtttgaacagtttttcgtcgcatcccagttccttggtatcattgcgggtcatgcggatgacggcgcttttcacttttgggggcgggttgaaaacatgttcgctgacggtaaagagatattctactttataccatgcctgtatcagtacgctcaggatgccgtaggttttgctgcccggtccggcagcgatacgttcggctacttctttctgtatcattccggtacagcaagggatgatgtccttgttttccagcatcttgaaaaatatctggctggagatgttgtacgggtaattaccggtcagtacgaaaggctttccgtcgaacaaccggtgaaggttcattttcagaaaatcgtcttcgataatgtgatcctccagtgacggataggcttcacggagataggcaaccgattcgtagtctacttcaacgacttttaccaaccggtctttttttaccagaaactgggtcaatactcccatacccggtcctacctccaatacaggcagttcggggaaggtgtcgactgtatcggcaatatcctgcgctactttcagatctttcagaaagtgctgtccgagaaactttttaggctttactaatttcatttaccaactaaataattacttttgcagccgacaaaggtaattcttttaaatgaagaatgaagaattaaggatgaagaaactactaaaaaagacgctgaagctgatattaccgattgttttaggcggctttattctatactgggtttatcgcgactttgatttcagcagggtcggcgaggtattacggcatggtacgaactggtggtggatgcttttttcgctcttgttcggggtgcttgctcaggtatttcgcgggtggcggtggcggcagacgctggagccgctggatgctttccccagaagaagcgactgtgtgaatgccatctttatttcttatgccgccagcttggtcgttccccggataggggaggtgagtcgttgcggggtgttggcgaagtatgataatgtctcgtttgccaaatcgctggggacagtggtgacggagcgactggtagatacattgaccatttttctgattaccggtattactgtattgctgcaaatgccggtgtttgtcactttccttgaaaatacggggaccaagataccttcttttgcttatcttttgacttcggtatggttttatatcgtcctgttttgttttatcggggtggtggtgcttctttattatttaaggaaaacgctgtttttctatgaacgggtgaaaggctttgtgttgaatatttgggaaggaatcatgtctttgaaaggagtacgcaatattcctttgttcatattttatacattggccatctgggcttgttatttttttcatttctattttacgttctattgttttgcattcactgctcatttgggcattcttgcggcactggtaatgtttgtcggcggtacgtttgctgttattgtgccgactcccaacggggcgggaccgtggcattttgctatcatggagatgatgatgctttacggagtaaatgtgacggatgccggaatatttgctctaattgtgcatggtattcaaacttttttggtagttttgttgggtgtatatggtttggcggctttgccgtttaccaatagacagcgaaagtaatcacttaataaaaatagatttgttatgagtactattctttctttagctccacagaatgtgtggaagcatttttattcgttgactcagattccccgtccgtccggacacatggagaaagtgactgaatttctgattaacttcggaaaaggcttgggactggaatctttcgtagacgaagcgggtaatgtgattatccgtaaaccggcaactccgggcatggaaaaccggaaaggtgtaattcttcaggcacacatggatatggttcctcagaagaataatgatacagttcatgattttgaaaaagatcctatcgaaacttatatagacggtgactgggtaaaagccaaaggtactacgctgggtgctgataacggactgggtgtagctgctatcatggctgtactggaagcgaatgatctgaaacacggtccgctggaagcattgatcactaaagatgaagaaaccggaatgtacggtgcattcggcttgaaaccgggtacggtaaacggagaaatcctgctgaatcttgactctgaggacgaaggcgaactgtatatcggttgtgccggtggtatggatgtgactgctacgctggaatataaggaagtagctcccgaagaaggcgacgtcgctgttaaagtaagtctgaaaggtttgcgtggtggacactccggattggaaatcaatgaagggcgcgccaatgccaataagctgttggtacgtttcgtgcgtgaagcggttgccagctatgaagcccgcctggtaagctgggacggtggtaatatgcgcaatgcgattcctcgtgaggcatgtgcggtacttgccattcctgctgaaaacgaagaggaactgctgggcttggtgaaatattgcgaagacttgttcaatgaagagttctctgcaatcgaaactccgatcagctttacggcagaacgtgtggagcttcctgccggtgaagtgcccgaagaaattcaggataatctgattgatgccatctttgcttgtcagaatggtgtgacccgtatgattccgaccgttcccgatacggtggaaacatcttctaatctggctatcattacgattggcggtggtaaggctgagattaagattctggcccgtagctccagcgatagtatgaaagagtatctgactaccagtcttgagtcttgcttctctatggcaggcatgaaggtagaaatgactggcggctattcaggatggcagccgaacgttgaatcacctattttgcatgcgatgaaggaatcttataaacagcagtttggagtagaacccgcagtgaaagtaattcatgcaggtttggaatgtggtattatcggtgctatcattccggggttggatatgatttcatttggtccgacattgcgttcgccgcactcaccggatgaaagagctttgattcctaccgtacagaagttctatgacttcctggtggctacattagcacagactccgacgaaataaggattcttttcctatttatataataggtatcatat

SEQ ID NO: 98 - DNA, 28582 bp, Bacteroides thetaiotaomicron
atattttacgattgatataactactgactcatttaatcgcaataaaataaatgagtgaagaaaaaaatgactgtacaaacttgattaatagatatttttgtctaaatttggcaaacatgatacaaacttacatacagtatacaagaaattatatgtgagataattagaataaacaaaccaataaatacgatgaaaaataattttacatggtttttactgtgccttgcatgtatgatgacgctctcttgttccgacaagaagaatactgcagatgaatcggagaaaggcgtctccacagtccttccagatacgaagaatgaagtagctgttcagatattgaagaagcgtgattttcatcacgaactggtgagtaacggcaaaatcagtgcccgtggcaaagccgatctgcgttttgaaaccggtgaagtcatcgctcatatctatgtgaagaatggcgaccgtgtacagaaagggcagaaactggctgatctggataaattccgtctggaacagaaattatcccagtcggaagatgctttactgaaagccgaacttgaattgaaagacgtactgatcgggcagggatattctcctgacgactttagtaaagtccctgccgaaacaatgaaaatcgccaaagtaaaaagcgggtatgaacagtcgaaatcccagtatgaactggcgaaaagagagatggagcatgctacgttgattgctccttttgacggtgtagtagctaatttattttcaaagccttataatccggcaaatacttctgaagcattctgtactattatcgattccaaaggaatggaagctgatttcacagtgctggaaaatgaacttgcttttatcaggatgggagataaagtggtaattactccttatgccggaggagatgcgtttgaaggcagtgtatcagagataaatccattggtggatgccaacggcatggtgaaagtgaaagcattggtaaatgcgggaggaaaactgttcagcggaatgaatgtaagggtaagtgtccgccgttcgctgggagagcggctggttattccgaagagtgccgttgtattgcgttccggcaaacaagtggtatttaccctgaaagacggcaaggcaatgtggaattatgtgaatacgggactggagaatgcgatagaatgtgtcgtctccgacaagtcacagaaaggtatcgaggatggtctgctggaaggagatacggtgatcgtcaccggaaatctgaatctggcgcatgaggcggaagtctatgttaaatgaagaattaagaattaaataatgaatctatgataaaattcttaattcagcgccctattgccgtattgatggcctttaccgcctgtttcatcatcggactggtgacgtactctacgctgcctatatcgctgcttcccaatatcgctattcctgagattacggtacaggtggcgtctgccaatacctctgcccgggaattggaaaacacgattgtcaaacctttgcgggggcagttgattcaggtctctaccctgaaggatattcatagtgaatcgagagacggggcgggcattatccgcttgtcatttgaatatggaacgaataccgaccttgcctttatcgaggtaaatgagaagatagatgccgccatgaactatcttccgaaagaagcggaacgcccgaaggtaatcaaagcgagtgcaacggatattcccgtattctatctgaatctgacactgaagaatgacagtgcttacggagctacggaacagcactccttccttgaattgtgtgagtttgccgagtctgtcatcaagcgcaggatagagcagcttgaagaagttgccatggtggacgtgaccggaattttggaacggcaagtacaaattgtgcccgacaaggacaagctcgccatgatgggactctccattggagatatcgaatcggctttatcctctaataatgtggaaccgggcagcatgacagtgcgcgacgggtattatgaatacaatattaaattctcgacattgctgcgtacagcggaggatgtggaaaatatctatctgcgtaagggcgaccgcatcgtacagttaaaagacttctgcaaagtaagcgtcgtacctgtaaaggaaaaaggagtatccctgtccaatggaaaacgggcggtgagccttgccgtcatcaaacaggcggatgagaacatggataagatgaagcaggcgctggttggcacgatgacctattttcagttagtatacccggagatcgatttcagcatcagccgtaatcagacggaactgctggactacaccatctctaatctgcaacagaatctctccctgggctttctctttatttgtctggtagcggttctgtttctgggagatgtaaagtctcctttggttatcggactcagtatggtggtgtccatcgtgatcagttttgtctttttctacctttgcaatatgtctctcaatatcatttcacttgccggattgatcctggcattgggaatgatgattgacagttcgattattgtgactgagaatatatcgcaataccgtgaacggggatactccttgcgccgtgcttgtgtgacgggaaccagtgaagtggtcacccccatgctgagttcttctctgacaactattgccgtctttgccccgctgatttttatgagcggtattgcaggcgctattttctttgaccaggctttttccgtcactgtaggactgatggtgtcttatctcaccggtatcatgctgcttcccgtgctttatctgctggtttaccggacaggtgtccgcacccggaaatggaagtggctttctttcaaatttaataacccgatcaaggatcacacgctggaccgcttctatgatgcgggtgttgactgggtatttcgccataaaacgttcagtgtactgttctgtgtgatttccattccgctttgcgtattcttctttttctttatagacaaagaacggatgcccgatatcgaggaaaatgaactgatcgcccggatagaatggaatgagaatatccatgtggatgaaaacaaacgacgggtggatgaacttttcaaggaactgaaagatgaagtactggagcaaacagcctctatcggcagacaggatttcattctcaatcgggaacgggaactgtcttcttccgaagcggaactttatttccgtacggagacttccaatgctattgcctctttggaacaggcggtataccggaaactgaaggaacgttatccgctctctgtcatttctttctctccgccggaaacggtatttgagaaactctttgtgacgggtgaaccggatgtggtggcggaattttacacccgtaataaagcggaagcccccaaagcggaagcaatccgtagcgttgaacaggaactgggacgaaaaaccggaatcaatccgacaggtatcgccttcgaaaaccagttgaatctgagtatcagcaaagagaaactcttgctctaccgtgtttcctacaacgaactgtatcgggtactgaaaacggctttccgggaaaacagtgtgacgatgctgcactcttatcagcagtatttgccgatcaacattgccggggatgaaaagactgtgaacgaggtgttgcaggaaacactggtgcagacgcaaccggacaaccgtgggaatgtcgattttatcccgcttcgggaattgatcaacgtagctcccgccgaagacttgaaaagtattacttccggacgtaacggcgagtatgtcccgttcgacttttacggcgtgcaggatgcgaaccggctgatgcgtgaagtgaaacaggtggcggaggaaacaggggactgggatacgggcttctccggcagtatcttctccaacaaggagatgctggatgaactggtcgtgattctgttgatctcactgctgctgatgtatttcattcttgccgcacagttcgagagttttctgcagccgttgctggtactggcggaaatcccgattgatgtggcatttgccttactcttgctttggatatgcgggcatacgctgaatctgatgtctgccatcggtctgattgtgacctgtggtattgtaatcaatgactctattctgaaactggatgcgatcaatgaactgcgcaaggcaggcgttcctttgctggaagctattcacgaagcaggccgcaggcgtctgcgtccgattatcatgacttcgctgacgaccatctttgccatggtgccgttgctgttctcctcggatatgggatcggaactgcaaaagccgttgtctatcgccatgataggcacgatgtccatcggtacggcggtcagcctctttatcataccgctgctttactggtttatctatcggggaaaaagcgggaatcacaaaccaaatgaaaaacatgttgaattatgaagaaatcatccgttctttttgtattgatggcagcatcggggatatgtttctcttcagtatatgcccagaaacgtctggtgctggacttgaaccagactatcgctttagctaacgacagttcgctggagtcattccgcacacaaaatatgtatctgtccggttattgggaataccggacgtaccgggcaaaccgtttgccgagtctgacaatggaccttaccccggcacaatataaccgggatatcacgaaacgttatgattcgggacaggacctggatgtctaccgtacgcaacagtcatattatgcctatggaggattaagtgtccgtcaaaatctggacctgaccggaggtacgttctatctggagtcgaaccttgcctatatgcgtaatttcggggataatagtgcgacacagtttaccagcgtcccgatacggctcggttattcgcagagcctggtcgggtataatcctttcaaatgggaccggaagatcgaaccgctgaaatacgagcgtgtgaaaaaggaatttctttataatgtggaaaaggtttcggaaacggcgacgaattatttcttttcgctggcgatggcgcaggcggaatacaaactggcaaaggaaaacctcgcatctacggatactttgtaccgcatcggacagcaacggcaccggatcgccgctatttcacaggcggacctgttgactttaaagctggataaagtgaatgcacagaatacattgcagaatagggcaagcgccttgaaacgggcaatgttctcactggcatcttttctgaatctggataagaatacccagatcgaactggagcttccttcacgcccaagtatgatggagattccggtggatgaggctttgagatggggaaggagcaataatccgcagttgctggaactgaagcagaatgtactggaagcggagcggaatgtggacagaacaaagaaggaatcccgtttcaatgccagcgtgaatgccagtatcggtttcaaccaggtggcggaaaacttcggagatgtgtatcataaaccgatgcagcaggacttggtagcggtcagcgtatcgattccgctgctggactggggcgttcgtaagggcaaatacaacatggcacggaataatctgaatgtagtgaagatttcggcacgtcaggatgagatcagtattgaggaggaagtcatcatgacggtgagtgattttaatatccagcagcagttgattgccagtgcggaagaagcgctggacctggcgatactggcttataatgagacaaggcaacgttttattatcggtaaagcggatattaatagtctgacgctttcgctcaacaggcagcaggaggcgcagcgcaactacatttctgccttgcagaactactggctgaattattataaaatacgtcgtctgactttattcgattttgctacgaagctttctctttcggatcgtttcgactttaatggaggaagactgattagatagtaatttcttttgggatatagacaaatgaatcatgcaagatataggttctgaaattaaaaagtcatcaaaggcttccgcttttacgctcattgtcgcttttatcagcgtggcgttggtcgggctggcacttgttccgttgctgccggtgaagctgaatccgtcacggaccttacccggattttctgtatggttcggcatgggagggacttcggcacgtgtcgtggagatgacggctaccagcaaactggaggcgatgcttgcccgtgtcaagggaatacaaagcatatcttcgacttccggcaatggctggggaagtataaatgtgagtctggacaagcatgcagatgcggctgtcgcacgttttgaggcttcgaccatcattcgtcagacttggccggaattgccggcgggagttagttacccgtacattcagatggcaagtccggagcagaaaagtcagggaccttttatcgcattcacgattaatgcgcctgccactcccagtctgattcagaagtatgcggaggaacatataaagacacgccttgcgcagcttccgggaatctataagataaacgtcagcggagccacaccgatggaatggcgtctggagtatgattatgagcagttgcgtgcgttgggggtgagtacggatgaaattagtcaggcagtcggtctgcattatcagaaagagtttctggggacttatgatgtggaacaggcggcttcgggcaaggaatggattcggttggtgctgatgcccgaacatgataaccgggagtttgacgccgggcagatacaggtgaaagtgaaggatgggagaatcatccgcttggacgaactggtgaaggtcgtccgtatggaagagcagcctcagagctattaccggatcaatgggctgaattcgatttatctgtctgttgtcgctgaagaggcggctaatcagctggaactgagcaaaaaagtacaggcgtgtatggatgatatcagactgtcgcttccggcgggatacgagattcataccagttatgatactacagagtttatacatgacgagctgaacaagatttatttgcgtacgggagtgacggtggctatcctgctcttgtttgtactgctgattactttcagccccaaatatctgtttttgattgtcaccagtctgaccgtgaatatggcaatagccgttatcttttactatgtcttcggactggaaatgcagttatattctttggcgggtatcacggtttcactgaacctggtgattgataatacgattgtgatgagtgatcattatcttcgatgtaaaaaccggaaggcgttcatgtctgtattggcggctacactgacaacaatgggagcgttggtcatcatcttctttctggacgagaggattcgtctgaatctgcaggattttgccgcagtggtgatgattaatctgggagtttcattattggttgctctgttctttgtaccttctttgattgataaaatcgggttgaaacgacgcaggaagtcttctctgaccggagtgaagagaaaatggaaaatggggaatacccgtttcttaggatggctgcgttcgaagatgcgaagggggccggtctatttcagtcatttctacaggtggctgatacagaggctttgccgctggagagtagcggtttgtctgttgctgttgctggcattcggattaccggtctttctgttgccggaaaagatggatggggatggcaaatgggcagagatttataataagacactggggactcctacctataaggaaaaggtgaaaccgatagtggataaagcgttgggaggaagtctgaggctgtttgtgcaaaaggtgtatgaagggagctactttacccggaatgaggaggtggtgctttatgccaacgccaatttaccgaacggcagtacgcttgaacagatgaatgcactgatcaagcgaatggaaacttatctgagcgagttcaaggagatcaagcagtttcagacatcggtagaaagtgcccgcagggcatctatcagcattcgtttcacaaaggaaaatcagaaaagcgggttcccatatacgctgaaagctaacatgatcagtaaagctctccagttggggggaggagattggagtatttatggattacaggatcagggattcagtaatagtgtacgcgagaatgcgggatcattccgggtgaaaatgtacggatataattatgatgaactttatagctgggctacaaaactgaaagaggtcttattgtctcatcgccgtatcagggaagttacggtcggttccaatttctcgtggtggaaggatgattatcaggagttttattttgagctggataaacaacggatgatcggagcggggatcggagccggagaactgtttgctgctattcgtcccatatatgggcggaatcaggaaatcggttccgttgttaccgaagatggaacggaaaaaatcaaactctcttcccgccagtcggatcagcgggatatatgggccatgcagtattatcctttccgtgtaggcgataaagagtataaactggcggaactggctaaggtagagaagggacagatgccgcaggaagtggcgaaggagaatcaacaataccgcttatgcctgcaatatgagtatatcggtgcgtcggaacagggaaataagttgctgaaaaaagacctggaagagtttaatgaacttcttccgatgggatataaggcggaagcggaaagtaataactggtcatggggtggaggtgccaacaaacagtatcgcttgctcctgattgtgattgctatcattttctttattacaagcattctgttcaattcgttgaaacagccgttagcgatcatctttgtcattccgatctcttatatcggtgtgtttctgacgttctactggttcaagttgaactttgaccaaggtggtttcgcttcgttcattctgctctgcggtatcacagtgaatgccagtatttatattttaaatgagtacaatgcgattcgaaaacgctttccctgcctttcttctcttcgtgcttacgtgaaggcatggaatacgaaagtgatccccatttttctgacggttgtttctaccatccttggctttatcccctttatggtgggagcagagaaagaaggtttctggtttcctttggctgcaggtactatcggtggattggtaatgtccgtgatcggcgtgtttattttcttgccggtactgactttgaataaaaagaagatgatggtgaagaagccttgaagaaataaattagctattagcatatttcgattagctaatagctaatttgtttttgctaatagctaatcgaaataaggtataggagataattcaccagttatttcctgcattgctgctgccgatcagcatttctacccgttgcttatacaagttggctccctcagcgatgttctttcccgcatctgcggttcccattccgtaaacaacaacaggcgtttgccacgacatccccgaatgaatggcactaacctgataaggacgtaaaagctcatccactgtgaagcggtttctgcctccgctacggtatgcttcatattcggaacctgtggtggttactactgtcaatggtttcccggctactgccggagtcttggaaaggaaggtgaatacttcgtcctgccattttttgagcaatgacggcgcagccatccaatgaaagggaaattgataaatgagggcggaagcatcggaaatgattttgctccattcgtcaacatcaaaagaagcgccttgctggtcgtaaagattgaatactgctacgccttcaatatcactcacagcatcaatcagtgctttgtttgcttgtgattccttcatattgggatgcgccaggagaatcaccacttttcttaaatctttattcataatcaatcgggtatttaggatgaaacaactacatctataatataaaggtctaaaaataagaaaaagttttcgaaactcaatatcttaattaaaaataaaagaatctctctttgcttttgaatttgtatttttgcaggcacgtccgtaaggcgttattttagataataaatttatatatgatagatttcacccaatttccttctccttgctatattatggaggaagaactcttgcgaaagaacctgtgtctgataaaaagcgtagccgacagggcaggagtagagattattctcgccttcaagtcattcgccatgtggcgttcatttccgatattccgcgaatacgtggagcattccacagcaagttctgtgtatgaagcgcgtctggcattggaagaatttggaagtaaagcccatacttattctcctgcgtatacggaacaggattttccggaaatcatgcgttgcagcagccacatcacttttaattcaatggcacagttccgtcgtttctatccgatgacagtggccgaaggaagcggaatctcctgcggtatccgtgtgaatcccgaatattcggaagtagaaacagaactttataatccgtgcgcacccggtacccgtttcggaatgaccgccgacttattaccggataccttgcccaaaggaatcgaaggtttccattgtcattgtcactgcgaatcttcttctttcgagctggaacgtactttgcagcatctggaagagaaatactcccgctggttcccgcaaattaaatggctgaatctgggaggcgggcatctgatgacccgaaaagattatgatacagaacatctgattaaattattgcaagacctgaaagcacgatatcctcatttgcagatcatccttgaacccggttctgcttttacatggcagacaggagtcctgacttcggaagtggtagatatcgttgagagtcgcggtatcaagacggctattctgaatgtgagtttcacctgccacatgcccgattgtctggaaatgccttatcagcctgccgttcgtggtgcggagatggggaatgaaggagaatttatttatcgtttgggaggtaattcttgtttgagtggtgattatatgggattatggagtttcgatcatgagttgcagatcggagaacggattgtgttcgaagatatgattcactatactatggtcaagacaaatatgtttaacggaatccatcatcccgccatcgctttgtggacaaaagaagggaaagcggaaatatacaagcaattttcttatgaagactatcgggaccgaatgagttgataatcaaaacaattgtttgtttgcggaaacaaagtgtgcagattcttgtgaaaaaaagatgcagaatgtttgcagaattacggaaaatccctacctttgcaaccgcaaacgaaaaaatgcggaaatagctcagttggtagagcataaccttgccaaggttagggtcgcgagttcgagtctcgttttccgctcatgtttctttgaaatgttggaaatataatctttgcccaggtggcggaattggtagacgcgcacgtttcaggtgcgtgtgtcgagaggcatgcaggttcgagtcctgttctgggcacaaagattttaactttaaaattctggagaggtggcggaattggtagacgcgctactttgagggggtagtgacagttatgtcgtgggagttcgagtctccttctcttcacagtcattaaagttatttgcggaaatagctcagttggtagagcataaccttgccaaggttagggtcgcgagttcgagtctcgttttccgctcatgtttctttgaaatgttggaactaaattttgcccaggtggcggaattggtagacgcgcacgtttcaggtgcgtgtgtcgagaggcatgcaggttcgagtcctgttctgggcacaagaaattcagatttctgaatggagaaaatttagtttgcggaaatagctcagttggtagagcataaccttgccaaggttagggtcgcgagttcgagtctcgttttccgctcaaagtagtgaggttgtcagtcgataagattggcgacctctttttgtaattacgaaagtcgatgtacttcccccaaaaagagtgtcatcgactcacacagacctataattaatttaagaacttgtgatatgttaacacaaatcattaatgcgcgcatcctcacccctcagggctggttgaaggatgggtccgtacttattcgtgatcataaaattctggaagtgactaactgcgacctggcggttatcggagcaaaactgattgatgccaagggcatgtatatcgttccgggaggagtagaaattcatgttcatggcggtggtggaagagactttatggaggggacggaagacgccttccggacagcgattaaagctcacatgcaacacggaactaccagtattttccccacactttcttcttctactattcctatgatccgtgcagccgcagaaacaactgaaaagatgatggcagagccggacagtcccgtactcggcctgcatctggaaggacattacttcaatatggagatggcaggcggacagattccggagaatatcaaaaatcctgatccggaagagtatatccctttgctggaagaaacccattgcatcaaacgttgggatgcggcaccggaacttccgggggctatgcagttcggaaagtatatcaccgcaaaaggcgtattggcatctgtaggacatacacaggctgaatttgaagatatccagactgcgtatgaggcaggatatacgcatgctacacatttctacaatgctatgcccggatttcacaaacggaaggaatataagtatgaaggtacggtagaaagtatttatttgattgatgatatgacagtggaagtcgtggccgatggcattcatgtgcctcctaccattcttcgtctggtctataagataaaaggagtggagcgtacgtgcctgatcactgatgcgctggcttgtgcggcaagtgacagtaagactgcttttgatccgcgtgtcattatcgaagacggtgtgtgcaaactggcagaccgctctgcattggcaggaagtgtggcgacgatggaccgtctgatccgtacgatggtgcagaatgctgaaattcctttggcggatgctgtgaggatggcttccgagactccggcccgtatcatgggagtgctcgaccgcaaaggtacgttggaacgtggcaaggacgcggatattattgctttggatagagatctgaatgtaagagcggtctgggcgatgggacaattggtagaaggtacaaacaagctgttttaacgactaaaaaagaaaacgatgttaactcaaataatcaacggtagaatacttactccgcaaggctggctgaaagacggctctgtattgatttgtgatggaaaaatattagaggtaaccaacagtgatctggcagttatcggtgcaacagtgattgatgcgagaggaatgacaatcgtaccgggatttgtcagtatgcatgcgcatggtggcggcggccatgattttaccgaagcaacggaggaggctttccgtatcgcagcaactgctcatttgaagcatggagctaccggcatatttcctactttgtcatctacttcgtttgagaggatatatcaggcggtcgatgtttgtgagaagctgatgaaggaaccggagtctccgattctcggtctgcatatcgaagggccttatctgaatccgaagatggcaggaagccagtatgacggttttctgaaaactcccgatgaaaatgaatatgtgccgctgttggaacatacttcctgtatcaagcgctgggatatcagtcccgaattgcatggggcacatgattttgcaaaatacactcgttccaagggaattatgacagccgttactcatacggaggctgaatatgatgagattaaggcagcgtatgcggtaggattctcgcatgctgctcatttctataatgcgatgcccggttttcataaacgtcgcgaatataaatatgaaggtacggtagagagtgtatatctgacagatggaatgacggtagaagttattgcagacggtattcacttgcctgctactattctgaaactggtttataaactgaaaggggtagagaatacttgtctggtgactgatgcgttggcttatgctgccaatgaagggaacgagccgattgatccgcgttatattattgaggacggagtatgtaagatggcggatcattctgcattagccggtagtctggcgactatggatgtgttggttcgtacgatggtgaagaaagcaagtattcctttggaagatgctgtgcgtatggcttccgaaactcctgcccgtctgattggtgtgagcgatcggaaaggggcattgtctaaaggtaaagatgctgatattgtgatacttgataaggaattgaatgtacggtgtgtctggtcgatgggaaaagttgttccggggactgatagattgctgcataaatgataagtgctatctgttaaatctgaaaatagaaagtccgaacctttaaattgcaaaaagcaattgggattcggactttttcagtaagaaaagtagtaatgtgagtactctatattctattttatcatgaaaatagagtcgtttctataaactctttcaattgaaccttattcattgtaccgagtttcattatcggtttgccattcaccgggcaaagcaaaaggttgggaattgtccgaatcttgaatgcactttccagttcctcttcctgatcgacgtctactttataaatgtccagtctccctttatattcttctgctaattggtccaatatgggtgataatgccttgcaataaccacaccatggagcatgaaaatcgactaaacaaggtttattccctttatattcccaattatccggataagattgataatcagcaactttctcaacaaagctttctttggttaaatctataattttcatatttcctgtttttaatgattcattatttatttctactttgcaaagataggggtatggtagagaaagagggatagccattcttcctgttgtgtttacaatttttcctttccttagatattttctaatcaaattctaatctgaaatgagagccttataatcgcttttatccagcctctaccgttgcagagttgtacttttgtcggaaaacaaattaaggtaacaaaaagattgcgatgaacagagcatttttatttttactatttcttctattggcaggaaagatgtgtgcgcaacaggttgcaggcacattgacactgaaagaagcagagcagcgttttttagagcgcaatttatcgttgatagccgagcggtacaatatcgacatggcacaggcgcaggtattacaagccaaattgtttgaaaatccggtcatttcgctggaacagaatgtctacaaccgattgaacgggaagtattttgattttggaaaagaaggggaagctgttgttgaaatagaacaggtgatccatcttgccggtcagcggaacaagcaagtccggctggaaaaaatcaataaggaaatagctgaataccagtttgaagaagtaatgcggacgctccgtcaggaattgaatgaaaagtttgtagaagtctactttctttctaagtccattgccatctatgaaaaggaagtaaattccctgcaagtacttttgggcggaatgaaaattcagcaggaaaagggaaacatctctttaatggaaatttcccgtctggaatccatgctcttctccttgaggaaagagaagaacgaacgggagaatgatttactgactaccaggggagaactgaatttattactgaaccttccggaagatacacaagttcaactctcattagacgaagaagtactgcaacaactggacctgtcgcaattatcatttgcagacctgaaagcaatcatcaatgaacggcccgaccaaaagattgcccgaagcacagtgaatgcctcccgtgcaaatctgaaactacagaagtcaatggcctttcccgagttctctgtgaaagggaattatgaccgtgtaggaaactttatcaatgactatttcgcgataggagtaagcctgtccgtacctatcttcaaccgtaatcagggaaatatcaaagcagcccgcttcagtatccagcaggcgggagtgcagcaggaatatgctgccaatcgtgctgatatggaactcttcaccgcttatacgtctctggagaaagcgactcaactctatcaatccactaatatggacctggaacgtaacttcgagaaattgatcacaggagtcaatgagaatttcaccagaaagaatatcagcctgctggaatttatcgactattatgacagctataaagaaacctgtatccaactatacgagataaagaaaaacgtatttctcgctatggaaaacctgaatacagttgtcggacaaaatgtattgaactactaataaaccgaccaatatgaaacgattaaagatcacaatccataaattatcaaagactatgaactggaataaatttcttccttgtatattgtttggcagccttttgggagcatgctccggaaaaggagaacaacccaaagtagaaccgactacactatgcctgacggacagcctgctgagaatcgtatccgtcgataccgtgcacgtctgtgaagtggtagatgaactgacattgaatggacgggtcactttcaatcaggatcaggtggcaaatgtgtatccgatgttcggaggaaccgtgacggaactgcgtgccgaaataggagactttgttcacaaaggagaagtgctggcagtgatccgtagcggggaagtggcggattatgagaaacaattgaaagaagctgaacaacaactcttgctggcccggcggaacatggatgccacacaggatatgtacacttccggcatggcatcggataaagatgtacttcaggccaagcaggaactggcaactgcggaagcggaagaaagacgaatcaaagaaatattctccatttatcacttctccggaaatgctttttatcagctcaaatctcccgtatcaggctttattgtggaaaagcagattagcagggatatgcagctgcgccccgaccagggggatgcgctgtttacgatttccggtctgtccgatgtatgggtgatggcggatgtgtatgaaagtgatattagtaaggtttccgagggagctgatgtccgtatctcgactttggcatatccggaaaggacatttacaggtacgatcgacaaggcctatcacctgttggacagtgaaagtaagacaatgaacgtacgcatcaaactgaaaaacgaggattacttgctgaagccgggtatgtttacaaacgtgagcgtgaagtgtaaagcggaagatacttccatgcctcgtatcgactcccatgcgctggtgttcgagggaggaaagaattatgtggtcacagtagagcctgaccagcgtctgaagataaaggaagtagacgtttacaaacagttgagcaaggaatgttatgtccgttccggtctttccgaaggagacagggtactgaataataatgtattgttagtgtataatgctttgaatgcggattaaaaatcagagaatagtatgcataaattcatagataatatagtagccttctcgctgaagaataagttctttatattcttctgtacggtgattgccgttatagccggagccgtctcattcaaacatacgccgatagatgcctttccggatgtaacgaatacaaaagtgacgatcatcacgcaatgggcgggccgtagtgcggaagaggtggagaaatttatcacgattcccattgagatagccatgaatcccgtacagaaaaaaacggatattcgttcgaccactcttttcggactttctgtgatcaatgtaatgttcgaagatcgtgttgatgactttacagcccgtcagcaagtctacaatttgctgaatgatgccgatcttcccgaaggcgtgactcccgaagtacagcctttgtacggacctaccggagaaatctatcgctacaccctgcgcagtgacagacgtagtgtacgcgatttgaaaacgattcaggactgggtgatcgaacgaaatctccgttcggtatcaggtgtagctgatatcgtcagtttcggtggcgaggtgaagacattcgaagtgagcgtgaatcctcatcagttgattaattacggaattacctctctcgaactttatgacgcgatagccaagagtaatatcaatgtaggaggagatgtcatcacgaaaagttctcaggcatacgtagtccggggaatcggtttgataaacgatctggatgaattgcgaaacattgtagtgaagaacatcaacggaacgccgattctcgtaaagaacctggcagatgttcacgaatcctgcctgccccgcctcggacaagtgggacgaatggatgagaacgatgtcgttcagggaattgtggtgatgcgtaaaggggagaaccccggtgaagtcattgcaaatctgaaagataagatagaagaattgaatcagaatgtacttcctgaagatgtacggataataccgttctacgaccgtgaggacttggtgaacctggcggtaaaaacggtgacccataatctgattgaaggaatattgttggttacgtttattgtgttaatcttcatggcagattggcggacaaccgtgattgttgcggtgattattccattagctttgttattcgcatttatttgtttacgcgtgatggggatgtctgccaatctgctttctatgggggccattgactttggtattattatcgatggggcagtggtgatggtggaaggtgtgtttgtcgctttggacaagaaggcgaaagaggtgggaatgcccgcattcaatgtgatgtccaagatgggactgatccgtcataccgccaaggataaggcaaaagcggtatttttctccaaactgatcatcattactgccttaattcctattttctcttttcagaaagtggaaggaaaaatgttctcacctttggcatatacattgggttttgctttgctgggtgcgcttattttcacattaacgctggttcccgtcatgtcgtccatgttgctgaaaaagaatgtacgcgaaaagaacaaccgctttgtccatttcatcaatcaaaagtgcacggctctttttgataccttctatgctcatcgcaagctgactatcggactggcaaccgtagttgcaggagtcggtttatggcttttctctttcctcgggacggagtttcttcctcagctcaacgaaggttcgatctacatccgtgctacgctgccgcaaagtatatcgctggatgaatccgtaacgctggcaaataagatgagaaagaaactattgactttccccgaagtgaggcaggtactgtctcaaaccggacgtcccaacgacggaacggatgcaaccggattttataatattgagtttcacgtagatatttatccggagaaagactgggaaagcaaactgaccaaactgcagcttatcgacaagatgcaggaagatttatccatttatcccggcattgactttaacttttcgcagccgattacggataatgtggaagaagcggcttccggtgtaaaaggttctattgcggtgaaagtgttcggtaaggatttgtacgaatcggaaaaactggccgtccagattgataagatcttaaataccgtgcagggaattgaagacttgggagtgattcgcaatatcggccagccggaacttcgtattgaactgaacgaacgtcagttggcacgttatggagtggctaaggaagatgttcagtctatcattgaaatggctattggcgggaagtcagcttcgctgttgtatgaggacgaacggaaatttaatatcatggtgaggtatagtgaagagttccgtcagaatgaagaggagataggtaagatactggttccggcgatggacggaacgatggtgcctattaaggaactggcagatatcactacgattacaggaccattattgatcttccgtgacaaccatgctcgtttctgtgctgtcaagttctcggtgagaggacgggatatgggtacggcagttgccgaagcgcagaaaaaggtaaatgcttccgtccatttaccggctggatattctttgaaatggacgggtgattttgagaatcagcagcgtgcttcgaaacgtctggcacaggtagtacctatcagcattgccattatttttattattctgtttattctcttctccaatgcaagagatgcaggactggtattgctgaatgtaccgtttgctgccgtgggaggtatcgcagcccttctgataacgggcttcaatttctctatatcggcgggtatcggttttatcgccttgttcggtatctgcatacagaatggagttattatgatttccgatatcaaggcaaatctgaaactgggttcgcctttacaggaggccactaaagaaggagtccgatcacgtatccgccctgtgataatgacggcggctatggcagctatcggtctgttgcctgcggctatgagtcatggtatcggttcggaatcacagcgtccgttggcgattgtcattatcggcggattgataggagcgactttcttcgccctgttcatcttcccgctgattgtggaagtagtgtatgaacgaatgctatatgataaaaacggaaaattattgcaaagacgtatctaattcattttctattctttctatgaaagaaacggcatagattaaattttaatttcgttttcagtaggtagaagtgaggaagggacaaaagtcggttgaatcagaagatcacccgtacttttgttcctttttctatttccgaagatatttccagtctggcgttgtaggcagatactattttctgcgtcaggctgaggccgatgccctgacctgcatagtcatgtgtgttgctgccccgatagaaagactggaatatatgttctatttcttccggaggaatgccgatgccctgatcttttatttcaagaacgaggtgttgatctttttggctgagcgtaatgtctacttccttttcagaatatttgcaggcattatcgatgatattctttaaagctattttgagcagataaggattggcctttacagtggcagccttacctgtttcttgataatggagacggattcgttcgttcatttttattaagtcattcagcatatccggcagagacattgcctccatattgctttttatgagctcttcatcctgacgtgaaaggaaaagaagatggcggatcagattggagattcgcttgctttcggatgagattcgttgcagggcttcgatatattctccggtacttctttctttcagcagactgatttcacattctccctgtatggcggttatggggttgttcagttcatgcgaagcatggctgacaaaggacttttcagctttgaaagcactgtccagacggtcgagcatgctattcagtgtttcgatcatgtcttccagttcatcgttgtttccggtcgtctttaaccggcggttcagactgttggctcgtatcctcttcagctccttcagtatatgctgcagggggataagaatacggccggaatagattttcccgactaaataaatcaggatggaactgaataaaaccagaaagatggagagaagcaagaggtgttctttgatttctgcaccgtacacattccgggacatgacgaggacgatgaaatttccttcattatcgggataataaagggcggctcccaactggtctttgtatttaaaagaaaaagggacgctgtcttcaccggctatcaggagtgcctgctgatgctgggtcagatatttgttcagtgtgtcacggacttcggagagactgtccatatttaaaagaatctcatgagcttcgggcaagagttcgtcatatttgcgctggataatctggtaactctgttcgtctatttcgtctttctcccagtgcttttgtgcggtcagatatgctttttcacgaagataggaggcatagagtttattgataaactgtgtgctgaaaagatagaatacggcgataatgatgatagttgtcagtacactgagcaacgtatagaagagagctattttagaacctattttcatacacggatttgtttgatggatgttcaggcattcatgatatatcctaatcctactactgtatgaatcagtttcttgtcgaagtcacggtctatctttacccgcagataattgacgtatacgtctacgatgttggtattcgtatcaaagttcttgtcccatacgtctttgagcagcgtaatgcgcgataaggctaccccttggtgagtcatgaaatattcgagcagacggtattcttttacggtgagatcgatatccgcatcacctcttttcgcccgtctggtgttacagtccaataccagattgtcgcaagtcagttgattggttacagtctccttgtttcgtcgcagcagcgccttgatacgtgcttccagttcctgaaaactgaaaggcttgacaagataatcgtctgctcctgcatccagtccttttacaatgtcttccgtagtgcctaaagccgtcagcataatgaccggtgcctggtaaccgaacatctgccgatagagatggcaaagttcgagcccgtttattttcggcatgataatatccaggattacaaggtcgaaaggttcttcctgaaggattctccaacccgtatttccgtcatgacagactgttaccgaatgtccgaactctttcagtccccgttcgataaaggaggcgatattgacttcatcttctgctaatagtatctttgccataaatctacattgtttagatgcaaagatactttttctttgcatccgaagaaagaaaaacggcatacatttaagtgtttctcctttctgaactgtattatatataaacagacgattatactatgaaagtaaaacatttagttggagcttttctgtgtgtgctgggatgctatgcctgtagtagcccgaaaacagaggtccagtcaccggacggacatatcaagatgacattgacggtagacgaaaacggcaaaccgttttataatgtgtcggtggatgactccctcttgatagaaaattcagccatgggctttacggcggctaacggcatcattctggcagaaggttttcaggtgaagaacacgactttcagcagtgaagacgaaacttggacacagccgtggggagagaataaaaagaaccggaatcattataacgaaatggcagtcagcctgacaaatgaagatcaggtacaactgacactccgtttccgtgtatttgatgatggaatcggtttccgctatgaatacacggtgccgactgtagattctttattgattaccgacgaactgactactttccgtttccatcgtgacggaacttcgtggtcgattcccgccagtgccgaaacatatgaactactctatcaacaacaaccgatttccgaagtggaaacggctaatacacctttcacattcaagactgcggatggagtttacggaagtatacacgaagccgctttgtatgattttccggaaatgactctgaagcaaatcggccattatacattgaaagcggaacttgccccgtggcctgacggcattaaggtgcgtaagggaaatcacttcacgacctcatggcgcaccatacagatcgcaccggaagctgtcggtttgatcaactcttcactcattctgaatctgaatgatccttgcgtactggaaactacggactggattcgtccgctgaaatatgtaggagtgtggtgggggatgcacctcggcgtagagacctggaagatggacgaacgtcacggagctactactgccaatgcaaagaaatacatagattttgccgcggccaatcatatcgaagctgtcctgttcgaaggttggaacgaaggttgggagagttggggcggtatgcagagctttgatttcaccaagccatacgcggatttcgatattgatgaaatcgtacgttatgccaaagagaaaggcgttgaaatcatgggacatcatgagaccggagggaatattcctaactatgaacgtcagatggatcatgccatgcaatggtataccgatcatggtatccacctcctgaagacgggatatgcaggcgcatttccggatggatatctgcatcatagccaatacggtgtcaatcactatcaacgggtagtggaaactgccgcccgtcatcaaatgactctggatgcacacgaaccgatcaaagataccggtatccgtcgtacatggccgaatatgatgacacgcgagggggcaagaggcatggaatggaatgcgtggagtgaaggcaatcctccttctcatcacgtgatgttaccgttcacccgcctgctgtccggtccgatggattatacgccgggaacttttgatattctgttcttgaaaacgaaggattctccgcgccgacagaagtggaacgatcaggataaaggcaatagccgtgtgaatacgacgctggctaaacaactggctaattgggtaatcctgtattctcctttgcagatggcttcggatatgatcgagcattatgaaggacatccggcattccagttcttccgtgattttgatccggattgtgatgaatcgaaagcactggcaggtgaaccgggagagttcattgcagtggtacgtaaagcaaaaggcaattatttcctgggagcagctaccaatgaaagcccccgtactttagaagtaaaactggacttcctggaaccaggcaagcagtataaggctgtcatctatgcggatggcgaaaaggctgactggaaaacgaatcctaccgattataagattacggaacagattgtaacatctgaaaatacgttgagtatacggatggctcccggaggcgggcaggctgtttcgtttataaaaagtaataggtagtaagtaataggtaataggtaataagtaataggtgagggtaataagtgaggttgttaaagtagagagattgtcggaggataacaagataaaattaagttggttaggttagactgaaaaaacggtggacagagttttgatacctgttcaccgtttttgtttttattgagtatggttttgaaaggatgtgttatccttttgcttcctgatacataaagcgtttgattgatttcttcgcagtcttttcaaattcctcgaaatggattttgactttgcttatctgagaataattgggaagctgctgattcagttcaacacgattggcttccataacttttatgatatcggcctgttgcaagccatgggcaaaagcatcgtcaaagtccggataaatcagtgcgaccaacttgtcgtgctgcaaaacgatcagtgactcggcaacataaggcatattattcagtttgctttctatctcttccggatagatattctgtccgctggaagtcagaagcagattcttgctacgaccgcgaactgtcacatatccttcgtcgtcgattgttcctaaatcacccgtgtgaagccatccgttggcatcaataatttgtgccgtcgcttccggatttttataatatcccagcatcatattcattcccctgcatacgatttctccggcatgtgttttagggtcgggcgagtcgatgcggacttccattcgggtggttgccttgccgcaggaagccagtttcagtgtttcccaacggctggagcaaataatcgggccacattcggtcataccgtaagcgatggtgtagggaaagcctatctttttgaggaacgcttctacttcggcattgaaaggagcaccaccgataatgatttcatcgaagttcccaccgaagatttccatagcagcctgccgcgccaacgatttgattttatcgtttacaatgggcactttaagcaatagtttaccgattttgctgtccactctcggaagaatatcttttttgataattttctctacgatcaaaggtacacaggagatcactcttggctttatttctgcaaaagactgcgcaataatcttcggagacggcatacgtgtcaggaagtaaatgtgcgctccggcagagaaaccatataagaaatcgtataccatgccgaatacatgacccatcggaagcatggaaacgatgtgatcgcccgctttcacgggaagcatctcgaaacagtatgccacgttcgaccaaatactgcggtaggggagcatgactcctttggaatatccggtagtgccggaggtataattgatgatagccagttcttccggacggtccttccggtaacagatatgttcggggcggaaattcttcggataacgctgaccgtaaatagcgttccggtgttcgaaggcgtaagtcagtttctcgttgcgcgataccaatgcagtgaaatcggtgagtgaagcgataccttccagtagcggcattgcgtcttcattcagattttcccatgcctgatcgccgacaaagagtaatttggcttcggagtgattgacgatattgtgaatattatccgctttgaactcatgcagaataggaacgatgacggctccgtaagtgatagtggctaagaaggtgactccccaatgggcactgttccggccgcagactgctattttatctcctggctggataccggcactttccaatacaatgtgaaacttggctatcttgcgcgctacatccttatattgaagcgtgattcctttgtagtctgtcaatgcatctttatcccagtttttaatgatgctctgttcaatataatcaatgaactgatgttcttgttccattcgatttttgcacatttgatttaaaattgcgcaaaaataacatttcattaacggaaaccgaagtttacaattaagttttacggttaattaacgggggaggaaagctgactaaaaagtcagtagtacctttaaatggggctgactaaaaagtcggtagtatcttaactctcctccttcgggaaggaggagtccccgtagggggaggtggtaggtgaacacataactctgttgtttacaatagaataggaataaaccttattttacctaccaccccggctttcagccacctctcctttccgaaaggaggggaattggagatactattgactttttagtcagtccctataaacatcaggattcgctgttggcttcctcgtcctctttgggcttttcggagatgagcagcaatttatcgttcacatgcagtttcagcgttccgttcggtatcaggaactcatccccacgtttcacaatcattaccagcgtgcctttggggagattcatatctttcagcgtatctgcctcttccagcatttcctgtgtgatagtcatatctttgaggtctgtatcaatctcttccggaagttccactccgaaatcattccccgtcttttccagcggtttggacagatgtaacaggcgggcaacgaaagaaaccgttgttccctgcactaccagtgaaacgattgtgatgaagaatacgacattaaagataatattcgatccttcgactcctgcaaccaccggataagtggcgaagataatgggaactgctccacgcaatcctacccaggagacgaacagccgcgatttcattgtaatcttccggaacggaagcaaacagaggaacacacttaacgggcgaccgatcacaatcatgaagacaccgatcaatagtgctactgctgcaacttccagcatttcatgaggattaacgagaagtccgaggcagaggaacatgatgatctggaacaaccaggtaagtccgtccatgaacgtataaatgtctttgcggtgcatgatcttgttgtttcctaccataatacctgcgatatatacggcaaggtaaccatttcctttcagtaaatcagtgatagagaaggtgaagaaaacaaacgccagcaacaagataggatacaacgcctgattgtcgatgttgagcttgttcagcatacggatagccagttttccgagcacgtatccggcagccgcgccgactataaactgaatgatgaaagaagcggcgatagccccgactcccatacctgccgattggataaactgtatcaggacaatggtgagcatgtatgccatcgggtcgttacttccactttccagctccagcatggggcggaggttgtgtttcagattcatcttctgcgaacgcaggatggcgaacaccgaagccgagtccgtagaggacatggtagatgccagtagcaatgacgtggtgataggcagatagatattcgtccagctcattccggacagccaccagataaataatccggtgaaaagagcggttagtagaactccgacggtagaaagcacgatacctggacctaaaatgggtttgatttctctgaatttcgtatccatacctcccgaaaacaggatgatgcttaaagcaaccataccgatgaattgcgcatcttttgcgtcatgaaactggagtccgagtccgtcacttccgaacaacattcctactacgaggaacagtaataaggtgggcactccgaagcgatatcctgtttttccgacaacgatgctaacgaaaagtaagatagaaccaattagtagggtgttttctgctgtaaatatcataggcaatatatta

SEQ ID NO: 99 - DNA, 28234 bp, Bacteroides thetaiotaomicron
ttcatacacttaaatattgataagatgaaaaaatatataatcacagcatttgcttttatcacactgttgacaggcagcgttacattcactgcatgtgaagatatagatgacataaaagaattaaatttagatcgtctattatccccgactaatctgaccgcaagagttagagacaaagtaaatatagaattaacatgggatgaaatggatagagcccaatcctatgtaatcgaagtatttaaagaagatcctgattttacaggaactgctatttctacgttagaatctgaaaaagcaacttatacggttacaggattagaaggagaaacatcatactccatccgggtaaaaagtgtagcagaaggaattactgattccaaatgggttagcgctacccgttcaacagatgcagaacaaattcttctggaagttgcagaagaagatctgacagcatcagaagtaacacttcgctggcccgccggacaagttgctacggaaatcatcataactccaaatgatgttgcagcacaccgtgtgacttctgatgaaattgcagccggtgccgctactattaaaaacttaaagtctgaaactacttatactgcaactttaaagaatggtgataaaactcgtggtacgatggtattcacaactctcataaacttggatggagcattacctgcttatccgggtgacaatcttgcaacaatcatagcaacagccgaggctaatgctactattgtcctattacctaaagacgacaataatagcttcatatatacagatgaaagtggaactgcaaaaacattggaaatagaattaaccaaagatgttactataaaaggtttatatgcagaaaaccgtccaactactaatatcaagtttgtattaagtggatgtaacaatttcaaaatagagaaccttaatttaactgctagtgacggaggtacaattattacagtacttgatagtaaaggtggaaatataactgttacaaattgtgatgtaactggatttggttcgttgttagtagagaatgataatacacaaactggtactatcaatacatttactgtagataactgtattttccatgatatggcaagtggcaaaagatttgtagactatcaaaagaagaaatcctttatagcagagtttacattgaaaaattccacattctataattgttgctctggttctgattttattcgttttgacagacattcaacgaaaggcaatatcataaatatatcgaattgcactctgtatggaattgaagcaacaagtaaaggtctcttctatgtccgttccaactcagttggtaataaagattttactgcaaatatcacaaaatgcatttttgctaacatgagtaataaagtattctttagtcaagatactaaaactgataatctgacatttaactcgaactattatttcgaggcaccttccttactatcaatacctgaaggtggagccggtaaagtggtagacgcaactggagtcactcttgatccaggctttacagatgcagcaaacggtaatttcaaagtatctaaccaaacaatcatagataatgaaattggtgatccacgctggagaaaataagattttataaaatctagttaagctaaaagaggctaaaatcaaataatattttagtctcttttctcaagatagcgatactcgtattcgggcatcgctatcttttttattattattccaaagaagtaatgacgtacatcattcgctcgcattttgtacaccattcatccaattcttatacatcttttccttaaatcttctacatccttggagtgactctagtacatcatcataacaactcttgtacttctttctatttactctaatacaaataaaaagcctgcttggcaggctaacaatgaaagaatcagccacctactaaataaagttgaaatccaggtattcagttctttcagtaatctccgcaaaatccctgtcagaaggagatacagctgaaagcagtagtctctgaaaagaggtttcagcattcagctctttcagtttcaaaaacagagcctgcgtttgttccaatcagaagttctatttactaaaagtaaaaggtctattttacttaaacagaggctctattcattcatcatattttcagcgctgtttctatcattctcaccttatttgtcagcaaactttagctcggaggtcagcaagcctaagcctacacgtcagcaagcctgagtcgacgggtcagcaagcctttgcccgtacgtcagtcagcctttgcctacatatcaaccagcctttgttcagaaattaagatatacatagcttatcgactataaaagcagaaactcaaactataaacctgaaagaactgaaaccacgcccccgctcagagcacgtctacgcaagggtacgaaatggtgccttcagccgctatcaccttctatcaaggcttttccgaagaaagctgaaacggctgaacgctatttattcaatgaaacttctaaggagataaaactgcaagaagctccaattaccgaccgactttctcccgatactctgtcggagtcataccgacctgcgccttaaaacatttactgaaataacgcgggtcattgataccgaccatataagaaatctgagtcatattaaactctcccgtttcaatcaattgtgcggcacgcttgatacgcatttcctttatgaactcgataggggccagtcccgtaagcgtttttagtttcttgaagaacaccgaacgactgacagccagttcacgaaccaaatcatccactaccaattccccgttatccatattctgctccatcaaatcaaccagtttatccataaatttacgatcgttaggagacatttccggcatcgcaggctcttccgctgcactacttacgggttcagcagatgcatgacctgctaaagtctccccttgagcaaccggagtttcagacaccgtcacatgcgtcagactatcacgatagaaattttgcagtttcttacgctgcatcagcaggttctccacacgggcctgaagataagtcgcactaaaaggcttggtaatataatcatccgccccatattccagtccttccaatttactttctatcgtcgtcttggcagtaagcaggataataggaatatgactggtcgtcatatccgcacgaagttcacgcgtcatttcgataccgtctttctccggcatcatgacgtcgctgataataatatccggcagatacttcaaagccttgctccatccctccataccctcggaagcctctaccacccgataagttgaagcgaaaatactgcgcaggaaggaacgcaattcctgattatcctctaccagcaacataagctctttcgaactgctttcctcagcctcttctttgacagcagatacttccaggtccggcgcatctgcgatggcagcttctgtctgaagcgaagaattagcgatatccacaatacgttccatactcagcggagcaaccgaatcttcgagaataaattccactgaactattataatgctctttgcccttcagaaagtccactttaaaacaacttccctcaccgagccggctgtcaacggaaatcgtagccttgtgcatctctaccagttccttcaccaaagaaagaccgatgccggagcttgcctgattgaaaatattcttgtccaccaagttctcaaagcgcacaaagagagacttccgtttattttcggcaataccaatcccctgatcctgtacgccgacagacaccgtgccctcatcttcacggataaagacggtgatcattttcccattaggagtatatttaaacgcattggacagaaggttaaacacaatcttttcaaacttatcggcatccacccaaagattcaaagcctctttctctgtctggaaaaggaaatcgatgttgtgttcttccgccaccgactcaaaattatccataatcttgcggacaaaggcaacgacattcaactgttgtacctgcatcttcatcttcttgttctgaatcttacgaaagtccagaatctgattgaccagacgaagcatacggttggtattccgttcgaccactaccagctgttcccgtgcatcagccggcagtttatcgttcttcagaacttgttccaccggacctgcaatcaatgtcagaggagtacggagttcatgggatatattcgtaaagaagcgcagcttgatatcagaaatctgttgttctacagacacctcatgcttcaaccgataaatggtaaacaggatataaaccgcaacaaaaataatcagcagcacaaagcagacatacagcacatacgccaaaggcgtctcccagaaagaagggagaatcgtaatgttcaagatgcgctcattgtccacccacaccccgtcactattggtagaacggacacggaatatataatctcccttcggaaggttagtataagtcacgcttctttgccggtcggcaaaagtccactgcttctcgaaaccatcgagaatgtatgcgtactgtatgttctgcggattcgtataatcgagtgcagcatactgaacggaaaagatattctcatcatgagaaagcaccagttcctgtgtatcatccaaatcgactttcaatatggacttctctcccggaattacatcttcattcgctaccatcaacttagaaaaaactacaggaggcacatagctactcttccggatagaatccggagtgaacatgaataatccgttgctggttccaaacaacatatctccgccggatgtcagcgtagaagccgcttcactgaaacggacacggaaactgatactacgttcatcgtaattctcaaaacgctcgccggaaggaacaaacttacagattccattttccgtactgatccaaaggttctgtttatgatcttcacggatggaaagcaagacgtccgaagaaagtccgtcgagcactgagtaggatttaaattcaccgtgaccgttttcgctgatggaaatcagtttattcagtccccctccgaaagtagccagatagagttccttctgctgggtagcgataatccaatgcacgtcattattacttagactcttcgtatcgttcgggacacgcgagaagtggtggaactgtatatcttccggctttttgaaattctcatcaaaggcaacggcgcctgtggtagtacctacccaaaggcgtccgttattatccgaagtgataaaacgtgctttgtaacagacatcaatcggatatcctttcagattattccggtggttgataaagacggtctctccatgttctccctgggaaatatagttgataccgcctgcaaaagtagccgcccagatacgaccatgatgatcttcataaacacaatatacattgttgtcactcagactgtacatatcgttggagtcgtgctgataacgggtcagtttataagacatacttgtgggagaaatctgttcggcacgcaccagaccgtttcctttggtagcaatccagataatcccttttgaatcctgcataatgaaataggctgtaccctccataggtgtacctgtcatcgaaatggttccattacctgtcagatgccctatgaatttccggttcgagtcgtacaggcggatcattccgtccttcagtccgacccacaaattcccctgtttatcttcgcataccgaccgcacttcgttgctcaaagattcatattcatgcggaacgggagtcagcattgaaaacggtacgttgcggaatgttactttctccagtcctttggagtgggtacaaagccacaaattcccctgtttatcagaaaaagcggcatgtatcttgttagaaaagcgccagttgttactgcccaaatcatcataaaaaggaacgagacagttccggtcacgatcaaaataggagaatcctccgccataaggatgtacccatatatgcccgtgtacatcttcatggatatgaaaagcgggacgcgaacgatcggcgttactatattccacccgcatctgctcacgccttaccacgccggtggcaggattaaaatgaacgacaactcccggctcttcctgttcgaaccatacctctgacgtgcggtctacataagccgaaagaatcggttgtgcagacaattccttacaggtcacgggagaataatgcgtatgtttgtttgtcttcaggttgcaaagaaagaacccgtccgaatctgttgtcactacagtattgccattgctcacggtgtgtatagaagtaatgcgggctttcgtcggaagttcgagcaggcgaaactctccgccctgtttctgataacaccagattctccctctgtctgaagcaaagcagatatcgtcttcacattcccggaccgcataaaatgcctgattcatgccgtcttgtttccctttcgtctccacaaagtagttcacgggttgctgctcaccggggcgtatcattcccaaaccgttatcagtcagcagccagtgattgccggctttgtcctgatagacctgataaaagtgatcggcaggaaacagaccggacttcgttgaataaatatctgatttcgtcgtatagttcttctgaggaagcgtgactacacggatagctccatcatgttctgttagcagccagaccgtaccatcgggcaatacctgaatagcgtgaatgttatatgtactaccttcttcacctgctgccggaacctgttcgaacgtctccgttttcgggtcaaaacggtggacacggttgtcataagtcaataaccacagaaagccgtaccggtcttcatacatccggtcggcacggttattggtcagactgatgtaattgccctgacgtgctttataagttttaaagttatagccatcaaaacgattgattccatcccatgtggcaaaccagaggttgtctttgtgatcctgcaacatgctcatcaccgtgttttgagacaacccatcctcggtagaataatgggtgaaaaaactgtgttgttgtgcctgcactacaggtgcggtcaggcacaaaagaattagatataagattctttttatcattattacacacatattgaatggtgtaaagataatgatttagctgaacttacatctatattcggtgtttatttaacagaatcgttctttagcggattccagccgtcttcacctgccaaaaccgtttccatctcgtagcctttcagattcttcagttgacgagagaaagctgcgcgggctttcggattggctccctcgccatgactatcgtattcggcataaaatacggttttctccgcttctttctttccccagttgtgccagccttccggaaggatatgtttccccagttcacaacggataaatacagcctgtgcatacggacgccacggacgagacagatatactttggcaacatccggatcagcagtcaaccggcaatcataaaagacatatccatactttttgccttgatctgtagagggtgccgtcacataaccatcacgtttgctatgaatatgacaacgattgaatacagctacagaccatccgaagataaagtcaaccgttccttcgatatagcaatcctcgtaatattgacggctgtgcttgccatacgtataaagggtatcctgataaccgagaaaacgacaattcttaaagaacgcacggtcggcagatacaaaacaggcaacagcctgtcctaccggtcctgccgagttttcaaaagtgatgttctccgcatagaaatcgggagcataaatgtagcaactcgacgatcccgaagttcccatattctcaccaaacacatttttcttattggcaaagtcatcatttgtcagtaccacaccatcctctcctatcagagagatatttattttggattccggaataataatcttctctttataagtgcctttacggaccaagatagtagtacgcacattcttgcgaaaatcgggtactgcatttatcgcttcctgcactgtgaagaaatcacctgttccgtcttgtgccactacgtaatcataatgacggacatattttgccagttccggtatttcctttgcgatagcatctacagtcagcccggcgatagtccgtgctccgtacacattcaaatgggtattatcctcccggcctttcggaaaagccggaactttctcaggttcgacaaacataaacaacttcttcgattctgcggggcccagtccctgcaccagatcatgggtaattttgttcatatcgataaacgccactcccatctcttttgccacattacgcggagaatcaaggtaggcaccgtgcgtatcgtacaagacgtttacttctttcggcagttcctgttcacccggagcacgacgggcatctgtggcaatcgaggcatcttccggctgtacaaaattacgacgaacaatggagttgaacaacacaggaatccctcctttaacacgagtttcattgacgaaacgacggagattgtcatcaaaggtcgttcccggatcagtatggcgtgcagaatcagccttttcatcattgtgtccgaactggataaagacataatctcccttctttacctgggaaatcacttttgcccatcggccttcagatatgaaacttttggaactgcggccattggcggcatgattatcaacacgtatatcttctgaaaaaaatccggggagcaccatacaccagccgcgttcgggatttccaccgtacagatttttgttagccatcgtagagtcacctatcgtaaagatggtcaatacgggcttatccgcacgaaaggcggagaaaaggataaatactataaacagcaatagcagtctgtttttcataatcttattttgttggttcaaaattaaagttcccttatgacttctatttaacgtgaattcgatataaatttgagtaactcaattctcctccttccaaaaggaggggaaaccatgcggattactcttatatcgaactgatgttatttataaggataccaattactgcattccttaaatatattctgcggagtatattgcaccgcttctttatcagtcagctgtttagcccatttcacacgtccggaagcatccgcaccttcacccgtgtttttaaattcagcgtaacgggcagtcttttcgttttccggattcttccagttgtgccagccttccgaacggatatgtccgccaaactcgcaattaataaaagccgtagcagcataaggtctccaaggacgtcccagatagactttcttgataccgggagcggctgtcagcttacagttcttgaaaacataaccaaactccacctccttcggagtagaagccgcggtaatatatgaatcgcgtttgctatgcaattcgcaatattcaaacaaagctgtagaagggccgaagatgaagtctgtagttccttcaatatagcagttagtaaataacaggcggctaccctccgatcctgtataaatagtatcctgatttcccagaaaacgacagccgacaaacatcagcctgtctccttcggtatggagcgcaactgcctgccccaaaggagcggcattgttctcaatggtcagattcttaaaagtaatgtcacttccttctacctttacagtataagtgcggaaagtgcccattttattgatattggcatgatcatcatacgtgatgatcgtcttttcggcatcttcacctaccagctgcacgttcttcacccatgaaggaatcaccagtttttctttgtatataccattctttataaatatagtcaccgtataatccataaaagcacgtaccgcttccacggcttcctgaatatcccgatattttcccgttccgtctcgtgacacgactattgtgtcttgcttttgctgttgtgcacaggccaaagttcctcctgaacaaagcagaagaaacaacgccattcctttcaaaatactccttttcatcgatagaatttacttttgcaaacgttcgtattccagacttgccataataaatggtcctactgctttcgggtcgttattacggattgtttcatttatataatagtcataatcgccggaacgataaaccttccctcccagccctgctaccgcacaggctttcgttatagtcaccactccatctttatccacttcaatgaaatttttcagaaaaccttcataaccagcctttgctacatccagataagacggatcgatatatcccatacgtactgccttaaacaggctgtatatgaacattgccgaacaggatgattccagataattacccttgtcaccgcttctgtccatcacctgataccatccaccggtctccgggtcttgcagtttctttacctgaactgctacattatccaagattgcaagcaacgaatctcttccggcctcatgcttcggaataaaatcaagcacatctaccaacgccatcgcataccagcctaatgcacgtccccaacaatgttttgactgtcctgtcaccggatcggcccagcgctccgtgcgacttacatcacacgcatgacgataaagaccattcttcggatcatacgtatgacgggcacaggtaataaactgatttatgacgtctgcataatcctgcgggcgattattacggaaagcatattctgcataaaaaggagctcccatataaagtccgtccagccacatctgatgcggatatatctttttatgccagaatcctccgtcttcattacgaggttgtccggcaaactggctatagagcaagtctaatgccttcttatacttttcatccttggtctgctcatagatacgaaacaggatttttccggaattgatacggtccagactgtaatcggtcaatttgtatgcagtaatacttccatcctcatgcaccatcgtatctgcataagcaattgcataatctcgtattttcttgtcgccataagtatcgtatacatcaagcatcgcccccaattccagtccgtggcaatagtcccatttcagtctgggctgaaaatcaagctgccaggattccgggcaacggatcatctccgattcagtcatccgcaccgaccaaggcagtttttcatccacctgctgcgccgacagtgaaatggtgcttgacattattattactaatatcaaaaatttataaaaagagcttcgtctcatggtttattgttttaaggattatacatgctattttttcatgctacgaaagtagtgtatttcctccaaacagagtgggattttttagttaagaaggtgtattttttgtttttcgtgcacggaaacgactaattttgtgcacgtaaacgtcaaaaatgtccatttttgatgcattaactgataaattaagagtttcgttttggaataaagcggaaaaggtcgtacttttggcacggtttacaactaataccctctggggaaacacagtaatttatcattaaaaacagagaaaaaaatagaacagaatggaagaagtattcaagtacattatcggtctgggagcggcagtaatgatgccgatcattttcacaattttaggagtatgtatcggtattaaactccccaaagcgctcaaaagcggtttgttggtgggagtcggtttcgtcggcttatctgtagtcacagccttgttgaccagtagtcttggtccggcattaagtaaaatggtagaaatctacggattggaactcggtattttcgacatgggatggccttcggcagcagcagttgcctataatacctcggtcggcgctttcattatccctgtttgtctgggagtaaacctgttaatgctactgaccaaaacaacccgtactgttaatattgacctttggaactactggcacttcgcatttatcggggctatcgtatacttcgcctccgatagtattttctggggatttttcgccgctatcatttgctacattataacattggtaatggcagacatgactgctcctgcttttcagaagttctatgataagatggacggtatctctatcccgcagcctttctgccagagcttcgttccgttcgcgattgtaatcaacaagcttttagataaaattccgggattcgacaaactgaatatcgactctgaaggaatgaagaagaaattcggtctgatgggtgaaccgttattcctgggtatcgtgattggttgcggtatcggagctttgggctgtgccagctggaaagaagtactggacggcattccgggtatccttggattgggtatcaaaatgggagcggttatggagttgattccacgtatcaccagccttttcattgaaggtttgaaacctatctctgatgcaacccgcgaattgatcgctaaaaaatataagagtaatacaggcctgagcatcggtatgagccctgcacttgtcatcggccacccgacaacgctggttgtatccctgcttttgatcccggttactatcttccttgcagtgatccttccgggtaaccgtttcttaccgctggcttctctggctggtatgttctacctattcccgatgattctgcctatcaccaaaggtaatgtggtgaaatcattcatcatcggactggtagcattgatcgtaggtctgtacttcgtaacagaactggcaggattcttcacgatggctgccaaagacgtatatgccgctacgggtgacccgacagtaaatatccccgccggcttcgaaggcggagcgctcgactttgcatccagcctcttctgctggggtatcttccacctgacttacagtctgaagattatcggtcctgccatcctcgtagcccttgcactgggaatggcagtctacaaccgtatccgcatgaaaagaaatgatgcgaaaaacgcagctaacgattaaatataagtataatccaaataaagattcgaaagatgaaaaaattagcaattgcaatgatgatgggtatcgcagctatgtctgcttctgcccaggtaaattacaagatgcaggtggcttgcaatccgcaagacgtgaaaacgtataatacaaaccgcctgcgtagtagcttcctgatggaaaaagtaatggttcctgatcaaatcaacgtgacttattccatgtacgaccgcctcatcttcggtggtgccgtacctgcaacaaaagagctggtacttgaaactatcgatccgttgaaagctaagtatttcctcgaacgtcgcgaactgggtgttatcaacattggcggcgaaggtatcgtaactgttgacggcaaggaatatacgctgaacttcaaagatgcattgtatgtaggcagaggcaagcagaaagttactttcaagagcaaagatgccagcaaacctgcaaaattctatatcaactccgctactgcccacaaggagtacaaaactcagttgatcaccatcgacggacgcaaaggttctctgaaagcaaattctttcgcggcaggaaagatggaagaaagcaacgaccgcgttatcaaccagctgattgttaacaacgtacttgaagaaggtccttgccaactgcaaatgggattgacagaactgaaaccgggtagtgtatggaacaccatgccggcacatactcacagtcgccgtgtggaagcatatttctacttcaacgtgccggaaggcaactccatctgccacttcatgggcgaacctcaggaagaacgcatcgtatggatgcagaacgaacaagctatcatgtcaccggaatggtctatccacgcagctgccggaaccagcaactatatgttcatctggggtatggctggtgaaaatcttgactatggcgacatggataagattaaatatacagaaatgcgctaatctttgcgcagctctttagcacatatcaagtgatccgaaaaacttcattctttcctcgaaacggggagagaatgaagttttccggatttgtcatattcttcccccaaagagaccaaattgttacgataatacattactatgtacaaataatatgtataatgcaacgaattatacatgattttgaccaattattacaaaaaaaatccagctgaaataccgacctttgtcagcaaatcaaaatctatttaaatccattatcatgaatgcatttcaaaaaacaggcgaaaaaatgacaaactacagatggacgatctgtgcgatgctattttttgctactacagttaactatctcgaccgccaggtactatcgctcacctgggatgaatttatcaaaccggaatttcactgggatgaatcacactacggtactatcacttccgtattctctattgtttacgcaatatgtatgctctttgccggtcgctttgtggactggatgggaacgaagaaaggattcctctgggctatcggcgtatggtctgccggtgcctgtctgcacgcagtctgtggtattgtaacagaagcgcaggtaggactgcacagtgctgccgaacttgccggagccaccggagacgtggtggtaaccatcgctactgtcagtatgtactgcttcctggctgcacgctgtatacttgctctcggagaagccggtaacttccccgccgctattaaagtaactgccgagtacttcccgaagaaagaccgtgcttatgctacttccatcttcaacgccggtgcttctatcggtgccttgatcgctccgctcaccattcctatccttgccaaagctttcggttgggaaatggcgtttatcgttattggtggacttggttttatctggatgggcttctgggtatttatgtatgatgctccttcaaagagcaagcacgtaaacaaagccgaacttgaatatatcgaacaagaccagaatgaggccggtgcaggtccgaaaacagaggagaaagacgagaaaaagatgagattctggcaatgtttcagctacaaacaaacttgggcatttgtcttcggtaaatttaccactgacggtgtatggtggttcttcctgttctggaccccgtcttacctgaactcccaattcggtatcaaaacttccgatcctctgggaatgggacttatcttcacactttacgcaatcacgatgttatccatctacggtggcaagcttcctactatcttcatcaacaagaccggcatgaacccttatgcggcacgtatgaaagcaatgttgattttcgcattcttcccgttagtggtattgctggcacagccattgggaacattctctccgtggttccccgtgatcctgatcggtatcggcggagctgcccaccagtcatggtcggctaatatcttctctacagtaggtgatatgttcccccgaacagcaattgcaagtatcaccggtatcggtggtatggccggtggtatcggttcaatgattcttcagaaagtggcaggtaacttatttgtatatgcttccggaacaacaatggttgacggcaaagaagtggaaatgacaaaagaactactggaacaaggagcacagtttgtacatcctgcgatgacattcatgggcttcgaaggaaaaccggccggttactttgtaatcttctgtgtatgcgcagtggcttacctgatcggttgggttattatgaaagcactggttcctaaatataagcctatcgtattggattaatccgatataattatatagaataaaaaacaggagggcactcagcatgagtttgtcctcctgtttttttaaccaattatttattcaaaaagttccaaaaacaaaaaagcctcttctcacgaagaaggctttttaggtttacttattcttcatagccatcctgtactattttacaaaatatcttgcacattcaaacaatgaaggatagtaaacgttaagatgaaaaaaagggaagtctcacgacttccacaattcttctaaccttaaatctaaatctctatgaaaaaaacgtattgcaaagataggggtttgttcaacaaataggtgttaatgaattgcataaagagagaataaaaactaacgtctgcaaaaattatgcaatattccggaggctctctattaattttaataaacttttatagagtggattacgctccaacagcgtcggcacacctgtcagcagcatctgttttcttgcacgtgtcaaggcaacgttcagtttccggtcaatcagaattccgtcttcttctgtcagattggaaaggaatttcaactgatacggatagttcacacagaatgaataaataatcacatcgcgttcacttccctgaaaacgttctacagtgtcaatcaatatctgattcagttcggaaatgccgagaacttctatttccttcttgatcaaagctatctgactacgatatggagtaatgatccccaatgtgcgggaggcatcaaatgcttccgagtgttctttatagacagttgcggccagacgggcagcaatctttgcttccgaatggtttgttttagcagaagaacccatcggttcgggccgcgaaggatagaaagacagccggttgatatttccggaatcttccagttgatgcggcagtccgacaggcagcagccgaccttcatagaaagcttgattggcgaacagagccacttcggggtgcatacgtccctgacggcagagcatatcgtaagtacgatgggcatcggtatgctgacgggctgtgcgatacagtctttcaaacagagaatctttcaaattcttcagtccgacagcagacagggcttcatcgtatacttccgattgttccgtattctgcaagacgacagccggaagttgcttatgatcgcctatcaggataaatttgccaacgccctcttttccgttttctcctttggcacaaagtatgcccagcaactgaggttccagtatctgagtagcctcatctacaatagccacatcgaaatgcttcaatcggaaaagttccggtttgccggagatagacgctactgtaccgactaatatacgacagcggttaatacgttcgcaaacctctgtacgacgcatacaggtagcaagttcattctctatcaaatgatcccgatagttctcgtcacatgaaagctcgcttcccacacgaatgaaatcgacttccggacgaatggaagaaagtgctttacagatttcatctacggcacggttagtgtacgagagcaataaaatttgggctccttcctctttataaaaggtttcgaccatcttcttcagtgcacaagacgttttaccggttcccggaggccctaccagcagaaaatagtcctttgctgctttcgctttcaaagcaatacgagtaaagtcatcggcagcttcggctatctgcttatccaatgccacatcaaattgcggctcccgttgagagagcagcaaatcacgacgctcttttgtagcagacataaaagcataaagtccctggtacatgctacggaaagtagtatccatcgcatcgtgctcaatagcatagaggctatcagacggaagtacggaagagttctgctgggtcgcacgcagacggatacagatttcattctcgttcagatagtcgatattgcctttgaataccatcttgttggtgacgttatccgtatccgcattccgttcgtaaagcacgatggcatcgccctgacggaagttagggagggtgtgctgcgcatcatccgccaccgttctctgaagttctccggacggtaccagcaacaggtgggatttatgttcgtcggctgcgtgattctctttaattcttaaatcatagatgatctcccccgattcgcatttctccgccaaagtggaaagccataaagaagcggctcctgtacgtccctcataatccacatcaccggacttggacgtataaagttccttcgttataaaattatagagtgcatagaagtagcttttctctaaagtggagagagatttcaacttctcctggaaattatcgatagaagggcgcagatacgtctcccaaaaacgtcccgacaatccccgctcgtttagtaccgaggcttttatttcttccagtttttgtgccgtatattccaggctgttccgcaactggatgccatattcatccgctacaatccggttgcgcagatcgatcacacggcggaccattgcccatgaaggacgggaaggataaagcaacggatagcgtgtatagagcagataagcctttaccttccggtgatccatccccatcgaatattgcagaactgcctgataaagcagcatctgcaccttattattctctttcggttccacttttccgcgaatcgcatattcgtcagcctttcccgatttcatttcgatgaaagaagacatatcgcgctgcatatagtcgagccgcccttgcaggccgagcgcttcacatatataagaaggttcgagcacggcatccgtcttgtccagttcgtagccggcggcatgaaaagtatcattcaccgtctcacggatatgatcaaaatggagtttgcagtcatcaaagaactgacgttccttctcccgatcacgcaggtcggcacaagcagccagttcaatcggataacgccggaaagctttctgcatacatttcagataatccacctccccttccgcatgtatccactcatcgaggaaaaggttggctatatttcctaaaagcaacgggcgtgcattctctatcggctgaagacgggaaaggaaatagtttgccggatgatgtccataatcacggtaacattctgccaatgaactgatatcaagcagataatccggttcaaggacaatgaacgaaggggtcagaattcctgcttcgtcaacagcgacatccagcaagttgagttgtgcatggcgccagagcaactgacaggtttccgcaaattcttcattgatctgaggaatattgtaacggacacgcaacggttcgtcagctatttcatccaaaggagtcacatacagatactgctcgtcggaatactggaaacagacgcgcatccgctgcacctgcttgtgtgctggaggagctacgatataagttgcatccgtccggggaagcaaacgatacagttcctgtggaatatcttcctcaaaaagtttacggatgaagaaagccagcgttttcgcatcccgcagaaggtgttcgcgggtaggttcctgttgtcggttcagaatggcattggaggtcagtcggaaggtatgcagtctgttttgctccgctacagaaagccccactttggccgctacaaaactaattcgtgcggaaagatcggtcatctgcagactaccgttgtgcatatgtaggcggcaaagcctttccagcaagtcgcgcatctgtttgtagccaatagtcagctgcaaatgatccgccttacaaacggctaaaagaatttcataagattctcttccttcattttccatacgacaaaagggatatgataaaaattacatgtgtgtgtcaaaagtcagcctcaattgagttactatcgacttttgacacacacttggggaaacgaacgataaataattggcttatcagacttttgccacgccttcttcttcctcttcttcttccaactcaggaacttccttcttatcctttatcatcagaatactcatttcatagagcagataaagcggaatagccacaacactcagtgtgaacgggtcgcccgtcggagtgatgatagcggcagctattacgataatgacaactgcatgacggcgatatttgcgcaggaaagacttattgacgactcccagcaaagacaacaaccaagtcaccagcggaagttcaaaagccagtcccatacagagaatcagcatcataaagttatcgatatacgaattgagcgacagaatgttctcgacttccgaactcagctgataggtagagaggaaacggagtgtcagcggatataccataaagtatcccataagcaccccgataaagaacataccggttcctatggtcaaggctttcctgactcctttccgctcattcggataaagggccggattgataaaacgccagacctcaaagaaaatatagggcatagccgtcactaccgacatccagaaagctgtcgacatatgtataaagaaaggagctgccaaattgatattgacaagcttcaccttaaactcctgcgtaaaaaattcatcagtcaaatcgaatttctgaccgataaagcgtagtaagtcgtaaaatacaaaatcattatggcaaggcgccagtattacatggtcgaacaaataaggcatcgctacgaaatagccgattgccaatacaaaccagactccgataacacgaaaaagtacccgacgcaactcatccaaatgatcccagaaggtcatttctgccattgcttattatttcttagctgaatctgccggtgcgtcgatttcgtcttttgccttattgatttcttcttttgcctcgttcacaccatctttaaagctctttactcctttacctaagccacgcatcagttcgggtatcttcttaccaccgaaaaggagaagaataacaagagcaataatgatccattcagagccactaggcaaaaagcctaataataataagtttgtcatatgtttattaattatagaggtttattagttggtgcaaatataaagaaaaacggcagactataaaagaaaaacaggaaactataaacgggaaacgggaaataatttaagtatacccgttatcatttaccgcccatttatccatcgttaacctttatagtcttccattcactattctactacatataattctgtttttaccgcctgcgctttagtcctgatagtagactcgcttcacacggttcgagatgctggtcagcacttcgtaagggatcgtccccaacttatccgaaagtgtggttatcggcaggtcgtcaccgaagatgacagctttgtccccttccctgcaatcgatatccgtcacgtcaatcatacagacatccatacagatatttcctacatagggagctttcttgccattcaccagacagtaagcattgccacgtcccagatggcggttcaagccatcggcatacccgataggaattgccgcaatgcgggaaggacgcgtcagatgtcccatccggctatagcctaccgtatcttctccgggcacgtcccgaatctgaagaatcgtagtcttaagcgtgcttacattattgataatcgaattgtcgatcgggcttaccccatagagtcctatccccagacgcaccatatcaaactgcgcaccgggaaaacgttcgataccggctgtattgcagatatgacgcagaatcttgtgtgagaaagcttcctgcaattcctgcgaacctttctcgaacagttcaatctgctgacgggtgaagaagtcgaattgcgccgaatcacttcccacaaaatgagagaataccgaccggggaataaccgcattctgacttttcagacgacggatcaacaacggaatttcatcgacggaaaaaccaagacggtgcatacccgtatccagtttgacatgaatcgggaagttggtgattccttctttctcggccgccttaatcagtgcatcgagcaaatggaagttgtacacttccggttcgagtttataatcgaacatcgttttgaacgatgtcagttcggggtccatgatgataatggaggaggtgatgcctgctttacgcagttcggagccttcgtcggcaacggctacagcaaggtaatctacatgatgctcctgcaatgttttggcaatctcgtatgatccggctccgtaggcagcagccttcaccatacagatcattttcgtctccggatggcggagcatggagcgatagtgattcagattggcaaccatcgcacccaagttcacttccagaatcgtttcatgcactttcagttccagctcttccgataccagatcaaagttgaatacgcgggaaccttttatcagaatgacttccgaatgaagggttttaaaaatgcccgatcttagcaaggcgtctgtatcggggaagaagtatcgttccggtgtaccttcgaagcgagcggcacacgaagaaatctccgctcctacaccgatcagcttgttgatgccccggctctttatcagttgtgctacccgacggtaaagcgtagccgtactctgccctgtctccaaaatatccgataagataagtgtccgtttcagtcctttcttttccgaacggcgtaccaggaaatccagtgctatatccagagaagccaagtccgaattgtagctatcgttgatgagtatacaattattcttgccttcttttacttccaggcgcatggcgatcggttcgagccgtgccatccgttcggtaatctgatcggcaggagtcatcagataaagacaggctgccaggcagttcaacgcattttcgatggaagcatcgtctataaaaggaatacagaagatattatccatatccagatagcggtaagcaatcacagtatggtcttctttctttgtcaccttgctgatataaagagggcgctcgatatccttgcagctccatgcaatctcacgggctgtcagcatcgactttgccacacaattactgatcagctcgttatctccattatagatcaccacatcgcaatctttaaagagtgtcagcttctccatacatttctcctgcaatgagaagaaattctcctgatgggcaccgcctatattagtcagaataccgatagtcggtttaatcatgcgcttcaaggcccccatctcccccatttcggagataccggcttcgaaaatacccaattcggcttcttcattcagttgccagacggacaagggaacgccgatctgagaattataactgcggggcgaacggacaatgcagcggtccggactcaataattgatgcaaccactctttcacaatggtctttccattactgcccgtgataccgattaccggaatcttgaaattctcccgatgagcctcggccagcttctgcaaagccttcaaaggattcgccacgatcaagaaattggagaaatcgagaatggagagtcgagagttgggagtaggctgcgcaccatcctgctgcatagcattctccattttccattctccattctccattctcttaaagtcttcttccgtaaccacgaagttgcgcactccccgatcatatagttcggagatatagcgtgcaccattattacgtttggtgggcaaagcaaagaaaagggtttcttccggaaagctcaaagagcggctatctgtaagtagccaatcaatcgtcgcttcatgctctccgacacggcgtgcaccgatatattcggctatggattcaatcgtatatgacatagttctgtttctttttgaaagtctaagtacggatattttccgttaagtcgttcgatttttaacactatttgtcctaaaaagcgttgatacgcttccgactccggatgaaaaggcttgtgtgacaagtctttagtaatatcttcgatggcagtgatcacctgcttcgtttcggcagaaaagaaggcctccgaaaagcgttcccacaaataacggacagccaacggagacggatgaagcatgtcatcggcataatagcgataatcacgcagttcatccaaaacgatctcataagaaggaaagtagaacacatgatccggaaagagctgttgcaggcggtcgatggcaagcaataaggtcgatttactcaactggttggcatgcatcccgtcacgtatatgccggatagggctgaccgtgaacaagaccttcaagtgagaattgcgcgccaccatactggttatcaacgaagtatattcgttcacaatctcatctaccgaaagaatccggcggttgaagcagctctccggcagtttatgacaattggagactacctgccttgtttctttctgttcatatacataggcagtgccgaaagtcagcatcagccagtcaagttcgtggaccgaacggtgagcctgcgacaagcgagtgtttatcttttcaagtacttcctccggcgatgacgcagagaacaaaccatgatgcatcggactatgccagcactccttatataggaataagtctttctcctgatacaccttccccttcaatatctccaccaaagccgtagagaccgacagcggattatagagaatcccgaaaggattcatgtcaacgcgaaatttattttctgccagcaacctgcccatgttctctgcaaaacaagaccccatcaaaagaatccgttccgcatgactgacaggcggcaagcccgccggtagttctacctttgtttgaaaatccatatattctccttctttcgattgtttctctcttgcaaaagtacgacaaagatacgatattccgctttattttaatcacaaatctattcaaggcttgacaaatggctttttatgttgtatatttgtagaccgaaaacagaaaatcaatgaataacggatataaaagaatagaaaacatggataaaatacagtatcatattacaacaaatacagcttattccttctcattttactaaggaataagacgattgatatagcccaaaggctgcaagctctatgaagtttgcagccttttttgttgcattaattcaatctatttcctacaaaatctcattttagagtttctaataaacggaagacacgtctataataaacgatcatcaaatttattaataacgatacgaacgtttctgcaagttcatgttctcttttttcatgcaacttttatttccctaatagagatttcatttgattagtaatattaatccacatttcacataataaaaagaaagttacagttcttccgggaacccgacggcacatacttcaatataccaacgaccgaatgccattccaccctcgtacttcgctttaacaataagaatttaggtaaaaagaaagggcttccgctttctttttcgtatttttgcaccaaattttctcgaatcatgaagaatgaaccgatatataacttgctaaactcaatcaacagccccgatgatctgcgccgtctggaagtagaccaactgccggaagtatgcgatgaattaaggcaagacattattaaagaactctcctgcaatccggggcacttcgctgccagcctcggaacagtggaactgaccgtagccctgcactacgtctacaatacaccttatgaccgtattgtatgggacgtgggacatcaggcgtacggccacaaaatcctcacaggacggcgtgaagcattctccaccaaccggaaactgggaggtattcgccccttcccttctcccgaagagagcgaatacgatacatttacctgcggacacgcttccaattcgatctccgcagccctcggcatggctgtcgccgccgccaagaagggagacgaccaacgtcatgtgatagccatcatcggagacggttcgatgagcggaggactggcttttgaaggattgaacaattcttctaccaccccgaacaacctgcttattatcctgaatgataacgacatggctatcgaccgcagtgtcggcggtatgaaacaatacctgttcaacctgacaacctcaaaccgctacaaccaactgcgtttcaaggcttcccgcctgttgttcaagctcggcatcctgaacgatgaacgtcgcaaggcactgatccgcttcggcaacagtctgaagtcaatggccgcccagcaacagaatatattcgaaggaatgaacatccgctacttcggtcctatcgatggccatgacataaagaacctttcaagggtattgcgtgacattaaagacctcaaaggtcccaaaatactgcatctccacacgatcaaaggaaaaggcttcgcccctgccgagaaacacgccaccgaatggcacgctcccggcaagttcgatcccgtcaccggagagcgtttcgtagccaatacggaaggaatgcctcccctgttccaagacgttttcggaaatacactggtggaactggcggaagccaatccaaggatcgtaggtgtgactcccgccatgccttccggctgttcgatgaacatcctcatgtccaaaatgcccaagcgggctttcgatgtgggtattgccgaaggccacgccgtcaccttctccggaggaatggcaaaagatggcttgcagcctttctgcaacatctattcatcgttcatgcaacgggcttatgacaatattatccatgatgtggctattcagaatcttcccgtagttctctgtctcgaccgtgccggactggtaggcgaagacggtccgacacatcacggtgcgttcgacatggcttatctgcgtccgatacctaatctgaccatcgcctcccctatgaatgagcatgagctgcgacgactgatgtacacggcacaactgccggataaaggtccgttcgtactccgctatccgcgtggccgtggcgtattggtggactggaaatgcccgcttgaagaaattcctgtaggcaaaggacggaaattgaaggacggaaaagatatagctgtcatcagcataggacctatcggaaataaagcaaggagtgccatcgcccgtgccgagtccgaatcgggaagaagcatcgcccactatgatctgagattcctcaaaccgctggacgaagaactgctgcacgaagtgggccgcacattccgccacatcgtcaccatagaagacggaacgattcagggaggaatgggaagtgccgtacttgaattcatggccgaccatgaatataccccgacagtcaaacgcatcggaattccggataaattcgtgcaacacggcacggtagccgagttatatcagctctgcggaatggatgaagacagcctgacaaaagaattgctgaagcaatgtgaacttctgcccgacatgagcaaaataaaagaattaactaactgaagatgaagataattatcgcaggtgccggaaacgtaggcacccacctggctaaattattgtcccgggaaaaacaggacattatcctgatggacgatgacgaagaaaaactaagtgccctcagcgccaacttcgatttgttgactgtcacggcttctccttcttccatctcgggactgaaagaggtaggcgtgaaagaagcggacttgttcatcgcagtcacccccgacgaaagcaggaatatgactgcctgtatgctagccaccaatctgggtgccaaaaagactgtcgcccgcatcgacaactacgaatatcttctgcccaaaaacaaggaattcttccggaaactgggtgtagactcattgatctatccggaaatgcttgctgccaaagaaatcgtatcttccatgcgtatgagctgggtacgtcaatggtgggaattctgcggaggcgccttgatactgatcggtaccaagatgcgcgaaaaagcggaaatactgaatattcccctccatcaactgggtgcaccggacatcccttaccacgtggtagccatcaaacgcggaacggaaaccatcattccgcgcggagacgatgttatcaaactgcacgatattgtttatttcaccactacacgcaaatatattccttatatccggaaaatagccggcaaggaggattatgccgatgtacgcaacgtcatgatcatgggcggaagccgtatcgccgtccgtaccgctcagtacgtgccggattatatgcaggtaaaaattgtagataacgacatcaaccgttgcaaccggctgactgaattattggacgacaaaaccatgatcatcaacggcgatggtcgtgatatggacctgctcatcgaagaaggtttaaagaataccgaagcatttgtcgccttgacggacaattcggaaacgaacatcctcgcctgtctcgccgccaaacgtatgggagtggaaaagacggtggcggaagtagagaatatcgactatatcggcatggcggaaagtcttgatatcggcacggtcatcaataagaaaatgattgccgccagccacatttatcagatgatgctggatgccgatgtatccaatgtcaaatgcctgacgtttgccaacgccgatgtggctgagtttaccgtacccgccggagcaaagattactaaaaatttaatcaaggatctgggattgcccaaaggaacaaccatcggaggtatgattcgcaatggcgaaggagtgctcgtaaccggagatacgctgattcgtcctggagaccatgtcgttgtattctgcctgagtatgatgatcaagaagattgagaagttctttaattaagtaataggtattaagtaataagtattaggtaataggtaataac

SEQ ID NO: 100 - DNA, 28227 bp, Bacteroides thetaiotaomicron
gaataatattctgtatgtatttttatccagttatccaaacagccgtctccttcgttgacagcaaattcttctgttatatcttgaaaatctacaatctctattctttcaattttcacaatacatttttctttgccctgtgagtctagtatagaagcgcattcattgactttaatttcttcttgattcataagagaataatcatataaagaagaagttgctgttttttctcctgataagaccttgtctgccaattcgtctgtatcgcatccgaactgtattctatgttttatttccatcatgcttagatagataatatcttttccccgtttttcagatattcggttagcgggattcccatatatctaacagttatacctagatttgtgatgatagaggctaccccgaaattctcacagcaatcttggcatgcctcaatcgtaattcctgattgtaacatctctaatatttcagtctgtacttgcgtatcgttggctactaatttcacagatgctccccaaagaataatatttatatgtttccaccaacctctgtttttagagtttaaggcatacattgccaacatattaaaaacggtatctttgttgtcagtcgtccaaagaatggttaatttgtcatttgcgctcataatctgttatcttttgatgattctttattttctatagacatattgtgtcactatgctatgaaacaaaagtaatgaataaaaattgaatgtcgtttattactattcttttaataacacatattaagtcagataatttgcaccttttgtttcatacgagtatctttgccttactgttctgttaaaacgataggggagaatgtatcacaagagaaaaataagagcatacatagcatggatgttattcatgacattcattcccttctttgtagtgaaaacctttcactatcatggaagtgaagatgaaacgtcatgctctcatgccgaccattcccggagtcatgccgaggattgtgcgatatgtaaatactccctttctctctttacagaacctcagccggtagaatttcattgtatattgacgctcgttccttacgagacgattacttaccaggataaggttgtctgcaaacgaacttattcgcatcacctacgcgcgcctcctgccgcataattacatattcatattttctaggaagacaggttcattgtaacttgtcctcacattcattttacacattatataaaagattgtaattgatgcgtatcggaattatttcgggcgtaatagggttgtttgtaaccttacccgtccacgcacagaagtccgattcaatcaagagtatgcttttgcctgatgttgttgtgaccgagtcgtaccaacagcgtcaagccaagaagtctgcacttacggttgaagtgatagaacaggattttctgcgcaaacattttacgggaaacttcatgcaggcagtggagaacattcccggagtacaagctatggacataggctccggcttctccaaaccgatgattcgggggatgggattcaaccggatagccgtattggaaaacggaatcaagcaggaaggccagcaatggggagccgaccacggactggaactggatgccttcaatatcgaagcagtcaatgtcttgaaaggtccttcctcactgctttacggcagtgatgccatgggtggagtgattgatatagcctctcctcccataccttctgcgaatatgctcttcggcgatgtcaccctattgggcaaatccgtcaacggaacactggcaggttcgctgatgctgggacttaaaaagaatgcctggtatgcgcaaatccgttattccgaacagcacttcggtgattaccgcatccctacggataccattgtctacctgactcagaaaatgcccgtctatgggcgtaaactgaaaaatacggcaggagtggaacgcaatatcggccttttcacccaatatcagcgaaaaggctatagagcagactattccatcagtaatgtctatcagaagacggggttctttccgggcgcacacggtgtccccgacgcatcgcgcgtagaagatgacggagacagccggaatatcgaactgccttacagcaaggtaaatcatctgaaagtaaccacacatcagcaatatgcttgggagaaactgatcctgtccggtgatttgggatttcagaataaccatcgggaggaatggagtgcttttcatactcattacggctcccagcctgcgccggagaaggacccggacaaagaactggctttcgatctgaacacatacagtgcttcggtaaaagcccgctttattggctcttcttcatgggagcatacgttggggtgggataggcaacatcagcagaacgacatttccggctattcatttttgttgccggagtaccatcgttctagtaccggattgctctggcttacgacgtataagcctaataacattctctctgtcagtggaggcgtgcgatatgattatggttatattggcatctctccgcacgaggatgtttatctggcggattaccttcggaggcaaggatatgatgatgaacaagtagagtcctataaatggaacagtcatgccgtccgaaagcatttcggtgactattccttttctttgggactggtatggacaccctccgttcagcacatggtgaaagtgaacatcggacgtagcttccgcctccccggagccaatgaactggctgctaacggtgtacatcacggcactttccgtcacgagcagggagatgcttctctgaaatccgagcaaggatggcagatggatgcttcctacaacctgcgatatcacggactttccgtttccgtgtctccttttgtcagttggttcagtaactacatctttctgcgtcccacaggcgaatggtcagttctgccgcatgccggacagatttaccgctacacgggagccgaagcactgtttgccggaacggaggctacgatagacattaactttctgcgtcacttcaattaccgtatctccggagaatacgtctacacctacaactgtgacgagcatattccgttaagtttttctccgccgttcggtatgcggaatacgttgacatggcaaagaaaacactatatgctttatgcggagtggcaacttattgcccgtcagaaccgtgtagaccgtaatgaggaccgtacaccgggggctaacctgtttcatttgggtggctcgctgaatattccggttggcaggactaacgagatagaaataaccctgaccgcccgtaatatcttcaataccagatattacaatcatcttagtttttacaggaaagtagaaattccggaaccgggacgaaacttccaattattaatcaaaattccatttaaaaaattactgtaatgaaaacaaaactttacctcccgatcatcagccttctggcaatgtctgtatttgcatttatttcttgtgacgattcggatagcgataccaccaaaccggtgattgaactaagtgaaccggaagaagggcaagaactgaaaattggcgacgagcacggagtacattttgaaatggatctgtcggacgacgtcatgttaaagtcatatatgattgaaatacatagtaatttcgaccaccattcgcatggaaagagcagggctgctgctacgggcgaagccactgtcgatttcagtttcaacaggtcttatgatatctccggaaggaaaacggcgcatatccatcaccacgatattgtaattccggccaatgctactccgggcgattatcatctgatggtttattgcacggatgccgcaggaaacgaaacctacattgcgcgcaatattgtactgagcactaccgccgaaagggacgatcatcatcacgatgaataaataaaatagccagcctgccatgcaaaacgggggcgggatggagtatcttttttctcttattaatcagtgttcgtataattttctttaaaaggtgtaatagttattacaccttttgtgtttccaaagctttacttttgtgaaaaatactttttcactatgatgaagttaccatttataaaccgaatttttccttcgtacagatcgaagataatagccattatcattggcggtattattgtaggcggaggagctttatttatgtacatgcttcgggcacatacgtatctgggcgatgatccggcagcgtgtgtgaattgtcacatcatgtctccttattatgccacatggtttcacagttcacatgcacgggatgccacctgtaacgattgtcatgttcctcacgagaacattgtaaagaaatggacattcaaaggaatggatggtatgaagcacgtcgcagctttccttaccaaaagtgagccacaagtgatacaggcccacgaggccagttcgcaggtgattatgaacaattgtattcgttgccatacacaactgaatacggagtttgtaaaaacaggaaagatagattatatgatgtctatggtaggagaaggaaaggcttgctgggactgtcatcgggatgtacctcatggtggtaagaattcgttgtccgctactccggcagctatcgtccctcttcccgaatcgcctgtaccggaatggctccggaagatggttaataataaggaataagcatatacataactacgtaataaaataataaaaccgatatacaatggaaaagaaattaaaatcatggcaaggatggctgttgtccggaggttcaatggtcgttgtttttgttttaggattatgtgtttctgcgttgatggagaggagggcggaagtcgccagtatctttaataaccgcaaaactgtcattaaaggtattgaagcacgcaacgaactgtttaaagatgattttccccgcgaatatcagacttggacggaaacggcaaagactgattttgaaagcgagtttaatggcaatgtcgctgttgatgctttggaaaaacgtccggaaatggttattctgtgggcaggatatgcattttcaaaagactattccactccgcgcggacatatgcatgctatcgaggatattacggcgtcacttcgtaccggttctcctgcaggtccgcacgatggccctcagccttctacttgctggacttgtaagagtccggatgttccccgcatgatggaagcattgggagtcgattctttctataataacaaatgggctgcctttggtgatgaaatcgtgaatccgatcggctgttccgactgccacgatccggaaacaatgaatcttcatatcagccgtccggcattgattgaagctttccagcgtcagggaaaagatatcacaaaagctactccacaggaaatgcgttcattggtctgtgcgcagtgccacgtagaatattactttaagggtgacggtaaatatttgactttcccgtgggataaaggtttcactgtagaagacatggaagcatattatgatgaggcaggtttctatgattacattcataagttaagccgtactccgatcttgaaagcccagcatcccgactatgaaatagctcagatgggtattcacgggcaaaggggcgtttcttgtgccgattgtcatatgccttataagagtgaagggggcgtgaaattcagtgaccatcatattcagagcccattggcaatgattgaccgcacctgtcagacttgtcatcgtgagagtgaagaaacattacgtaacaatgtgtacgagcgtcagcgcaaggcaaatgaaatccgtaaccgtctggaacaggaactggcaaaggcgcatatcgaagcaaaatttgcctgggataagggtgctacagaagatcagatgaaagatgtgcttgcattgattcgtcaggcacaatggcgttgggacttcggtgtggcatcacatggaggttctttccatgcaccgcaggagattcagagaattctttctcatggtctggaccgtgctatgcaggctcgtctggctgtatccaaagttttagcgaagcatgggtatacggaagacgttccgatgccggacatttcaacgaaggccaaagcacaggaatatatcggtcttgatatggatgctgaaagagctgctaaggagaaattcctgaaaacgaccgttccggcatggctggagaaggcaaaggcaaacgggcgtctggcacaaaagtaaaatagggatatatgtggagcaaaccgtggagttataaagaagggctggtgattggtgcgggattactggtgataggtattttgctgcaaatggcagtgggagccatcaactggggcctgtttgcctgtccggtcaatgcgattgtgttagtggtttatatcatagcgctggtagccatgcaccttcttcgtaaacgtgtgtatctgtttggatggttgagccattattccgctgccgtttcttccctggtatgggtagccggcatgacggtgatcatgggacttatccggcaggctccttccggtcatgcttccaatgatatactgggattttcgcagatgatttcgtcctggcctttcgtcctgctttacttttggatggtcactgtattgggactgaccatattccgtgccagctttccattcaggattggcagactatcctttcttctcaatcacgtaggattgctcgtggcattgattacggctactttgggaaatgccgatatgcaacgcttgaagatgactacccgaatgggaaacgcagaatggagggctaccgatgataaaggaaaattgatagaacttccgttggctatcgaactgaaggattttacgattgatgaatatcctccgaaactgatgctgattgacaatgaaacggggggagtactccccgaaaagtctcctgtgcatttactgcttgaaaacggagtttccgagggcagtctgctggattgggacttgtttgtcgaacagtctattccgatggctgcctccgtagctacagaggacacactgaaatttacagatttccattcgatgggagcgacatatgcagtgtatctgaaggccgtcaaccgaaagaaccaacagacgaaagaagggtgggtgagctgtggtagttttctttttccttataaggcattgcgtctcgactctctgacgagtctggtgatgccggaacgggaaccgcaacgttttgcttcggaagtaaaagtctacacacaggaaggaacgataatggaaagtacgattgaagtaaatcgtccgatggagatagcaggatggaaaatttatcagcttagttatgatgagtcgaaaggtcgctggagcgatatcagtgtctttgagctggttcgcgacccgtggttgcctgtagtatatgcagggatcatcatgatgatgctcggagcaatttgtctgtttgtcaatgcacaaaagaggaaagaggaggatacggaatgagttgggaacattttatatggtttgcgatagccgcattgatttgctggggcttgggcgcgtttgctgcctgggaaggaaagaagccggtatgggcttatgggtttaccttgttggggctggctatctttttcagttttatcctcggtatgtggatttctctggaacgtcctccgatgcggacgatgggagagacacgtctgtggtattctttcttccttccattggctggtttgataacgtacgtgcgttggaaatataaatggattcttagtttcagttgcattctctcactggtatttatctgtatcaatatctttaaaccggagattcacaataaaacgctgatgcctgctttgcaaagtccgtggtttgcccctcatgtcatagtgtatatgtttgcttatgcgatgttgggagctgcggtggtcatggctgtctatctgctttggttcaaaaagaaggatattgaacggaaagagatggacttatgcgataacctgacttatgtgggcttggcatttatgacattgggaatgctgacgggagctatctgggcgaaagaagcgtgggggcactactgggcttgggacccgaaagagacatgggcggcagctacttggttctcctatctggtatatatccatttcaggctgggcagaccgttgaagagtcgtccggcattagtcattctgttagtatcatttgtcttattacaaatgtgttggtatggaatcaattaccttccatcggcacaaggagttagtgtacatacttataacttaaattgaaatatcaatgaaaacattttattggtcattcgttcttatgctattgccaagcatggcatacacacaaactacggagaaggaaaatgaattttcgatgtctatgcaaatcagacctcgtgcggagtatcgaaacggtgctttagtccctcgcaatgaagggcagaaggctgcatcattcattaataaccgtgcccgtttgtcactggactacaagcgttcggaccttgaaatcaagatgtcggcacagcatgtcggagtatgggggcaagatccgcagattgacaagaatggtcgctttatcttgaatgaggcatgggcaaagctggattttggaaaaggcttctttgcacagttaggtcgtcagacgttagtttatgatgatgaacgtattttgggcggactggactggaatgtggcaggccgttatcatgatgcgttgaaactgggatatgccaataagaataatgaaatacatgctattctggctttcaaccagaatgatgaaaaaacggcaggtggtacttattacaattcttctattggtcagccttacaagaatatgcagactgtgtggtatcactataaagcagataagattccgttcggggcttctttactgtttatgaatttagggttagagacagggaatcagctcactcaagattctcatacccgctacttgcaaacgatgggaacttatcttacatataaaaatagcggatggaacttggatggcgctttctactaccaaacaggtaagaacaaggatgccgagagtgtttctgctttcatggcaagtgctacggcagcttatgcgttcaataagacatggggaatggttgtaagctttgattatttgagcggaaatgaagaaggtagtagtaaatttaaggcttttgaccctctttatgggacgcatcataaattctatggcagcatggattatttctacgcttctgcattcaacaaaggatttgctcccggattaatagatggtcgtcttggggctcgttttcgtgcatctgccaaggtagatatggaactcaattatcattattttgctactgctactgaagtagattttaaagaagatttgaagaagtcactcggttcggaagttgactatcagatcaattggtccgtaatgaaagatgtgaaactctctgccggttattcttttatgcttggaacgaagacgatggatgctgtgaaaggcggaaatcataagagctggcaagactggggatgggtatctgtcaatatcaacccgaaagtgttttttacaaaatggtaattgaaacctagctaggattcagattaaaccgttgatagaatataaaaagtggcacagcattaaatttaggctgtgccactttctttttattataagtatttctccagcgccattttattcagaatctcgatcttttttccttccattgtgatcagcccttccttgattatcttattgatttctttggataaagcaggacgtgatacattcaggtactcggcaagctgtgactgggtatgcatgatctctacagtcagagaatcttttttcttatgttcgaataagtaaacaataaacctttcgcgtacagtcttgcgcgacagaggtttcaaacgtgatacggtacatatattgcaatttccggcgatgcaaagaaaattgtgcaacacctgcgggtcctgactgatgactttaaaagtggaatctttggttgccatgagtaccacgctgtcttccaaagcagtaaaagtagctggcaacgtattgtttgaattgaaaaggtgaggggtggcaaaggtacgtggtgcgatgatatactcaatcatcacttcgttccccaatccgtcaatgatatccgtgcgtagttttccttccaataacacatatagtttgttgcaaggtgtaccttgcgtaacaactatttcttttttatccgctgcatagataacgaaatccagtttatccagcagagattccttaatgttcagaggtaaatcccgaaataaagggatttgaaataatttttctttatgtgcgttggtcagttgtatttttttcattgcattatgttgttcgtatcatgggcaaagatatgaattatatatgggcagagaaaatctttttttatgtttgtgccgccgaaagaccgattatggatgagatgaaaaggatattgataaaaagtaaaaatggcagaaaatgtttgaatcagtaattagggtacacatctctgtaatttatctacatttgctatatgataaattgtctatttttgcagagtgaaaaagctgattaatgaaattcaaaaaataaaagtaataaagttatggctaaaaaagttctgattatttcgtccagcccccgaaagggcggtaattctgatatgctttgtgacgaatttatgaaaggtgttctcgaaacaggcaatgaagtagaaaagatttttctgaaagagaaagtaattcatccttgtacgggatgtagtgtttgcagcatgtatggcaaaccctgcccccagaaagatgatgccgcaggaattgtagagaaaatgattgctgctgatgtcatcgtaatggcaacacctgtttatttctatacgatgtgcggacagatgaagattatgattgaccgttgttgtgcgcgttatacggaaataacgaataaggaattttatttcattattgcagcggcggagaatgataaggggatgatggaacgtacgattgatggtttccgtggcttccttgattgtctggaaaatccgcaggaaaaaggagtgatttatggaataggtgcctggaaggtaggagaaataaaagatactccctacatgcaggaagcctatgagatgggaaaaatggtgtaaacgttcgctttaggtaaacatttcccgtcttatataacaacctttcaggatggtgtcactatgctgagtatatagtgacgctatacctgtaggatagtgacactaaagcagtatgatagtgacactatagtaatgggatagtgacaccatatttttgtctggatttaatgagagaagtttagtttaacgattctgttacaataatcttctttcgttcgattccagctccaataaagtctttttagctacaagaccaccggcatatccggtcagtttatgatcactgccgatcaccctgtgacaaggaataagtattgaaatcgaatttgctccattcgaagaggctaccgcacggatagctttaggattatccagtctctgtgataattgagcataagatatcgttgttccgtagggaatgtttaataattcattccatacactcttttgaaactctgtcccgacaagaagcagaggaatatcaaacgtagtcctttgacgggaaaaatactcatctagctggctgatcgtttgcgttatcacttcagagttttctattgcgtactgagcatttagcgctttttgtattcgtttatcgattgctgctctgcgttcttcactcaccacccagtcgcacatacagagcttgttctcgaaagaaccgagtatcaatttcccgcatggagattgatagtactgtatctgaactgtatttactttaccttttgcttctttctccattttgattctttatttaaagggtttgatatggatgtaaaagtaattatttgtattcaaactacaaaatgaataattcggcaatagaagcctgaaacaaaatcttttacccttacagtcgatttaaattgattgattacttgttctgccgtagaattattataattttgtagcagaactttttatttcgtagtatttgataaagaaccaaaccacatgaactataaaataacgactcttgtcgaaaattgtgtctatggacgtaaattgcaggcagaacatggtctttccctctatattgagacaccggaaaacagattactttttgatacgggagcttccgatttatttatccgtaacgcccggttattgaatattgacttgcaaaaagtagattatttagtattatctcatggtcacagtgaccatacgggtggactacgccattttcttgaactaaatgccgaagcaacggttgtctgcaaacgcgaagtgtttttttctaaattcaaggatgaacgtgagaatggaatgaaatatacacgctcgcttgatctttctcgttttcgttttattgatgagttgactgaactggttcccggagtatttctttttccctctgtggatattatagacccgaaggatacacattttgaacgattttggattcaaaaggaagatggttctagagtccccgatacctttccggacgagttagctatggtactggttgagcctgaaggactttccattttaagtgcctgttcccaccggggtattacaaatatattgcggactgtaagaacggcatttccggaactcccctgtaatttgcttttaggtggatttcatattcataatgcagaagaatccaaatatcaggttattgctgattatttgcacgaatatttacctcaaaagataggtgtctgtcattgtacgggagtagataaatatgctttcttctataaggattttggagacagaatattttataaccatacagggaaattgattcagacggattctctgttataataatctgcgacgactaaacaagaatatataaaaacaaactggatgaattttaaagactgcatagattcttatccctttatattaatggaaggtgctttaggcgagcgactaaaaagggagtttgatttggatatcagtggtactgttgcaatggctgacttagtctatcagcagaaaggtagactggcattagaaacgctatggaatgaatatattgatattgcatataggtatcaactaccatttcttgcaacaactccaacaagaagggccaataaagaacggatttatatggctggatacaatgaatccattattgcagataatgtggattttcttcgttccataaaagaagcagcaaatgtagatatgtatatcggtggtttgatgggatgtaagggagatgcatacactggcgaagaggctctaaatctggaagaggcaatagacttccatagttggcaggccggtttgtttaaatctgccaaagttgattttttatatgcaggtattatgcctgtattgacggaagctatcgggatggcagtcgctatgtctgatacggatattccttatattatcagctttacgattcaaagagacggaaaactgatagatgggcataccattgatgatgccatacattgcattgataatcatgtgtctaacaaacctgtgtgctatatgacaaattgtgttcatcctgatattgtttacgaagcactttctcataagttcaatcaaacacaaacggtaaaatctcgcttttggggtatacaagcaaatacttcccaattgtcatataaagaattggatggagcaaatcatttacatacttcttcggcagccgatctgagtgaagctattttaaagttgaaatctgattgtcatcttaaaatatttggtgggtgttgtggaacagacagcagtcacatggaaaaaatcgctaaaatatcggaagtgacttaaactaactagaaatacggtcttctcatgaaacaaggaatatagaataaatatataaacatacaataatatgaagaaaataatcatctctttagcgctggtactgactgcattatccagctatgctattacccctttgtggatgcgtgatgcacgtatctcaccggacggaaaggaaatcgtcttttgttataaaggcgacatttacaaagtccccgttcaagggggaaccgctacccaattaacaacacaagcttcttatgaggctaatcccgtctggtcgccagatggtaaacaaatcgcgtttgccagcgaccggaatgggaacttcgatctctttatcatgtctgccgatggaggaactgcacgtcggttgacttatcattctgcctcggagattccttcggctttcactccggatggtaaatttgtacttttctccgcctccattcaggaccctgcgcaaagtgccctttttcctaccggagccatgacggaattatataaagttccggttaccggaggacgtaccgaacaagtgttggctactcctgccgaatgggtatgctttgataaatcgggaaaaaacttcctttatcaggaccgtaaaggttttgaagatgaatggagaaaacaccatacctcatctataacaagagacgtttggctatacgatgcttcgaccggaaaacataccaatctgaccaatcgggaaggagaagaccgtaatccggtatatgcaccggatggtaattcggtctattttctaagtgagcgcaatggcggttcatttaatgtatataactttgccctgaacactccgcaggaagtgaaagccatcaccactttccgcacgcatccggtacgtttcttgtcaatcagcgataaaggaactttatgctatacgtatgacggagaactttatacacaagagcccaatgcccgcccgaagaaagtaaatgttgatcttgtgcgtgatgatgaaaaagagattgctactctcagattttctcagggtgcgacttctgcttctgtgtctccggatggcaagcaggtggcttttattgtgcgaggtgatgtttttgtgacttcaaccgattatgctacgaccaagcaaataacaaatactccggcaaaggaatccggtgtatcttttgctcccgacaaccgtacactggtttatgccagcgagcggaccggcaactggcaactttataccgctaagatagctcgtaaagaagaggcgaatttccctaacgccactcttattgaagaggaagtattgctcccctctaaaaccgtagaacgtgcttacccgcaatactctccggatggtaaggaattggcttttatcgaagaccgtagccggttgatggtactcaacctgaaaactaaaaaagtacgtcaggtgacagacggttctacatggtacaatacaggaggcggattcgactacgaatggtcgcccgatggcaagtggtttacgcttgagtttatcggcaatcgtcatgatccctattcggatatcggcattgtcagtgcgcagggaggtactatcactaatctgactaacagtggttatattagcggctctccacgttgggtactggatggaaatgccattctgttccagaccgaacgttatggtatgcgtgcccatgcttcctggggatcacaacaggatgtgatgctggtattcttgaatcaggatgcttacgaccgttaccgtttgagtaaagaggatttcgaactgctcaaagaatttgaaaaggagcagaagaaagcaaaggagaaagacggtgataagaaaaaggacggaagtcagtctaaaaaggaaaaggcagacaaagaaaaagataaggtagacaaagaaggagataaggaggataccgaaaaggacaaggcagacaagaaagatattgttgtggaactcagcggtattgaggaccgtattgtacgcctgactcctaactcttctgatttaggtagtgctattctttccaaagatggagaaaatctgtattatttctctgctttcgaagagggatatgacctttggaaaatgaatcttcgtgaaaaagggacgaagcgtctccataaacttaattccggctggtcatcactgatgctggataaaaaaggagatatcttcttgctgggaagcagaaatatgcagaaaatggacgcgaagtcggatgctctgaaatctatcagttatcaggctgaaatgaaaatggatttggcagccgaacgtgaggcaatgttcgatcatgtatataaacaacatcaaaaacgtttctacaatcttaatatgcacggagtggactggaatgccatgacagctgcctatcgtaaattcctgccacatattgataataactatgactttgcagaattactgagcgaatggttaggtgaactgaatgtttcgcataccggagggcgctattctccgaggggcaatggggatgtaacctctaatctgggcttattgtttgactggaattatcagggaaagggtatgcagattgctgaaatcgtagagaaagggccgttcgatcattcccgtaccaaagtaaaggcagggtgtattatagaaaagatcaacggggaggaaataactccggataaggacatcactgatctcttgaataataaggcaggaaagaaaacactggtttcgctgtacaacccgcagaataaggaacgttgggaagaagtggtaaaacctgtcacaagcggacagcttaatggcttattatataaacgttgggtaaagcaacgtgctgaggatgtggagaaatggtccggcggtcgtttgggatacgttcatattcaatctatgggagatggcagtttccgtactgtttactcggatattctgggaaaatacaataactgtgacggaattgtgatcgatacccgttttaacggaggcggtcgtctgcatgaagatattgaaattcttttcagcggtcagaaatatttcactcaggtggtacgcggacgtgaagcctgtgatatgccaagccgtcgctggaacaagccttctattatgttgcagtgtgaagccaattattcgaatgcgcatggcaccccgtgggtgtacaagcatcagaacattggaaaactggtaggtatgcctgttccgggaactatgacaagtgtatcttgggaaactttgcaggacccttcattggtatttgggattcctatcatcggttatcgtctaccggatggcagttatctggaaaatactcagttggaacctgacatcaaggttgccaacagcccggagactatagtgaaaggagaggatacgcaacttaaaatggctgtggatgaattgcttaaagaaatagatagtcggaagaaatagacatcgttcgtttgtgttaaaagaaccgaaaaaaaagcttattgaaatgatgtgtccaacttattcttacttttgtgtttgacaatagtgtcaaactaggggaacatagtgtagaacatgattaaaataggaattgatgtaggttcaacgacggcgaagttagttgccgtcgatgaaaatgataatctattattttcaaagtacgagagacacaatgcgaaagcaaaagagacaattctatcattcttgaaagagctgttatctgaaatcggagataaagatatttccgtgaggataacaggctctatcggaatgggaatttcagagaaatgttcgttgccgtttgtacaggaggttgttgcggcagcgaaagcgatacaaaaggattattctcatgtgacttccatgatagacatcggaggagaagatgcgaaagtcgtcttctttaatgatgccgaagcgaccgatttgcgtatgaacggcaattgcgcaggagggacgggtgcttttattgaccagatggcgattatactgggagtgaatattgatgaattgaatcaactagccatgaatgcgacacaggtatatcctattgcctcccgttgtggcgttttctgtaaaacggatattcagaatctgatagctaaaaatgtaagtcgtgagaatattgcggcttccatctttcgtgcggtagcagttcaaacggtagtgacgctggcgcacggttgcgatattacaactcccgtattgttttgtggtggtccgttaaccttcattccggcactgcggaaagccttcattgattatttgtccctcgatgaaaaagagatcatactgccggccaacggcactttgctccctgcactaggtgctgctctatttcatcttgataaagaggattactgtaaactgtcccatttgatcgataagattgacactactttaaacggtaacggtaaccttgcctcaacaggattggaacctgtttttgcaagtaatgaagaatatgaagcatggaaagaaagaatatcccgtcataagatgatatcttccggcttgaaagccggaacacaggatgtctttatcggcatcgattcaggttctactacgacaaagattgttgtactggatgaagattcaaggcttctgtattcttattataatattaatggcggcaatccgataaaagctgtggaagaggggctgaatcagttgaacgatgaatgtttgaagcagaatgccgtactcaatataaaaggaagctgttctaccggatatggggaagaccttatcaggtctgcctttcagcttcattcggggattatcgaaacgatcgcccattatatggcagcgcattatctgaacaaggatgtgtcttttatcctcgatatcggcggacaggatatgaaggttatttttgtgaataatggcgtgattgaccggatggagattaatgaagcatgctcttccggatgtggttcttttcttgaaacgtttgctaaatctctggggtattcggcacaagagttttctctggcagcctgccattcggaagcaccgtgtgatttgggaacaaggtgcaccgtttttatgaactcaaaagtgaaacaggtactcagggagggggcaacgatcaatgatattgccgccggactggcatattccgttgtcaagaattgcctgtataaggtgttgaaactgaaagatatatctgttttgggaaaagatattgttgtgcagggaggcaccatgcgcaatgatgcggtggtccgtgccattgaacttctctcgggagcggaagtggcaaggtgtgatacacccgaattgatgggagcattcggatgtgcattatatgcgatgaaacatcagggggagtccgtatcattggatgagattatcaataaagctcaatattcggcacgttctttatattgcaagagttgcgataatcgttgtctggtcattcgttacgagttcgaaagcggcaaaagttattattcgggaaacaggtgcgagaaagttttcacgaatggagagagcagtaaccggaaaggtctgaatgtctatcggcaaaaagaagagcttttgtttcatcgcagcgcagagattgcagcacccgagcagattatcggaatcccccgatgtctgaatatgtacgaggaatatccattctggcacactcttttcacttcctgtggcatacaagtctgtttgtctgatccgtccaatttcagaaagtatgagcacaatgcgcgtatggtgatgtcggacaatatctgctttccggctaagctggtacatagtcatgttcaggacttgatagaaaagaaggtcgaccggatttttatgccttttgttattttcgaaagaaaagggatggaacaaaacagttataattgtccgattgtgacaggttattcggaggttatcaaaagtgtgcagtccgaaggtataccggttgattcccctgcaataactttcaaagaccggaatctgttgtttaaacaatgccgtgaatatctgagcggtttgagcgtggacgatcggacgattcagcaagcattccaaaaagcggaaagcgaacagcactcttttattaatacattggtcgattataacaaaaacatattgcagcagactggaaagggagagactttgactgtcatgcttgccggacgtccttatcataccgattctctgatacagcacaaagtctcggatatgcttgcggatatgggagtgaatgtgatagcggatgatttggtgcgtcagatggatataccgacggatgatgcgcattttgttgctcaatgggcgtatacgaaccgtatcctgaaggctgcgaaatggtgtgcgacacaaggaaagaatattcagtttgtagagatgacttcgttcggatgtggaccggatgcttttctggtggatgaagtaagggatttgctgatgcgtcataacaaatcgctgaccttattgaaactggatgatatcaataatatcggttcaatgaagttgagagtacgttccatgattgaaagcctcaaacttgcgaatgcggatggaacggaagacggtgtaaaggactttacgaccgttcctgtttatgacaagtcttaccgtgaccgtaagatactcgttccttactttactccgtttatttcacctttgattcctgctattatgaaagtagccggttatgatgcggaaaaccttcctctcagtgataatgattcaagtgaatgggggttgaagtatgcgaataatgaggtctgttatccggctactctgatagtcggcgatattataaaagcacttaaaagcgggaaatatgatatttcaaaaatagccgtagccatcacccaaacgggaggacaatgccgtgccagcaactatatttccttgataaaaaaggcgttggtggatgccggatatacggatattccggtaatctctatctctgtgggcagtgacatagataatgaccagcccgcgttcaaggtcaactggatgaaagtagtaccgataacttttcatgccgttttgtatagtgattgcattgctaagttttattatgcgtctgtggtacgtgagaaagaagcaggtgcatcggcaaagctgcgtgataaatacctgcaactggcacctgaagtgatactgagaagagacataaaggggttgaactctttgttgcaatcggcaatcactgaatttaatgaggtatgtagggctgtagatactcctaaagtcggaattgtaggagaaatcttcttgaaattcaatcctttcgcacaaaaagagatcattgattggctgataggccgcaagatagaagtggttccgccgattctggctgactttttcatgcaggggtttgtgaacaggaaagtcaatacggattcttacataaaaaacagacagttgcctgagtttatttacgactggatctacaagtttgtaaagaaacagattgataaaataaatgagacagcaagtaagttccgttactttgcccccttcaatgatatctttgaagaagcggaaggagctaaaagcgttatttcgctgaatgcccaattcggtgaaggctggttgttgccggctgaaatcgtgtcttacgcccggcaaggggtgaacaatgtagtgagtttgcaaccttttggctgcatagcgaatcatatcgtatccagaggagtcgaaaaacgtataaaaagtttctatccggatataaatttgctatctttagactttgatagtggtgtgagcgacgtaaacataacaaaccgtatgcttttgtttattgataatctgaaaaatgcgacaatgaattatgacaacaactaataataatgaagatttggagaaaaagataattgaggctgccaaagaactatttatagagaatgggttcgcagaaaccagtatgagtgatatcgctgctaaagtaggtatcaacagaccggcacttcactattatttccgaacgaaggataagatgtttcaggccgtttttggtaatatcatactttcttttattcccaaaatacatgatataatcattcagcaggacaaacctgtctccgagagtatcggtgaaattgtagatgcttattataaagtattcacggaaaatccatgtttgccattgttcatggtgagggagatgcatcgtgatatgaaccatttaagcactactatcaaggagttgcgcctggaacaatatctccataaaatcatggatgttttacaggaagaaatgaatgacgggagactgaaaacagttcctttgccattcgtattctatactttttatagtgcattgacagttcctttcctgacaaagaatctcagtgcttctttctttttggagaaggatgattcttttgaggatattctggttcagtggaaaccttatatcgtcagacagatggaaacgttgctggtagcgagctagagaaaacttatttcaatacaggtaataatttgtagagagttttccttgtcattattttctgattcaggaagctgacgatatatccggtgatgcaggcggcgataagagacccctcgcgaacaccttcgatgcattgcgaaagcaggagagagagtatgactgccagagtgaccagcgtaacatcaaaacagactttgaactttccgaactctttgttataacggcgggaggcgtattttacaaaagcctctgcactcatcattgctactttgggtttgagttcgagtacgactcctatggattgtatcatgcatcctgtgagtaataaggctattgacattccgtaattgtcgggatgcagattactggtgagtgccatattaaaatcaatgaatgccgaaaagataaaagagaacggcaattgaagaagtatttcaatagtgtcctgtcgggtcttattttttctgatgacccagaactgtcccagaataagcagcatattgatcagaaacgtacaagttcctaatgataaagggctgttcaggcttagcacataattgacgctggatataggtgtggttcctaatgcagaacgcacaatcaacactattccggcagccagaaaatacaatccgataacaaataccaaataccttttaaaaacgtctttcattcccatatcttactatcttatataatcgtatttttcttcattctataaagaagaatatgcaaaggtcccgttttttcgtctgatataagttatccgattccacacagtttttgtcatatccgaaacaaattgtacttttacgtcgaaaagaaggaggtataaatggtaaaatctcgtatttttgataataggcagttgttaaaggaacatccggaaattcctcattataaagaggaagtagtctgctttatgagtgaatataaggacaggagctatccggaaaacgaacgttactttaatcgtgaactttatatgatactcgttcttgaaggtcgttccgagattttgctgaatggggaatttattgtgatagagcctgatatgttgcttgttcatggagcgaattatctcaccgaccatctttattcgagtccggatattaagtttatcaccctctccatttccgagtccatgcggacggatgactcttatcttacccagataacggctattctgttggcaacgatgaggcagaataagcaatataccatacagctgaccgcatacgaatctcaaatcattcgtaatgaactggaagtgttgatgcgtttgctgaatataaaacatcagtttcttttccggcgaatacaggcggcttgcaatgccttatttttggatatagccgattttctttcccgaaagactatcataaaaaaggaggtcagtcgtaaagaccatgttttacaggaatttcatgcgcttgttacccgaaatttcagagaagagcatttcgttagtttctatgcggataagctggccatcagtgagcagtaccttgcacgtatcgttcgtgccggaacgggaaaaagtgtgaatacgattattaatgagttactgatcatggaagcccgtaccttgctgagttccactaaatctacggtaggggatattgcttcccggcttggctttagtgatgctgccggtttctgtaagtttttcaagaggaatatggggcagactcctctcaattatcggaagggattatggatttaagtgaaaatgaatgtaggttgatgtgatcccataacgaacggatacatcaacctacatgaaatatataatgaactggttttgacttatcagccaatgagtgataggatatcttctacgatctgttcatctgtcagatggttggcacgaagcagttcctgtatatcataacggtctacaaattcttttttagctccgtagttgagtactttcatatctgtagcgccatagtaacgggcaatcttttcaccgaaaccaccatccagaactccgtcttccagggtaatcactaattcgtggtcggctttcagttcgtccatcagttcgctgtccacacctgtgatgtagcggggattgataagggtggcatcaatgttggctttatctttcagcaatgacagaaccgattgccctaatccgaagaaggagcctaatgcaagaattgctactttggagccgcggtgggcgactttataacgattgagattgctatagtcggattccaccggttcaccgcaactgattacatctgtggcaggtacacggatagccaccggatgctcattttggcagatgctccattccagcatggctagatattcctctttacaggtaggtgccagatagaccatattggggatattgctgataagtggaatatcgaagaaacagaggtgggttacatcattcataccggataacgtcccccagaataccaacagaacagccggattattattgatacagagatcttgcgatagctggtcgtaagagcgttgtataaaggtgctgtacactccgtaaaccggttttccgccattggctgcgataccggaagcaagtgccactgcatgctcttcggcaataccgacatctacaaactgcttgcctgcttcctgacgacggtcgggagtgaagcctagaacagcgggggtgcccgaagtaatggtaactacacgcttgtcttctttcatcttttttagcagatattgagcggttacttcactataatcttctgcgtcgtcgttcacttttgattctccggtttctagatcaaacggagtgcgccagtgataggtctccttgtcctgttctgcaggctcgtaacctttgccttttaatgtattgatgtggactactatcggatgctgtatatctttaactttggagaaagcctcgatcagtgcttccacatggttgccgtcattcacgtacatatagtccagccccatcgctttgaagaagttgcattcacattgaccgttactgtcgcgcaaatctttcagattcttgtataaacctccgtgattttcggcaatggacatctgattgtcattgacaataataatcatgttagttccgagttctgctacgtagtccagtccctcgaaggcttcgcctccgcttagtgaaccgtcgcctattacagcgatgatattttcgttgccacctgtcaggtcacgtccttttgccagtccgcttgccaagctgatcgaagtagaagtatgaccgatcacaaagaaatcatgttcactttcctgtggttctgagtagccggatacatggtcatattcagcaggatggagaaaagcatctttacgtccggtcagcatcttatgtacgtaactctgatgtgatacatcatatacaattttatctttcggtgaattgaaaacatagtgcagggcaatggtcgcttctaccattccgaagttagggccgaagtgcccgccatgttcactcagtttttgtaagagggatgcacggatttcgtgacttaaatcattcagttcctgaaacgataacttctttacgtctgcgggagagtaaatattttctaaatacatatcaaattgtttttttatgtttatacctatatttttatttcactgcaaagatactgccggatttgaaatctgtttgtatatgaattacggattcttttacctatattacagttccgctaaaaatgggcttgataaaacataaaatatgacttcctctatatcaaccatatgctcttttgcaagcttgattctttttacctgaatatactgttgtaataggtatcgcgcacgcgtaatcattatataatagcaaaataggatgctataataatatctgttcttgtgtgatagaaagatggaaacctataatctgtaattggggtaattatacccgtaatctgtctacaatcccttcacttaattcttccgacctttgtactgtcgaatcaccttgagtatatggaactaattatataaagaatatggatagaaaaggcttcttgaaaagtacgatgatagcaaccggaagtttactgttaggcggggcggggatttgtcggtttctgaatgataaagaacccgcagatggtccgtttccccggacaatagaaaaaatacattgtggaaatatgaaaaaggtacttgttataatgagcgcggggacaaaactcggtaatacagaccggttgaccgacgcttatattaaaggactcgtggaacggggacattcggtaaccaaagtatatctgggcagtatgcggatagaaggctgcagaggttgcggcgtatgccagcggctcgctcatcaatgtgcagttcgggatggtatgcaggatatatatcctttgtttgcagaatgtgacacagtggtcatggcttcacctttgtatttctggacaatcacgtcacagttaaaagcttttatagacaggctttacgccatctctgccgacgacaagtatccgcagaaagatacggtattactgatgacagccggtgacgataatgagaacacctttgaccaacccaagcagtatttccggcttctgagccaggcattgggttggaatgaagtcggaatatattgtgccggcggttgtaccggatgcgaaaagctggcacggcaaatagataaggtacatcttgaaaatgtctataaaatgggattggaattgtaaatagcagatttaatatggaacaaaagaatcaatcaaaacttcattcgggcggtttgctcgtatttatcctcacggtcggtgtgtttggtattataaataccgaaatgggggtagtgggtatcctgcctctaatagccgaaacttttgatgtctcggtgccgcaggcaggttggacggtgagtatctttgcactggtggtagctgcatcggctcctgtcactccgttattgtttttgggagtaaaccggaagaaagtcatgttgctggcattgggattgtttacactgagtaatattatatccatgctcactaccaattttacagtactattggttgcgcggatacttcccgcctttcttcatccggtatatgtttcgatggcttttacagtagcggcggcatcagtcagcaaggaaaaggctccaaaggctgtttcaagggtttttgtcggtgtgtctgccggtatggtgctgggtgttccggtgaccagctttatagctagtgaggtctcattctctatgtcaatgctgtttttcacagttgtaaatgccttggttcttatagctacgattttgtttatcccctccatgccggtaaaggagaaagtatcttatggtgcacaactcagcgtattgaagagaacggtgatgtggaactctatcattgccgtcaccttgattaatggagctatgttcggcttctttagttatatgtcggactatctgaaaacagtgacggaagtatcatacagtgtgattagtgttgtattattggtctatggtctggctaatattgtaggtaacgtacttgccggaaaactattatcgataaatgcgcggcgttcaattattatcatgccttttgcattgctggtttcctatatatgtctctttataacaggagagtggattacagctatggtaatcattattttaattttaggtgtattggcaggtatagcaagtaataatatgcaatatatgatcgcggaagctgctcccgaagctcccgactttgccaacggaatgtttctgacttctgccaatttggggacaacgatcggtacagccgtatgcggagctttcatcacggaaatgggcacacgctattctgtattcggtgcattgtttttcctgattgccagtattgtgtttgtttatttgagagttcgtgtagctcattcacagaaacaagttaaaatgaatatggcaacggaatgatgaaaaatatataatccgtaattggggtaataatgtcagtaattcatctacaaacactctctttatttcaccgtatttttgtaatgtagaaagtagacaatcaattcattaataattaaatgtacgagatatgaaacgaatattattattaaccgttgtat

SEQ ID NO: 101 - DNA, 28164 bp, Bacteroides thetaiotaomicron
tgatattatcgaataaaattcttttatagtattacgaacaataaagacgattcacctattctctatcaaagatatttatgaaaactcgcaaaacaacaatcgttcaattaaaacaatgatatgtttattcatctaacaatgattcttattgtacagccaataacgtcaattcggtggttattccagattgcaccgcttttccgtcaatcaccatcttacagggggcagaagaaagaatataccattttccctgcttcttttcgagcagcacattagcagcctccgaagtctggatactgataccggatgcaatcagttgcgttccgttccctataaacagcgtccggtttcccgcatattcgttactgattacggcatagtccgctttcactttcattccctgataggttgcggtctgcgacgaatccgtcaaagagaaaatatggtcagtacgcccgtttttactttccacacagataccggcaaagtctttcaagccgggctcttccgcatcaaagtaagagactgactgaatagccgaaggctctttctgcgtacttggttcataaacagcaacaaaaggacgattccatgcttctccatgctgccgggcaacgaaggtgagcgtaggctgttcctttatattataaggcatatggggagtccggctcaatccttcggtcatcggtgacagtgcggtgaacacttcccgttccggttctcctttcatccagagattcatggaaatatcatctccgcctttatccttcatatcgatggtaaaagtcactttcacatcctgaccggtggtagccactttcttatcatataagtaggaataagcataaagatgggcacctgcaaaagctagctcttcggtaggctgcaaattcaagtccgtaccatcggcagccgtaagtgtcattgtctgacctagattatggtagaaataatcgtgcattttatcgcctccccgttctttccggctgcggaatacatccacataataccctgtctccggaccggtagtaacaatgcccatcagtcgagtctgatccgccctgctctccggctcacggaaagctacctgactataggtgacggaagtaaatcctttacccggttccgccgaagccggaaaacaggaaagcaaatcgaaagaatgattacttttcatcaccggataactggaaatgccatctacacaaaccgtattatgactggggaattgagagtaatattccgcatagtccagaccgctatacagaaaaagtccgatacccgcatccggtcccagcacatatccttttccataaagctccatcgaaataccattcgcgtgcatatgattgccttcactagcattgagagaaatcatcagactgttgcgcggatgcatcccgttgcgctgtaccagccacgatacgttgggggcatagaacagaggagatacataatcctcgattttccccgcctccaccttcgggtccaacactaacggcttgtcctcaaagaaggagttgacagaggcccgtacattcttcttgccacttttttcgctaccttcctccggattcagacatttcagcaaagcggtgaagtaacgttcctgctctttctttccgtttgcctgcgcattctgtatcatccggataaagaagttcgtacttaagtaacttggatgcgtatctccgaaaccacagatcatccggttcggaaaaagatactgcggagtagtcgctactgcttttgccagcacaggcattgcctttaccaagtcatattgcagattgtggtcaaactgatgggtgaagttcgcgtagtcattgatgactacactgctgtatcccggacattccgcccatatacccgtttcggagtcaaagccgtaatcggccagcttggtcagactccactggcggatgctcgaacggttcataacgtagtcaatatagtattcgcgtcctttcccgtccgcatattctttattatcttccagcaccagtcccacgttcatgatatatcgtgcctgcaataaatcccagttattatgggggactccgttggcgatgatattatccgcccatttcttcaatgcgccggcataaatcatcatcttatccggatagttggattgcagataatgatagaggaagtcatacaaagggacaacgatatgcaaagcatcctcatggatcacttcaaaagaagtcagccccaccagtgtctgctgatgcccgtgattcaggtcaacaggaacatttctgtaataaattcccgtcatataagtatcgaaaacgccggcagccagtcgggcatacttttcctctcccgtcatccaatagaggaaagcggcgtcacgggcaattcccagaatctcacagttcagactttcaatattgcgtccggtcttggacggatgcacactctccagcggacgacctttcagggcattgttgcagaaagtcacgtttccttccgcactatcgtcataaggtactacatcttccagcttaggtcgaccgtgcgtagcggccgtccctcgtgttccggtatagcgaaccgtcggagcaggtgccttcgcgcctccggcatggtcgaacacctcacctttcacgtacacttccgttgcatgcgacttccagtacatggccaaacgggataataaccagtccggctgactttccgtacgtcgcgtatatacttccgtccgttctttcagcttgttaaagacatcttgtgcccatgcttccttcttgatcaacttccatgtttctttttttccttccggggtagtcagtactctcggatgatcctgcggcatcttctccggcaacggaatctcctgcccgtgcgcattcaggaaaaaaagcacacacaatcctaacaaaattcgtctcatacttccatttcttatttacgtttgctacgtatttaatacgaaaataaggaataatttacctaactggtatcagaaaacccgtttttattttcaccggtacggactgccttcatactccggacattcaagtatactcaaaaagatagcctgcaagcataccacttacaggctatcacaatccccttttttccctttgtatcagggaggcaacttacgtttccccgtccccgccggaactcttgctgtacatccttgccatcaagctatataaaactcatacaaggagcattttcccattcagatacagtaccggcaggtccccataagtcactccacaatgttcttgcgaatctccccaactattgttggattcatatgggtattcgccctttttcgatgcgaagataatttttttatgctactattatagttaacaccgtctattaaaagtgttaaaaataaagatttcataccatacttccgcaagccgacaccaaagaagaatatttattttctctaaacaaagcgctaattccgaacaaagaattatatttgcagaaatctaacaattctgatacttatgaaaatactatctatccatgatttgcaaataatcaggaagagagcggagcaccatctttcattgcgcgaagaaagtaatgaaaaggtttccgaaaaatgttgcgggctggcgtccggaacaacacacctccagattcttatttgcggaggtaccggttgtaaagcctcttccagtcagggcatcactgaaaatcttcaaaaagccatcgaaagaaacgggattaccgacaaagtagacgtcatcacagtaggctgcttcggcttctgcgaaaagggccccatcgtaaagatcattcctgacaatacgttctatacccaagtcactcccgaagatgcggaggaaatcatcagcgaacacatcatcggaggacgaagaatcgaacggctgctctacatagacccgaagaccgaacaaactgtcagtgactccaaacacatggacttctaccggaaacaactccgcatcgccttgcgcaactgcggattcatcgactccgaaaatatagaagaatacatcgcccgtgaaggatacttcgcactggccgactgccttctcaacaaacagcctgccgacgtcatcgacatcatcaaacgctccggactgcggggacgtggcggtggcggtttccccaccggcttgaaatgggaatttgccagtaagcaggtatcgaacgtaaagtacgttgtctgcaacgccgacgaaggcgaccccggcgccttcatggaccgctccatcatggaaggcgacccgcactctattgtagaagcgatgtgcatctgcggttactccatcggttcctccaaaggactggtctacatccgcgccgaatatccgctggccatcaaccgcctcaaaaaagcgattgagcaagcccgtgaatacggattactgggggaccacatcctggggacagatttcagcttcgacatagagatccgttacggagcaggcgcattcgtctgcggcgaggaaaccgccctcatccactcgatggaaggaaaacggggagagccgaccctgaaacctcctttccccgccgaatccggttatctgggcaaaccgaccaatgtgaacaatgtggaaaccctcgccaatattcccattatcctgaccaaaggcgccgaatggttcgcctccatcggaacagaacgctccaaaggcaccaaagtcttcgctcttgccggaaagatcaacaatgtcggactgatcgaagtaccgatgggaactaccctgcgggaagtaatctacgaaatcggcggaggcatcaagggaggaaagaaattcaaagccgtacagacaggcggtccgtcagggggctgtctgacggagaaacatctggatactcccattgacttcgacaacctgctggcagccggttccatgatgggatcgggaggcatgatcgtgatggacgaagatgactgtatggtatccgtcgcccgtttctatctcgactttaccgtcgaagaatcctgcggtaaatgtaccccatgccgtatcggcaacaaacgcctgctggaactgctgaacaagataacggaaggacggggcacggaaaaagacctggacacgcttgccaccctcggacgggtgataaaagacacggcactctgcggactgggacagacgtccccgaatccggtgttgtctaccctcgacaacttccgtgacgaatatctggaacatgtcagagacaagacctgccgcgccaaacaatgcaagtccctgctgacctataccattaatccggaactttgtatcggttgccacctgtgtgccaagaattgtccggcggatgccatcagcggcttggtacgcaaacctcatgtcatccaccccgagaaatgtatcaagtgcggcatgtgtatggcacgctgtaaattcaaagctattcttgtctgttaaaatctactgctatggaagaaaaacaaattaccctccagatagacggtcactttatcaccgtacccgaaggaagcacgatcctcgaagccgcctgcaaaatcggcatcaacatacctacgctgtgtcacatcgacctgaaaggaacctgtatcaagaacaatcccgcttcctgccgcatctgtgtagtcgaagtggcaggacgccgcaatctggctcccgcctgcgctacccgttgcacggaagggatggtggtgaaaaccagtaccctacgcgtgatgaacgcccggaaagtggtagccgaactgatcctgtccgatcatcccaacgactgtctcacctgtcccaaatgcggcaactgtgaactccagacactggcactgcgtttcaacatccgtgaaatgccgttcaacggcggcgaactttctccccgcaaacgggaagtgacctcctccattgtgcgcaacatggacaagtgtatcttctgccgccgatgcgaaagcgtctgcaacgatgtacagacagtcggcgcactgggagccatccgccgcggattcaacacaacgatagcccctgccttcgacagaatgatgaaagacagcgaatgtacctactgcggtcaatgcgtagccgtatgtccggtaggcgcactgaccgaacgggattacaccaaccgccttctggacgatttggccgaccccgataagatcgtaattgtccagactgcccccgccgtacgtgccgccctgggagaagaattcggcttgcctcccggcacactggtaaccggaaaaatggtttacgccctccgcgaactgggtttcgactatgtattcgataccgactttgccgccgacctcaccatcatggaagaaggttccgaaatcctgaaccgactgacacgctatctggacggagataaatccgtccggcttccgatcctgacttcctgctgcccggcttgggtaaacttcttcgagcaccacttcccggatatgctggatatcccttctaccgcccgttctccgcaacagatgttcggctccatcgccaagtcttactgggcagagaaaatgggaattccccgcgaaaagctggtagtcgtctccatcatgccctgcctagccaagaaatatgaatgtgaccgcgacgagttcaaagtaaacggtgtccccgacgtcgattactccatctccacccgcgaactggcacgcctgataaagcgagccaacatcggctttaccctcgtgctggacagcccgttcgacaaccctatgggagaatcgaccggcgccggtgtcatcttcggtacgacgggtggtgtcatggaagccgccctgcgctccgtttatgaaatctacaccggacagccgctgaagaatgtcaactttgaacaggtacgcggactgagcggtgtccggcgcgccaccatcgacctgaacggatttgaactgaaagtaggcatcgcacacggactaggcaacgcaaggcacttactagaagatatacgaaacggacataatgaatatcatgtcatcgaaatcatggcatgccccggcggctgcatcggaggtggcgggcaaccgttgcatcacggcaactcggacgttctctacgcccgtgccaacgccctttaccgggaagatgccaacaaacctttgcgcaaatctcacgacaacccgtatattcagaaactgtatgaagaatacctcggcaaaccgctgggtgagaaatcggaaatgctcttgcacacgcattatttcaacaaatcgattgattaactttaaacaagtactattatgtcagatatcaaactagcctgcgatgtggtggaacaagtcaagacgatttgcgacaagcacgggaacaatgcgggcgaattaatcaatattttgcatgaagcgcaacatctgcacggctatctgcccgaagagatgcaacggatcatagcctccaaactcagaatccccgtgtcgaaagtctacggagttgtgacattctacaccttctttacgatgactcccaaaggaaagcatccgatttccgtctgcatgggcacggcgtgctacgtacgtggttcggagaagttgctggaagagttcaagcgggtactcggcatcgaagtcggagaaaccacccccgacggaaagtattcgctggattgcctgcgctgcgtaggcgcctgcggactggctccggtagtgatgatcggcgaaaaggtgtacggacgactgcaaccggtggatgtaaagaagattatcgaggaactggaataagtctcccccgcccttcaaaagaggatgtgacgtatcgggtatccgatatgtcacgcatcttctttggggtcatatccccacttcacataaaccgctccccaggcaaatcccgcaccgaatgcggtaaatatcagattatcgcctttcttcagttttttctcaaaatcccagatgcagagcggaagcgtgccggcactggtgttgccataacgttcgatgttgaccatcactttctcggacggtacttcgagtcgttgcgccacagcggtaatgatacgctggttagcctgatgaggaatcacccagtcaacctcttccttagtcagatggtttctggcgataatagcttcacaggaatccgacatattcgctacggcatacttgaacaccgtgcggccttcctgataaatataatgcagatgatgatccaatgaataataggaaggaggacatacggaacctcccgcttttatatgcagaaaaggcagccctttaccatccgttctcaacaccgaatccatgatgccgacctcttccgtagtcggttccagcataaaagcggccgcaccgtcgccaaagatagggcaagtggcacggtccgtataatcgattacggatgacatcttatcagcacctacaataataatctttttatatttccccgaacggataaaattcgctcccgtttccatcgcatacaggaaaccgctgcaaaccgcctgcatatcgaaagcgaaagcattcttcagccccagcctttcgcacaagatagatgccgttgaaggaaaacgatagtccgaagtggtagtggcgacaatgaccagatcgatatcatcgggacgactctttgtgcgttgcatcaactgcttggcggccttacgggccatatacgaagttccaagcccctcttcattcaagatatgtcgttcttttatgccgatacgccccatgatccattcgtcggtggtatccaccattttagaaatttcatcattagtcagcacataatcgggcacatatcccccgaccccagtaattaccgcatttattttatccatcaagtctattttcagaattacaaaaatgtgatatctcaaaaaaaatatcgggcgcaaatatacagaaaagagaatgatatacaagagaagagtactagaaataccagacactttgacctatgaaaagaacttttggctaaagaacgagaagttttgactaaatttcagattcagcggagagagcgggattcgaacccgcgatacacttttggcgtatacacgctttccaggcgtgcctcttcaaccactcgagcatctctcctttcaaaaaactcaataaacactaagaaaacgctcccgttttcgtttcacgacatcggaggcgtcgccctccataaaaacaaaaaagcagcccaaaagctgcttcccagcggagagacaggctctcgaacctacatattcaagaaatatcataaaattgcaaatcattaataatcaagcactatttggagtacatagtaaatctaaatctttctgaatatcttttgctattccaaatattgggtgtatatttgggtgtagaatttcaaacacacccaattatgaatatcaaacgaaacatcatttttgcattggaaagccggaagaagaacggtgtgccaatcgtggagaacgtgcctatccgtatgcgtgtcatatacgcaagtcagcgcattgagtttacaacgggttaccgcattgatgtagccaagtgggatgctgacaagcagcgagtgaagaacgggtgtaccaacaaactaaagcaaagtgcatctgaaatcaatgccgatctgctgaaatactataccgaaattcaaaacgtgttcaaggaatttgaggtacaggaagccatgcccactacccaacagctaaaggacgcattcaacctgcggatgaaagatacaagtgaagaccaggaagacgtaaagataagtttttgggaggtattcgatgaatttgtaaaagaatgcggcaaccagaataactggactgaatccacatacgaaaagtttgcagccgttaaaaatcacctcaaggagttcaaggaagatttaacctttgaatatttcaatgaattcggactgaacgaatatgtcaatttcctgcgcgacaaaaaggatatgaggaacagtaccatcggtaaacaaatgggattcctcaaatggttcctgcggtggagcttcaagaaagactatcaccagaatatagcatacgatacgttcaaaccgaaattgaaaaccacccccaagaaggtaatcttcctgacatgggaagaactgaacagacttaaagactatcagatacccaaagacaaacagtatctggaacgtgtccgggatgttttcctgttctgttgctttaccagtctgcgttattcagatgttcgcaacctaaagagaagtgatgtcaagtccgaccatatagaagtcaccaccgttaaaacggcagatagtctgagtattgaactgaacaagtacagtaaagccatacttgaaaaatacaaggacatccattttgaaaaccacatggtattgcctgttatcagcaatcagaaaatgaatgattatctgaaagaactgggagaactggcagaaattaacgaacctatacgtgaaacctactataaagggaatgagcgcatagatgaagttaccccgaaatacgcattgctcagtactcatgcaggaagaagaacattcatctgtaatgcgctggctctaggtattccggcacaggttgtaatgaaatggacaggacacagtgattataaagccatgaagccctacattgacatagccgatgatattaaggctaatgcaatgaacaagtttaaccaactataaaagtatcagtctgtttcacagattatccattattagagttatctttgttaagtaatagttagtaatatggaaaataacaacgaacataatataaagaaaggtcattttgatgcctttgtccatgctgtcggtgcggaaatagaacaggcacaagtccggctcattaccgcagccaatgcccagatgttgttccattactggaaaatgggcaattatatactgtaccaccaaaacctgcatggctggggtggtaaaattatcaagaagttggcacaggcaatcagattcaattatcctgaaaagaagggatattcggagcgtaatcttacttatatgtgccagtttgcccgtttatatccgttaaatgtacttcgtagttttattgaaacagattcaatactgtcagtccctaatattcaaaacattactaatgaagtccttaaactcaacagcgggcaatttacgcaggagcttactgcgcaaatacaatcagctgataatcaatctttagaaattacgcaggaggttcctgcgcaatttcagaatgtagaaaaaacagtagcaaccatctataaaataaaaatagaggatatagaagatttattcttggcgtcaccgattgcaaggataaattgggcaagccatatggtcatactcaataatccgcttccattgggtgtaagatactggtacatgaaacaatctgtagaaatcggttggagcagtaatgtgttgaaaatgcagattgaaagtaatctgtatgacagacaaatcaagagtaacaaggtaaacaacttcactgccacacttccggcacctcaaagcgatcttgccaattatctgttaaaagacccgtatatctttgacttggtaggagcaaaggaaaaggctgacgaaagggatatagaagaacagctggtaaagcatgtaacccgttacttactggaaatgggcaacggctttgcttttgttgccagacagaaacatttccagattggggacagtgactttttcgccgacctgattctatataatatcaagctccatgcctatgttgtcgtagaattaaaagcaacgccattcaaaccggaatatgccggacagttaaatttctacatcaatgtcgtggatgacaagttgaggggagagaatgacaacaagacaatcggtcttttgctgtgtagaggtaaagatgaagtcgtggcacaatatgccttggctggatatgaccagccgataggtatcagcgactatcagttgagcaaggcagtacccgaaaatctgaaatctgccctaccgagtatagaagaaatggaagaagaactgaccttattccttgacaaggacaagaacccttaatattaaatatatggcaggaaagatacagacgatgattccccaatacggagaactcaacagaatatacagagactatatagataattacgctttttcttttgacaggcagaaattcatatcggatttctatcaggagtataatgacatgaaatcctttgaagccgctatccttgaactggtgcttgacaagcaaaaagagcaatacaccttgatactcaacagtctgaaaactgaaatagaaaagagcatacaggcttatgagatacgcccgttaagtgacagagccatagaacgtgcttgctatcagcacatggaaaggtattctcaggaaattgaagcccagctggatgttacaagaagtctgagcaagccgctgaatgaagccaacaacaggtatgattccattggttacagggagcatacagccgaagaggaaaaacaggcagagaaagaatatgaacgctgcaaggctgaatatgacagggaaaaagccaaactgaacaaactctatgaccagcaaaaggctgcaagaacagaggcattccaatatatgaagaactgttgtgcggacatataccgtcaaaactgcctttttctggatatattgaagaaatacattcctgacggaaagcaagagaataaatcaagcgagccaatcagtcagcaggaaacgacagaagaacaacaggaatatttcagcatgaaattactttcgctcattcatgaggtgtgcgaaggagaacagttcgaagaaatttccgcaccggatttctatgccaatatgaatcttcacccctgcaactgtaagctgaaaataaaaccgagagagaaaatacgtgtatgctatctgatattcctgatgagcgagaaactctccaaacaggacagggacaaatggaaagacagaatactgaaactgctggatattgacgacagctactacaaatccaagtacaaggagcctgtttcagatttccccagtgacagcaaccaaaatttcgccaaggaaatggaacatatattcagataatccgtgatatatcctgatactttacgaaagttccacttttaccactcaaaataatttttgagtggtatttttgttttctgatattcaataagatacaatgatattcagtttgtaccgtccccatccttaccactcataaccctacctaattttgcatcgttcgagaacagaaataacagccagtgcgcagggctgattgtttaacgactaaatagattggacgatgacaaatatccaagaattattatcaaaacccgtctggcaaatgacaggcgaagaattcatattcctgagtaagcacgcttcaggtcaggccgaagcattgccgcaacccgttacagacacggaaaagaagtatgtgtacggaatactcggtatagccaaactgttcgggtgcagtctgcccactgccaaccgcataaagaaaagcggtaagatagacaaggcgattacccagatagggcgcaagattatcgtggatgcggaacttgcccttgaactggcagggaagaaaacaggcggacgcaagtaacgggaggaatcgctatggactatatgaaagacatccgggaaatatcggacgaacaggcgataattctctggcaagcctcacggctgagcctgtcgaaaagttatgagaaagcacctgaaatccttaaagtacatgattctgtcattgggacattgggtaatttcagcgcatccatcggcaaagccaaaagtaaaaaaacgttcaatgtatcggctatcgtagccgctgcattgaagaacggcacagtgctgcggtatgtggctgaactgcctgaagataagcggaaagtgctttatgttgatacagagcaaagcccttaccattgtctgaaagtcatgacgcgcattttgcgaatggctggtttgccagatgatagggacaatgagaatcttgaatttcttgccttaagaaaatacacgcctgagcagcgtatcaggattgtggaacaggctatttacaatacacccgaaatcggtcttgtaattatagacggcatacgggatatggtgtatgacatcaacagccccagtgaatcaacacgcatcatatccaagctgatgcagtggacggacgacaggcagatacatatccatacgatactgcatcagaacaaaggggatgagaacgcaagagggcacattggtacggagttgaacaacaaggcggaaaccgtattgcaggtagaaaaggacaagggcaacggtgacatcagccatgtttcagccattcacatccgggcaatggactttgagcctttcgcattccgtatcaacgacaaagcccttcccgaactcattgagggatacaaacctgaaacaaagaagccgggaagacccgaagaagagaagttcgacccttacaggcatatcaccgagcagcagcaccgtatcgcattggaagccgttttcgggctgaaagaggaatacggctacaaagaactggaagatgccttaatcaagacctatatgtcagtgggtgtaaagctgaaccataaaaaggcggtatcgctcatcaccatgctccgcaacaaacggatgatagtgcaggagacaggcagaaaatacacattcatgcctgacttccactattagcccatttccctgcaatcacttcactttattctcggggtgtatatattaggaatatagtgaagtgcttggggaatgggactaaatcacttcactttattaccgtatcctatatatacgagaatttagtgaagtgattatagaccgtacttcctaaaaaggtacgggcaaaaagaaaaataaaccaattcaccaactactaaaacaatcattttatggatatacagacagccaagcaaatcagaatagcggattatctgcatagtttaggatattctcccgtcaagcaacaaggtgtcaatctgtggtataaatcaccgttaagggaagaagccgaagcctcgttcaaggtaaataccgaacgtgaacaatggtatgacttcggtttgggtaaaggtggtggtatcatagaactggctgcacacctgtacgctaccgaccatgtaccttacatcttgaaacggatagcagagcagacaccgcacgtgcgcccggtatctttctcttttggaaagcaaaactcttccgagccgagcttccaacagttggagattgttccgctgtcatctactgccctgcttgcctacttacaaggtagaggaattaacataaaactggcgaaaagagaatgtagtgaagcacgtttcactcacaacggcaagcggtactttgccatcgcctttcccaatggttcgtgtggatatgaaatccgcaaccgctatttcaagggctgcatcgccccaaaggaaatctcccacatcaggcagtcgggaaaagcgaggaatacctgttatgtgttcgagggatttatggactacctctcctttttgacattgagacaagagagctgcccaaattatccggaattggacgggcaggactacattgtattgaactccgtatcgaatgtaaacaaggctctctatccgttgggcaattacgaacgcatccactgctttttcgacaacgaccatgcaggactggaagcactccggcaaatccgcatggaatacggcagagagcggtacatccgggacgcttcgcagatttacagaggatgcaaggacttgaacgaatacttacagaaacagattgaaagaaaaaggcagctccagtccgccaaaggggtgcgcagccaatcaccggaaaagaagaacggcttccagttatagcccactataactacacgcttcgctttcgtagttgtgggctctcccgaggggattagggctttgccctaatgacccactcagggcgtttcacccctgagaaccccgagcaaagagtgaccctctctttgcaatctccgcttatgggttacccctaagaacccctctgcgaaagcgagcaaagtaaatcaattgtaaacaaaggaaagaagctatggcaacaaaatcaagcatacatatcaagccttgcaacatcgcatcgagcgaggcacacaaccgaaggactgccgagtatatgcgtaatatcggggagtccagaatctatgtcgttcccgaactttccaccgataacgaacagtggataaatcccgacttcggcactcccgaactgcgaactcattatgacaatatcaagcaaatggtcaaggaaaagaccggacgtgccatgcaggaaaaggaaagggaacgcaagggaaagaatggaaagattatcaaggtggcgggatgctcacccatccgtgaaggagtattgcttatcagaccggacaccacactggctgatgtacgcaaattcggtgaagagtgccaaagacgctggggcatcactccgctacagattttcctgcataaagacgaagggcattggctgaacggtcagccggaagcagaagacaaggagagcttccaagtcggtaacagatggttcaaaccaaattatcatgctcatgtcgtattcgactggatgaaccatgaaactggaaagagccgaaagctcaatgacgaggatatggcaaccatgcagacccttgcttccgatattctcctgatggaacgtggacaggcaaaagctgtcacaggtaaagagcatctggaacgaaatgatttcatcattgagaagcagaaagccgaactgcaacgtatagaggaaaccaagcgacacaaggaacaacaagtaagccttgccgaacaggaactcaaacaggtaaaagcagagatacgcacggacaaactaaagaaaacagccaccaatgctgctaccgccatagcaagcggtgtaggttctcttttcggaagcggtaagctgaaagaactggaacatcacatcgagcagctacatcaggaaattaccaaacgggacaaagctactgatgaattaaaaattcagatacaacaaatacaggaacagcatagcagacaaattcgtaatcttcaaagaatacataatcaagaacttgaagccaaagacaaggaaatatcacgattgagcaccttgcttgaaaaagcccacaaatggtttcccatgttcaaagagatgttgagaatggaaaaattatgcgctgttatcgggtttaccaaagacatgatagaaaacctcttgacaaaaaaagaatccatacaatgtagtggcaaaatttattccgaagaacacaggtggaaatttgacatcaagaatgatatttttagggttgagaaacatccaatggatagtggtaagcttatgctgaccataaaccgacaacccatagtacaatggtttaaggaacaatgggaaaagttacagcagaatctacgtaactcggtgcagagagagcaaaaatccagaggatttagaatatagaatagcctattattaataaaatcaagtatctatgcatccaaacagattgtttttattacagaatcaaaatcctaagaatttataaaaaatgaagcctaaagaagttttggaaaaatggatagattgctttaacaaagcagatgcttatcatatagcagagctgtatgctactaatgcagtaaatcatcaagtcgcaaacgaaccaataataggtaaagaatcaatctacaaaatgtttgtgaatgaatttgccactgctaaaatggtttgtatggtggaaaatatttttgaagatggcgaatgggctatcatggaatggaaagactctcttggacttcgtggatgcggattttttcatgtaaaagataacaaaatcgtctttcaaagagggtattgggataaactttcattcttgaagcaacacaatcttccaattgaataagtactatcagaatacggactgggaaattgaaatacccagtccgagttatataatgaattttacttgttaaactatttaaagtcagttggataacaaaccatacctttcacattctcagtagctccaggtattaattcagccaccatgcaatattcatgagagacttcgaaaggaaattcaattcctaaatcgatagccttgcgatagccaaatcgaggataatactctttatgccccaatacgactgctgtgccgtaacccaaaagtgctgccctctgatgggcttactgaatcaacatccccccccaattcccttacgctggaattccggcaagactgccaatggagctacactcagggatgtgacagactgggtgtcactgtctatctttacttctgtaagtaagatataccagacaatttgtttttctgtcattttcttgttcttatctaattgttaggctcattgttgttatacattgtttaattatagataaatcgtgaatatccttctctcttaaatcgtagcccgaatggaatacttgttgcccttttgcagaaatgcaagggatgcttctgccttcaaagactgctgttccaaaatagtccggttgaaattcataccagcctccatccaagtcggcttgtttggaagtgccgtccgcattcaagacaaaaggatggatatcaatatagcctaattctttgctatacagttccacacgggtgggcaaccaatttgtttcaatttgatatcctctctcctgcaaaagatcaaggagttggtctgtataattggcatcaaaatcaatgtcaatatctctatgcaagcgggtttgctgtccgtacaagacatccactccccagcctccatccaaccaaaactgcatgtccaggctttccaacaagtccaaaacttgaaataactctgtaatcgtagtgtgttctttctttgtcatataataattctttaataaataatactatgcgtaattatccaactgcttgattgaagaaataaaatttgcacccactccaatcagaaagataacccatccgctgatcataaagacggatgtgataccccatgcttccacccaatatcctgaagctacgatacccagcattgatggaaaggtactcaaactaaagatgagagaaaaagtccgtccaagcatgtccgaagccaagttctgctgaataatagcgatgaaaagcgcatggtaaatggaataggctatgcctcctgtaaatgttaggcaaacaaaacctataaatgcgcttgatggtaaataactggcgctaatcagatacaatcccaatatcacataagccgtatgcatcactaatgtttgcttgcttttcaaagccttacaggcaagtactaaaccgcccaacaatgcccctgagccccaacccatttccacaactcccatttgcaaaatgtttccgttgaaatgcagaagcgtcataaaaggaaataacgtaaaaacaggcataaggacaaaagtcaccagcgtaaagcatacgaataaaggcaaaatgcccattgtacgccgcaaggtatgccaacattccgtcagttcttttttgaaatctggaagaactttcgttttttgaagagaaggaatctggacacaaagtaaggtcagacaagcagcaacagctccgatcacatctatgagcagaatatactgtatgggaagccaaacaacgaggcttgcccctacaacgggagctatcacctcactgaaggattgaatggaatggtacaaacctgataccctgacaagatggtgcttgggaaccagtaaagggatgcttgcctgtaaagcaggtgcatgaaacgtactgcctattgaacgacaagcagtcaatagataaaaaaaagaaaggtctttataacccttggttatcacaataaaaagacatagggtacagaacgcgatgaacaagtccgaataaaacatcgttttctttcgattccatctgtcaacatagaccccggcaaacaagcctaatacaaattgtggtaaaaatccagctaaaatagccagagataaagctgtcggggatttaaattcgttgctaatccaaaaaataatggagaagccaacaatcgtacttgttaaaatagatatgagttggcctattcctatcacggccaaagttgatttccaatgattcattgtgctaatatttcatgcgtttatagataagtactttcgtacattaagcaaaacgaaattctatccacacaaaaaacttgtattataatccactcctgacgttggaatacaataacaaatactttcaggacgatgtaaagtcctgaaaaatcaaactgaatggatagataaatattagtcttttctcatcggattcttttaatatcgctactcttttattatgtagtggttgtattatcttaaataaaacaaaaatacccgactttacattcttgggtgtaaaactgggtgtttgttttgcaatctgctgattttcagcgtttgttgcggagagacagggattcgaaccccgggtacctcgcggtacaacggttttcaagaccgccgcaatcgaccactctgccacctctccaaaacttccttatcagaagtgcttttcgttaaaagcggtgcaaaggtacgaagatattttaaacttgcaagagttttcactaaaaatttaatctaatcttttcctaaggatagcaattaataggtattttatgttgaaaagcataaaatagagcatatttatgctgattatatgaaaaatgattgtaactttgtgcgctctaaagaataggataactacaacctctaattttatcattttatggaattaaacaagatctttaaagacggtctttggagcagcgaaatcaacgtcagagatttcgtaagtcataacatcactccgtattacggagatgcttcattcctcgaaggacctacagaacgtaccaaagccgtatggaaccgctgcctcgaagcgttggcagaagaaagagaaaacaacggtgtccgctcattagataatgttaccgtatcaaccatcacttcccacaaggccggatatatcgacaaggaaaacgaactgatcgtcggcctgcagacagacgaacttctgaaacgtgccatcaagcctttcggaggtatcaacgtagtcagcaaagcctgtcacgaaaacggcgtggaagtggacgaccgcgtaaaagatattttcactcactaccgcaagacgcacaacgacggagtattcgacgtatatacggaagaaatccgttccttccgttcgctgggattccttaccggacttcccgacaactatgcacgcggacgcatcatcggtgactaccgccgtatggctctttacggcatcgaccgtctgatcgaagcaaagaaggaagatttgcacaacctcaccggtccgatgacagatgcccgtatccgtctgcgcgaagaagtggcagaacagatcaaggcactgaaagacatgaaagtgatgggcgaatactacggtctcgacctgagccgtcccgcttacacggcacaagaagccgtacagtgggtatatatggcttaccttgccgccgtcaaagaacaagacggtgccgccatgtcactgggtaacgtttcttctttcctcgatatctatctggaatatgaactgagcaaaggaaccatcaccgaatcgttcgcgcaagagctgatcgaccagtttgtcatcaaactgcgtatggtccgccacctgcgtatgcaatcatacaacgacatctttgcaggcgacccgacctgggtaaccgaatctctgggcggacgtctcaacgacggacgtaccaaagtgacaaagacctccttccgtttcctgcagacattgtacaacctcggcccttcaccggaaccgaacctgaccgtactctggagcccggaacttcccgaaggattcaaagaattctgtgcaaaggtttctatcgacacttcttctatccagtacgaaaacgacgacctgatgcgtgaagtacgtcagtccgacgactacggaatcgcctgctgcgtatcataccaggaaataggcaagcagattcagttcttcggtgcccgttgcaacctggccaaagccctgttgcttgccatcaacggcggacgttgcgagaataccggtacagtcatggtgaagaacatccccgtactgaccagtgacacgctgaagttcgaagaagtaatggacaactacaagaaagtactgatcgaaatcgcccgcgtatacaacgaagcgatgaacatcatccactatatgcacgacaagtattattacgagaaagcccagatggctcttgtagatacgaacccgcgcataaaccttgcttacggtgtagccggactttccatcgcactcgattcactgtctgccatcaaatatgcgaaagtaactgcccgccgcaacgatatcggtctgacagaaggcttcgacatcgaaggagaattcccttgcttcggtaacgacaacgacaaggtagaccaccttggcgtagacctggtatacttcttcagcgaagaattgaagaaattgcctgtttacaagaatgcccgtcctaccctctccttgctgactatcacttccaatgtgatgtacggcaaaaagaccggtgctactcccgacggacgtgccaaaggtgttgccttcgctccgggtgccaacccgatgcacggacgcgacaagaatggtgcgatcgcttctctgagctctgtagcgaaacttcgttaccgtgactcacaggacggtatcagcaacaccttctctatcgttccgaaatcactgggtgctacggacgaagaccgtatcgagaacctcgtaacgatgatggacggttacttcaccaaaggtgcccaccacctgaacgtaaacgtactgaaccgtgatatgctatacgatgccatggagcatccggagaactatccgcagctgaccatccgcgtttccggttatgccgtaaacttcgtgaagttgagccgcgaacaccaactggaagttatcagccgtagcttccacgaacgtatgtaatctattactctatatgatgataaacgtacattcatacgaaagtatgggaacattcgacgggccgggcttacggctcgtcgtttttcttcaaggatgcaacttccgctgcctctattgcgccaatccggatacgatagcaggaaagggaggcacgcctaccccaccggaagaaatcgtccgcatggcaatgagccagcgccccttcttcgggaaacgaggaggaatcactttctctggaggcgaaccgacgtttcaggcgaaagcactcgtcccgctggtccgcgaactgaaagaaagaggcatccatgtctgtctggacagcaacggaggactttggaacgaagacgtagaagaattattcaagctgaccgatcttgtgttattggatataaaggaattcaatcccaaccgccatcagacgctcaccggaagaagcaacgagcaaaccatccgcacggccgcctggctggaagaacagggaaaacctttctggctgcgttatgtgctagtgcccggatacagcgattttgaagaagacatacgcgcactgggagaagcactcggaaaatacaagatgatccaacgggtggaaatactgccttaccatacactgggcgtacataagtacgaagcgatgggacaggaatacaagatgaaaggggtaaaagaaaatacccccgaacagcttgaaaaagctgcggaggtattcaaagagtatttcactacggtagtagttaattaatggagaattctccaatgacctcaaagcaagggcattctttaatccgttcccaaggatctacgatcccattatagttggtgtcgggacttaaatcccgatgccctactactttagcttccggataacgctgcaacaattcgtgtaccaagcgatgtagcgcctccttctgacggggtgtacgcgtatccgccgcttttccattctcatccagaccgccctcatagcatacacctaagctgatcgcattgtagccacgtgcatgagctccgaccgtatcttcatcccgcatcggctcaatctcgcccgacttgcgtatataataatgatacccccagcacgaaaagccacgataacggtgagccgtatccacatcctttgccgtaaagtcgcaatcgacacgggtggcggaacaatggatcacaatcagactaatctttctcatgttccttttccctttccgtcgttttcactttgcacacctccttacaagtagtatgatagcgcacttctctcaccaccttgtcccgctttctctttccgaagaaaggaatcagatacatgatcacatctaaaatccggtttactatttctttcatcttatcaaaatattaatggaagttattctaattcgttattaccttgacccgtctgccaattataccgtagggtccggagcctcttcatcaccggagccatcaccaccggaatccggattcttgtcagggtcttctcccccgccatcgcctgcacccgcctgcgccaccgcacgagtcagcacttgctggtaactcagaatcttcatcaattccgccagcgttttaccggggcggaaaataagatgcgcccccttaatcatcgaaccggaaaattccttgaccgatgccgcaccttcactgttcagtcctatctgcaaactgcccaaatcacccagtctcgcaattcttcctgccttcaacgcacgcttcacttcgtaaagaatacccgaaatagccgcacgtacatccgtttccgtacaagtagaacgactggtgatcgcttcgcacaactcttcaaagtccagctcacccgacgcctgcgcctgtgcataatactttgccggttcactcttttttgcaggattcttgcgcggcaccactgaataagatactgtcattgccataataaaataattttaaagtttataatacgtaggatgcatccctttcttgttaacagcacaaagataaggatagccggacaagccatattccccaacgaagtttcttgattcccaacgaataaaaatgaagtcaaacctttgaaaaacaaggaattttatgtaactttatagcataaaacaagaagaaaacatcatgaattacaaagaagattctttccttatccgcacctataccaaagcggaactggctcacctttacaatccccatgtctgcctcaaagttgctttacaaatacttcgtcgttggattatttacaacctccctctcctgcacgaactcgaacaggaaggctaccgcgcacgcaaccgtctcctttcgccgaaacaagtggcaactatcatacactttttgggcgaaccgtagtaacttattgccattttatacaaagttcctttacacatttccgcaaagaagttcctttgcatcgacaaacaataatcaaaataaaaatgaaacatttcaccatatttcaaggtttctactacgcaatagcagagatgaccgaagaagaaatagtgtccactatcggcagttttacctaccgggaaaaagtcgaagaaatacgccgcatctttgcagagcaaggagaaaaggctgccaatgagaagaaaaaagaattgccggcaatcgccttctccgccagctaccgaggaaggcgtaccaaagtgaacctcgtcaaatatctgggacacatcgtgatagacatcgaccacctcagcaaagaagaattggcacgcatcctccctatcatcaagagatgcgattacacccgcatcgcctttatcagtcccaaagggatgggcgtgaaaatcatagtgcgcgcatgccatccggatgagacattgcccgaaacccttcaggaaatagaagacttccatcatgcagcttacaccagactcgtttctttttacaccgaactctgtcggatagaaatcgacacctccggtcaggatgtggcacgcacttgtctgttctcttacgatccggagatctatttcaatccgaacgctgacgcttttcttgtagatcaacctcaggcatcctacaagatttcaaatcgtaaaaatctctccggcagtaaacaacagactcctccggacggcaccccgacgaatgaagacacagcactcaacgcccattccgccaacgcttctttggtgttgactttaacttactatcacaacaagtccgaaaaatacatagcaggcaaccggaacaattatctgcaccatctctcatgtaccttcaatcgctacggcattccgcaggaggaaacatccgcctttatcaaaagccagtttacagactttccggcggacgagacagtctctttgatcaatagcgcctacgctcataccgacgaatttaatacctgtaaactgaatggcacgcagaaacgaatattacggatagaacaatatatcagcgagcactacgaaacacgctacaatgaagtgctgcatatcatggaatatcgcagaaggcgtcccgacaccgagaaaccggagcctttccgcatcttggatgagatgatggaaaacagtatctggatagaaatcaacgagctgggatatccctgcactgtcaaaacaatcgaaaatctgatttactccgatttcagccagtcgtatcatcccattcgcgagtattttgaattactgcccgaatgggacggaaccgactatatccgtatcctggcggatagtgtccagacgagtcatcaggagttttgggcggaatgcctggaacgttatctggtggcgatgtgcgcagcggctactcaggagaatattgtcaatcacacggtacttctgctatgcagcgagatacagaacataggaaagactacctttatcaataatctcctgcctcccgaactgcgtgcttatctctctaccggactaatcaattcgaacaataaagatgatttagccaaaataacgcaggccatgctgatcaatctcgacgagtttgaagggatgagcggtcgggaactgaatgcattcaaagatttggtaacgcgcaaagtgatcagtttccgtctgccatatgcacgccgttcgcaaaacttccctcatacggcctcttttgcaggaacctgcaattatcaggaagtgcttcacgacacgacaggcaaccggcgtttcctttgttttcatccttattccatccaatttattaccatcaattatgcgcagctctatgctcagatcaaatatctgctgaataagccggggtaccaatactggttcacgcaagcggacaatgaacggcttgaagagaataacgaggctttcatctttcattcaccggaagaagaaatggttcttacgcatatccgcaagccggaacgttttgagaaggtttattatctgactgtcagtgagattgcggaactaatacgtgagcgtaccggttatcagtattccatcggatcaaaaatacagttggggaaggtgatgactaagcaccattttgaatctaaaaaaggaaataacgggcgccgatatgccgtatttattatagatatcgagcaggtaaaatcaaacaggctgtatgaatagaagcgggaaagccttgtgaatatagcaaaatgcagagtcatcttgacagatactctgcatttattgtttttacaaaatcattgaaaattcgattttacagcctaacgcattcattatacgatagaaagtagatactttaggctctgtctgaccactttctactcttgaaatataagaacggtcagagccgatacgccgggctaattcagcctgagtgattttagccttttttcttgcgtcctcgataatctgtcctgtataaaaggcgtaggccttttcttctgcctctgcacgagaagctgttccttccttaccaaaacgctcatctattaatgcactgacattaaagaattcctcatttgtttttgcttccataatactcctttcttaatatctttgctttatcaatttctttctttggtgttttttcggttttcttttgaaaaccgttaaacagaatcacaatacgcccttcgtcgaaacaaaagaatattctatatatattgctttggtactcgatacgaagttcataaagtccttcttctatcaaccgcataaatttcaaaggtattctgtcttgtgtctgcaataacattagcacatacaatatcttatcttgggtgccagcatctaaattttcaaagaattctttgaagtatcctttatatgctattatttctcttttcataacgcaaatataagaaatgttgttcaactatacaacacatttcctcgttttatattatttttcatcatcttcacccacaaaagtgagaggagtgagag

SEQ ID NO: 102 - DNA, 27919 bp, Bacteroides thetaiotaomicron
gtttttgtgtaatctgcatataattagtatattacagaatgagagatactttttaaataggtatctctcattattttctccctagaatcgcttcatttcagtctatctctcactctttttgggggatatccctcattccatttctttgccctttgcgtaagtagttgccgaatgcatctagcatcttggttgctgtttacttgttgtttatatattatgttacttatctctatggcatttgatgcctttattcgtgtgttattttaccgacatcttcatcgttccacccgggtgaaccgatcgttgtacccttgtaaacaggtctgcgcacctaggtggacatgcttgttcacctgggtggaacgatgaagaactccctttgaaaatgcgacaataatagttgtaaagcaggttattatagggttgtttgcatactattgaacggtaaaagaaatgtgcttaaaggcttttccgggaaagggaaagtatatcggcatgcaattatctggcggatatcggaaagcagaatgagataccctgttttcatgggtttgaattaaattaattccgccaacaggtatgttttagtgagaatgtagcggtattactagatagatatagaataaaattagtagctttgctgaataatttattgaacaaagctatgatagaagttatggagtccgctttacagaaagctgcgggcgaaggaatggatgaatttatccaggtttttactgataaatataaggaaataatcggtggtgaattgactgctgacacaatgccgttgttgacaggtgaacagcattcattgctggcttatcagatttttcgtgatgaaataatgttcggcggattctgtcagttgattcagaacggttatggcggatatatctttgataatccttttgcaaaagtgatgcgcctgtggggggcggaagagttctctaaattggtatataaagccaagaagatatatgatgccaaccggaaggatctggaaaaagaacggacggatgatgaattcatggcgatgtatgagcaatatgaggcttttgatgatttggaagaggcatatttagatatggaggaacaagtgacaacactggttgccagctatgtagataatcacctggaactttttgcaaaaataataaagtaaacgatgcagtattttttaagtatctgcatttattaattgtgaattagaatttatatctttgcaaactctaaaaaatatgtttatgaaacaaatgaaatttttattagtagctttaatgacggttttaatggggatgtctgttacttcttgtatgaatggggatgataatacgatatataccggacctgcgttcgctaaatgtacaaactattttcctgctacatttgaattggctaatgggcagaaattagttgtgaatgaattgtcaatgtctaacttgaatataggagaaatctatttcttttactatcagtttgacacagcgcaacagccagggaattctcagactcttgatgtaacactttatgcaggaagtactccgacttctattagtgcaaaatctactgaaggaccagagaaagcggcagattataacgaagctactgcacctttatatacttttaatagcgatacatcaactcagccgggaatactttttgatcaatatcttgtaattcctattatgtattgggtaaaagtagagagtacagacgaaaagcagaaagaagaacttaataagcattcttttatactcacatatgattttgatgaattggcatcagggtcaactgaacttgtattgaatcttaatcatgtgattaaagatggttcagaggagactgtgactcgtgataagtatacttctacttataaggcatataatctgtctagtgttatttatgcattcaaacaagctactggagtagaaccaactaaaataaaagtaaatgcaaagaccaactcctcaaagaattctttggatggtgccgcaaattcaacgtggagtgaaacacttaaaacaaattgaactacaaagaattatttaatatagcaatgaaattgatttcctctccggccaaggcctgggaggaaatttctatggaagaggataggcgaaaagtttttatggcttttgtctatcctatgattggtttatgcggtttgtccgtctttatcggctctttgctgacgaatggatggggaggaccgcaaagttttcaaatagcgatgaccaattgttgtgccgtagctgtggcattgtttggtggttactttctggcggcctatgcaattaacgaaatgggagtaagaatgtttgggatgcctgccaatgctccgttgacacaacagtttgccggatacgcacttgttgttcccttcttgcttcagattgtgaccggacttttacctgattttagaattattgcctggctatttcagttctacattgtctatgtagtatgggaaggagctcccatattgatgcaagtggaggaaaaagtacgattgaaatacacccttttctcatcagttttgttaatactatgtccgacggtgattcaaattgtatttagtaagttgatagccatacttaattaatgtgtaaagatgaaacaaccttctgtaaatatcaagaataaacgtgctacatttgactatgagttgatggatacctacacggcaggtattgtattgacaggcacggaaattaaatccattcgtttaggaaaagcaagtctggtggatacgttttgttattttgcgaaaggcgaattatgggtaaagaatatgcatatcgccgagtacttctatggttcgtacaataatcatacagctcgtagagacagaaagttgttgcttaataagaaagaattggagaaaattcaacggggaatgaaagaccccggttttactaccgttcctgtgcgtttgtttatcaacgaaaaaggtttggcgaaactggtcgttgctttggcgaaaggtaaaaaacagtacgataaacgggaatcaattaaagaaaaagatgaccgcagagacatggcccgaatgtttaagcgataagatggctttatagcgtaatagtaagataagatcgtgataggtctaagataggcagagtgacaattaggtgttaatgtaataaggtaagaatgaaaaagacaatttctcagattgtatccgagcgtattctgattctggatggcgcaatgggcacaatgatccaacaatataatcttaaagaagaagattttcgtggtgaacgttttgcgcatattcccggtcagttgaaggggaataatgatttgttgtgtctgactcgccccgatgtcattcaagatatccatcgtaaatacctggaagcaggtgcggatattatcgagaccaatacattcagttctacaactgtctcaatggcggattatcatgtagaagaatatgtgcgcgaaatcaatcttgccgctaccagactggcacgtgaactggcggacgaatatacggcaaagagtccggataaaccgcgttttgttgcaggctccgttggacctactaataaaacctgttctatgagcccggatgtgaacaatccggcgtttcgtgccttgtcttatgacgaactggctgcctcttaccagcagcaaatggaagccatgctggaaggtggggtggatgccattcttatcgaaaccatatttgatacgctgaatgcgaaagctgccatctttgcagccggacaggctatgaaggtgacaggaatagaagtccctgttatgttgtctgtgacggtatccgatatcggcggacgtacattgtccggacagactttggaagctttccttgcttctgtgcagcatgccaatatattttcagtcggattgaattgctcctttggtgcccgtcagttgaagccttttcttgaacagttggcttcgcgtgcaccttattatatcagtgcttatcctaatgcgggccttccgaatagtctggggaaatatgatcagactcccgcagatatggctcatgaagtgaaggagtatattcaggaaggattggttaatattatcggtggttgttgtggtacgacagatgcctacattgcagaatatcagacactgatagcaggtgccaaacctcatgttccggcacccaaaccggattgtatgtggctttccggactcgaactgctggaagtgaaaccggaaatcaactttgtgaatataggtgagcgttgcaacgtagcaggctcacgcaagtttcttcgtctggttaatgaaaagaaatatgatgaagccctttccatagctcgtcagcaagtagaagacggagctttggttattgacgttaatatggatgatggtctgctggatgcccggactgagatgactacttttctgaatctcatcatgtccgaaccggaaatagcccgtgtacctgttatgatcgactcttccaaatgggaagtgatcgaagccggattgaaatgcctgcaaggcaaatcaatcgtaaactcgatctctctgaaggaaggggaggaagtatttctggagcatgcccggatcatcaagcaatatggagcggcaactgtcgtgatggcttttgatgaaaaaggacaggcggatactgctgcccgcaagatagaagtgtgcgaacgtgcatatcgtctgctggttgataaagttggattcaatcctcatgatattattttcgacccgaatgtgcttgcggtggctacaggaatcgaagagcataacaattacgccgtagactttatagaagctaccggatggatcaggaagaatcttcccggtgcacacgtcagcggcggagtgagtaatctttctttctctttccgtggcaataattatattcgtgaagcaatgcatgcggtattcctttatcatgccatccagcaagggatggatatgggaatcgtcaatccgggaacttccgtactctacagtgatattcctgcagatacgctggaaaagatagaggacgttgtattgaatcgtcgtcccgatgctgccgagcgtctgatagaactggcggaagcattgaaagaaacgatgggcggtacttccggtcaggcagctgtgaagcaggatgcatggagagaagaatccgtacaagagcgtttgaaatatgctttgatgaaaggaatcggtgattatctggaacaggatttagcggaagctttacctttatatgataaagctgtagatgtaattgaaggtccgttgatggatggaatgaattatgtcggcgagctttttggcgcaggaaaaatgttcctgcctcaggtcgtgaagactgcccgtactatgaagaaagccgtagctatactgcaaccgatcattgaatcagaaaaagtggaaggatcatcttctgccggaaaagttctgcttgccaccgtaaaaggggatgtgcacgacatcggaaaaaatatagttgccgtcgtaatggcgtgcaacggttatgatatagttgacttgggagtgatggttccggcagaaaccattgttcagcgtgccatagaagaaaaagtcgatatgatcggtttgagtggcttgatcacaccttctctggaagaaatgactcatgtggctgccgaactggagaaagccggactggatattcctctgttgattggcggagccactacttcaaagatgcatacggcactgaaaatcgcacctgtatatcatgcgccggttgtacatctgaaagatgcttctcagaatgccagtgttgcttcccggctgttgaattcgcagatgaaagccgaactgattaatgagttagatgcggaatatcaggcacttcgtgagaagagtggactattacgccgtgaaacagtatcgttggaagaagcccagaaaaataagttaaacctattttaaagacttgtcacaatgaaaaagattttttctttcttgtgtatgctcatggcaatgactgctatgatctcgtgttcttcctcaaaagaggaaaaaggaacaaccggcaccggaaatgccgctttggataatatctttgagcgtaagagcgtgcgtacttacttgaataaaggggtagagaaagagaaaattgatttaatgcttcgtgcagggatgtctgctccatcgggaaaggatgttcgtccctgggagtttgtggttgtttccgaccgtgcgaaactggattcgatggcggcggctcttccttatgccaaaatgttgacacaagcccgtaatgcgattattgtctgtggtgattctgcccgttctttttattggtatttagactgttctgctgcagcacagaatattttgctggctgctgaaagtatggggctgggtgctgtatggacagctgcttatccgtatgaagatcgtatggaagtcgttcgcaaatatacccacctgcccgagaatattcttcctctttgtgtcattcctttcggctatcctgcaacaaaagagcagccgaaacagaaatatgacgagaaaaagatacattataatcagtattagtaaacaaaagttttgtcttttcaataaattccttacatttgtggcttaattgattaaaatctgatacgcaaatgtttggaatagatgacccttttatagtcttgccatatatcctctcagtgatatgtgtgatttttgctgcctggtttgggctgaaatattggaataaggacgacgataaagacgaaacgcgatgaatacatttactcttggcttgattgtgatagcttatctgctgtcattggcctacctcggttttttaggatataagaagactacgaataccagtgattatctggttggcggacgtcagatgaatccgatagtgatggcgctttcttatggtgctacgtttatctctgcgtctgctatagttggttttggcggagtagcggctgctttcggtatgggtattcagtggctgtgtttcctcaatatgtttgtcggggtagttatcgccttcatattcttcggtttgcgtacccggcgcatgggagcaaaactgaatgtcagcacttttccgcagttattaggccgtcattttcgttcccgtaatatacaggtgttcattgcagccgtcatatttataggtatgccgttgtacgctgctgtggtaatgaaagggggcgctgtatttattgaacagatttttcagattgattttaatatatctctgctgatatttacgttagtcattgctgcgtatgtgattgcgggaggaatgaagggggtgatgtatacggatgctttacaggcagttatcatgtttggctgtatgttgttcctgttgttctctttgtatcaggtgcttggcatgggttttacggaagcaaacaaggaattgacaaatatagcccctctggttccggaaaagttcaaggcattggggcatcagggatggaccgcaatgcctgtgacaggttctccacagtggtactcattggttacctctcttattttgggagtaggaatcggttgccttgcacagcctcagttggtggtacgttttatgacggtagaaagtagcaaacagttgaatcgtggcgtatttatcggttgttttttcctgattataacggtaggagctatctatcatgccggtgcattaagcaatcttttcttcttgaagacagaaggagccgttgctacggaagtgatacaggatattgataaaatcattccttatttcatcaataaagctatgccggactggtttgccgctttgtttatgctctgtatcctttctgcaagtatgtctacgcttagttctcagttccacacaatgggagcatcggttggttctgacatttatggtacttataaaccccgttctcgtggcaaattgacaaatgtgattcgtttgggagtacttttctctattttggtcagctatattatttgctatatgctgcctcacgatattatcgcccgcggaacttctattttcatgggtatctgtgctgctgcatttcttcctgcctacttttgtgcattgtactggaagaaagcgacgaaacagggagttatggcaagtctctgggtaggaactttaggcagtgcttttgcactaatattccttcatcagaaagaagctgccgcaatgggaatatgtaaattcctgtttggcaaggatgtattgattgagacatatccgtttccggtaattgaccctattctctttgcattaccattgtctatactggctattgtggtggttagccttttgacgggcagaaacaagtagtaaataagtaataggtaataagtaataggtaataagccgtgcggatacactattgataagctacggttattacctattacctgatacttattacttattttatcttttttttgtacgattcgaaccgggactgaatatcacgtacgaagttgaacgtttctatgccacggaaatatccatttttacaaacaggatcggtgaagtattcctcattgcttttgagcaggatgaagttttcgacgttgtctttccatacgaggttattctttccgtatttttttgctaatgccatggcgtcgtagatatgtcctaggccggcattgtaagaagccagtatgaagttgagccgttcctgtttgtcagggatcatattgaaacttcggtctgtggcggcaatgtatttaacggctgcttttatactttcttccgggttttgttctttacctgcgggtacgcccattgcgcgtgcagtggcaggcatcaattgcatcaatcctttggctcctgcccaagatacggctgttgtgtcaaagtttgattctgtataggcgagggatgccagcattcgccagtcccatccgatctcttgggcgtatttcttgaataaatcgtcgtaatgtgatatttttccttctttaagtgaaaggatgggggagtgtggcatcattttactattctcgaagtaacgcttcatacttgccgtataggcaggagaggtcatattttctttatgccagtttgtggcggcggctgccagttcgggactgtcttttcgtacagcccatgaagaacgctggtcaaaactgatagaaagatcgatattcagattgggatagtaagttttattcagtttggctaaatcattatcggctacggtatagggaatcttaccttgtgctacctgggtgattaagtcttccgcggtaacgctatctcccgttatcttatgaatatggataccacctcccagttcgttgttcagattcacgaggcgatcgtaatatttgcctggtttgacatatatatctttgccgataagttccgttacatctttcaatggtttatgctttccatttccttgctggacgataacctgatgggtgattatgtcttctccgcaatacaaaaggctgtctttccattctttggtaatcggcaggttgtaggcgatcatatctccttcgcctgactgtaatttctgaatcaattcacggacatttctggctacctcgattctgagtttcagtcccagacttttagcgaactgttcactgagttcgtattggaatcccatttcctgtccgcgataaatgaaatatgaagtagagctatagagtgtcagcacaaccagttctccactgtctttaatctgtggaagatcgtgtgctgtttcattcttttcggtatgatgtttgttccggcatccgaatacacagcacaaaagtataagaaacaaggggaggatcagtgtcttggcactcattctgaactctttatctttcattcttcatttttcaaatgtttcttgatatacattgttaatatatcgatagctactgcattgctgccgccttctggaacgataaggtccgcatagcgtttgcagggttctatgaattgcaggtgcatcggtttcagaacacgggtatagcgttccatgacagcttccgctgtccgtcctctttcgatgacatccctttggatgacacgtatcaggcgttcatcgggatcggcatctacaaatatctttagatccatcatattgcgtagcttcttgtcgcacaaggcaaggataccttcaataatgacgacttcacgaggctcgatgtggatggtttccggttggcgggtacaagtcagataagaataggtcggctgctcgatgctttttccttctttcagcatcatcacatgtttggaaagcaagctccattcaaaagcatccggatggtcaaagttgatattctgacgttcttcaaccggcacgtgactactgtctttgtagtatgaatcctgaggtaatagtactacttctccaacggggaggctttctattatttttcgtacgacggtggtttttccggagcccgttccacctgctattcctattattaacatctctttatagtgttatttgaaccaaatagagtaattttgcattagtaatgtaatgcattgacaagacaaatatagaaacaattcattaaaataacaacgtaatggtgaaacacattgtattatttaagttaaaagacgaagttcccgaagcggagaaactcgtagtgatgaataaatttaaggaagctatcgaagcgctccccgctaagatttcagtgatccgtaagattgaagtcggactgaatatgaatccgggagaggcttggcatatagctctctatagcgaatttgacacgctggaggatgtgaagttctatgcaacacaccctgatcatgtggcagccggaaagattatagctgaagcaaaggacagtcgtgcatgcgtggattatgaattataacccccaataatgaaaatgagaaaattaatttcttttctgcttttaagctttgtagcctatacattgcaggcgcagattaaagatccggtaaagtttaaaacagaactgaactctctttctgatacagaagcggagatcgtgtttacagctgccattgacaaagggtggcatgtttattctaccgatcttggagacggaggacctatttctgccacatttaatgtggagaagaagtccggtgtagaactggttggtaaattgaagcctgtcggcaaggaaatagctactttcgacaaactgttcgaaatgaaagtgcgctatttcgagaatactgccaaattcgtgcagaaagtgaagctgactggtggagcttatgcgatagaaggttatctggaatatggagcctgcgacgatgagagttgtctgcctccgacagaagttccttttaagttttcgggtgaagcaaaggccggaactacggctactcctgtagccaaagttgataagccggagacaaaagaggcggaagaggtaactgctcctgctgcgtccaaagactctgctgcgatgatggaactggttcctgcttctgctacggatgcaaatgccgatattcaaccagcagtagcttccggtgacctttggcgtccggtaatcagtgaattgcaggcactgggcgaggaacatactcagggagatatgtcctggatttatattttcgtgacaggtttcctgggtggattgctggctttgttcactccttgtgtgtggcctattatcccgatgacagtcagtttctttctgaaacgtagcaaagataagaagaaaggtattcgtgatgcgtggacttatggtgcttccattgtcgttatttatgtggcattaggattggctattacactgatatttggtgccagtgcgctcaatgctttatcgacgaatgctgtctttaatatccttttcttcctgatgctggtaatctttgccgcttcattttttggagcgtttgagattagattaccgtcaaagtggggcaatgcggtagatagtaaagcggaatcgactaccggtctgctgagtatcttcctgatggcatttacactttcactggtatctttctcttgtacaggtccgattatcggattcctgctggtacaggtttctactacaggaagcgtggtggccccggctatcggtatgttgggttttgccattgcattggcattgccgttcacactctttgctctgttcccgtcatggctgaagtctatgccgaagtcgggcggatggatgaatgtgatcaaagtgacgttaggatttctggaactggcatttgcgcttaaattcctgtcggttgccgatctggcttatggctggagattactcgaccgtgaaaccttcctcgctctgtggattgtcatctttgcattgctgggtttctatttgcttggtaaaatcaagtttccgcatgacgatgatgacaataaggtgggagtgactcgtttctttatggcacttatttctctggcgtttgccgtatatatggttcccggtttgtggggagctccgttaaaagccgtaagtgcttttgcgcctcctatgcatacgcaagactttaatctgtataagaatgaagtacatgcgaaattcgatgactacgatctgggtatggagtatgcacgtctgaatggcaaaccagtgatgcttgactttacaggctatggatgcgtgaactgtcgtaagatggaagccgctgtatggacggacccgaaagtgagtgatctgattaataatgattatgtgctgattactctgtatgtggataataaaactccgttgaccgaacctgtgaaaatcgtagagaacggtaaggaacgtactttgcgtacagtcggtgataagtggagctatctgcaacgtgtgaagtttggtgctaatgcacagcctttctatgtattgctggataatcagggaagtcctttgaataagtcttatgcttacgatgaagacattcccaaatatattgaattcctgcaaactggactggagaattatcggaaggaaaaataatccgaagatataactatcaatgagaagcggtctcactctgtagagtgggaccgcttcatttaaatagaatagaataaaactagaaataatgttttttacatgggtacttccattaccagaagtttggtccctttagtagcacggatagagaagcttttggtatcccatattccgatgccgtcacgtttggccagatgttcatcggccacgctgatctctccttctatcacaaacagataagctccgttaccttcctgatgcatacaatattcgatggttctttccgtatcgaagtctcccatagagaaccaggcatcctgtttgatggaggccggtgtcttgccgttcggtgaaatgaacagagataactcgttcggtttcagcagcggacgtatatcgaaattgttatattcgggtttcgtattctcgattcgggggaatacccatatttgcaggaattccaattgttcttccttgctgtcgttatactcactatgatagataccactgcccgtactcatcacttggatatcaccgggagtaatcgttttcgtattttgtacactgtcgccatgtctcagataccctttcaacggaatggaaattacttccatatttttatgtggatgagtatcaaatcccatcgacgggtctacactgtcatcattcagcactcgcaaggctccgaaatggattctttccggattgtaatagttagcaaaactgaatgtgtggtgggttttgagccagccatgattaaaatagcctcttgatgaagctctgtcgattacttttttcataatcttcctttcttttttatagaactttgttgtgtgctttgttcgcacttttataataggacaacaattaaagagtacacaaagttctcggccggaaactcaataagaaagaaggttatttttttatttcagaaaaaatacatacgtttgtaacatcataacaatacctttgtgcccaaaagtaaagaaaatatgtacgcaacagacacgcttatggacgaacgggagttagttctccgtctgatagacggcgatgaggatgccttttgcgaactctatgccgcctataagaatcgcttgctgtattttgcgatgaagttcgtcaaatctcgtgagtttgccgaagatatttttcaggacgcgtttacggttgtatggcaaagcaggcgttttatcaatccggatgcgtctttctcatcctatttatatacgattgtacgcaatcgtatccttaatcagatacgggatatggcgaatgaagataagttgaaagagcatatcctttctcatgcggttgattcggccaatgaaacgaataataaaatattgttcgatgatttgaaggatgtccttagccgtgcattggaacaattgactccccgtcagcgtgaagtctttaatatgagccgagatttacagatgtcccataaagaaattgcggaagcgctgggagtctctgtcaataccgtacaggagcatatttctgtttcgttgaaagtgattcgtgcctacttgactaaatattcgggtacttctgctgacatattgctgattctactttgtctgaatttataataaatgttaatcataccctagctgtttcctgcctttgtgtattactaatacgaaggggagaaatcagcacccttatttgaatatatgatgaaagatacgaagacagaaaaaaataaattacgtcgttatctggatgatatgtacatccgggaggaagcatcgcagttactggaaagtatgagagatgctgaccataaagatatattggatgagttgtctgccgaagtctgggaggaatccgtcagccagcagcctgttactgacttggagcgtgagaagtataaaaaggaggctcgccagttgctgaaacatattgaacataagaaacgtacctggtttcgtcgggtaatgacgattgcagccagtgtggcggctgtaatagccatcgtgacaggaagtatcagttatttccggtatatgagtgagcagcagataactttcgctgaaatctcaacctcttttggagagaagaaacgggtggaattaccggacggaactatattagtgttgaactcttgttcacaagtacgttatcctgattcttttcaaggggatatccggaaagtggaactggaaggagaaggatatttcagggttgcccataatgaagatatgccgtttattgtacagacgaagcgactggatgttcgtgttttgggaacccggtttgatgtaaaatcttactctacggatgaaatcgtatcggtaagtgtagagagtggcaaagtacaggttgatctgccggaagcaatgatgcgattgactgcaaaagaacaagttctgataaataccgtttccggtgaatatagtaagaagaaggaagaacgtggggtagcagtctggatcaagggaagcctgcgttttaacagtactccgatccgggatgtggcaaaagaactggaacgtgtttataattgtcagataacctttgcttccggacaggaatttgataatctgattaccggtgaacatgacaataagagtctggagtccgtacttaaatccatcgaatttatcagtgatatcaattataagaaagaaggcaggaatatacttctttataaaaaatgagaattaaaaaatagatcaatgtttaacccgttaataaggacagaatgaaagcatcaccctcatagaaactccctaaaaagatagaagcactcctaaggaatgcttctatccgcaacccggacggatattcattcgcttcgacccaaatgaataacgtatcgcacgttgcttgtttttaataactttagtcaattactaaaacgcacaaatttatgaataatcttcttatttgtaaaggaaaaagtagaaatagctgctcgtttttagcttttttactattcaccttccttttagttgctccgactgctgctcagacattgaaagagaacaacattacgctccgtgtacaaaacgagccggtagaaaatgttttcaataaaatcagtgaacagaccaactttaaatttatctacgatcaggaaacggtaaataacgctccgcatgtttcttttgatgtaaaaaacgctacgcttaaacaaattctgggagtgataactactcagtcaaaactttatttcaataggaccgataatacaattgctgtcagtaaacagccgcttaaagaagaaagcgctcaacgtacacgtaccgttcagggagtggtcgtagatgataagggagagccagttattggtgccagtgtccagatcaaaggagagggcagtggtacgattaccgatatggacggacgatattcgttgatgaatgtaccggaatcggctacattgacaatttcctatattggctataagaccgtcagcctttctgcaaaagataagaatacggctaagattacgttgaccgaagacagcaagatgatcgatgaagtagtagtggtaggatatggtgtacagcggaaacgggatgtgtctacttccatctcttccgtgaaagccgagcagattgcggaggtttctgcttccgactttcgtcaggcattagctggaaagatgccgggagtgcaagtgactcagccgagcggtgacccggaaggaagtgtcagtatccgtgttcgtggtatcagtacagtcaatgcggggagtgatcctctctatatcattgacggtgtacctgtggagcgtggctttgccaatctgaataataatgatgtcgagtcggtagaggtacttaaagatgcttcgtctgctgcgatttatggtagccgcggatcaaatggtgtaattattatcactaccaaacaagggcagtcggaaaaaatgaaagtacaatatgatggatattatggtatccagagtatttcgaaaaaacttccgatgttgaatgcttatcagtttgcggagtttgccaaagacgggcatgataattcttatctggatgctaatcccggtggttcacctaatgaccctaatggtatgcgtccgaattcatgggaacggattcctacagaactttttccttatctgaacggcgatcagggattaacggacacagactggcaggatgcaattttccgtagtgcggctacaaccagccataatgtttctatctccggcagaggaaagaccgttggttattttatttctgccaattattatgataaagaaggtattatcatcaattctgatttcaagaaatatagcatgcgtatgaatctggacggaaaatataaaagactgaaattcggtcttaatttctctccttcttattcgacttccaatcgggtggatgcttccggatcgaatggtattgttcagtcggccttgatgatgcctcctgtgtggccggtatataattccgacggtagttataactatcagggaaatggctattggagaattggcaatgactatcagcacaatgcggtattaaaccctgtggcaatggccaatctacaatcggacgtagtagaccgtatggcaattgtagggaaagtctttgccgaactggaacttttcaagggacttacttataatatttctttcggtggtgattattatggttctcataatgatcagtatcgttcgtcagaactacccttactgggccagaaatattatgatatcaagtcgaaccctactgcatacagctcctccggtttttattttaattggctgattgagaataagattaattataatacagtgattaatgaagatcattcgattaatgcggttctggtgcaatctgcacaaaaagaaacttataaaggagataatgtgacggctaccgattttccgaatgattatatacagacgatctccggtggaacagttataaagggggcgtctgataagacccaatggtcgattgcttcctatctggctcgtgtgcaatatagttataaaggtaaatatatggcttccggagctattcgtgcggatggttcttcccgtttcggaaaaaataaccgctggggatatttcccgtccgcatcattggcatggagagttagcggggaggatttcttcacgaaggcgaaatttctctcctttgtagatgacttgaaaatcagaaccagttatggtgttacaggtaactttcagataggcaactacgatcatctatcattgatggctcttgataattatatactgggtacgggtaacgggcaactggtacaaggttataagcccaatacaattaagaatgatgatttaagctgggaaaagaatgcaatggtcaatgtcggtgtggacctgcaaatgttcaaaggattattggggataacagttgattactataataccaatacctccaatatgttgctgaatgttcctgttcctcatctgactggatacagcactgccctgatgaatattggaaaagtaaataaccgtggttgggaaatagccttgacatctcagaaaaatttcaccaaagactttgggtattcttttaatgccaactatgctacgaataccaatgaagtaaaagctcttggtccgggaaatgctcccattatctctaccggaagcgtagatcatgcttattatatcacaaaagtaggcgaaccgatcggatgttactatttgctggtgcaggacggtatcttttccaacgaagaagaattgaagaaatatcctcatttcagcaatactcagccgggagacttccgttttgtagatgtggatggagacggtgtgatggacttggacaaagaccgtacgatagtaggtaactatatgcccgacttcacctatggatttggtggtaaagtatggtataaaggcattgatcttgactttaacttccagggagtttacggtaatgagattctgaatctgaatcgtcgctatattgataatttggaaggaaacaccaatggtaccacgattgccctgaatcgctggaaaagtgcggataaccccggaaatggtcaggtgaaccgtgccaaccgcaaatcgaaaggttataatggccgtacttcaacctggcatctggaagatggttcttatttgagattgcagaatgtaacgttaggatatactttgcctcagaatctgacacgtcgtttctttgtggagaagttgagagtctatgtctccggacagaacctttggacatctaccaactacggtggatacaatccggaagtaaatgcacgtccgagcaattcactttcgccgggtgaagattacggaacatatccgctggcgaaaaccttcttgtttggattaaatataacactttagtcatccttaaaaatatacggtgtatgaaaatatatagacaaatcctattcttggcaactgcttttgtatcagtggcctgtacagatagctttttcgacttggagccaagtagcagtgtgcctacagataaagtatacaagacagcagacgattttaatgtagcagtgatcggctgttattctaaattgcagggacaggtttcctacttcacggaatgctgcgaatatcggagtgacaacctgtcgttgagtgctcctactgccggaacacaagaccgttatgatatagatcagtttgcggataaagcctctaatggaatattggaatccgcctgggcgaattttaataacggagtatatcgctgtaatttggtattggacaaaatagacgcagctgactttgatgctacgttgaagaaacaatataaaggggaagcgcttttcgtgcgtgctcttacttattttaatatgtatcgcttgtggggtggaattccgatgactgataaagtggtgacggtggctgaagctcttaaaatcggaagaagctcagagcagcaggtctttgattttcttaccggcgatttgaatcaggttatcaatgagaatatgctgccttcttcttatacgggtactgatacgggacgtgcgacctccggtgctgcaatggcattgctgggaaagatttatctgactttccataagtggacagaggcacgcaatgtactttcgcaactgataggcagatattctttgatgcctacaccggataaagtatttgatgtcgataataaaatgaacgatgaaatcattttcgcagtgcgctttaataaggacgttgagggtgaaggacatggttattggttttcaattatcaacctgacagatgatactaaccagacaaaggctttgaaggagtgctataaagacggtgataaacgcaaagacctgatcacttatgtgaaagtagaagataaagtttgcgtaatgaataaattcaaggatttgaaaagtgcgacatacaataccgtcggtaacgatcagattattcttcgttatgccgatgtactgttaatgtatgccgaagcactgaacgaaatcagctatagcaactctcagacttctgatgcaatggttgctttgaatgcggtacatacccgtgccggattatctccggttcagattacggaactggcagatcaggatagtttccgtaaagccattatgctggaacgccaacaggaatttccttatgagggacaccgttggtttgaccttgttcgcatgggaggtgccaaggaagctatgaaagcggagggacatacaattcaggatttccagtttctgtatcctattcctaaaacggaattggaaagaatcaacaataccgagttgttgtggcagaatccggggtattaatatggttaaacttaaagaattcagacgatgaaaaaaataatatatagcttgttgtttgtcattacggcagtttgtgcagcttgtgacgaagaactgccaaaagcaagttttgatttatatgaattaaagacgcttacggcaacggccggagatatgaatgtggcactttcctgggaagcatatccggacgcccgtcctgatgaatatcttattagctggacttcgggctcttcgggagcggaaggagggcaaatgactgtggaggctgaggcttccggtgcaactgtcagtgatcttgtcaatgatgttgcttatacattctccgtacaacctcgctataccggaggattggcgagtaagcgatctacttcttgtacgccaaagaatgcaagatatccggtgactggtctgactgcgtcagcgggagacaagaaagtccggctgagatggacgaagcctgccagcgaacggtttacgaattatcagattaccgtaagtcccggcaatcaggttatcaaattggatgacacaacattggaagaatatatggttgaagggttgactaatgatcaggagtataagtttgatgttgtttgcatttatccgatggggaattctgtttcggcggaagcggtggctactccgggaattatttatccggtagcagtcaatacggaattggttgtctgggagtctgctgtctttgcttataacgatatgtattttactggtggcaatgttaaatccgtcagctgggattttggtgatggtactgcttctgctgaaacgactccatcgcatgcttttgctgctactggaacttatacagttactattacagtaacatatacgaataatacgacggagtcaggaagtgtggaaattaatgttgtcgaatataaatgggatagtctgaatctaaattttaacggattaacaggatatgtcaagacgtccaatcctgtattctccccggatggaaagacgatgtatattccgacttcaacgcctgccgggcatttgtttgccttagatgtagtcagcggcgaattcaaatgggtatttgccattgataaaataacttatggcggcggtgcattagtggggtctgacggtactatctatcagtgcgtgagagatgcttctatcaagaatgtgtatgccataaatccgaatggtactcagaaatggtcattgcaattagacggaccgataggtgcgttccctgctttgtctgctgatggtgtactctattgtttgactaataaaagtacgttatatgcactcgatgttgcgaatggtgcgattaaatggcaacaatctcttgatggaacaacaggaagtgcggtggctattgatagaaacggacatatctatgcaggtaccagtgaagctatttatgctttcagcgcaaataaggaagaactttggaaactcagtggtgttaatgtgacagagcagggaacttttgctttgaatggcaacacgctttacgcaactttgaagtcaaaggctggacttgttgctgttgatatcacgaacggaaccaaaaaatggacctatccgacaacaggcggtgatgcttatttccctatcgtagataagaaaggtgttgtttattttacagagaaaggttcgcaaacagtttacgctgtagacgctgacggttcaaaagtatgggtgaagaaggtaaataataacctgaactacagtggtgctgcgttgagtacagatggtgttctttatatcggaacgcagtcaaataataagattttcggacttaatacggcagatggaagtactgtttatgaggaatctgtgggtcaacaggtaatggcatccgtttcgattggtccggacaagcgtctttattgtggtactattggagcgagcaatataggttctataaaagcgtttgacattaataaaacgttggaaacagactcctggagtatacggggtggagatattcaaggtacaaaccgacaaaaataaacggtgatgagaaaattgatatttatcgcatttatggtgatgtctgtttgtggatatgcacagaaatatgaagtaggtactacgacagcagtgtggaaagcacctgctgctgccgacttccttcatgcaaaagcgattggtgtgaagtatgtcgaagtagcctttaatcaatgttataggggagttcctgtcgatgaagtgattccacgtataaaggaaatgaaagcgaagatagacagtgcggatattgaagtctggtctattcatcttcctttctcccgaacgctggatatctcagttctggatgatcggttaaggaaggaaaatgtagattttatggcagagatgatagaattgtgtgccatgttccaaccgacttgcctggttttgcatccaagttcggaaccgatagccgatagtattcgggcgcaacggattgccaatgcttcggagtctattgcttatttgaagaaatatgctgataggattggcgctcaactttgtatagagaatctgcccagaacctgtttgggaaatactccggaggaacttatgaggattgtcggagatatcccggacgtaaaagtgtgctttgatacaaatcactataccaaaggcacgacagagcactttgtggcaatagtaggtagccgtatcggcactatacatgcttcagattttgatttggtgaacgaatgccactggcttcctacacagggaaatataaaatggggaaagttgatgcaagatttggagaagaccggatataaaggcgttttcatgtatgaagcgacgaaggatcacgaaaataataatgtgagacctgctcttgaacggattgcagagaccttcgataaaataactgatgactataaaacactgaaataatatgaataatataagaagaatacaatatttcctgttttgcctgctggcaataggacttgcaagttgtagtgacgatgataataatgataagaagaccgggtacgaaggaattcttacggaactggcagcagaggtagatgccactacccaacagttatggggaacttctccatcaattgtaaatactgaacgtgccgatgctttgagcactattcagggatatgccgataaatgtctggatgactattttatcagttttctgaatggttttgatcaggcaagtatgagtatggagaagagtgaaccgatcttatactattaccggagtgcttttgaccgggtgatggacggaattgaaaactccaaagtagagaatggcacagcagaaatctggttgctttataacatgggatatatagttaagactccttccggatgttttgctattgatatttctcatcgctgggcgaaggaacttgcaccctatatcgacttcctttgtgtgacgcataagcattctgatcattataatacagatttgattcaggcaatgtttgatttggataagccggtattatccaattatttgaaagacaccacttatccctacacggcaaagggggataaagattatgaaataggtaaatttaaaatccgtacttgtattaccgatcataataattccggattatcaaatttcgtaactattttccagatagactgtggggacgatactggaaatttcgtctttatgcatgtcggtgattccaattttaaaacggaacaatatacaaacattgcgccacatgttaatgtcttgattccccgctatgctcctaatgcgctgactgagaataatattttaggtaccggagcgggacaggtacagccggattatgttctgttatcccatattctggaaatggctcatgcaggtgttgatgcatccagatggtcattggacatggcactagaacgggcgtccaagattaactgtgaccagacctatgtgcctatgtggggagaaaagatggtctggaagaacggtaagctgaactaataattttaatatttgaatttatgaaacgaatttataactttatattgcttgtatgcctggtgcaactggctgttgcccaaaatcggattgcggaaatcagagaaaacctgttaggaaattattccgatagagtgttggtcgtttctcatcgtgccgattggcgaaatgctcccgaaaattcattgcaaggaatacggaattgcattgatatgggagtggatatggtagaaatagatttgaagaagaccaaagatggtcacttggtcatcatgcatgataagacaattaaccgtacaatgacaggaaaaggaaacgctgaggattatacactggcagaactgaaagcaatgcgacttaaaaatggagcaggctgtaaaaccagacatcagattcctactctcgaagaagttatgttactttgcaaagggaagataatggtgaatatcgataaaggttacgattattttcaggaagcttatgctgtacttgaaaaaacaggaacaattgaccattgcgtaattaaagcagggctcccctatgaacgagtgaaagcagaaaatggtgatgtacttgataaggttatttttatgcctattgtgaatctgcacaaagaaggagcggaaaagataatcaatgattatcagtcacacatgaaaccgactgcttatgaactggtatttaatgatgataatgaagaaatacttcgcttgatcaggaaagtacgtgatagtggtgccaagcttttcattaattctttgtggcctgaactttgtggaggtcacgatgacgatcgcgcggtagaactacaccaaccggatgaaagctggggatggattttgaatcagggggctaaactgattcaaacagaccgcccggcattattactcgaatatttgcgtaaaaagaaactgcacgactaaagatattccttcatgctgaaacatcttataaatttttacaaggtctcttcaccggggccttgtaacggagacgttatgtcttcatccggcaagcgtcggttgaaatatctgcaatggtctacctttctttcggcaactttcggatacggtatgtattatgtctgccggttgagcttgaatgtagtaaagaaaccgattgtagacgagggaatcttttctgaaacggaactcggaataatcggttcggtgctgttctttacgtatgcggtgggtaaatttacgaatggatttctggcagatcgaagtaatataaatcgttttatgactaccggcctgcttgttaccgcattgattaatctttgtctcggtttctcccattcatttattttgtttgctgttctttggggagtcagcggctggtttcagtctatgggggctgcttcgtgtgtagtcggactttcccgttggttcacggataaagaacgtggctcttattatggcttttggtccgccagtcataatattggtgaagcactgacatttataattgtagcatctattgttagtgtttgcggctggcgttatggtttctttggggcgggtatggtaggattgctgggggcattaattgtatggcgtttttttcatgacagtcccgaaagcaagggctttcctccggtcaatgttccgaaagaaaagaaaacgatgagtgcttccgaaacgacagattttaataaagctcaacggcaggttctgacaatgcctgctatctggatccttgctttatcaagtgcatttatgtatatcagccgatatgcggtaaacagttggggagttttttatttggaagcacagaaaggatattccactttggatgccagtttcattatttccattagttctgtttgtggtattatcggcactatgttttccggtgtaatttctgataaactgtttggtggccggcgtaatgttccggctttgattttcggactgacgaatgttttagcattatgtttgttcttattagtgccaggggtacacttttggctcgatgctgtggcaatgatcctctttggactgggcatcggagtactgatttgtttcttaggtgggctgatggctgttgatattgctcctcgcaatgcttcgggagctgctttgggagttgttggaattgccagttatatcggagctgggctgcaagatgtcatgagcggagttttgattgaaggacataaaacgatccggagtggggtagaggtttacgactttacttatatcaattggttttggatcggatcggctatattgtcggtatttttcgctttatgggtgtggaatgcgaagcaaaaataaatcattgattatcagtggagtataaaataggtactttttcttttaaaggaacgggctcttggtttaaaaccaacgacctgttcctttaaaaccaacggggtgtttcttttaaaggaatgagccttgatatttcagaattatttcagtatcataatttttctttgcgggagatttattatctttgtacttttaacccggtaatcgatgagtagaatatttgcaattactaaaatactgctgtttgtgctattggctggaatgacttccactgtatttgcgcaaagcgatgatttcactacatggactaaattcaaagtgaactataagatcgatccccgattttcacttttaagcaatctggagtttcggacaaaggatgacgtaagtagaatggaccgtttgggattggccattggaggcgagtatcgggcttattcatttttgaaactggaagccggatatgaaactcatttccggaatttgggagattcggaatggaaattcagacaccgttataactttggagcaactgcaagttttcaatatcagtggttgaaaattgctttgagagaaaggtttcagcaaacttttgaccgtggagattcaaaagctcgccttcgttcccgcttaaaattagcttatgcacctgaaaaaggaatcgtttccccctacttctcaattgaaatttatcaaagtttggatgacgctcctttttggagagcagatcgtatgcgttatcggcctggagtagagatagctttggctaaacgatgggcgttagatattttttattgttatcagtatgagtctccaaaaggtaaacatattgccggggtagaaataggctattctttttgaaaatgttagattactaatataataatgtgtaagcctatttggttttgaaatatccctgattcataaagtgctactaatttgatacttatgaataaatataaatattatttaagaaaatgaagtattggttgatttatgatttatacttttgcttttggcatttcagaatgaaatgttggagttgatgattctccagtcgcaacagacgtgttgtgtggaatctcataactgaaagtgaatacttcctcttatgtcc

SEQ ID NO: 103 - DNA, 27426 bp, Bacteroides thetaiotaomicron
gtatctagttatcaataatgttttcatgataaaaaaaaacaattattatttgatggtataatgagtgccttactccgcaaggatttatttcgggtaccgatgagacctatttccggcaccgatgaggacaggctccgccaccgatgaggaactatctctccaccgaccaacaggaagcaccggaaaattattaatagaggattaatttagagtgaatttataatatcatcgtaagagaaatcaggcttggcattcagcaaacgttcatattcaatacagaacttatcgaaactttgcttggacaaacctttctgccccatctgatacaagactctgcatttagtgcggatagcgtcttcgtctatattatcaacaagcagaattacatctgatattttcagcaaaagcctggagtcttcttttatatcgggacggttgaccacagaaagcagtatttccgtcaacagaacgtagtaggctgacttatattcgtcaatccattcggcactgacgttagggagcaatgcgccggcactcgccagggatatgattttattgattatctttttgtccgtaatggtatcttttatctgatccagcaatctcatcacttcctgataatcgcaggtcacgtctttccccagattcagataccaatagccgttcttattggcaatattgatatctccgattttctctatgatcagccttagctttctgatattcacgtttctgttattcgatgcactggacttactcatatcgaaccagaaggtttcatccaggcattgagaagttgttccctttccgttcttgatggtattcagcagtaaaaacaagaataattgcttaagagtaggcgtaaaatctcccgtgatgttaccgccttgcttatcaaagacctgaaatccgcccaataataaaacggaagatactttttgttcggtcggttcttcttcgaccgatctgtcttttacttcttccgtagcaaccggaccgactgccacattcacttttctctttctcttactatgcaataaccatatacttcctcctatcaggcacagtagtcccgccaaaataccggatatcaatatcaccggcttcattccgccagtctgatgaggcaaaatatcttccttggacaaaggtggaaatgccagtttataaaattcgactttagatattccgggctctttttcctgcaacaccacggcataaatagaagatgtctctttatgcagaaacatatcacaataagaatgaatatcgaggaagttataaacaatggaatcactcatcacttcctgaaccggttgtctggtctgtatatcaaaccggctcaaataaacaaaagtattataccggtcattattatatgtcaaagcatatacactattcgacggtgtatcgataatcattgaattaccgaaagtaaagtgctgcctgtcattcacaaactcccataacttggtgcatttacctgttttcaaattcaaccggtaaagatcataaaagtttcctggagattcttcctgcttacccgactgattgccataaccacccatgatcaataagtagtcctcattctccgcccccatcgcacttaaatagcggggaaacagacaggaatcaagggaactgatcgaccacccctgcggatcagacaggtttattctgctcaactgtgaattatagcggtgattaccatagccaccaaaaacaatcagttcatctcttttctgattgataatacgattatgatgctggcgggtatcaatcattaccggagtttctaatgtccagcatttccggtcaaactcatagacattcaaatcgttgaaatccggtgtataagacaagagcctgtttcgtttggcatcaaaaataatcaggctggaagctcctatataaggatgtcctttataagcaatcgaatcaatacgattcgccttcacatcgtaaacaaataactgaccgcctcctgctatgaaaaaacgtcccgacacatcgtcataagccacctgcggattaatatggtgcacattcaacgaagctaatgccgcccatttagtatgtttatctatctcccagacgccattacgtacaaaagcctgtttatttctgacactatcgtaagtcacatctttatcatgagcagccaattcccatttataaagcagtttaccttgaatatcagcaagttctatattacgaatggtcataggaggtacatctgtagagaagaaacggggatgcttgctgcctccgaaatagatcttgatatccttaaagttgctcagggaatgattgatttccgcctggataccgtctgcagcaatatgaatccggtctttggcaaattgcagatcgacgtgtatccatctgtctgctacaatctttaccgaatctgcaatctccgtattcttgatcacccggtctttgtcagtcaatacaatattaaatcgggaataaagcaggtaggagataaaatcaaagcaggaagaatcatctgctatgacccgtacaacataaccataagtatacagttcatttctcaactttatatcgaatcccaccgagaaaccgtcctcgggaaaagacaaagaagccgcaggagtaagatccagattggtccgctgatcctgattggtagaatgagccagaaacgtaagaccataatcatagacactattatctataacattactcttgcatacccatatatgcaataaaaagactaaagatagaaggtatctacatttcatagtaacaatcataaaaaccggaatccttgttcaaaagtaagaaacttatgtctaagaccaatgcatttgattgcaatattcgcaaaaaattataggatatgcaaatcattggaaacaaaaagactcgcccaagtaaagtatccgagggatatctttacctgagcaagtctttcctttcataaatacggcccacttaacagccgtatctatattacaatatcaaatgtattattgagctgattctaccaataccacacgattcagaatcggttgaccgaacttgtcgacaccaccacctgctgcaacagacagtctgtctgcagagatgccatatttcttaaccaacaggtcctttacagcttgtgcacgttccagacttaacttctggttgatagaaggagtaccggttgcagagtctgcatatccgttgattgtataggtcatgttcgggaattctttcatcttgctggcaagatatgacaagttcatttcttcttgtggagacaatttgtctgaaccgatcttgaagaatacagtacgcggtgcaatgttggcatctgttacaacgacttcttcagcttcttccactacaggctgctgtgcattggctaactgttgctgcaactgcatatttgcggctgccatagcattcatctgatcacgcatctgtctcaattccagttcggagataatctgtggaacaggacgttggaatccacgggtcgggaagtaataagtcacaccgagagtagcacctaagataccatcataatcgggtttgccaccatgttcaccatcaaatttaccttccagccctgttgcactcagttcaaggttcaaatctacagcgtttgacaaacggaaacggttgataatacctgcattgaaggtagcagcgtttgtatgaggcttagaataagaatgagcccaaccggcaccgatatacggaataatctcatatacgcgatccggattgtaaccaccgaaaagtgcattcagattaatcagcaagtcgccatgaagattcatatagtcccatctctgtttgtaggagccatcttctctcgggccaccgactacataatttgcagattcattggtggtgaatcctttggattgcagtccgctatattgcatacgtaacccgaaaccgggtgttacccatttaccaactgacacattcaatgtcggagcaatacgatctctgaattttccgatatggtcgttattaccaaataatacctgtgcaccgcctcctacagagaagaaccagttgctccagaatgggttagttattacttgatgtttatcttgtacctgaataacctcgtattcagttacagtcacggtttgctgcgcagaagcgacagacgcaacgccggcaaaagccagcaacattagaatctttttcatatacctaatagttaagtggttattataatcttttctttgttgaactatttaaataacacgaactgaactaaaaggttttaagaaatgatgattttatttgttttatttgaataatttctcgatgtcctcttccttgattgttgtcaagactgttttgccatccggagtgtaatttggtgaaggacaggcaaaaagactgtctacaagacttaccatttcctcattactcaatacctgaccatagacaatagccgccgcacgtgccagtgttaaagctaagatattctggatttcctccttcacatcattccctttttccatagctgtatgtagcatattccgtaccaactcaaccggattcaatccttctattcccgaaggaatgccattgatggcataactaccgccacccaaatcactcagatcgaaacctaccgccgacaaatcatccatgattccttgcaggacagccgcttctgaagcaggcagctgtaatatctcggggaaaagcactccctgcgaaacaccttgtttttgttttatctgcaccatataccgatcaaaaagtacgcggatatgcgcacgatgctggtcgatcaacatcaatccggatttcaccgaagtcagaataaaacgacctttgaactgcaaatgcagattccctttctcaatcaccgattcattggcatataaagtagaggaagccgatgagaaagtggaggaagcggcagataccgccgaaatagttttctcttcagcaaccatcggttcttcctcgaaaggagaattttcccaatccatttccggttcctgctgaggctcattcatcttacttgccttggtcaatccaccatacagtccttcccattccaccttcggacggctatatgatccgccgccacttccaccggaagatactttgaacggattgaaatccgaattataatgaatcttcggaggtgcaggaggcaggttctgctcaaatgcaggaatatccggcatatcttccgtatcgaaatcaatggaaggaatggcgctgaacttgcccaacgactcctttactgatgccgaaagtatttgccaaatagcctgttcattctcaaacttgatttctgtcttagtgggatgaatattcacatcgatattagccggatccacttcaaaataaataaagtaggaaacttgctcgccaacgggaatcaactgttcataagcctccatcactgccttatgaaaataaggatggcgcatataacgcccgttgacaaagaaatattggtgagcacctttcttacgggcagtttccggcttcgctatgtagcctgagattttcaccatcgtagtattcacctctatattcagcaactgttgattcagcttcttgccgaagatagcaagaatacgttgccgcaaaggagatacaggcagattaaacagttcggaatcattgctgtaaagcgaaaaggctacttcgggatgaaccaaagcaatacgttcaaactctgccagaatattacttagttctgttgaatttgctttcaggaacttgcgacgggcgggcacgttgaagaacagattcttcacagagaagttacttcccttggaacaggaaacagcttcctgactttcgactttggagcctgcaatcaccagttttgttcccagttcttccgattccaaccgtgttttcagttcaacctgcgccacagctgcaatggaagccagtgcttctccacgaaaccccatcgtacgcaaagcaaacaaatccgctgcttcccgaatcttagaagtcgcatggcgttcaaaggaaagtcgcgcgtccgtttcggacattccctttccatcgtctataatctggatgcaggtcttaccggcatccgtaactaacacatgtatattttgagcatctgcatcgatcgcattctccactagctctttaataacagatgccggacgttgtatcacttcaccggcagcaatctgattagctaccgaatcaggcaacaaatgaattatatcgctcatagtttatttagtagttaaaatgaccagcttcccgtcgctaaataatgccacaaatataaaaggaaagctatgataatcaatatgattccaaaagatacaggcttacggccacttgcctttctgcgcttcaggtgcgtcgtaccttcgacaaacttaccacggatatcttcgggactgaattctttatccggaagcattcccaactcgcgtttcgccttctcctccatcttctcaagcttttctttccgctcgtttacgtaaatgtattgatgattaaagcctcgaggttttctcatcgaattgaaaaacattcccatattacttcatattaattaaacttcgcttatctgtctttggcttccggtcggtggttggtttcagtgtctctccttccttcttgcctctccagttgaatatatcttctttatttaaagggcggacatagtcaaaccaggcaaatgtagatagccgcaacttgtcgggagggatctgatccatcggatataatgttccgttggacttacctacgaacatccctttttccatcttcttctctttcatataaagatggagcacactcccctccatattattaaatccggtcatcgtactgtctttttcttccgggtagaaagcggtcatcacattacctatcacttcaatatgacgcatatcaccattttcgaaataggctttcatctctttaccggacacttggttataatgaacagaatctttcatctccaccgtcagtgcctgattgataatgtgggcccagttaatggtactgtcattcatataaatcttgatctcctcgccaagcagttgctgaccttcattccaaagaatcggatcggtatacatggtcagacaagagtcttttgaattataaaccagtgagtcacaaactccctgtacatccgtccggtacatacgtaccttatgataagctttcatcaggcggaaaacagagtccgtattcagattataggaaataagctgcaacgtatctccatgcataaagagactgtctccttgtgaatagtcaatagcaactgcacgtttggtagcaaaagcagagtcggccaattcgttatagaaacaataatcgccggtcaacatattcttgttaatggtatccgtcattcgtatattatcgaacgcttcaccgtatcccactttccggtcataaaacaaactgtcaccaatcaacttctttccctcattcgtcaggatagaacggtccaacaattcagcctgttcgctgagtgtattatagaagcctcgttccgaatagatgtgattattgtcacttacgatattcgaaggaccgagaatggtagcaatcttggaaaaagtattatatttcagtgtatccgacgtcaggacaaacttgggattcaccaatttcacatcatgattgaataccgactgtttggtagccggactgtattctccccaatccgaggtcaacacattctcttcatccatcaaagtaccgccctcgaaataataaccgagatcataaagacggtcataattcagactatcggtcagaagcgtcgtgttccggttgatcatctttacgttctcacgaatctgcgcaatctgtgtcatcccgtcgtagtaaagataatcaccgtaaataaacaaggtatccccctgctccatacgtacattgctgaatgcttctaccgaattggttttctcgtaaatcaaagcactgtcacaaaacatatacatactgtcgtgacgcagctttacattcccaatcagtacctgaacatccggtcgggcaagcttgtcggcctgtccctgattggcatgaagcaaatatactttcgtcttcttattttcgggctctttcttgatatctttatcagtttgcttcgttccatttggagttttcgcagccggagtctcagcctttttagtctgtccggtaggcttcacctgcgccacaaggcatacggcaaacaggcatagaaagcctataagaagccatctatgcccgtcttgctgtttatcttttttgttttgtttcagcatataaagtcaagctgtttaaacatcaatcgttccttacccaacccggatacttgaagtcacacttctgccaattcgggtcaatacgtacatacgtatgtttttgtttgttcagaatccacttctgcaacatttcttcccggcgcttatccatcacgatttctttcaggtcctgatagtcttctgcaatggtagctttatgaccgttgatctttgctttcagttttacaatggcacaaacttcttttccatccttctcgttaatcatcgtaaaggctctggaaatttcgcctacattcatcttatccaccactttcgcaacatcctgaggcaaatcctgcatctggaacttagaagtagtgatacctgtacgctcattcgtattcaccataagaccgtgattattacgagtatccttatcctgtgaaatcacagaggcagcctcatcaaatgtaaacttattctgacggatatcatcgccaatagaatccagacgggcacaagcctcagtcaactccttttcagatactttcggacgcaacagaatgtgacgggtattcacacggtcgccacgtttctcgataagctggataatatgataaccaaattcagattctacgatcttagaaactttcttcggatcctgaagactgaatgctacattggcataagccggatccagcataccacgtcccataaaatcaagttcaccacctttgatagcagaagccttatcttcggaatacagacgtgccagtgtagaaaaatcaatttcaccctttgtcacacggtctgtataatcacgcagacgtctctttacatcttcaatttcagcaataggaattttaggttgcagtgtaataatctgcacctctacctgagtcggaatataagggatactgtcctgaggaagatccttgaaatagcggcgtacttctgccggagttaccttgatatctcctaccagtttctgctgcatcttctgtactgtcagtccgtcacgggcattttcgcgcaacgtttcacgaatttgagtagcagtcttattgaagtattcctccattttctccttagaaccaatctgctggatatacatattggtcatcatatctacacgctgaatgatttccgcttcggaaacttcgatactatccaactttgcctggtgcaggaataacttctgcacagcgatttcttcgggtattacacaataaggatcgccttcaaatctgcgtccattgtacaaggcatccatacgggcctcttctacatctgatttcaaaatagcttcgtcacctactacccaaactacctcatcaattacattgtcctgtgcataagttaccacgttggcaaatactgccaggacaagggtaacaataaatctaaagttcacaaacttcttcattctttgtatttaataattgtatataatcttcttcttgtttacagcctgctgatacaggtcattcttcacttgttccataaagttcacccgtttctgattgaccagtaaatccttcacttccgaccgggcaaactcatacggtttctcttcacctgccccgcgataatcgctcacattgaggaaatagtaaaatgccgtatctttcagttccacatgtcggtgcttgtctacatactgctccggtgacgcctctttcaatggaatcaagtccagaacatccgtaaccggaacccatttattgtaaaagtattcatacttcaccgcattctgcaaactatatttttccagactttccacagcatcctgtttttccgtcttgtaccatctgcgaacattgttcagctgaggtgccgtcaacggtactttaataaacaatcccttgatcagcggagattccaatttaaacaattccttgtttttctcataataatccgctatttcctgttccgaaatatcattcgtcagtttttgatttatcaattcctgctgataggtatgcataatcaaagctttcctgtaattctccaccagcttatctacatccacattatccggaatattattcgctgctttttcatacaacaaaatctcttccgcccaactacgaatgtaatgctcagcgaaaagaatactatcatcttttgacaatccgaccggtagtacagacatcaaatcttctttatacaaaaagttaccatctacctccaccaatgcagtcttgcctttgtggtcgtactgctctttgcacgctccacaacagagaagggtaattagtaagaggactaatattcgcattgtcaattcaaatctacttatttaaggtacgaagatagtgaataatcggttacatcagttattattaactgtttttaaaacctcttggtttatttcaaccttaccggactccctcaattcccgctcccaatatgcgttaagatagtttctataatcttttctcacctgatcaattacctctctgtaatcctccggtcccttctgttttttgcctacagcaatagtaaaaggataagacactacaggatcaaaagcgcccttcttaaagaccaatttatctatatatttattatctccgtcggcaaaaacaccctgttcaattttaattatttcagcaccggatgtattaaatgttttgcgaagcatatcctcccattcattctccggaacttttttcagtagctttttagcctgtttagcagtctttttatctgcacaatgcaacactactcctttgtatcggggatgctcccatcggtaatccgatgaatgaaacttaaaatacgtagccaatcccacccggtcgttaacagccggtaaatctactttctgatgcacgatttcctcagccaaacatttctctgcatattcctgcaaagtataacgaagttccggatgctttctttccatatgctgactctcataatccaacagagattttgctataaagccattcaactgtcgttttacagcctgaggatgggatgcagcaaaccgcttaaacatttcccctgtatatgcctgcccgtcgatggtaaacaaagtccgctccgttccacctttctgcaatacttcctccaaagactccatattcggaatatactggtattcctttttcagttgttctacgatggcttccgttcctttatccaacggctgacgccttaaacgatttagaaggctgtcactaacgacttcatatgcaggcacttcttttcgatctatgactttcagaatatgaatcccttccggagtaaaaaaaggtttggatatttcaccttttgctaaagagaaagctgcttcctcaaactccgaggttgtctgcaaactttctatccaccgacaacgtttatcatccgaaaaccgatccaccaaacgggcaaaatccacacccggctgattttgtatcacctgataaatagagtccatgcgagcctgttcctcctgtaaatgccgggatgtaatggtctgaggcagatatttgtaaatttgctgtatctgcacttgtccgccacgtacattttccttcatcttctgatatagaatacgggcattgccatccatttcctgatcatccagcaggtatgatctcagcaaatttgtccgataagcctcctgttgcttgcgaaaagccgaagttgtgtcgagtccggccgctctggctgcttccactttcaacttagactgaatgaaaaactccgcatattctttaggagacaatttcataccattaccgtccgcatgccggcgataggagtattcaaactccgaacgaggtatgtctttcccattaatccgcatcactacgggatcttcctgagcgaaagctaatactccgaagagacttatccatcctaaaagcagatttcttttcatcattgatttttatttaaaaacgacaaacggtgaacaacgaacatatgccatacagcctgttcaccgttcaccgctaatcgtttaccgtttatataaattattccggacggctatagttaggcgattcactggtaatcgtcacgtcatgcgggtgactttccatcactccggcatttgtaatacgagtaaacttcgcatcatgaagtttttcaatattagcagcaccgcaatatcccatacctgcacgaagaccaccggacaactgataaactacttcgtaaagtgtacctttataaggaacacgagcagcaataccttccggaaccaatttcttcacatcggcagttccgctctggaaataacggtctttagagccattctccattgcttccaatgaacccataccgcgatatgatttgaatttacgtccgttaaagatgatagtatcacccggagactcttctgttccggcaaccaatgatccgatcatcacacaatatccgccggcagccaatgcttttaccacatcaccggaatagcgcaaaccaccatcagcaatcagaggaacacctgtacctttcagtgccttggctacatcatatacagccgacaactgaggaacacctacacctgcaacaacacgagtcgtacagatagaacccggaccgatacctactttcactgcatcagcaccagcttctgccaaagccttcgcagcttctccggtagcaatgttacctaccacgatatcaatattcgggaagcgtttctttgcttcttttagtttttcaataacgtacatagaatgtccgtgagccgtatcgattacgatagcatctgcaccggcatccaccaatgcctgcatacgatccagcgtatcagcagtaacgccgacacctgcagctacccgcagacgacctttggcatctttacaagccatcggcttatcttttgcctttgtaatatctttatatgtaacaagaccgatcagtttgccatccattcctacaatcggcaacttttcaatcttatgtttttgaagaatctgtgcagcagattccagatcggtagactgattagtagtaaccaatctttctttaggagtcataacaagatcaatatgctttgtcatgtctctttcgaaacgcaaatctctgttagtaacgatacctaccagataaccttcatcatccactacaggaataccaccgattttatattcagccataattcccaaagcgtcgctgacagtagaacctctcttgatagtaacaggatcgtaaatcataccattttcagcacgctttacaatggcaacttgtcttgcctgctcctcaatagacatatttttgtgaatcacaccgataccaccttcacgggcaatggcaatagccattttcgcttcggtaaccgtatccatggcagccgtcacaaaaggaatttttaactcaatgtttcttgaaaactttgtcgagagatcgacagtgcgcggtaaaacttcagaataagcggggatcaacaatacgtcatcgtaagttaacccatccattacaatcttatcagcaataaatgacatagggctgtgcgtttaaaaatttattgcgtgcaaatatacggtttttattcaaaacagcatacctgcacgcctatttttttcgcttttttaattagccatttcagagatgaacttgattctcaccagtcggacttcctcttcggtaaattcatcgcccagttcgtcaagagcatcatcaatcttgtctgtcgtagattccttgaagtaatcatagatatcgagcatatgatcttcatccataatttcttccaggaagtagtcgatattcagtttagttccggagtaaacgattgcttccacttcatccagcagttcaccaaactcgattcctttggaaagagcgatatcgtccagcgccactttacggtcgatagcctgaataatagccactttcatctttgatttattggcaaccgtacgtacacgtaaatcttccggacgttcgatttcattctcttcgcaatgacgtttgatcagcttacagaactcttcaccatagcgtttcgcctttccggcacctacgcccggaatattctgcagttcatccaatgtcaccggatagatggtagccatcgcttccaaagacggatcctggaaaatgacataaggaggaacttccagtttcttggacagcttcttccgtaggtccttcagcattgaataaagagccgggtctaccgcacaagagccaccgccacgtgcaggtacttcttcttccgtttcttcaaaatcattatcttcagtaatcttgaacgattttggcttcttcaggaacttatgcccttcttccgtcactttcaggagaccataattctccacatctttgctcaagtaaccgccaatcaaagcttgtcggatcactgcattccatgttttgtcttcttctcccatacccgaaccgaacacttcgagatcttcgtgtaggtgagcctgtacttccgacgtttctctaccttgtagtatgtctatgatataatctgccttaaaattttctttcaccgcgataatcgcttcaatcacggcacataataactcttgagcctccacttgttttttagggtttaaacagttgtcacaatttccacaattttcttccgtatattcttcaccgaaatagtgcagcaatgtcttacgccgacacacggaagattcggcataagcagcggtttccaacagaagctgcttgccaatttcctgttctgccacaggttttccttgcatgaacttttccagtttctgcaagtctttgtttgtataaaaggtcaggcactggccttcgccgccgtctctgccggcacgtcctgtctcctgataatacccttccagactcttcgggatatcataatggatcacaaaccgtacatccggcttgtcaattcccataccaaaagcgatggtagccacaatcacttccaccttttccatcaggaaatcatcctggtttttcgttctcgtcattgagtccatacctgcatgataaggacgcgcgtttattccgtttgcctgaagaatttcagcaagttcctctactttcttccggctcaggcaatagataatgcccgacttttccgaattgttcttgatgaacttgataatatctttatcaatattattggtctttgcgcgtacctcataataaagattcggacggttgaacgaggatttgaaaacctgtgcatccaccatccccagatttttctggatatcgtgctgtaccttcggtgttgctgttgcagtaagcgcaatcaagggagctttccctatttcgttaatgatcggacgaattcgccgatactccggacggaagtcatgcccccattcggaaatacaatgagcttcgtctaccgcatagaacgaaattttcaccgaacgcaaaaaatctacgttttcttcctttgtcaatgactcaggagccacatatagcaattttgtttttccggcaaggatgtcagaccttacttggtctattgcgcctttatttaatgaagaatttataaaatgggcgatgccatcctcttcactgaaattacgcattgcatccacctgattcttcatcaacgcaatgagcggagaaataacaattgccgtaccttccatcaagagcgaaggtaactgatagcataaagattttccgccaccggtaggcattagcacaaaggtatctttaccatcaagcaagttctgaatgattgcttcctggtttcccttgaacttattaaatccgaaatactttttcagttcatctgttaaattaatcttccctgccatcttaacttaggttgttttattcagttcatggtttaactttaagtaaagccctccattgcaagagagccaaacaaagttataaacaacttcgtaattaccaagcaaaatacgactaatattttcaagaaaaaacagaaacaatcattttcagtagccttactatttgatattaagcaatttgcagccttgccatattcgctttttccagctgttgttttgcataatccagcgttaccttatactcttttttgctctctgaagggatttcaaacatgacatccatcatgattgtttccacaatagaacgcaatccacgggcacctaacttatattctacagccttgtcaacgatatattcgaaaacagaatcttcaaatgtcagcttgataccatccatttcaaacaacttgatatattgcttgatgatagagtttttcggctcggtaagaatagcacggagtgcattgcggtccagcggattcagataagtcagcaccggaagacgaccgattatttcgggaatcaggccgaatgacttcaaatcctgaggagcaatgtactgcatcatattattcttatcgatcactgctgttttctgcgatgcggtatatcctaccacatgcgtattcagccgttgggcgattttcttttcaataccatcgaaagcaccaccacagataaagagaatattcttggtattcaccggaatcattttctggtcgggatgcttacggcctccctggggaggaacgttcaccaccgatccctcaagcaatttcagcaaaccttgctgcacaccctctccacttacgtcgcgggtgatagaaggattgtctcctttgcgggcaatcttgtctatctcatcgataaacacaattccttgctcagcctccggcacattataatctgccacctgaagcaaacgggtcagaatactttcaatatcttcaccgacataaccggcttccgtcaataccgtagcgtctacaatcgtaaacgggacatgaagcaacttggcaatagtacgtgccagcaatgtttttccggttccggtactacccaccatgataatgtttgatttttcaatttccacatcatcaccgctgtctttctgcaaaagacgcttgtaatggttgtaaactgatacagaaagaaagcgtttcgcatcgtcctgtccgattacgtactggtcgaggaatttctttatttctaccggtttgggcagttcttttaagttgagtttggtagctcccgccctttttctgccttcgcccagggcttcctgagtaatctcataagcctgagtagcgcagctgtcgcagatatagccgttcattcctgtgatcaggaatcctacttcattctccgaccgaccacagaagctacactttttctttgtctttgaatcagccatttttattttttaatcaatacttcatcaatcattccgtattctttcgcttcctgagctgtcatccagtaatcacggtccgaatcggcccataccttatcaaagtcagtgtgcgaatgatcggcgatgatcgtataaagttctttcttcaatttctgaatttcacgggctgtgatttcaatatccgaagcctgtccctgcgcaccgcccatcggttggtgaatcatcacgcgtgaatgcggcaatgcagagcgtttgccttcggcaccggctaccagcaatacggcagccatcgaagcagccatacctgtacagatagtagcaacatcacttgaaataaactgcatggtatcgtaaatacccagtccggcatacacactaccgcccggagaattgatatagatagagatatccttgcccgggtctacagagtccagatagagcagctgcgcctgaagcgtgtttgccgtatagtcatctacttgtgtacccagaaaaataatgcgatccatcatcagtcgggagaatacatcgagctgagttacattcagctgtctctcttcgagaatatagggattcaaatacccggcttgcgatttaatcacatcgtccagcaccatgccattcattcctaaatgcttggttgcgtattttctaaaatcatccatgttattgttcctttctaattaaatttataataaacgtaagtgcaaagaaacgaaaaagaacacagagacacaaaaaaacacagagttataattttataaaaactctgtgtttctgtgactttatgttctattcaaccgaacgattattcaaacattttattgaattcttccatagaaacgttcttgttctccaaagttacctgagctttcaaagctgcagccagcttcacttccactacgcggcttaccaggttgttgatagtatctttcttcttcaacatttcctgtgcatagttatcaagcacatcttcgggtacagacaacattccgtattgagcgaactgtgctttggtagtttctttcgccatcttcagcacatcttcctgctctaccttaatatcgtttgcctctaccagctgttccttgatcaggtgccaagtcagttcttcaatgctcttatcgtagttttcggctacatattcttcgcctttttcttcgttgttcagcaacatgatacgtttcagcaatgcatcagagaattccagcttacctactttgtccatcatcactttacgaatgtcgatcaggaatttataatcgctgtcagcaacaaatcttgctgcgatttcttctttgatcttagcgcggaattcttcttcagtcttcactacaccttcaccaaatgcctggtcaaatacttcctgagtcagttcacccggtacgaaacgagtgatttcttctacctggaagctgaagtcagacttcacatccttagcgatttccttgtcgatcttcaacagagagccgagttcagcagcgtgtccgtcgtaagcaacattcgggttgaataccaatacgtcatttacttttgcattagcaaagatagctttctgatcgtcgttcttcatataagaaggcattaatacagcaccttctacctgaataccgccttctttcgtattaccttcttcgtccagctgagccaacagacctttcagcatgtcgttatcttcgtaaacgtctactttgtcgtatttaccggtgcgctgagtatacatcttcacctggttttcgatcatttcatccgatacttcgatcgtatagtaatctactttatctttagcgcttacttcagctttgaattcaggtgccagagcgatatcgaacacaaactcgaattcttccattgtatcgaagtcgataacctgctgtttttcttcgttaggcaacggttcgcccagcatgttcaccttattttctttaatatagttgtaaacagcttcttgcagtaccttattcacttcttctgcaatcactgatttaccatacatcttcttaaccaggctcatcggaaccattcctttacggaatcccggcatctgtgccttctgacggaatgatttcaacgatttgtctactttttcctgatagtcggctttctcaagcttcacagtaagctgtgcgcttactttgtcaatgttttgtaatgaaacgttcattctgacaattatttatttgatttatactttgttctaactcaaacgagggtgcaaaattagtgctaatctttcaattttcaaaagacattgcagatttatttcgcatctattttggaatatacaaatgacaattgcatgacaggcagcggttcactagccacgcatccttgtttttttctcgttgcctgcaaataaaagtaagaaaaagatggtcaatccaaaaattattcttttctttgctgcggattgatggaccattagtttctcgatttgattacaaggtttttacttctgtttcgaaaacgcatttgtaaactctctgtcgttttaatctttttattagtaaccatctatccagagagttttattcatttatttatttttttatcattttcattatgaacatttatgttggaaaccttaactaccgtgttaaggaaggagatctgcaacaagtgatggaagattacggagcagtatcatcagttaaagtagttatggatcgtgaaaccggtaaatccaaaggatttgctttcatcgaaatggaagacgatgcagcagctgctaaagcaatcgcagaattgaacggtgcagagtacatgggccgtacaatggtagttaaagaagctagacccagagcttaattgccgacgctaatatagctaagaaaaaaaagaaacttctgccacctgatgacagaagtttttttatgtccttctatttacttttccgtcagccttccatattctgcacttccatatccttcactttacgaagcaggtccgaagcaaagataaagttattcagccgttcattggtagaagtgaaaatatcatctttcgtcccttcccattccttatgtccttcataaatataaatcactttctcaccgattcccagcacagagttcatgtcatgggtattgataatagtcgtcatattatactcctgagtgatgtcatgaatcaggtcatcaataactaatgacgttttggggtccagcccggagttcggttcatcacagaacaggtactgcggattcaatgcgatagcacgggcaatagccacacgcttctgcataccgccactgatttcacccggaaatttatctttcgcctcagtcagattcacacgttccagacagaacatggcacgcttggtacggtcacgcagtgtatcgttgctaaacatattcagcgggaacattacattatccagcaccgacatggagtcaaaaagcgccgcactctggaaaatcatccccatctccttgcgaagcatctttttctccttcttccccatcaagacaaggttacgtccgtcatacagcacttctcctttttcgggagtaagcaagcctacgatacatttcatcaagaccgttttaccagagccgctctgaccgataatcaggtttgtctttccattctcaaaagacgcattgatattactcaataccgttttatcttcaaatgatttataaagtcctctaatatcaatcatcccatcaaaagtttagttaataccaaatctgcaaacagaatcaacacactactgcttaccacagcatccgtagaagcctttcctacagcaatggaaccaccatctaccgtatagccgaaaaaggcagaaacacttgcaataataaaggcaaagaaaagggattttatgatacccgcccagataaaccattcgacaaacatatactgcagtccatattccagatcgaccgcattcatcacaccggcaaaccaacaggtacaaaaagcaccgataataccggcaaaaatactaaacgtcaccaacacagggatcacagttaccatggccgttattttgggtagtatcagataattggcggaattaatacccattatttcgagtgcgtcaatctgctgcgtcacccgcattgttcccagttccgaagcaatgttcgagccgacctttcccgccagaatcaaacacataatagaagaggagaactccagcaacataatttcacgtgtcacatatcccactgtccagcgaggcatccatggactttcaatattcaatttaatctgaatagtaatcaccgcgccgatgaaaaacgaaatcaacaacacgatgccgatggagttcacacccagttgctccatctcgttaaggtattgccggaaaaacatacgcatacgctcgggacgggaaaaagtacgtcccatcagtatgatatatcgtccgacagttctcaatgcttttatcataactcacactatttgtctgcaaatgtacattatttcagcttatttttactacatttgccgcaaaataactagaatatggaagaaagcaagatggtgcttcgcacggaagacctggttaaaaagtacggtaaacgaaccgttgtaagccatgtatccatcgacgtgaagcaaggtgaaattgtgggtttgctgggaccgaacggtgccggtaagacgacttcattctatatgaccgtaggactgattactcctaatgaaggacgaatctttctcgacgaccttgagataaccaagtttccagtatacaaacgggcgcagacaggtatcggataccttgcacaggaagcctccgtattccgtcagatgagtgtagaagacaatatcgcttccgtactcgaaatgaccaataagcccaaagattatcaaaaagacaagctcgaaagtctgattgccgagttccgccttcagaaggtacgcaagaacaagggtaaccagttgtccggaggtgaacgccgtcgtactgaaatcgcccgttgtcttgccatcgacccgaagttcattatgctcgatgaaccgtttgccggagtcgaccctatcgcagtagaagatattcagcagattgtgtggaagctgaaggataaaaacatcggtatcctgattaccgaccacaatgtgcaggaaacattaagtatcactgaccgcgcttatctgctgttcgaaggcaagatcctgtttcagggaacaccggaagaattggcagaaaacaagattgtgcgtgaaaaatacctgagtaacagtttcgttttgcgccgtaaggacttccagttaaataaagacgaataatcctcttaaataaaaagaaatcgcccggcaatggaatattgccgggcgatttctttttattcatacgaatataccttttacttctgtcggatataaatattgatcggtgtaccggtcaggttccacttctcacgcattttgttttccaggaaacgtttgtacggttccttcacatactgcggcaaattggcgaagtacacaaatgaaggcacttgtgtattcggcaactgcgtgatatatttaatcttgatatatttacctttattggatggaggcggatatgcctcaatcagcggaagcatctcttcgttcagacgggcagtcggtatcttcgtcgtacggttttcatacacgttgcgggcttcttcaagcactttcaggatacgctgtttggtcaatgcagaagcaaatataatcgggaaatccacaaagggagcaaaacgtgaacggatagtcgcttcaaactccttcatcattttcgctgttttatcctctatcaggtcccacttattaatcacgactaccagtcccttctgatttttctgaatcaaagaaagaatattcaaatcctgactttcaacgcctcttgtagcatcgagcatcaaaatacagacatccgcattttcaatcgaacgaatcgaacggactaccgaatagtattccagatcctcgttcaccttattctttttacggataccggctgtatctaccagataaaaatcaaatccgaatttattgtaacgagtataaatagagtcacgggttgttccggcgatctccgttacaatgttacggtcttctccgataaacgcgtttacgatagaggattttcccgcattcgggcgtcctaccacagcaaagcggggaatatcatcatccagaatttccgaagtctctttattgaatttgctgacgatcaagtccatcaaatcacctgtaccacttccggtgatagcagagatacaatacggatcgcccaatcctaatttataaaactcaggagcgttatattgtaattcattattatctgtcttattggcaaccataatcaccgggctgttagcacgtcgcaagatagtcgcaacctgcatatccaggtcagtcactccgttcatcacatccactacaaacagaataacgtctgcttcctccacagccagcaatacttgcttccggatttcctcttcaaagatatcgtcagagttcactacccatccgccggtatctaccacggagaactcacggcccagccattcggacttgccatactgtctgtcacgggttgtacccgcttcttcattcacaattgcctgacgagttttcgtcagacggttaaataaggtagacttgcccacattagggcgtcctacaattgcaactaaattattcatagctcaataccttgttttttcacgactatcccagtcgcatgaatactcttaatctaactgataaccaaagttccgcagttccttatccgaactacgccaatctttatcaaccttcacataagtttccaggaaaatcgtctttccaaagaaacgttccaattcccggcgtgcttcggtagctacttttttcaatgcttttccctgcttgccgataatgattcctttttgtgaatcacgttccacataaatcactgcccggatatgtatttttttcgcttcctctttaaattcttccactactacttccaccgaataggggatttccttatcataatatagcagaatcttttcacggataatctcattcacaaagaagcgggcaggcttatccgtccactgatctttgccgaaataaggaggagaatcaggcaacagttcctgaatacgcttcatcacatagtctacattaaacttagatgcggcagaaataggaataatctcagcctgcggaagcagttccttccactcttcgaccagtttgatcagcttctcctgatccgtaaggtctattttgttgataagcaacaggacaggaaccgtcatctgacgcacctttcccataaactcattattcttatcgggcgtctccaccacgtcagtcacataaagcagtacatccgcatctgtcagtgcagaagttgagaagttcagcatcgactcctgcaacttatagttaggtttcaatactcccggagtgtcagaaaaaacaatctgcatatcatccgtattataaattcccataattcggtgacgggtagtctgcgctttgaaggtagcaattgatatacgttctcccaccaaagcattcatcaatgtcgactttccgacattcggattccctacgatgtttacaaaacctgctttatgcatttctctttattttattggttgagacaaaaaaacgcatcgaatcgaaataggatgcgttttttgtgttataattcagtaacttacgttacgattccttttttccgtcataaccccattttacataaaccgcaccccatgtaaatccggcgccgaatgctgtaaatataatgttatcacctttctttagtttatcttcaaaatcccagatacacagaggaagcgtagcggcacttgtgttaccataatgttcaatgttcaccagcactttatccatcgggagttccatgcgatgagccacagcttcaatgatacgtacatttgcctggtggggaaccacccagttaatagtatctttggtcagaccattcttttctgcaattgcagccgatacatccgacatacttgaaaccgcgtatttgaacactgttcttccttcctggtgcagatagtgcattttattgtctacagtgaaataagacggaggacaaaccgaaccaccagctttcatatggaggaaaggcaagcctttaccatcagttctcagtatcgaatccataacacctaaatcttccgtagtgggctccatcataaaagcagcggcgccgtcaccaaagatagggcatgtagcacgatctgtatagttaaccattgacgacatcttatcggcaccgacaatgataattttcttatatcttcccgaacgaatgaaattagcagctgtttccatcaaatacaggaaaccgcaacaagcggcctgcaaatcgaaagcaaatgcgtttttcagtccgagtttatcgcaaagaatagaagctgtagaagggaagtgatagtcaggagtagtagtagcaacaataaccaaatcgatatcgtcaggattggctccagtcttcttcatcaactgcttggcagctttgcgtgccatgtatgagctacctaatccttcctcattcagaatatgtctttcctttactccaatacgagtcataatccattcatcgttggtatctaccatttttgatatctcttcattagtcaagatataatcgggtacatatcctccaactcctgtgattactgcatttattttttccatcaaacctattttaaattagcgatactataatacttaaagcagccggagagttttccccctcggctgtcttgagtatactgtactaattatacagctgcttctttttcgatagcgagcttacctctgtagtaaccacatgcgccacatacagtgtgataaacatgccattctccgcaattcggacaaatagccaatgtaggagctactgccttatcatgagttcttctctttgctgttcttgtttttgattgtcttctcttaggatgtgccattttcttaaaactttaattattatctaatattttttttaattcattccaacggggatcaatttgttcctccatttcctccgcaactacgatatcatctccacctgtgtcgaagacttcatcgctatcttcattagcatctgttttgagatgcttgctcaacttgctagtaacagctttgttgcacttacccggagcgtgtacatgcttcattgggatagagagtgcaacgaattcatacatgaaccatgcaacattgatttctccctcttcttcagggatcacaatcaggttgtcgccttcctctgcatattcatgtccaaacttcaccatcagtttgtcagacgaagtgatctgtagctccatttcgtccaggcaacggtcgcatggtacccatactataccgtctgtctgaaagctcagttcgaaagcacgagaggttcttttcacagtcaaagtaacatttacttttcctttctgaacttcaggaccatcaatgtgggcgaagtaaaggttatccaaaacaaactcatacttagcagagtctgtttgcatgcctttcaaatcaattttgtatttatcaaactttcccaaagcttctctcttttttaaatcgttagattacaattcgggcgacaaagatacaaataaatatcctcataacatacaaattaccagtaaatattcacttttttaataggtattatgaggattattgctgttaaaaatgatgtcacaaatttcagaaggacaaaaaacaataaagcccttcgggtatttctacctgaagggcttctctaaaaacggcggctacctactctcccactgttacgcagtaccatcggcgtgacgaggcttaacttctctgttcggaatgggaagaggtggaaccctcgtgctataaccacctgaataaattcaataaggttatgacatgatgaaaagtaaaacttaagtaagatatcagagtcaaatgaatgaacttactgatacgctcgctaaacgtatatatcgcgatccgcaccgtccgaaagaaagtgaacgggcaattagtaatgctcggctttgatgttaccacctttacacctgcatcctatcaacgtcatcgtctttaacgaccctaa

SEQ ID NO: 104 - DNA, 26834 bp, Bacteroides thetaiotaomicron
atacctatctataataaaaacaatattatggattttaagaaactagcgaatcagtaccgggatgaattgttggacaatgtccttccattctggctcgagcactctcaagatcttgagtttggcggttatttcagctgcctggaccgtgaagggaaggttttcgatacggataagttcatctggttgcagggacgtgaggtatggatgttctccatgctttacaacaaagtggaaaaacgacaggaatggctggattgtgccgttcagggtggtgaattcttaaaaaaatacggacatgatggaaattataactggtacttttcactcgaccgttcgggtagaccactggtagaaccatacaatattttctcatatactttcgccacgatggccttcggacagctgagtctagcaactggtaatcaggaatatgcggacatagcaaagaagactttcaagatcatcctttccaaggttgataatccgaaaagcaagtggaacaagcttcatccgggtactcgtaatctgaagaacttcgccctcccgatgatcctctgtaatctggctttggagatcgaacatctcctggatcccggctatctggaacagacgatggaaacctgtatccatgaagtgatggatgtcttttatcgtccggagctggggggcatcattgttgagaatgtcgatatggacggtaatctggtggattgcttcgaaggtcgtcaggtgactcccggtcatgctatcgaagcgatgtggtttatcatggatctgggcaaacgcctgaatcgtccgaaattgatagaaaaagcaaaagacgtaaccctgacaatgctcgactatggttgggacaagcaatatggaggtatctattactttatggaccgtaacggttgtcctccccagcaattggaatgggatcagaaactttggtgggtgcatattgaatctctgatatcactgctgaaaggttatcagctgaccggagacaggaaatgtctggaatggtttgaaaaagtgcatgactacacatggtcgcacttcaaagatccggaatatccggaatggtacggatatctgaatcgcagaggggaagttttgttaccgctgaaaggtggtaaatggaaagggtgctttcatgtaccaaggggattatttcaatgctggaaagtattagaaccgctatagaaacaatgaattattatgttaaccaatcttattaataatctaaaaattaattctatgacagagtttaactcaaaaattaagcaaaactctcgcatattgaagatatttcttttctcaatatgcgcactttttgcatgtgctatcaatgctcatgcacagagtttggtgcaaggtactgttactgatgagacaggagaatctctacctggtgtaagtgttgtagtaaaggggactactaatggtacagttacagatgttaatggaaaatacagcattcaggcgacttcaaaagatatattgtctttcacatatgtaggtatggcggaacaagatataaaagttgccggacagaaaacgatcaatgtggtgatgaaggatgatgtggcatctctggatgaagtgattgtcgttggttatggtactgcaaagaaacaatccctgacaggagcggtttctgcagtcaaaggcgacgaactgttaaaggcaccggcaaccaatgtatcaagtttgttaggcggacgtttgccgggcatttcttctgttcaagtctctggagaaccgggtgatgaccaagcagtattgcgggttcgtggttctatttacaatgttacttatattgtagatggtatgcctcgttccatcaatgacattgatcctaatgatattgagagtgtatctgtcttgaaagatggagcttctgcggctgtgtacggtttgaagggcgcaggtggtgttatcattgttacaacaaagagaggacaggaaggaaagtcaagaatcacatataacggttcaataggagcatctatgaatgcaaactttccgcagtttatgaatggtccccagtttgcatattattataatatggctgatatgatggataagctggctaacggaagtattacggacatgaagcaatatacaccggtattcacaaaagcaaatgtggaagcgatgttgaacggcgatcctactgatgggtgggataatgtcaattatattgataaagtatttggtacaggtatcaatcagaagcataacatcaccgtacagggtggtagtgacaaaatgcgttatttcacgtctgtcggctatttgggacaggatggtaatattgataactttacttatagacggtacaacttaagaaccaacattgaaactcagctggccaagaatttccagttaagtttgggagttgccggaaatgtaggaaaacgtgaaactccgggatatgcctccggtggtacagattctaattccacattgggagaacaaggttggttatccgttgctcaccagactatcatgatgcatccgtatttaccggaaaaatatgatggactttataccgctactacacagaataatacaagcttaccgaatagtccgctagcagctatttatgaatccggctacaaacataccaatagctttgatttgcagactaacctctctttacaatataatctgccttgggtaaaaggattaagtgtaaaggttaccggagcttatgactacaagacctcacataataaaaacctgaatacaccttattctacttatatcaataaaatgccgacttccactacagactggacttggactaaagcggatgatcctcgtggaactgcaaatggaataaatttaggtgaaggacaattcagttcccgtcaaatggtaggccagggaagcatcaattatgcgaattctttcggtaagcataatgttgaagccatggtacttgcggaaatccgtgattataaagaaaacagtttctccggatataataagaatatgagttttgcagaacttccggaattgagtttcggacaaccggcagactcccctatttccggctacagtgatgccaatcgtagcattggttacgttttccgtttgaaatacgactatgacaataagtatctggcagaatttacaggacgatatgacggttcgtataagtttgcgggcaatgtaagtggaaaacgttgggcatttttcccatcagcatcagtagcgtggagaatatccaaagaaaactttatgtccgatctgacttttctagatgatatgaaaatacgtgcatctatcggtttgttgggtaatgacgatgtgagtccgtatgcattccttagtacttataacctgatggacggtaacaaaaatgcgtaccagacaattctgaacggaaaagtcatgcaggcgctgcgtgcatctgtaattgcaaatcctactctgacgtgggaaaacacgttaacttacaatgcaggtttcgactttaccatgtggaatggtttactgggtatggaatttgatgcattctataattatacctatgatattctgacagcaatgggaggcgattatccaccatcaatgggaggatattattatacgtatgccaactataacaaggtagacagcaagggagttgaaatcacagtgagtcatcgtaataaattaaatctggcagggaaaccattttcttatggagccagtttcaacttgacttttgcaagaaatcgctatcttcgttatccggatagtcccaatactgtagaatggagaaaacgtacaggtcgcagtgtagacgcttcagtcgtatgggtggcagaaggtttgttccgttcggaagaagaaattgataattccgcatggtatggaacccgtcctaatgtaggtgacatcaaatataaggatttaaatggcgatggcaaaatagatgaagatgacagaacacgtgtaggacggggcaatcgtccggaactgacttatggtctgaacttgaattgtgcctggaacggatttgatttaagcgcacaatttactggaggcgcattgttcgatgtatcattaaccggaacttactataatggttatgatgacaatacggtctggacacaagcattcaaagaaggtgccaactcacctttatatctggttcagaatgcgtataccacggaaaatccgaatggaacattcccacgtctgactctgggaaatcaaggacatggaggagacaatggattagcttctaccttctggttgcgtaatggcagataccttcgtctcaaatcggcacagctaggttatacattccctaaaaagtggatgagccctgtgggaattcagaatcttagaatttatgtagaaggttccaatttattcacgatctccggtcttcccgatggaatcgaccccgaatctccgggagtgaataacggatattatcctcaacaacgcacaatcatgggcggtataactctgactttctaaacctttaaaagatttattatgaaaacaaaatttataagtatcatattgttgggagcctctttagggcttggttcatgtagtgattatctagacatgacaccgacggacaaagcatcagataaactagtatggagtaaactggaatatgccgaacaagctgtcaacgatttctaccgttatatcgattatttaggagtttatcgtgacggacaatgcctggcaggcatgacggaagcgttgacagaccaactcaaatacggttcctataactatatgtctaaatgccagatacctagcgaaatcgcttatggaggatccgttctgacagtaagttatgtcagcacttatttaggcaattgggggacgatgtatgaatatgtacgccgtgtcaatgaaggtctcaataaactgaaaaagtacgcctcattcggtcagacggaacaagaacggctggaagcggaaatgcgcttcttcagaggatatttatataccgacttggtaaaacgttataaggaagtcattatatatgatgaagatctggataatataaagaaggatatgccggtcagttccgaagcagaaggatggaactttgtatatgaggacctgaagtttgcgggcgaacatttaccggttgataaaacccctaatggacgtctgactagcggagcagcttatgcaatgctgtcacgggcaatgctttatgcagaaagatgggatgatgcccggatcgctgccgaagaagtgatgggcatgggatataagctggaagaaaaagagaattattctaatgcatttaaagcaggaagtcaggaagctattctgcaatattgctatgacaagagttctactgtaactcatgattttgacggctatatggctcccggaggtgataaagcattggatggtaattcaatgaccggaggatttggaactccgacacaagaaatggtagaatcttatgaatatgcggacggtagcggttttccggattggagtacctggcatactgcagaaggaacaacggcaactcctccatacgataaacttgaaccacgcttcaaagcaaccattctttataatggtgcgacgtggaaaggcagaacgatcgcatcttatgtcaatggtactgatggttgggctgcatggaaaacggatgccaaaccagaaggacgttctaccacaggttattatttgcgtaagctggtggatgagactcatagtttcacttctgtgcaggcaagtacacagccatggaccgaaattcgttatgccgaagtgttactaaatcatgccgaggcttgctatcatttgagtggctatgccgataaagccaataaagacatcaaagacattcgtaacagagtcggcttgccttattcggacaagagtggagaagacctgatgaaagcgattcgtcaggaacgtaaagtcgaattagcttatgaaggacactattattgggatatgcgtcgctggaaactatctgcaacggcattcaccggtatccgtcttcatggacttaagatagaacagaatgcaaacggttcgttcaattacatttatgtagagtgtgatgacaaagatcgtaacttcccgactaagatgtaccgtttccctatgccacaggcggagttggacaataacggtgcggtaactcaatatgcagaatggcaataaatctaaaatgaaaacaattatgaaaaagaatatacaatatttactattaggagtattggcattaatgagttcctgccaagatccggaatatgtacttccaactgctgagcggcagggaatcacaagcttgaccgcactttttacatcaggtccttatgtggacaaagaagctgttgtctacacaattgcggatgcgtctgtagataaatatgtgattcctataccatggttttatccggaagacagtgaaaatgaaacggcggaatatatgaagacaatgagggtccaggcaaagttagctcctaactgtactattaaccctgttttgacgatattggatttgactaaagaaaattacttcacttatacagatgcgcagggatataagaaacaaatctgcattacgggtgaaagagtgaaatccaataaatgtcagttattaagtttctcaataccggccgaagatattagtggaattattgacgaagagcataagacggtatctctgatttctgcagaagatttatcttcctgtctggcagaatattcactttcctctcatgcgacaatgtcgccggatcctaagacagaggcgcttgacttcaattcacctgtagaactgacggtcatcgctcacgatggagtgacgaagcagacgtacacagttcagaaggcagtgccggataagatcccttatggatatagaaaaggcagtgagacagaattgtttaaattggatatgggagttataggtttgccctggacttcagccaactcaccttcactggccgttaatggcaataatttagttgtttgcttaggggacggttctactgctcctacctattataatgcttctacaggaagtaagattggcaatatgactttgggaagcgtaggtgttgcatctttaggttgtgtgacaagtgatagtaaaggaaacatattgttggcaacaaaagcagctaatggtaaatccttctctatctataagacttcttctgtaaccacagttccaactttattgatatcttataccaacaatacaagtttggatatgggtaccaaagtatctgtacagggtgatatcaatacaaatgccgctatcattgctacatgtgacgggacagcctcgtccggttctaatacgtttgttcgctggattataacagacggtgtattgggaagtcctgaagtagtatcggtaaatggtgttggctattggggatctcctgtgtcaaataccaaggttgtcaccaaaggaactactgcacaaagcgattatttcttatcctattatgatcctaacgtactttattgggtgaatggaacaagtaataatgcgtccaagtctttatccaattcggacaatggcaattcctgggcaatgaataataactgtctggatgcaagaacgttcaataatgcgcagtatcttgtattggtatctacggctcacttcccgcaatggggaggcactccgtacttatatatgtacgatgtaacctcagacggatcgtttaccggtacggtatctacttcagacgctttgacattcaatccttcactttcttcgttcggttctgcagatggtgtagcggcaacaggtgatgtattgtttgctccaactacagatggatataaacttcgtctctactatgttgacaacaactgtaagattatcggagggtatgaatttgattgtatcgacaaataattaatgtgtttcaaaagagttactgacattaataaacatatataatatgagaaatctttttaaaatattattattgacgttttgcggaatggttgctatcacttcatgtagtgatgattctgatggaatccccggatggccctggaatgataattcaacagagggaccggaaaatccggatgtaacagaaatcaagccacgctatgtctggattgatgcggcagctaattttccggattatgcgaataataaggagaatatctccacagatatggtgaaagtaaaaaacgcagggtttactgatatcattgttgacgtgcgtcccactacaggagatgttttgttcaacactactgcagtagatcaggtgaagcgaatggatgtgtggggaagttcgggttatgtatattatgaacgtactgaaacatgggattacctgcaggcatttatagatgcagccagaagtcaggggctgaaagtacatgcgtcagtcaatactttcgtcggtggttacttatgtccctataacctcggatcagatggaatactgttccgtgatgactcgaagaaggaatgggcaagtgtggctaatctcgctgacggtctgacaaatacgatggatttgttgaatgacgagaccgattatggagctaaatttttgaatccggctaacgatgatgtgcagaacttcgttttgcagttactgggtgacctggctaaatatgacttggatggaataattctggaccgttgccgttatgacgattatggcttggaaagtgatttctcggctgtttctaaacagaagtttgaagagtacattggggaaacagttgctcattttccggaagacattatggcaccaggcacagatgagataccttcagatcagcctgcctatttcaagaaatggttggaatttcgtgtaaaagtgattcacgactttatcgtcaaggcacgtgagaaagtaaaatccgtaaattcagaaatcaattttggagtgtatgtaggcgcatggtattccagttattatacttcgggagtaaattgggcaagtcctaaatatgacacctcagcctactatcctaaatgggcaacagcagattataagaactatggttatgccgatcatctggattatatattcttaggtgcttatgcatctgtcgataagatttatggtagcggcgaatggacaatggagggattttgcaaaaacggtcgcgagttgctgaaaggtgacgttcccttctccggaggtccggacataggcaatggtaccggatggactaacggtggacaagccgctaaaatacctgatgccatcgacgcatgtataaacaatagcgacggcttcttcgcattcgacctctgtcatatcaagatgtacgactattggaacgctttcaagacaggatttgataactatctggagtccgttcaaaaataggaagttgataattcaatctgagaatatactcaatacaagtattctcctttctattcatagcactaagtctgagccgcaaggttcagacttaatgttaatgaattgccttatttgtataaagaacaatagataactatgaaaatatatttattacaacttgtcattttgatgagtttgagtttgaacttgcaggctcaaaatttatccggtactattcgtggaaaggtaacctgtcatgggaaaggacttcaaggagtagttgtaacggacggaatcgactgtgttctgactaataagtcgggcgaatatgtgcttgctcctcaaagggatgcccggtttgtttacttgtccgtgccttccggttatcagccgaaaacagaaaagaccattcccttattccatcaacaaatagagatggataaacaagacggatataattttgagttgatgaaaaatcctcagaatgatgcgaatcatctgtttctggtgcaggctgatgtgcaagtcacttccgaagacgatgtgaaagcctatggcagattcctgcaggatataaaagaatatgtacagccttattcgggaaaaagagacatattcggtattgattgtggagacatcgtgggtgataccccctctttgtatccatcttacattaataccgtatctactttggactttcccgtttatcgtgctatcggcaaccatgacatgacctacggaggacgtacttttgagtactcgtaccgtacttttgaaagttatttcggccccatctactattcgtttaataaaggaaaagcccattacattgtactcgacaattgtttctatgtcaatcgtgactaccagtacatcggatatattgatgaacggacttttgcatggctggaaaaagacctttcgtatgtgtccagggataagctggtatttgtggtcatgcacattccctccagccttcagaaaaagttaagatataatactttggatcaggatgaaacagtgaatacagctgcactatataaactcttggagggctataatgcgcatatcatttccgggcatacccatttcaatacgaacgtttgtttcaatgattcgttgatggagcataatacggcagcagtgtgtggcacttggtggcgtgcagacatcaatgtagacggaactcccagaggttacggtatatatgaagtgaacggagatcaattgaagtggatttataaaagcgcaggttatccgctggaacaccagtttcatgcttatccggcaggatcgtcggatgaatatccttctgatatcatagccaatgtatggaactgggatgatctttggaaggtagaatggtatgagaatggacaaaggatgggcgaaatgcaaaagtacaaaggatatgatcctatggcaaaagccatctgttcggataaggaaaaggtgaaatatgactggatatctccggttcttaccgagcatctctttcatgcaactcctcatgacccaaacgcaaggatagagattaaagtgactgaccgtttcggtaatgtatatactcaaactattgaaaacaaataaactaaaatcatatgttcagaaacagatacttttggctacttataagtttgttctttgttctgaaaacagaagctaaagtaaccttgacctccatttggggagacaacatggtgttgcagcaacaagcagaagttacttttcgtggaaaggctactcccggaaaacgtgtatatgcttccgcttcatggaatcatcggaaaatctatgcagattgtgaccggaacggacaatggacactggctcttccgactccggaagccggcggaccatataccattactttttcggacggggaagagctgaccttaaaaaatatcctgatcggtgaagtctggttctgctccggacagtcgaatatggaaatgccggtaaaagggttccgcggacaaccggtctatggttcgcagccctatatcgtgtccgctaatcctaaacgaccattaagactttacaccgtaaagaacaattggagcacgactctgaaagaagaaggaatagacggacaatggagtgaagcatcttcggaagaagtggccgatttcagtgcaacagcttatttcttcggcaatctgttgcaacaatctttggacgtacctgtaggattaatacattgctcctggagtatgtcaaagatcgaagcatggatggacaaagaaaccttatctcatttttccgaagtaaccttgccggatacaaatcaagataaattcgaatgggctgccgggacgcctaccctgttgtggaacgctatggtaaatccatgggaaggattccctgtcaaaggagttatctggtaccagggagaggcgaatactcccgatcctactctttataaaaagctttttcccgccatggtctctcaatggagaaatttctttcataatgctgaaatgccattttattatgtccagattgctccctggaagtccgaagggaatgacaagttggattgggcatggttccgtcaatgtcagttggagctgatgaaggaagttcccggagtgggaatggtgaccaccggagacgcaggcagcgaactctttatacattcaccttataagattaaggttggagaacggttagcttattgggcactggcccagacttacggccgaaaagggttccaatattccggtccagtctacaagacctatcgtatccagggaaatgctgtagaaatagactttgaatatggagaggaaggactgactccggaaaatcagaatgtgaaaggttttgagatcgtaggttccgatggtatattccgacctgcaaaggcggagatcatcaatggcacatctactgtgaaagtatggaatgattctgttagtgacccgacagaagtccgctactgcttccggaattatgtgcagggggaattatgcaataatgccgggcttccggcttctcctttccggatcgtcatcaaaaagaaaccggccttaatgtggattgatgccgaagcaaactttgagcgcttcagtcataaagattcgattgattattacttggaaaaaatcaaatcgctgggctttacacatgcggttgtcgacattcgtccgatcacaggggaagttttatataaaagtgaatatgctccgcaaatgaaagaatggaaaggagccaaagccggtgattttgactatctgggatactttatcaaaaaagggcacgaactggggctggagatacacgcctcattgaatgtattctgtgccggacacaactattttgaccgtggaatggtatatagcggacatccggaatgggcttcgatggtgtacactcccgataaaggaatcattccaatcaccgaagagaagcataaatatggtgccatgatcaatcctttgaacgaagaatatcgtacccatatcctgaatgttctgaaagaagtcgtgaccaaatatcccgacctggacggtctgatgctcgaccgggtacgttacgatggaataaccgctgatttttcttcattgtcacgtaagaagtttgaagaatacataggtaaaaaagtcgcaaacttccccgaagatattttccgttggactaaaaatgcagatgggaaatacacaacgcaaccaggaaaatatttccggaaatggctggaatggcgaactaaaaacattactgatttcatggcgcttgcccgtaaagaagtcaaggcagccaaccctgacgtttctttcggcacgtacaccggtgcctggtatccatcttattatgaagtaggcgtaaactttgccagcaaagaatatgatccgggcaaagatttcagctgggcaacacccgaatataaaaattatggctatgccgagctgatagacctttatgctaccggtaattattatacggacataaccatcgaggaatacagaaaaacgaaccggagtatctggaacgaaactgattcgcaggctcaatccggtacgtggtattgtgtagaaggctcatgtcagcatttacgtcagatattgaaaggtaataaatttatgggaggtattctggtggaccagttctatgacaaccccgccaaactttcggaaacgatagagatgaaccttcgccgttcggacggattaatggtatttgacatcgtacatatcattaccaaaaatctgtggaaagaagtagaggaaggaatgaaaagaggaggctccttatgaataaccgggcctatgcattagacgctttgagaggatatgcgattattacgatggtactttctgctaccatcgtaacgcaggtgctccccggttggatgagtcatgcgcagacgccgccacccgatcatatattcaatccttctttgcccggcattacatgggtagaccttgtttttcctttcttcctgtttgcaatgggagcagctttccctttttccataggtaagcgtgcagagaaaggtgactctaaactgaaattagtatatgaagcggtgaaacgtggagtacaactgactttctttgccatcttcattcagcatttttatccgtatgtgctgagttctccgcaggacatcagagcctggttgctggctattctttgctttgcggttctgtttccgatgttcatgcgcattcctttgaaaatgccggactgggcacataccggcataaagatagccgcatacggaattgcggtaatcatgatgcttactacttcttatgccgatggaagaacgttcagcctgtattttagtaatgtgattattctgttattagccaatatggccatcttcggttctgccctctacatttttacgatgcataaccgatggttgcgtttgggagttttattgctgctgatggctgttattttgggaagtactgtcgaaggttcctggacacaggtgatattcaattatactcctttgccctggatgtatcggtttgattatctgaaatatctgtttattgtaattcccggcagcattgccggtgagtatttgatggaatggatgaagggccgaaaggataccgaacagccggcttcaccgcaataccgtaagataggaattgcgctgctgatattgactatggtgattattgtattcaatctctatgggctttatacccgtatggtgacagtgaatttattagcgacacttgtgctgttattgattggcaaattggttttcttacgtccgacagaaggaatcgctttgttatggaaaaagctgtttaatgccggagcatatcttctccttttggggctatgttttgaaccttttcaagaaggtatcaagaaagatcctgccacttttagctatttctttgtaacttccggtctggcattccttgcgctcttattcttaagtattgtttgtgattatttcagatgtgtgcgaagtagccgctttcttgttatgtccgggcaaaatccgatgatcgcttacgtggttggtgatttattcattatgccgttggctaatatactgggacttgcctcgctgttgtcctacttccagcagaatgcgtggcttgggttccttcagggagtaatcattacgtctttagctgttttggtaacgatgttttttactaagatcaagtggttttggagaacttgacatcattcaatagatataccgacagtataataacaggcattaaaaataagttgaacagaaaacaaaatgatagataaatagcaaaataggaagcataatttccttatttccctatttttgctatttctatcttttgatagatgagtaaagatagaaagagatatgcatacaatcttgaattaatatgcatgattatgaataaacgagcggtcatttgcataaaaaacaccgtatagtttgaaataaacataaggttgattgagctaaaacataaggttgattgtaaataaacataaggttgcttttaaaggaacgtcccattgctttaaaagcaacgctaagtccgtttaaaaggagcacattttagctctaaaatgatgggtatcttatttattagactttgttttaggatgaaaaaaaataatcagaatgatgcaaagtaatataaaaaaagaaagatattacagaatagcatgaaaaataacgcaaaaagaatgcatatagatgcatattcgcaacaaagtgatttcctgtaacggcaaatctctgtcattttattctctatcctgtgcagtgatggaaatacgcccgttagagagtttataattatcaaaatgacaaaatgccattttgataattatataacatggtaagtcttaataaaacgattcctttttcaatggccatcctgtgatagttgacatataaggaatcaatgacatagccattttcatttgacctttgtaattgggatgccatactgctcctaagtctgtagtcgaatcgcaaaggccttcgggaagaactgctatataaactttcttatcattcaagtctttgcgcatacgctccatgtattgaacgatctgccgttgagcaatagccggactgatgcataatatagggacatctccgtaatttgtacgaagacggcttattagtagcttataagcatgaataaactcatcttccaacggatatatattggtggaaaaatcattagttcctaaattaacaaccaccaaatcgggcttgtatgttttaaagtcccatttcttatccaaattcatatcaaatgtattcagcatacggtctttcattgtcacggcagatattcggacggaatctccataattgcggactactccacgtccggaatgtgcaataagcgtataatcggcattgaaatagcgggcgataatagtggcataagataagttgcaattctccgtttcagctttataaggttcgctacggtctttcccttctacaccatagccacacgtcagcgagttaccgataaattcgatatgtctggacgggcactccgtttctttcatcagttctccttcattatgaagcacaaattgatgaatggttgtctttccccattccccttccgtacgtttttgaatcaacacatgatggatgcctttatccatgccggaaatgaaattaatcaaagtatctttaccggatacttttaccgttttgtgtaaaaggctgtctacaaaaacattgtaataattaataccagtatctgaaatcttcatagacaattctcctcccgaaagtcgggtacgaagataagtaccggtccagtcgaaagaaacggagccatcactctgtatttccgtacgtcccacgtaagaaacgttttcatcattagctttatagtatctgttcttggtagtttgagcatttacatcttcaaacaacagacagaggctaaccagaactaacacatttttccacatatcgttttctaaattaatcaaaggtaatcacacaactgccggacccgtcggatacaattctaagtcctttggctgttactttattaccggtaattgttattgatttacttttctctataatcgtaaaagacttctttgtataatcgacaggcaactgtattgtcctgtcgacgttcttcttgcaatctataaaaaggacctttttattatctattacaccctcataacacagcaaatcatcatcatcagaaacaggagacttaaaccaggtatacactccactccaatgaataatatccccctttttgtgttctctatcagctataatcttgtggtaggtcttattgctggaatttcctatgaatataatatcatcatctgatatttcttcatgatttcccaatccatcggcaaacagataagaagattgatacacatttgcgcttttctcaatgaaacggcgaaatgacggatactctttctttgtaaaggtagaaacatccttttgtactgtccagtccacatacttgccattggcagttaatgtatgtgtctccttgtcaaacatagattgcattccgtaatacatttgtactgtcacgggagactcattttgaaattcatgagtaaccaagacttgaatgttatttctataaatagaataattgacagtctcaatacataagatctcattcagaagtgtttttccactactggtatcggctttggaagggttcattatttcattgattacttcaatctttatctcttttgtcagagtcgatagatctgtctttatttcttttccgtctatataaatacgataaccgatattgcgagcagtttgagtaacttcatccaggtagggatgatttcctccacaccacccgtatccggttatattaaaaggaccgatattgtcactgtaagccagattcagaagagaagtcggagaagcatcgggcagagtggcaggagcaggcatattattgtcaattgttcctactctataaaatgtgaacagttcattgaacatacacttcttgaaccaataaagaatatcggttttggcatctaacttggctgatatatataaatcttcgccggttattttcactctcatttcttcagatatcgtttcagtcccgggagagtcttcttctgcagaaggcttatccgggagtccggaagaaattcccgaatctccattcgagcaggctactaagtgccaggataaaaatacgaatgcaaggattaaacgtttcgtcatggcttctatctttattttaattcaaatttgagaacatctttgatatccatagctgatgctgctatgatagcttcaaatttgcccggttcacaaatccattcatgtctttccgcatcaaaaaagcttaatgcctctttatcaatagacaaagaaactattttttcttcacccggcattaaatttactttcttaaatctctttaattctttcaccgggcggggaagagaagactttatgtctctgatataaagctgaacaatttcctgtccttcacggttccctgtgttcttgacagctaaactgaaagttattgtttcgtcaactgacatgactttcttgtttgctgttagttttccatacgcctaccactctgtctccaatggggtgattcacatcttgataaacaggagcttgcgtcatgaaagatgatgccagaaaaggcatgattgctatgatatttcttaatttcattgttttgttattcttgtccgtataaacagtataaatataatatgctgatggcagattccatcagcatattatccaaatgattattataagcctaagaaagctgtcggtgcatctgtggttatcagatcaaaaccattgtcaatacaccattgcatctcagaagggatatttacagtccatacattggaggtcatccctgaatttttcagatctttcaaccaatccggatttttatgataagcccaataattgtaatctgccccggtagctcccaattgtttcagttccttgggcgaaatatcctgtcccaaatacaaaattggagttttaggaggtgccagacgtataaactcacacatcacatgacgggaaaaagagatgtattctactctgtgagtcaattttttctcttccaccaactttaggatcatttcaacggctttcgtttcacgttccggagtactgaggggtttcatctccagtatcagatgtattttaagtttcttcgctttatcaaggaactgctctaaagttggcatattctctccattgcttaactttaaagtgcgtagcacgtcagaagatgttttctccagagagtatccttcatgccatccgtcatgattcaacatcaattcatcgtcagctgtcagccatacatcaaattccgaaccataacaacctattgaatcagctttcactaaagccgctagcgagttctgtgcagatccgggtgtattccagaatccacgatgggcaataactttggtctgatgagattcttttttttgcttgccacgtcttgatacaatcagattagccagtctgtccatgacttcatgatctttcgggtttgttgatttatacatatcaagaactgcatgattgccactataataggccattgcagatgtacggaaggcttgttgtctttcaaaatgatcaatatacgctaccagacgattataaaacgagtccttggcatcaaacaatgctctttcgtcaaattcaagttccatccccatgttcagagtggcggcagattgacatgcttcttccagtcttttatcgggaatagaggctttaaaaaagtggttcggttgttgataagcgatatcaaagcctaattctctccattggttgtagccttttgcctgccaatacggaatccaacaaaatgttttgttcttcgaatgaatatacttacttaatggaactgacagatctttggtgaaatcaatatcctctgccagccagtagaaaccggataatttcagatgtttgtattttgcctgtttgaatcgcttcattaactcatcgatataccaacgggtggccttcacctgatcctcttgtctggaaaagtccattggctcaccatccacttctccccaatctttttgtccgggaagaacttccggaagacatagtactatctgatgagtaaaatccggttttccgatttctttaatctgtgttccgatacatcgatctaaggcagacagcgctttaccatcttcaaaaagacgatctaataaccatagccattctttttttcttgcatttttatctgagtagcgtgttgcaaagccacagcctttcccatctgtgaactccaaaaacaagaatccgtcaaataaccagtctttatgtccatctgcaaactgatgtaccacataggggagaaattgatccgaagtccagtcaatacgatgcactcctccctggtaaataagtgccagatcttttattttattctgtctatatcctttatctatggatagcgcatgactatccatagtaataaataacagacagaaacatatcaatccttttagatatagtgagaaatagttcataattttcatgtttttagttacataccccaagcataaacttcaccaagactaactctcagcccgtcataagtcggataggtatcagttattacaaaacgaatgtatcgggcttgtgtcgcaggaacatccatattaacgttgggttctccgattttgggagaagtccagtcttttaatttaacccaattctcgttatcaatactagcttctacataaccggctttcgatgtgcctgcccaaacgtgtgctgctggtgcaacagggttagcaaatccaaatctgaataatgtatattctttccccatgtcaaatacaaagtaatagggcaagggctcttttacatcccatcggcatagccattgtgtgccaggattattgtctatcaatgattccactccccatcccatattcagataccatccgccgtcttgggtacaacagttgttgaaatctataacactccatcctttcttgtctattgggtccggttggaatttaactgtgtacagtttggacgcagcatcaggacttataccatattttgaaacggaagtaatgcgtagtggaagtacatagtcaccaaataaataagtaccctcttccggtattaaccctttcttgtggtatttaattttaatgaatgtttccttcatgcctgttaatataactcctttattatctacagtaaaggaactctccggcaacattttataagccgtgccatgagcggtattataatcaatgactaactgaggatcgacttcaatctgaaatgaaatatcttcgtcattagaataattagttcttatctttacgaacagttctctttcattcaaatcgccgaaagtcggcataaaatcagtaaccggactcataccaggaacatccatttgcaaataaggttccttaatagtaggtacaataatggtttttagtcgctcatcatctgcagagataaaattttgcaccacactcatttgtatgggcaagccatattcctttcccgtagaaagaagatcggatagacggtcggcattccatttaatatcaaaagctttccgatagtcggaatcgttgagacgcagagcaggctgaagaatggtataacaatcggaaggtaataattggatcgatgttccattatccgtattataactctgaagaacagtctcgtcaacagaaatggaaacttctgtctcctgctttcctttcccacttttgataacaaataattgatagggggtatccataccacggaatatctccgtttctgtataggtagaatgcaatagtccgatttgatcattaaccatgagattatcacgatcatcagtacatgccgatgcaataaaaagtgcagcaactatgaattgtattgtcttatgttttttcatatttatatccattacatatatttaccatccgtaattctgagtaatattcttcatttcactcaattgttcttgattgatagggaagaaataatgcttaggctcaaatacccgaggaccacctttccaaacatttgatgtccgcgaccaagaatcttcgtatgaagtggccaataaattaagagaatattccggtccgggaaactcttgttgagcaatcatccagcgacgggcatcataatatcggtgtccctcaaaggctaattctaccatgcgttccttttgaatcagcatccgcaacaaatccttattgcctttcacttccggatacgctgtttcgagggcatttaaaccggaacgttcgcgaacaaggttaatatacttcaatgcttccgtttcattgcgttcgggcttctcattgcaagcttcagcatagtcaagatatatttcggccaaacggaaatagggccagaatacggttccccaactgccactttctgtattaagagcaggatcgagtgggcgtctccacatatatccgactttgacacaatctccggattctaagtacgaggacgatcctcccgtaaaaaaggtaacttgttttatgcctttatattgattgatccaataaaaaccatttggaaatacagaagcataaaaacgggcgtcacgtccgacacagctattatgcgctttaaatccaggtgcaaaactgactcccggctgcttgaaattttctgtaaaaccggtatttgtatatcccgattgctcatcaattacaggattcccgttattgtcatatccggtaacaggatatcttccggatttagccatcggataagtatctactaatttcagagacgggcagaaaccaccgacacccaattcacaaactctaggaggcatgcaccggctatacagatagaaacctatagctccgagtccagtattagtaggattacgtccccaggcaccccagatcgtctctttattccactcttcaaaaagaactccttgataagatttgatggcacgcagtaaagggtctgcttcagtctggtctttgtacaattcatagatgttcatatctataacgtctttggcagctttagcggctttttcccatttttgaggatcgggactttgtggaaaaaggaaatcaccatacagattcttcatttgtcctttataaagatcgcatccattatacaatggactggcggcatagagcattaagcgcgctttggcagccattgccgctcccttggtgatacgtcctgcccattttgtgaaatcgctgatctctgcaggaagttctgcaatagccttatcatattcttcagctatgaaatttacgttttcatcaactgtatgacggtctatcgtttccggttttataagttcatccgattcgatgtctccccagatatacacaggaccatattgacggaatagttcaaagtaataataagctcgcagaaaacgtgcttctgctttcattatacgtctcgtttcagagtcaatctccaaacattcgtcaacatggttcatgaatatactagcttgttttatgcctgtatactttgctttccaaatattatagtttggagtagaaggtccccatgatccattattgaaagagaggtagttgacccactgataccaggagaacatggcttcatcactacggggaactgcgcttccttcttccagatattcatattcccgtggcaagtagctataaacatgcgctaaatactgttcggtagagacacgcttactaaaggtttcgtcttgtgtaagctggtcgagcaaagtcacatccagataatcgttgcatgatacaaagctgaatgcaacggtgaagtataggaatattcctaaaattcgtatctttttattcatagttctaatatactttaaaagttaagattaagacctaaggtgattgttctcatctgaggatatatatttccatagttggaatcgagttcgggatcccacaatttgaatttgctgaatgtcaaaaggttgacaccctgtgcataaacacgaattgatgacatgcccagacgtttataaatatgcttcggaagggtatatcctatctccacatttttcaaacgaagaaaactcatattacgttgccagtaggtggagggttgaagattattctctaccttgctcatagaaagccgtggataagtagcattaggattaggattgctggttgtccaacgtttttcggctacatctgcgtaaatctgtcctaaacgctctatattatcagaggcaccataaagagcgtctccaccgataatacgagtcacatttcctactccctgcataaacagagaagcgtcaaatcctttccagcccagactaataccaaatccataatttatttccggtacgtccgtatagccaatcgctaccttatcgtatgcgtcgataacgttatcaccattgatgtctttatatttaatatcaccaggacgaacgtttccaaagttttgtttggggctattggctatatcttcttctgactcaaaaagacctagagctataagaccgcgttgctgacgataggcaaatccagcttcactttggtagggccatataggagtcggtttatcatcatacaactttttatttcgattgtaagtgaaattggcacgggcagagacataccagtcattaaatcgttgttcatactccatagaaccatcgaaaccttgattcttcatttctccaagattcacatactgggtttcattgagaccgacgattgaaggaacactttcttgctgaatatagataccggtacgcttttcataaaaataatcaagttggaatttaagctggtcaaataagccaagttccagtcccacattcgctttttgagctttctcccatgaaacattcaggtttcccggaatacctgtagaaatacctacgatacttccactaccgggattcgttccgaaaatatagccgtattgtccttctttcatggtggagttgaatgcaaaacgtctgtttccgccaatctggtcattacctatttctccatacgaacctttgattttcaacaggtggatagtagaacgcaacggatcccagaaagcttcgttgcttagcatatatcctatagcaaaagagggaaagaaaccaaaacgtttgtcaggtgcgaaattctcagagccattgtatccgaagttaaattcagcaaaataacggtcgtaatatgaataagtagctctaccggcaataccgatgtttttgtgggcaaaagcgtctacataattacccgggaaattgtctgtatagttacgcatactaaaaagaaacaaggctccaacacggtgcttttctccaaagaggcggtcgtaattggctgaggcttcaaagttgatagtacgtgtgcccgaattcgtccgtgtgagtttcatataatcactaccttcagtactccttacaaagtcaagatttccttcttcatcacgtcctgttgcatagtaggtagatggtgttacaatgcggtttagtgtatgcgcattgtaggcgtcccatgagaacttaacattggcttttaatcccggagttaccatttttgagaaatcctgtgtaagcgaaataagtgattgcgcattgttgaagaaatcctgcgagtacccagagttattcaggctgttataaggattggtacccgtacttggtttagctaaagtgccatctgaataaatagtaggagtagctatcggagaagttcggatcatataagcatacaaatctgatagtgaaccataaggacggttcttggtctcatattgattggacagtgagagactcagctcagtagatgaagttacattgatatcaatatttgaacgaaaactaaacttgttatagcgcattgaagcatcgtagcggtctttatccgaaatattgaatacactgccttccgaataaaaggagccgcctacataataacgtattttaggagatcccccggtaacgttgatattcacgcgtgtggtgttggagaagtctttaaacaatgtttgcatccaatctacattcgggtaaagatccggatctgtattattcaggtattttgctttttcttcaggttgtatagccaagcgtccggatgattccaaagtaatatcattataataattgatccattgttccgtattagccaattcgggcatacgtactggattggtaaaaccatattctacgcgtgcattaatcttaggtgctgattcggttccacgttttgtcgtgataagtacaataccattggctccacgcactccatataatgctgttgcggtagcgtctttcagaatagagaaagaagcgatatcctcaacatctacaaggtccatactacgttctactccatcaaccagcactaaaggtttgttgcctgcaccgaaagtattgataccccgaatccaaaaatcagcacctgcacccggttcacctgaacgctgcatgacaactataccagccaactgtccggccaaaccggaactcaatttagcaacaggcattttcagctcattcatcgaaactgtattgatggcaccaataacgcttgcttttcgctgtttaccatatgctactacggtaacttcgtcaagttctgctgtttggggttgcattttaactacgatatttgtttgcttacccaccaaaatagtctgcgtttccattccaagaaaagaaacgactagtttatctgttggcaagacttctatcacaaatgttccgtccaagtcagtgataactccccttgaacgtccttctaccaatattgatgcactgggaataggttctccaaattcatccaagacttttcctgttactttcttgccaggattgtcctttacttctttgatctcatctttttgtaaagaatgagcgagagtattactggcgttcatgtttactagtgataataaacagaatgtcgtaacagtccagattttaattgaaaaaatgttttttcgtaagtccgacatcatacattaataatttaaagttaagtaattctgtatttttttcttctttagatttgataatttccttaattataagttcggtattatat

SEQ ID NO: 105 - DNA, 26801 bp, Bacteroides thetaiotaomicron
ttattataactatgtaaccctatgatgtttttttcaccaagtacataccacaatattttcttgtgatgcgttttgagataatccaatagggcatccttccggactaaaagatagttttttgacttctctacgactcctgcatcgaaacaaatcaccttgcctttttcatttaagaatatcccttcttcatctgcatattgcatcctaagaccatcaaataactgttttgaaggcatgagacagtaaaaagatgtttctttagaataatcttcttctgcctcccacaaataaccgattgtggttatctctgcatgagttataaaccgattcgttttcttatcatatattcccctcttagtaagcccttcagtatcaaaatgtttatatgctggcgaccagtaatattcacgataaaacaattcatatttatcagagcattcgggcatccatcttccaccaaaattttgtttcactgcccatttataaacaagagggaacttgtcttcgtcaatgatgcagcttcttacttgataccacagtcttttgtatatgcaatctttgccatgtggttcattccattctggataacattccaatgcaagccaatcgcatccatcagcatctgtcaattctataattggctcggctgctggaatatcatcctttatattaagccaatcaggcatttcatgctgccagttagcatatttccctccataccaccagaaatcttctttgaggtctgaattttgacgattctcatttactctaacaagagttgttggatcaatatcacgaacggttggttcccaagttccctcatattctacgacattatcactccatgaatattctaatttttcgaaattatctgctacacgagctaacaattcatgtaaggccagccactgatatttcttgccaattcgttcatttggtatggttgagcgtcctcttccagatccaattttttggtcgaatgtaccatgcttgtcttctcggtatccatgcttgtcaataatgagttttatggctacgttactcaggcgttctgcatcaattttccagttgctcaatgcactttgaaatgtatatcttccaaaatctccataaaggcctatggctgaatgttctgtaaacatggaagtaagcatgttacacatacccggagaattcttgtattccccgcattcgtctaatatagactttatttcctcatcagatacataggtataatcaaaagagctattatatggcggtcgtattttattaatatcaatattcagtttttctcctataaaaatagcatattctataacattccgtgcatagtcacgcagcaagatgtgagggtaaacctcaccctcaacattaaatactgacgaataaatgtattggcacaaactggccaaatattcttttgattttgacctcacggcgcagcctaatgctacaccataaagtctttcatgaatatatggatcatctacttttgagaacttttccaaaagtggtataagtacctgcatcctattatgcagaagttgtacgagggcttttgtcgctgtatcgcgtagttgtcgattggtacttgccaaaaaccaagaaagtaaagtagctcccaactcagcagactcttcatccatattgaccttatcgctttcatcccatgcccagttaataatatcttttattatttcatcctgattgctataaatccgatataatgtaggtgtccacatggcatccctgtcagctaaccgcattggttccagcattttgtgaagataatcggcattataatagtttcccggattaaatgcaacctctataacggttcgaataaaacggtctctgaattgttcattacttacaaattctgcaaaatatgtgtcgagatgtgagtctattgttctttcctctctccatattaaactagaaagaactgcatttataatggctttattactatggaaattaggtaatgaatcatataattctatccccttacgttctggcaataaaattgccagtgattccaataatccgccaactatataaggagattttatcgttagtacatattcctctagagctttatcgtcaaattgtaatttatctattagatattctgcttgaagaaaattttcaaatcgttcatatgtgaaatatatgcactcctcgtacttgtcaaccgtattataaaaaacatttttgctgaaaacaccttcagatatcaaacagtccaacaattcaccttctgtaaacacacggggataaatatcggaaaagatttctatagcagtgtctattggcatttcatgccttccttctttggctgtgaattctatgtacttatggacagtcttgtctacacatttgattgatggagaataatgtttggctttcctgagagatttttcaataccatcaaaaaacaaattcattattgatgttatacctttcacaccatctggtatcttcttataaccattgttcttcattccttcacagaacaaatgtaaaaacagtggatttttaaattcgggattgaggagtggaactgaaggatacaatataccatattccttaaaatatagttgtacggccttttgtgtattagccccaaatccataatgtcttgcccacacacaataatcattcccaaattcttcccatggaagtattgcaggttgatatgatgtacggatgcttaatacgagtccaagccacggatgttgtcgaattttatcaataaaactacggatattactttgccaaatagccagcccgtgtccctcatttattgcatctatgaaaatgatgatgcgatgtccggttgattctgccttggcttcaagcgtttctaataactcctccgaagaactgctgaagctaagcattctcattatctgagtgaaaggttcttcatcagtaacaaatttctgccctaaaaaaaatagactaaacaggttctctttttgtcttctttgaacagtatcagccatcaaatgcgacttaccgactccagcatccccttcaagtattaaaatagggtcatttactagcctcattatatcttgatgcaaatcgttgtgaacgcgcaaaatatttatacctagttcaaatatgttacttgatgttctgttttcttcttctgttacactttctttttcaacaatactgttggcaatatcttgaacagtttctcccaataacatcaatgctgacaataattcattaagaggtattttatctataccgttgatattaatttcctttatttgtttaatcgcattgcggacactttctactaaattaataatatcttgacaatacttatctttctctatttttctacatgtatcttctgctattatcagctccttatcaaaaaaatgtctcagtgaacttcctcgtgaaagaacctcgaaatattgaacgggttcaacttcaatattcagtttaggtgtatatcgtttacctaaatcttttattgaacctgcattaaatcgcatcatatcttcatctgaaaattcgtgctttccaaaccaaaatcgaagtagaccttgattagaggacttttgaagtctttctattaagtctgatgcccaccaaaaatcaaaagttacatgagaatttatctttgaccatctttccacatatccatcaattcgctctttcatactcattctacctgcgacatgagcatcggagggatctgtgggtactgctatgacatatcgtctcaaattgggatgggaatcgagtgcctcttttacagacctatctatttgttgatactgtgaatcatcaaaagccttacaaaaatatttagcttgccaagccacaatacttccatcttcaagagtccagtaacattccacccctccatctggcttacctttgcgtacaaatgtctttgtacatggaatttcctctctacgtgccaactggcacacaaattcttcaaacccttcatttgcagacccgtttatggatctaatattattgaaatcaatattcagcataaataccactcctatacagctcttttttcacttatgtgcattattctttctctctcatgcgctcatgcttattcccctgcacaatacctttatccatcataactatttggtacaactcctcaaaagtagtatcaataaacgtatagtttatcatcttgcttgtattgattggttgaatgttggcatattgtttacggaagtagcgcagttcaaaggcgagacgaaggtcgttgctattttcttctccatcggtttgcttcacttcctttgatgtgatagttctaactctaattatctcgtagacatcacatatcccttctcctttgaagtagggcatgaagtaatgtagattttgcagagcaatagtagttgggaaatgactacctgtgtaatagagtgtggcattaccatccttgaaactttgcaaatagcctttacggctgctgtttgtaacaagacctatgagtacacggtttcctacttctacgaatgttcccttttgcggtatcactttagagattgtctcatgtgattttgtggtgataagttgttcaacaaactgctccaatagctggcgattatgttggtctttaggacgaagtgggaatgcaccgatgttcacttcgtctatagtcttacggaacttcgatacagcaacatctgttggattaccatctccaggaaataatatataaccacctatcacttctttttttaaagtattcgattgatagtctttataatagatggcatcgcgatatctgtgcatctggttgatcgcatcttcgggtggaacatctactccatttttatcctttccatcaatacgatatttcgcatcaaacagataagtcattttcattccttcttgcaaatcgttcttggtcagttgcaggacaatatccggcttttgtggcactgtgcgcaccacaagatctttcattccaatgtcactattccccttgtctgtgttctttggattatagactaattcagccagttccacattgtctttcttgaaaaggatacgggaatgttctcctttgcccaaatcccacgtgaacaggccattcatttccatacggtttttatggtctatatcttcatcagacaaatgaagtttttccttcacaatatggctcacttctatgaaacaccatatctcgtagagtgtcgctatatctttggtttgcaaacggtatatgccatcattcagagaataggagcggcgaagcaggctccatgtgcgatatacctgactatatccggtagctttttgcagaaccagactttcctgattcattcctttgtaatttcctactgtacggaagaagggatttcgctgcaagtgtttcaatgtagccaatgtggcttgcatgtcatccttcatcacatccgaagcattctttaccgcttctatgcgcttcttcaagactgcgtatttatccgtgatttgtccaagagcgaatttcaagaatctgttttcctgcgtgtcatttgttcggatacgttcttctacacgatataagtgagagctgtcctgtctgtgttctgccaattcgttttctatgcaggaggggacaaatgtcagcttatcggcacgtttgtaagtctcttttccgtgtaaccgatgtcttgggcggtcaatgatgtttttgcaggccttgatgaaattcttttgctcattggcaaatacgctccaccaaattatttccggagtatcaccactcgtttcgggcgaaaagccatgaaaggttcttcgcatatagtcgagcgaaagcattctgtattcttgttcaacatcctctataatggctttccaatgctcgtgatagttgagctttgtactcaacacttcaaaagagaagacaaaactgcgggtttctgttcccacttgatacatgagttgtatttcgctgcgtccaacctcattgccataattcaagaaacctgccaatatctgtctgcggaaagtgaatttttcattttcactctggagcatggagccaaactgagcctttttcacatagttcttgaattccacccaaataggataatcggtgttgtcgaaaaatatggcgggagcttgttggctgttttcaatcgtaatttcttctccaatatagttgctcaggataacagatgatacgccttctgaccaagaataagtggagtgtaagcattcttctccaatattactcttggctttataccaaatgtcatcgaattttgcacattcgacaatcatttcaaaatcctgatgttttatggtaagcagctccatcgttctttgcaggtgtctaattgtttttaactccagaaacttgtatagccggatgacaaccgttcttgcatctctttcagcttggctatggaaacagattctattttcttatcttctccagtcaatgctaacaactgcgcttcgatagtagtaatcatcctttcaagaagtgaatgcttgacttttgtatcatcaccttctattcgcgacaagattttcatgcttgttatctcatccaatgcggttgctatgacctcatcctcactgaactcgtttccgttttcatccatattgtaaggtaaattgtttaccacataaagtaggaattcgttccgcgtgcggtaggcgaccttgaacggagtgccattaagaacgtcattcactgcttgcaaataagccaataccttattgcaaatatcctcgttgtcgacatatacatccacaccttctacggctataccgataagcatatcgctattcagtttaccaatgcgttcatatttactatccaatccggcatacaaatccacttcattcatttctatggtcatggcacggtcaagtaccttacgggagaatgagaaagtcgtttcatccatatttaccgtgcccactacgattaggttctgtggaatggtgataccttcttccaaaaagcggtttcttaatacttcattgtttcctgtcagttcggccgttaatactcgataccaatcttctgtgctttttttcaggatagggtctgtagtaatcgtaccgtcttcattgcttttacgagattctatcacactaaggaattccgcaaaatattgttctaccggagcaaggttcatttcatccagacaaaggaaatgaggtacatccaagttttcccaagcctttgtgataaatcttaagaaatcgccaatcacatatatgggttttccgctgacacgactcacatatcctatcagttctgtagaatcatgccaattgggttttacctgaatcatctcaaaattcttaggtttctgagctttatattcagtggaatcttcgtcccaacacgcacgggccaattcacggacaatacggcttttgcccgtaccggatataccggcaagcaaaaggaagggtttggtcttgatggcggtaatgtaggagcggtaattagaatatttgttttggctagtatgatctatgctattaatagattttatggcattaccataaagagacaggtagtctgattgtaaaataataacataatctgtaatctctaatcctgcatataatgtttgaacaaaaggaccacggcttatttcgccaggagctgctacaacacttcctttctttgcatcaatattttctttggacacatcgacgccaatagcattcaattctgctttgagtacagtttcagaatataaagagtctgtaaactcaatttctttagaatgagtgttgaaactgtttgaaataatgtttaatgggatgttgaactcttctgcaaacttttggagaatttcttcctttgtcatattgtcttcaaaagaatttctcctatatgcccaaattgctacatcatagatattgggagtgtgtcttccttgatcattaaaatatttatcccatttatttgagaatacaacgtacaatacacgtccactactgtatcgtttttttgcttgactcagattgaagatgttttcaagaaagcttgatacttcgtcaagattaacctcataaggtacggaggggcaaatactgctcttgcatcctttcaatagagccaaatatccccaagacttattggtcatacaatcttgaaagcctttgtaggcctcgactacagattttacacttatgaatttcatttttcaagagttttttcgtaagttttaatcatattattcattatcgttacgataattggcacactaacagagtttcctaactgtttgtatgcttgtgcatcggacacagggaacacaaagtcatcagggaagccttgaagtctttttgattcaagtacagacaactttctgcggatatcccatagttttggtgtcctattagctataattgtagaagcatatgtgtcaagacaggaatagaatgcttcctgaatttgtgttttagctggatcaccaacatgaaatcgcaaagaaccgtctgccttttgaaaagaaaaaacgccatattttcctttcttcgtatttggcttatattttgaattgtcatgttggattctatcaccaggcttggcatttgcaaaatgataatctattctgtccaattcaaatttaggaatagccaaagatggattcctatcattcatgtctataatgtcacgcaatacgggatgcccttttacaggcttaggccattcaaaatcgacttcggttctaaaggctacgcaataccatctttctcgtttttgaggaagaccataatctaaagaagacaaaatagtccaatgtgggtaataaccaagcttctttagagtgtccaaaacagtctggagtgttttgccattatcgtgagatttcaaaccttttacgttttcaagaaagaccattggtggtttatggtattctaaaattcgacatacatcaaagaacagagtacctcttacctcatcattaaaaccttgtttttctcctgcataactaaatggttgacatgggaatcccgctgttaagatgtcaaaactcggaatgtctttttcattaacagcctttatgtctcctgttggtacttcatgaaaattggcttcataggtttgttgggcgaacttatcattatcagatgagaatacacactctacctgactactgttcatggcaagccgaaaaccgcctatgccacaaaacaaatctattcctttatatttttttctcattgatatctgttctctttacttattatcttttattgaccacaataaatccttcgtatccacttcaaggacttttgcgatttccactaaagtctccaagttcggttgcatggtatttgtacaccattttgaaacagttcccgggtcttttcccaactgttctgctaaccatttattggtgcgtttcttttctgctaaaaccaccttcaaacgatttatgtctttactcatacgttctgtgatatgtttttgaatgcaaaggtaatcattctttttgtattatcatcttataattgtgttcatatgattatatgatgataaaaaacgactttatattgttgtatatttcaattatatggttgtctgtagttgactgtggttgtctcttgacttaaaaagtgtattagaattatctacaatttatacaacttatttcatgttatccaatggatctactaaaagatatttactcgtaaagtgcgtctataaaaagaaaaatcgtatctttacatatgtaatatggttaatttatgaagttaatttgatgcgaaatatgaatgctaacatagaatatgagaaatttacccaagaaatttatcaagaattagtgaacgctgatgtcgtaaaaagtacaaaagtcaaacataatataaagattcttggtaaatcaggacagaaacatcaaatagatgtatattgggagtatgaaatagcaggagtattacataaagttgctgttgaatgcaaaaattataacaagcctattccaattagtaaagttcgtgatttttatggtgtgctatcggatttagataatgtatctggaattatggttacaaagattggttaccaagagggggctaaaaaaatgggcagccattatggtatatgtttaaaagaattgagaacacccaatcaaggagaagctattgttgcagaagtaagaacctgtataaatgtatcagtcagacattgtctttttgaggtggatgatatatgggcaaaagaaaatggtttagatcttcaagcatatagggaacgattagattgtctaaactttcctccaaaagaaaaatggcttcattccatttatattcctttgcaagttaaagacagaagcatctgtaatgcgaaaggagaaattatagacacattggataatttagaaaatcagttacgtccagatgaagaccatgtcttttatttagagaattcctatatagatacccattgtggcttagtgaaaattagagcaataaaatatgaatatgaacaaaataacaaaactatgaatatatctattgacgctcaagagtttatcaaggctatcctaaaggatgctttgaatggggaaatcagattagttgccaaacgctagtggtacgatttcaatgtggaactaatgattttatttttctttctcccttctttctttgaccttttccacacccggcaactttttagctaatacactttctcctgcaggaaagtaaagcggaaaaacctgagataagaaacttacaatatcactacgcttcttacccatgttgaaaaaagcagaacaaacaaaatacataagatcttgctgactacatgtatttgttagctgaatggttgttaagggaatgattatcaaaccgtgttctgcaaatgcgcaagcactggcaagaatagctttttgttcttcctcagtgaacatcttgattttatctgctaaccatttaagttctctttgctgaagtgcttgttgcttttcattctgatgttccaatagaattgctacattttcttgttgcttttcagtcaaggcattttccaatgcttgattctttcgtttaaggacattgaatttcagcaatgcggcaatgtacatacagaaataccctactgcaatatcgaatatcaggacaagtagataattgttgcttgaatttttggtatcctcggccatatactcactgataggaataacggctaatagcatgatgatggctattgcataaagcactctgtatcgcgttttatggtttacctgcggtaaggaggcaaacaaaaaggcgataatcaagacggcaattattgcacaaagtggaatgaaagatgttcccataggtttattgctcagtttgagggttaacaataatgcgccaatagccagctttatcagaaccttcatgagccaaaatctccatatccctaaggcttttgatgtttttctctatggcacgtttagttacaccaattttattagccatattatcggctgtgattgatgggtcagaaataacgaggtcaattattttttgtgctgttttactgaccttcttcggtgtttttgatgtatctccgaacctatttgcatttacaccgaactttttcaccgaacctttttcgtttacaccgaacttttctgcatttacaccgaacttttcgaccgaacattcttcgtttacagggtacttttcgagggtactatttaccctgttggctacttcttccacaggaattcttccgttctcgtcccaattcaggttatagaacgtggtatagaaagaagtcgcttccgtttgatattgcggttcttttccttgcaggaagttaggcagtttctctgtaagttcacgcatcttgcgcaaaccggagccacgtttctccatatagtccagctgtgtgaacacatccgcaatgacgggattgcggcgcatggacggcactttgtatatgtcacggtcttgaatctgtgttccgtcaagcattgcgcccggtgatactagttctactcggtcatcgtaaatgtcaatatgtacttcgccacccattaccgtataatctctatggataagatggtttaccaacccttcaaagattgcacggtcggaatagtcggggagattcagacgatagttcggcatcttcacccatccgctcatggtgtagttcttgatgaagtccatgccgtatttcaatagcaatactaggttagcccgatgttctacggaactgatggcatcatctttataaagtccggtccaacgggtgcagaagatacgcgattggaatacggtgcaattatccacgaacaataatccggcattggttagtttaccgtcaggagtaaccagaccgaatgattccagatacttgtcattccactcctgatgggtttgctcacggaaagtattggcgagaataataaatgagtgcttgctggcatccacttgtgtaggaagagaatcccatgtcatgtgtgtacctttcaataccaacgaaagaagttgttgcgaattacactccacgctttcattgccaactcgtacatatgcggtacgtgttccatcctgataataataataaggtgtaagcgttcctgcctttactttcacttcaagcaaagagtgcccttcgcgttctatcggaataagttgaacttccggaacagggtcaagtcttgcctttatcatttcgctgataaagtcggcatcggcttgtggattctccaaccctacaattacaccgtcatcattcactccatagaacaagctaccgccatccgtattggcaaaagctgacacggatttaagccacgacttcactttcttacgctccaacatttccttgaaatcgtaagccgagcattccgctatcaatgtattgttatgtatctgcatagtttctttattgctgttatggtacaacaccccaatatcacatacaaaggtaaggataaaaccgaagaatctgttaaaatcctccttttcttatgatttttatgcgtttacatcacgttgcttatggggaaaaagtgtacttttgcgagtgagagcttgtgttgcttatggatgcttattttcggatttgcgatataattgcaacacgtgtacgcaagttgctcatactgagataatgttgattttgaggaagtgaagtaagattagctgaattagtatatataaaaaggtgtgtcagaactttttctgacacacctttttgaattttataattagcctattgaaaataaatagaaaggtttttgtttattttggtgaagccatatattttgttgtttcaataaatgtcactttttcccttttgctctttcctgcaccaatatatctttcatttcttttactatggctggatatttcggagccagattttcgctttcaaactcggacttattcatatcgaacagctgatcataaggtgcatatcctgtttctattttcggaccccaagtgatcatgggggaaccattggaaggttcgatatatttccattttcctttgcgtacggataatgccagaatattagattcctcgataacccaaggacgatcttttttactttttcctaaccaactgtctaaatgattttgactgtccggagctttactttggggaatagtgacatttactagagaagccaatgattggatccagtctatttggcttagcaatgtgtttaaagtttggttctttttcacctgtgccggatagcgtacgatggccggaacacatgttcccgcttcgaaggcactgtattttccaccacggaaaggaccacccggcttatgactgccagcaagctcaacggctttgtcatcataaccatcatccagtaccggaccgttatcgctggatagaataatgagtgtgttttcagtcaatcccagccggtctaacgttttcatgatttctcccacgctccagtcaaactgtacaatggcatcacctcgtaatcccatcgggtttttacctctgaaacgttcgtgtgggaagcggggaacatgtacatcattggtcgcaaaataaagaaagaaaggccgctctttgttttcttcaatgaaacggatggcatgactggtgatggtgtctgctatattttcatctttccacaaagctttacctcctcctttcatgtatccgatgcgcgagataccgtttacgattgccatgtcgtgtccgtggcttggcttgagattataaagcaattcaggattctttcttcctgtcggctcaccttcaaatggtttctgataactgacttcaataggagcggtggaatcatagtcggctactttaccgttttcaatataaatgcaaggaacacggtctgcagtagcagccatgatataagaatagtcgaatcctatatctttgagtgcaggagatattgtcccgttccagtcttgtgtacccgttttgtcacctaatcctagatgccatttaccaatagctccggtggtatagtctgccgatttaaacatatcggctatagtatattgttctggtcgaattatcatgcctgcattacctgcagctactccggtacctttctttctccatgcatattctccggtcagcaaagcatagcgggaaggagtactggtagaagcggtagcatgtacattggtaaaccgtataccttcagaagccaaccgatttacattgggggtatgtacacgtgtggtaccataacattcaagatcaccataacctaaatcgtctgcgagaatgataataacattaggttttgtttttttttctttttttgaactttgcccggcatacgcgggcaaagaacaagaacatagaactgcgacacaaggcagcagattgagggatcttttattcatcatgtgtttaaatcaaataaggttttgagtataatactgatttttaattattaccttctaatccgtaaacagtcaattcgcgaatggcggcaggaggacagttatttccatatccttcaggaattataagtttcagatatcgtgctttggtagactttacataatatcggaatgttgctctggtaccttcatcattaaaatcaccggcaccaattttatcccattcactattgttattgctggcataaaattctacccatttaatattattggcagctccgtctccacgattaagtaagtcaatttgagcgattgtaatttcttttttcatatcaataataaaatggaagggaggtacagatgatcctgcttcatttttgaatttgcaatgccagtatgtactttcattatcgtcaatcatgtatgtagcttcattccctgcatgttcagaactgcactctatcacttcccatccggatttgttgatcttattcccttcttttacaatacagaacaaaacgttgctttcctcatctattaccagtgagttattcggaactcctccttggcttgccgtgatacttcctatttttataggtaaaatatagtttcccggtaccagattgttttttagttggtaggaggcggttatctgactgactccttcctgaagagttacggattcaggagcagtataggcattttcgggaagtaaagtgaaatttactttattaatctgattatattcgtcaatcaatgataaatcttctgtcagattacaaagaatatcccacttattggtaaagggtactccgatctgtatatccattgtagaagttagatccggattgatattatatactccagcattactgatatgaacgataggttccaaaatggtaaatgcaagaaaagatgtatttcttgctggattaatagccagatcgttagaaatgagtcgtaatggcaatacatattttgtttcgttatacgctgacaaagccagtatcttttcaggatggtacgtgatgtaaccgcataactcgtttttatctaccgtaaattctgtatttgtcatttcataacaattttccggcaataactcataattagttttatcttcttgattcagcgagtcaagcaaaagagggtctacaacgaattgaactttaccggaggcatctttcagtcctccccgttgtatccatagttccgcttgggcagtttctccgacattataggctgcttgattattcaaggtgttgactgtaacagatatcagactgtctgctttatcggagacatcaaattcattctcgcaacttattgccagcatcgcaatagtcattgctgctaataaggtatgtatcgttttcatattgttattatatttttaatcatgaaatataattaagattaccatcccggattctgaacaagttgtccatcagactttttcatttcactatccggaataggatataggtacattttgcgtctgaatacgatggggctggcctctacttcctgaaggaatttatcttcagttccattcatgttcataccatgcacgtatccatattgacgtccttcaccttcttggtcagctatcatccagcggcgtacgtcgaaataacgttgtccttcagtagccagttcgatgcggcgttcacgctgtatagccagtctttgcagatcctgtttgcctgcaatgtcaggattcaaaatttctatattttctaatcctgcgcggtgacgtactttattcaggtaggtcaatactcgtgcatcgttaggatcgatttcgttgacagcttctgcgtatagcaggtaaaaatcggctagacggaaaatgatagaaggacggaattttgatgtaactcccggtgatttcttattaacctcacgattaaatctcttatacagcatatagcccgtaagagtataaatagtaccactaagttcattaggacttcctttatggaactgggtaacgttattactgacgtgccatcttctgttttgaaagaatacggtattatagaaacgtggttcacgattcatgaatcgattgctgacattcttggcatcacttactttcttattgttgctggtaacgactttttccttataagtgtctgttccctcggttgtgtagagtgtagactgttttaggaaacttgtttcttgtaccggataaccatcattcatatagaatgcatctaccaattcttgagtgacacccgtacatcccattccattttgttcacttcttggggtacatctgcggtcaaaggcatctccatccataccaccccaggtattggcagcagtggcccatataatttctcgattgtaagtttgaaataaatcatacaatgcttgtgaagggttctcttcattttccaacaattcataattgttttcatcttcagcgaatgtcatgaaatctttcaaagcacttactgctttctcccattttccgggatctttatctgggaaaagccgttgtccgtcaggattagtaatcgataatgcttctttgtactcgccattgaataatttactggcggcatatacccatagtttagctctgactgccagtgctacaccttttgtgggccacgcattgtgttggtcatcctcatgtagagcttcttgtgacagttcattggatacttctttcagttcctgatcaatgtaagctataatctcatcaatcggactacgtggaatatctaagtcatcatctctttcgtaaatggcgtcttttacaagaggaataggtccatattgctcaaacaaaagataatgataataagctctcataaaacggacattagctttcatttctataagttcctcttctgtcagaacatcgacgtgggtgccattggcagctattggtttggcattggccagaaaaatattagcttgccgaatttgtttataacaatttccccaacggtgaaaacccatgtttgctgcatttttttctgttttattgtataatttgttgtctccatagccaacggttagttcgtcacacataccagcccaagggtttttgaagcctgtgacgttgccttctgcagcgacgatacccgaataatcagggatagcagtaaaaatattggcataccatcttttggtataggcgacattgtcaaatatctcatccaacgattgaagatttccggctagttcatctgatacatccagatagttgcatgaacagagattgcatagcgtaaaagctactatcagtactttcctatatagtttcttttttgttttcatacttaataaatttaattagaatgtaaagtcaattcctaaagtaaatgtccgtgctttggggtatgtattaccaccattggcattaccagcttccggatcaaaatatttcagatcgtcccataaagcaatgttatatcccatcagatagattctggctgcctgaagatttattttacttaagagttttttgggtaattggtagcctaataccttaaatacgaaaatcaaaagaaagaaacggaaacaaaagcaacttataatactaattcatagatatttataaaatcacctttgattcctttcgttttattaaatagcttatttttgctgtaattttgttactcgtttttgcgataaatacggggaattgtgttacctttgtagctgtaacaaaattagaagtgatggaaggagacagaggcaaatatacaaaagatcccgtaaaagtccggtttactaccaaggcagacgggcgtaaatccatatcttttgagatttaccagaatggaaagcgcacgtatgaacgtcttcctaatttgttcctgcttgtggagacggatgacaattccatcagaaaaaaccgtgcaaccttaaacaaggttgaaaaactcaggaagcaacgtactaaagaactccagaagaacccggtaccggataaatatatttccaacaaagatacgggacaatcccccatcatgttatcttcatggatgaaccaatactatacaatccaaaagaacagaggtgtaagagaactatcgaacatcacaagaacccaaaaattccttttaacatacagtgaagatttagagttgtgtcagattgacaagtctttctgcatcggtttttccaattatcttaagactgaatacaaaatgtcggatgggagatgtctgagccccaaatctggattcaatatactctgcgaactgaatacagcccttaacacggccgtccgtgaaggaatacttgttacaaatcccttttcccttttatcgtcgtctgaaaagatacagccggtcgaagttgtcagggaatatcttacaatcgatgaagtaaagcagcttatcagagcaaggtgcggaaatgaaactgtaaaacgtgcattcctgttttcctgtaattgtggactgcgcctgagcgatgtcagagccctcaaatggaaagacatctacagtgacaatggtacatggaaggtggctaccagaatgaaaaaaactgaaaatgtcgtttatattcctctgcccggacaggcactgaaatggttgccgggtactgaaaggaatgctgacagcaatgtgtttcctgatctgactccctatgctctctcaaagtatctgaagccatgggtaaaggaagccggaatcatgaacaagaatgtttcataccacacggcccggcatacctatgccaccatgcttcttactcttggtgttgacctttatactgtatcaaaactcttggggcacaccagtatcaaacacacacaacggtatgcaaaaatcatcagtcagaaaaaagacgatgcagtacggttgatagataacaaactataaacccccatatatatgacaaataaagtaacaatcaaatccacaaaggaacccgtcagactccgtgtaaagaatctggccaacggagtacagtcactttatctggactgttatgtggacggaaagcgcagctatgagtttctgaaactgtatctgataccggagaaaggagccatggcaaaggctcaaaacgaagccactctacaggctgccaacgccataaagatgacccgtattcttgaaataaccaacaacaaggccggtctgaagaatacttcactgaaagccaagcagacactggccgactggatggaaactttcaagaagaagcaggcacagaagggtatcaaagaccagaagctgattcacaagaccataaatgtgctgacaaaatacaatataaacattccgctcaacaaaattgacaggcaatactgcatcgggttcatgagcttcttgaaaaatgactaccgcacacgtagcgggaaacaggttcagacattcacgataatcagttatatgtcctgtttgcgtaatgccttgaacacggcagtccgtgaggacatcatatcagaaaatcccataaacaagctttccgtccaggacaagataaaggtaccagaaagcaaaagggaattcctgacaatagatgaattgaaaaaagttgaagaaacggaaaatccccataaacatatcaaacaggcttttctgttcgcttgctattgcggtttgagatatagcgatatccgtcagctcagatggaaggatctcattaaggacggtgaccagtggagactgaacaagctgatgcagaagacaggaacacccatatatcttcccatatccaagaaagccatcggctggctcccggaaaaaggtaacatgagtgatgagtgtcttatcttccctaaacttccgcgcgagatctgcaccaaaatatatatcactccatggatggaagccgccggaataagtaagccgataacgttccactgtagcagacatactttcggaacgatgatgctgactttgggagttgacttatacactgtaagcaaactgcttgggcataccaaggtggaaacaacccagatatatgcgaagatcatcaacaagaaaaaggatgatgcagtcagtcttatagacgatgcattcagtgacatggaattttagtattgattacataaccccactataaagatgtatattgctgaaataactgaaaggttgcttgaagtaaacaggctccttttgaaatatatcaaagatacagaactgacctttgaggaaaatctggttttttccggattctatcatgactacaaagacataaacagtataatcaactcggctgaaaaagagttaaacgacagcccggcaatactcatggaacaggcaaaagccttggctgccgctgcgtctgacttccttgccacatatgaaagtcacgaggatatatttggctcttataatccgcaaccagtctgcgacaggcatatcaagccgcttgaaaaggaatatgactctattgcatatgccgcttcacaactatggaaacggtattctcaaatgagtgtccgcatggactatctcaatcctgaagatgacgattacaaggccatagaaaaagaatccgaggaggtaaaggcaagatatgaagcagagaaagccaagagtgatgagacataccgcttttacaccgcagaacgtgagaaaacagccaaactttatttttttgagatgatataccttgaaatgctggttgtccgaatgaaaaggattgcagacagcattatcaaagatatagaagaactgaaatccgaaggtaagatatgacaggactgtacttgaaagaaacggccaaactatttgatatagtagatttgaccatctgttgcagcctgtacaagatctgcaacggcaaccagtttgaacacatgaaaggtacggatttcgtagatttcatgaacctgaaagaagtttcacggcctgttgttgtccgtcatcgtgaaaacagccgtgtctgttacctgttgtatgtcgtcagtaaagagataatgaatgagtctttagcaaaggagtggatacaacacatgctggaacagtgtaaaatcagtcccggatactataaatcccattatagagatgccctcaattccggaacaggagaaaccaatgcccaattcgtcaaggctatcgaaaaagccatcgaaaaggcaaaatctgtgaagtgaccacacagaattacagagcgaccacagagatatacatcttttaacaaattaaataaagctatattgttgattaacaacgatatggctttatttgttttttgtccccaaccacaaatcgtacacattgttccacttgggaataggcataattttgcaacagagcaaaaggaaagaaaaagcattcaaaaacctgtttgctgttgaaacggaaataataattataaaatagaatcatatgacaaacaatttattgacaacggtagaagctgccgaatatctggggatgaaaaagtcttatctgcataaactgatgatgaaaaaggagattcctttctacaaaccaaacggcaaactgtgcttctttgacaaggacgagcttgatcaatggctccgcaggatacgcatagcaccacaggaagaagtggaccggcaggcaatcgcctatgtgaccaaaaaagacctacttaaatagcctgtattatgaacctgtatgaattgttcagtctattctggagggataacggatacagggcattttccaagacagaaacaatcttatacttctatcttcttaatatggcaaattccgccagatggcagatgccgtttacaggctatacggaaagaataagtgccgatcttcagacaacaaagcagaatattgtaaaggccagggccggactccagcagcgaggtttgatttcattcacagccgggacaggaaaggagaatccgcctttatataccataattgaccgtacttctcagttgtcggtgccgttgtcggagaacttgtcggtaaagatgtcggtgccgttgtcccctattaatataaaagataaaaatagaaataataatattcataatgtcagcaacggaaaattggaactggatgaactggaaatgattcttgcaaatgatgctgcctggctgaactcggtgatccttcaacggggaagcgatatagaccgtgaaactgtactggaatacctgaaaatgttcattgccgaacaaaaaatgaagtcatccgacaagagggaaataatagacatccagaaacatttccgcaactggctgaacattaaaatgaattatagactaaaacatgaaagagcagaatcaaaacgagtcaacagtggacgtagagctactgaaatcacagctacttcaccggaagattacgattggccggtttaggctgccatattcctacgaacagacaaaggatatgctgctggccgcataccaggcagaagtcgaatacaggtgcagacatttcacaacctgtgaagaatttgaaagccaacgtgaacagattgcacgcttccttacgggaaattccgaaaagttcggtctgtttttcagcggaatgtgcggaaatggaaaaaccacatggcttaaagccatccgtaccctgataaattcattgaacttgcgccatccgcagaccaattccagttatagcgtatcgctgtggaatgcaagggaactggcttacaggtgcaaagacgaatatcaggaatgggctcggatagccagacttccaatccttgcgatagatgatttcgggacagacccgaaggaaatcatcagttttggcaattgtcttacccctatgatagacctgataacaaaacggtatgaggaacagctgttcaccctttttacgacaaatctgacattttcacagattaaggaaaaatatgaggaacgtatcgccgaccggcttattgaaatggtcgtgcccatcaggtttggcaacggttcataccggagctgacatattctccaaacaagttaagacatgaaacaggaagaactcaaaaaggtactcgctgaagttgatcctttactggcaaatgccgttgattccatgatttcctttatacatgccaaaggcatagatggtgtaccgtcggaacggcagatagaacaggtaaatacctattttgattccatagtaagccgtaccggaaaagactatgagaagtggagcgaatacaggtggatagcatcatacaatatagaaatcggagccattccatgcctggaacaccacgaactggactatctgcacaaagtccttgaatcaatagccagagaccactcatattatgaggaagcacaggtacactggcacagataaaactccatttataaatccgtcatccacgacgaatattgtacaatagcctgttataatggcttccgtagcattgtacatcctgttcagaaagtaggacacttttttaaggggtgtgggagcaagataggttttttgtgccaaaaaaccaccgactgaatgtcggaaggctccgcctggatgaccttaaacaaacggacatgacagaatttgtacccacaccccgaaaggatccagaacggagaaaaggaggccgccctcgaaaggattcgacagagaaaaagtgccattttataaaggtcggttttgatgaactgaacttcaaaaaactaaaaaaaagaagccgcaggatgaaggcttcactttcctccatagtctatgatttggcaataaacggtaagataaacgaaccgctctcccaggagatgatggattgtttcaggaagctcgcaggaatggcaaacaacctgaaccagctggcacacgaagcgcacattgctggctatgaggatgtggccgcagttgacaggctattgtcagaaaagatagatgaagttttgaataaattaagtgaactaagataacaatgaatgcaaaaataatgaaagggaaatcagccggaggtctgattgactacctcaatagcatgaaagagaaaaatgccaaagtgattttttccaatggagtcagtacaacatcaaaccggactgtggttgctgccttcaatctccaatgggcaaacagttcttccaagataaaggacaagatgggacatctggtaatcagtttctcgcccaaagaccgggaaaggctgactgacgaatttataacggaactctgcaaggaatacatgcaacgtatgaaatttccgcccactatctatctcggctaccgccatcttgatcaagaacacgatcatgtacacatcgcttacagtcgtatagacaatgaaggaaaggctatcacatgcgacagcaactatgcacgttcagtaaatgtctgcaaatctatccgggcaaaatacggactttctgctccatcaaagagaaaaaaagatgtgaaccgagacagacttatcggaaaggataaggtcaaatatcatatcatggacatagctttccctgttcttgacaaagccggttcatggaaagaatatatctcaaggctgaaatcagaaggtgtcgatataaccatggtaagggatgaatacgggaatgtacgtggtatcgtatatacagcagaaaatctttcttttgccggaaagaaagtggatccggaattgtcattcggaaatttaagaaggaagttcggcagttatgggcaggaaaaaaccgctatatcggatatcagaaaacatgactccgtttttaccggatctgacatgaatatctcaaaggatatggctcatgcggaagcctgtccggtggacactccggaatacagcccgaatattcagaatgcacaatccaatcaggaaactatggctgctggcaatgtagaaagcggaaccgatagtggcagttcaataggatctggaatagttggagccgccattgaactgatagttcagccacatcaggcaccggaaacaggaggtggcggtggtggaagcagcgacgataacaaacgtgatgaagaaaaagacaaatatgtaccacgaaaaggcagaaggaggtaacaatggcaaagaacaaaccgttaaaggatgaagaatatgattccattgatgaaatccagactacactggatagacatacggacaaacttaaccggatagaagccggacttgtttctataaagagtgaaattgcctctgtaagtaaaaccggtggccacaatatggatagcagtggagacagacagtttatccaactgagaaatttgttctatgatatattagataaattgagcaaagcatacgaggaactgaaaaccggaaagtccgatgcccagacagaagaattactggttaagattgccaatctatgtacggatatacaaaagaacagccttaacgctgttgcactgacagcggacacgaacaagcaatatcttaagattatcccttacatagaacgaatgaaccgtatccttgatgttgtagcagaacggtataacatgtcaaaagcaccggtaaaacctactaccattaaaggctggattctttgggccttcaagagactttggtcttggattgacagatatgtcggattcaggtatatcaagcaattctgtgtccttgtggccatttttatatgggtagtcagcatagtaacctcattctttattttacgtgaaaatcacaggctgaatgaaaccgaaagaaaatatattttacttcgtaaggaatgtttcaaacataaagaaacaatgggcttcgtaaactatgttgatcatgcaatagataaataaatgtcatatttgatatttttattgaggcatacatttttttgcaatattaattctataagacgtttattataacttccccaaaacgaacggtgaacttgtaacaaaatagaaactgaggataagaatatctaaagagtatatttctttccggactatagaggcaaggtagttccgagcattgaacggagaaggaaggtggaatatatgctgctctttgaagattaaaaataagggagaatctttcggtgtatttccgtcaggttctccccttaaagattgtattacttagcttggcagatacaataagaaagtattatttattttatct

SEQ ID NO: 106 - DNA, 26725 bp, Bacteroides thetaiotaomicron
ctttcatttggtattattatatacgtattaatgtgagtatatttggggaggattgtttgatcgtttataatacaaagaatatggataaaatgtgagtgtatactggttatagttgaagtcctgtcgggataatctttttagagtgttagctgaaaaagcctttaaataaacgttaaactagcctggataccgactaaaaagtattttttccaacctatatcctttattttctcctcgaattaattgcaaattaattactaaattaactagcgggacttacatttgtgccagttatcataaaattctaataaatgaaaaagttgctggtactattaacaatgcttcttacatccttctttgctgaagcgcaaaaaagcagagactattggaataacaagctaaagcttatctcattccgactacctcttccggtaggatatattccgaagattggtcaatcctgttgtaactaaccgaataaataaattgaatatatatgaaatatcttatcagctttttattcttagctcttgctttttcaatgaaaagtgaggctaaagtgacattaccttccatactcggagataatatggtattacagcagcaagcagaagtcaaactatggggaaaagcccgtcccaatgctactgtaacggtgaagacttcgtggaacgggcagacatataaatcctcatcggatggcaagggaggctggtcgttaacagtatctacccctgttgcgggaggcccttacaagatcatcttcaatgacggcgaattactgacgttgcagaatgtactgatcggtgaagtctggttctgttcgggacaatcgaatatggagatgccgatgggcggtttcgaccggcaaccggtcagagggacgaacgacattattgccaaagccaaaccatccacgcctatccgaatgtatactacagattcaaaggatgggagatgggtacgccagtttagtaaaacgcctgtggaggactgccagggcgaatggctggaaaatacgccggtaaacgtttcccatatcagcgccgtgtcttattattttgcgcgttatatacaggaagtgctggaagttccggtcggcatcgtcgtttctacgtggggaggatcaaaaatagaggcatggatgagcagagaatccataaagccttttagtagcattgatctttccatcctcgataacgatgctgaagtgaagaatcctaccgccactccgtgtgtactctacaatggcaagatagctcctttgactaattttgcagtgagaggcttcttgtggtatcagggcgaaagcaaccgtgacaatgccgatctttaccagagccttatgcctgcctttgtggctgacttgcgtgcgaaatggggcaggggcgaacttcctttctactttgtgcagatagcgcctttcgattacgaaggagccgacggtacatcggctgcccgcctgcgtgaggtccagttgcagaatatgaaggatataccaaatagcggcatggttacgacgatggatgtcggccaccctgttttcatccatcccgtagacaaggagacggtagggaaccgactggcgtattgggcattggcgcagacctacggcatgaaaggattcggatacgctccccctgtttataaatcgatggagatacaggagaataaaatctatataaacttctacaatgcccaacgcggcctaagtccgatgtggacatctcttaaaggatttgagattgcgggcgaggataaagtattctatccggcttttgccgaaatagaaaccacgactgcccgactggcggtttcgagtgacaaagtctctcatcccgttgccgtgcggtatgcgtataagaattatgtggaagcaagtattttcagtattcatggcatccccgcggcacccttccggacggataactggtaaaagcagacgattacctgaatagatacagctattttatcagacatccggatattcgctttcttgttatatccggatgtataaccggttctctttcggcgaaattttgttgaaaatatatctatcaaagtcagtgggtatatccatgaatccctgtatctttgcattctcattaaaaccataattatggaactaaagcatgggtactatcatctgattgccatactaacagtagctatctggggactgacattcatttcgactaaagtattgataaaccacgggctgacacctcaggaaatcttcttttaccgttttctgattgcataccttggcatctgggtaatttctcccaaacgtctgttcaccaataactggcaagatgaactgtggctggtagcaggcggtatattcggtggctccctttatttctttacagagaataccgctttaggcatcacccaggcgtcgaatgtatcgtttatcatctgcacggctcccttgctgactactatcctttccctgcttttctataaaagtgaaaaggcatcgaaaggactgatatacggttccctgctggcattgatgggggtagggctaattgtctttaacggcagttttgtgctcaaaatatctccgataggcgatctgctgactttgcttgccgcattatcatgggcattctatagtctgattattaaaaagatggccgggcgttatcctaccatatttatcacccgcaagattttcttttacggagtactgacgattctgcctgccttcctcctgcatcccctgcatcccgataccgctgtacttcttcaacctgccgttctgttcaaccttctgtttctggccgtattggcttcgctgatctgctatgtactctggaatgtggtgttaaaacagttgggaacggtacgggcatccaattatatttatctcaatcctctggtcacgatgattgcatcgttccttattctggatgagaagattacgttagtcgctttaggcggcgcagcttgtattgtctgcggggtatattgggctgaaaagaaatagagtagataagaaatagagtagattatgagaaaaatgatgaatgagcagcttcctatatcgaagtcatctcctctgaaagctcgtttttatgattatccttattttacttacccgtggcattttcatacggagtatgagattatctatgtcaaggagggcacaggaatgcgttttgtaggaaataacgcggagaaatacgctgatggtgatattcttctgctaggctccgatttgcctcattatatgaagagcgatgaggtgtatcggcaagaaggcagtacgcttcggacaacagggaccatcattcagtttgaaaaggacttcatgcaccacgctttcaattattatccccattttatgaagataaagaacctgcttgaagaggcgcaacgggggatttactttcccgcaggatgctccccgcggctggttgatttgcttgaatcgattccggtggagacaggagtcgatcagattacttctttcctgcaacttctgaaagaaatggcaaacgtcgcttcacggtctgtgctatcgacttccgattttgaaaatgatattatctacgacggatcgagaatagacaaaatcatagtttacctgaataagaactatacacggcagattgacctgaatgaaatatcttctctggcagctatgaatcctgctgcattctgccgcttcttcaagagcaaaacggggaaatcattcaagaattacatattggagatgcggataggatatgcgtgtaaactcttgctcatgggcgatatgaatatttcgcagatcagtgtggagtgcggatttgatacgatttctcattttaataagtcgttcaagaagcataccggattcactccgtcttactataaaaggatgatgctggctgaatagaaatgaatgaaagaaagaggcaaacgggacgtatggacataaaaaaagggtcaacgccttgacccaacctttgttaaccttaaatctaatactatgaaaaacacattgcaaagatacggactattgggaaattagcaaattatccaagtaaaatagtatgttttataacacgttttaatagttttcctttacttgttaagaaatatacccttcttttttaaaaggatgcaacactaattgtgaaaattgaaacgggaaattccgttgattctctgccggaaaactgttatctttgcaaggttaatctcattattcactcaacaaaaaagaaaaggagcgaaccgtgaacgaggaagaaatcgtgcttacccccatgatgaaacagtttctggatttgaaagccaaacatccggatgcagtgatgctgtttcgttgcggtgacttttatgaaacatattctaccgatgccattgttgcatccgaaatcttaggaatcacactgacaaaacgcgccaatggaaaaggaaagactatcgagatggcaggatttccccatcatgcgcttgatacatatcttccgaaactgattcgtgccggaaagcgtgtagctatctgtgaccagctggaagacccgaaactgacgaagaaactggtgaaaagaggtattaccgagttggttacccccggtgtatctatcaatgataacgttctgaattataaggagaataacttcctggctgccgtccatttcggaaaggcttcctgtggagttgcctttcttgatatatctaccggtgagttcctcaccgccgaaggtccctttgactatgtagacaaattgctgaataacttcggaccgaaagagattcttttcgaacggggcaaacgcctgatgtttgaaggtaacttcggcagcaagttcttcacattcgaactggacgactgggtatttaccgaatccactgcccgtgagaaactactgaaacactttgagacaaagaatctgaaaggattcggggtggagcacctgaagaatggtatcattgcttccggtgctatcctgcaatacctgacgatgacacagcatacgcagatcggtcacattacttcccttgcccgtatcgaggaggataagtatgtgcgtctggataagtttacagttcgcagcctggagctgatcggcagcatgaatgacggcggcagcagtttgctgaacgtgatcgaccgtaccatcagtccgatgggagcccgcctgctgaaacgctggatggttttcccgttgaaggatgagaagccgatcaacgaccgactgaatgtggtggaatacttcttccgccagccggattttaaagagctgatcgaggagcagttgcatctgataggagacttggaacgtatcatttccaaagtagccgtaggacgtgtgtcgccacgtgaggtggtacagttgaaggttgccttgcaggccattgaaccgatcaagcaggcttgtcttgaagcggataacgcaagtttgaaccggataggtgaacagctgaatctttgtatttctattcgcgaccggattgccaaagaaatcaataatgaccctcctttattgatcaacaaagggggcgtgattaaagatggtgtgaatgaggaactggacgaattacgccgtatttcatactccggcaaagactatctgttgcagatacagcagcgtgaaagtgagcagacaggcattccgagtctgaaggtagcttacaataatgtattcggttattatattgaagtccgcaatatacataaggataaagttccgcaggaatggattcgcaagcagacactggtcaatgcggaacgttatattacgcaggaactgaaggtttacgaagaaaagattctgggagccgaagataagattctcgtgctggagactcagttatataccgatttggtgcaggcattgacggagtttattccgcagatacagattaatgcgaatcagattgctcgtctggactgtctgttgtctttcgctaatgtggcgcgtgagaataattatatccgtccggttattgaggacaatgatgtactggatatccgtcagggacgtcaccctgtgattgaaaagcagcttccgattggtgagaagtatattgccaatgacgtgatgctggacagcgcgtcacagcagattatcatcatcaccggtcccaatatggccggtaagtccgcgctcttgcgtcagacggcactgattacgctgttggcgcaaatcggttcgtttgttcctgcggagagtgcccatatcggtctggtggataagattttcacccgtgtaggtgccagcgataatatctcggtgggcgaatctacttttatggtggaaatgaatgaggctgcggatattctgaataatgtctcttccagaagtctggtgttatttgatgagttgggacgtggtacgtctacctatgacggtatttccattgcctgggcaatcgtcgagtatatccacgaacatccgaaagcgaaagcccgtacactgtttgctacgcattaccatgagctgaacgagatggagaaatccttcaaacgcatcaagaactataacgtgtctgtgaaggaagtggacaataaagtgattttcctccgtaagctggagcgtgggggaagcgaacactccttcggtattcatgtagcaaagatggcaggtatgccgaagagtattgtgaagcgtgcaaatactatattgaagcaactggaatcggacaaccgccagcaaggtatttccggcaaaccattgacggaagtcagtgaaaacagaagcggtatgcagctcagcttcttccagttggacgacccgatcctttgccagattcgggatgagatactgaatctggatgtgaataaccttactccgattgaggcgttgaataagctgaacgatataaagaagatagtcagaggcaaataaaaactgatataacttatgcgggggctgactaaaaagtcgttagtaactttaaactctcctccttccggaaggaggagaatggagatactaacgacttttagtcagccccaacgaagatactatagacttcttatgttgtaagttatagggttacttgccgtgccaatggtatggccttatgcttataccttctttgtatagaaagagaggccggttggcttccatgtgcctttgtttccgtaggtatccttttcttccgtggtataggcaaagttttttccgtctgatatttcgtagatacagtttaagtcatcgctcttcttttcatagacataccctatgattgttccgtctccgttcggtgccggttctaatgtcaaacggtgattctttccgtcggaagacaggtaaagcggtactgtacccggttcgtgtctgacaaatacgcttcctatcacaccttgacagatatcggcctttgcggttaactccttataagaggtatagtagcggtgatagtgcccgtcacttgcctgaaagatgggagccgtttgttgtaaggacagttggtgccttttgatatgggctattaccgcttcttttatttgctgtttctttatggggtcggctattacctcatagatggggataaggtcttcaccggtcagagtagttaaggcgcgattcttttcattggcagattgtatccaggggctgatatccatcggatcgcctgtcagctgatcaaagactttgtaatcagctccttgcaatgacactacaattgttcccccatagttcttttttactgtttcttcgggataagtgatggaaacattgggatgcttaataatgctgctctgatgtgcgcccatccctgtatttgcggttctcaataagttctcttcatcatccgctacgatgctgcgatagagggttttgcttatataacctaaatgagtgttcaccaatatatgagtaccaaatagttctatgattgtttcaggtgacgcatcttccagctcttgccggaaatcatcggccagccagttggaccaatccgcattcagagtgagtaatctttgaatcactccgttagctcctgaactgccaaaggcaaatgtgtattgggatgaataatcataaggtttctgaaaatatttatgaccggtaatggtagcggtaaacagcaaatcatctttgttttccgccggcaccacaaatttcttatattttgtgattgaccgaagaaactctttcatatcacgaccaatgaagctgtctcctactccgctcgaacctaccagattgctaatcctttcattatctattttgctcagatcaagcactggttcttttaccgaattattgtctatgtagctgcccataatatcatatccggcacccagaaaaggctgtgtaagtgacatggaggcttcaggccagctattaccttgtggtacggcagggcttatgtaactgtcattcgtttcttccggaggagtgtaaagtaattcttctttgtcactgcaacttgcgaatacggatgtgacgaaaggcacccatagtagtttgaatagtgtttttgtgctcatatttttatcatttagtcgcgctaaaggtagataaaaggaatgagaaaatactatttgaacagcactattatttcagaaagtcttccacctttttataaaacaaggaaagatgatgcccgtcaataaatccgtgatgaatcgtcatcgcgataggcatcaccagtctgccttcccttatgatggcttttccggcattcagcaacggatagttattgccgcttctcttctcttgtgtgccggtgatggaagtaaagtacaggtcgggagtcgcacttaacagaatcagtccgtaatctccgtcggctacttcttcgttttctgccgcatacggatcgccgtcttcggggatggcgtcgataattagccttgcttcctgatagaaagtgtcgaaatcgttgtggtaggggaaacgggtggtgaagaacttgccgttctcttttatcttgatgggagacaacatatctatggtgtcatagagcactacacgtccgtccggatcgatgcggtaacgaaactccggtatttcgttggctgcacgcagcacagcataaagataatggagaaagaaagactgtccggcggctttggcacgttgcctggctcctccgcactctacttcggaggtaatggataattggggattctggaagtggcggaagaagttgaaattctccttccgctcccagttttctatatctatgatttgtttcatttctttgctaccttcttccggtcatagaagaacataaagtagaaaccgatgatgatgaaaggaacgctcagccattgtcccatgttgaacatcatgttgtcttcgaatgcttcctggttctgcttcacaaattcgataaagaaacggaaggtaaagatataagccagacagagtccgaagaagaatccgcgatgcagtttcttgctgtaattcttataaagatagatcatgatgaagaacaggatcagataagctatcgcttcatagagctgtcccggatggcgggggagcatgtctacccgttcgaatacgaacgcccagggtacattggtcgggttaccgataatttcggagttcatcagattcgccagacggatgaaacaggcagtgatcggagtagcgacggcaatcatgtccaccacatccatataatgaagtttcgtcttgcgacaatacagccaaagggcgatcatcaatccgagcgtacctccgtgactggcaagtccttcataaccggtgaatttccatccgccgcctgccaggaacttgatcggcagaagcatttccacaaatccctttccgctggtcaggtactgtcccggatcgtagaacaggcagtgccccagacgtgctccaatcagaataccgaagaaacaataaaagaagaggggatcgaatttcttctcgtctatttttttgtcgcgaaactggtaatggacaatgatgtaagcaaagaagattcctactgcccacaataatccataataacggatagaaatgccgaacaggttgaatagttcgggattcggattccagttgattgataataaaagggtattcatgttggataacggtttacggtttgtaattagtgttttgtgaatttttcggcaaccatccggtaagttggtatgtcgataccttgctcctcggctgctgcaatcatgtcaaacagcaaaccttgtatttccgattcatgtccccgtgccaagtccttttgcatggatgcggtactgtcgggatcgagtttatcaatgactttcaaattgtagctgacagggtcttcgggaaattcgactcccagcttacgccccagtgcggcactctcggtagaaaggccgatgaacgtatcacgtactttccccggcttctgaacttcacccatcggcacgtcatagtaagcaccggtgacggccattgccgagatgaacgaccatttgacgaatgtatcccgattgatgtccggagaaatctctgctttgattccactttcctgaaggtctttctgaatggcttccataatgcccggagccacctgtgtccctttgtgggcgccatacaccagacggaagattttccccatctgagtgatctctcccgtgccggaaacaaagcctacgatgtagatgcaaccatcgagcaccgttacacccggaacgagacgctgaatgcgtggtcctgtcccgtaaacattcaggatagggatgacgactgtcttctcatgcgatgctcttttgatgagttcggtaatcgaatcgacggaatatcctttcacgcagacgaagatcacatccgctttcccgttaaattcctccgcattcatggtagggataaccagcgtatgctctccctttaaatctgatttcagtttcagaccgtctttctgtatagcctgcagatgagctccgcgggcaatacaagtaacatcttttccggctagcgacaagaatcctgcgatactgccaccgacgcctccggttcctgcaataagatatttcatactgtttgagtttaaacgttgaatcggaagtgcatgatgtcgccgtcctgcaccacatattcttttccttccacaccgagttttccggcttccttgacagccgcttcggagccgtactggatataatcatcgtatttgattacttccgcgcggataaatcctttctcgaaatcggtatggatgacgcctgcgcattgcggagctttccatcctttctcgtaagtccatgcacgtacttcctgtacaccggctgtgaagtaagtttcgaggttcagcagcttgtaagctgacttgataagacgtgcgacgcccgattcttccagccctacttcggcaaggaacatctgacggtcttcgtatgtttccagttcggcgatgtctgcttcggtttttgcggcgacaacgaggatttctgcgttttcgtctttcacggcttcacgcaccatgtctacgtatttgttgccgtttaccgcacttgcttcgtctacgttgcagacgtacatcacgggtttgctggtcaacaggaagagttcgtgagcgatcttttgttcgtctttcgtttcgaaagtgacggtgcgggcggatttgccttgttccagtgcatccttgtattgaatgagtacgtcataagcctgctttgcagccttgtcgccaccggtctgagcctgtttctgtactttctggatacggctttcgatggtttccaggtctttcagctgaagttcgtagtcgatgatttctttgtcacggacggggtttacgcttccgtctacgtgggtcacgttatcatcgtcgaagcagcggagtacatggatgattgcgtctgtttcgcggatattggcaaggaatttgtttcccagtccttcgcctttgcttgcacctttcaccagtccggcgatgtctacgatttctacagtcgtggggacaatccgttggggatgtaccagttctgccagtgcgttcaggcgttcgtcgggaacggtgattacgcctacattcggttcgattgtacagaaggggaagtttgccgcttgcgcttttgcgtttgacaaacagttgaaaagtgtcgatttacctacgttcggaagtccgacaataccacattgcaatgccatattaatctattatttcttttattatcaatgaatcatatcatgtgagcagcgacttggcgctaatctcccgataaaaacagttttgattgccagcctgctcattttagtttgcaaagataatcattttttgagctaatgagggaaacttggtgcactttctgtctttttctgataattgtgctggctggaaaaaggttttgagcaaattgacaaaatgaatttttagtctcttcagaatgccgttttcctgcccgacggcgggagtgggggaaaatatgcgaatgaaaatctgtattttgttcataaatagggcggtatctgaatctttacaaggctaataattgggcaaccatgcccttcttgtcaaatatgaaggcttgatgctttggataaggttgactgacacgttggatatatatgaccaacacgttggataaggttagctgacatatcagctattaatgttctgtaggttggatatatatattctgcgtgtcaagtaacgactcctttgcataatcttccaataaaacggaaatgatatgcaaatagtctgcatattgatacatcctattctttctctgagagctgactggcgttcttttcaaaatgtatctgtcagcagaaacggcaatatggtgccattaatactttgaattgattttattctgtcactatgataatttcatctttagtgagttcttaaaaaatccccttattctctggctttactttctatttgagagtaattaagaataagggggatttcagtattcgttattcgcaaggcggtacttccgaaatactgccataccggtgatactcaaaggcgatgctttgctccttgatatagtgtatcagctcgatgcgcccttgcttcacaggcggtgctgtcgcaatgtatttattggtttccgctgcccgttcgtacatgacatcgggtatatccggcgaacaggtacgtactctttcatattcgggcaattctttcaggaagtcctctaatgattctttccggagtgtgcagccgagtccggcaagtctgctgctacgatcatctgtcgggccaaaactgatggtgagcggagttctgcatatacgggcggcgtgtgcaatcatcgtcgcttcttcgtctgtatctttcgggaagaggcgtagaatcatgttcttcaaaggcagatagcggaagaggttttgttctccatatagccggttgatgtctctcggttttgagaactcttcctgataggctttggcataactctgtcggtagtcggtccggctgtccggtttgtcggtgatttcgaggaaacaggtacagtagttggggccacctgctttgataccaccaccgaaggcggatagtttcattcccccgaatggttgccggttgacgatggctccggtaattcctcggttgatatacaggtttcctgccattacggagttcttccacagcttctgttccttttcatccagactttgcaggccggaggtcaatccgtaatccagcccgttcaccagcttgattccttcttcaaggttctcgatacaggccacgctcagcagaggaccgaacaattcggtgcggaatgagaaactttccggttttactccccatttgacagtcggtgcaaggatgtactctctgtggtcaatgaaatgcggaggaaccagccacgactcacccggttcgaggttgaaggcttgcagtaacttatcgttcttgttggtaatcatcggaccgacgatatttccggcattccacacactgccggttttcaggcttgtcgccgcatctttcagcttgctacggaagttttcgtcttcgtatacggaacgttcgactaacaacagcgaacaggcggaacacttctgtccggcattgccgaaggcagaagtgacgatgttcatgatggcgtggtcacggtcgcccgacgctgtgaggataataacgtttttacctcccgtttctgccgataacggagtggtcggattggcttttgcgatattctgtgcggtgtccgttcctcctgtcagaatgatatgtttgatggcgggggcggtagtcagcactttcagtgcttcccggcgggtgatgatgacttgcagcgcttccttcggcacaccggcatcccagaatgccttggcaaacatccacgcaacaggggcggctacggtggcaggtttcagtataacggtatttcctcccgccagtccggctactataccgcccacggggatggcgcaggggaagttccacggggagatgaccagtatggtgcctttcggtttcatttctacgtcatccagcgcggcaaacttcttcatcgctgtcgtatagaaacgggcatagtctaccgcttccgatacttctacatcaccttcaatgacggttttacccgtcacggcacacatacagcctatcagatcgccccgcatatcggcgagccggttggccgcttcgtacatgatccggtggcgttcttcgagtgtggtttttctccatccggcagggtctgcctctgcaatttcgatgattttctccacttgtgcgctgtccgcctgcgacatttcacagatacagacttcatcgtcctgacaacggtctgtatatgggtagcggctttcgcataccaccgtttccgcacctatttgcagcggaatgatttccggctgttccgttccgtctttcttccatttggagaagatagaacgcacccattcctgattctgcggcaggtcgaagtccgtgtccggttcattcttcaggacgtctgccggagggacaggcgtgtaaggaagattgcgattctgagtgcgtggggacacatgactcagttgatctttcatggcgtaggcatcttcgaactgcttagccaggaaatcccactcttttgtgttcggcctcagattgaaagagtgagtcaggaagttatcaggtgccgtgttctcatccatccggcggacgagatatgagacggcattcagaaaatgttcgtttttcactacgggagtataaagaatcacccggttgccgagcatggattgggctctccataggtggttcgccattccttccagcatttcgaaggtcatatattcggctgtaccatatttctgagccagcagataggcgtaggcgatggagaacaggttgtgggaagctactccaagatgcaatacccttgcgttttcgggcatcagtgcccgttccagcagatgcaggtagttggcgtctacttcttctttggaagggcggatcggattgggccagcctctcagcgaagagatgacggtttccatttccaggttgcagcctttcaccagacgcatcttgatcggggcaccgccttctgctacgcgtgctttggcaaattcgatcagttcggtctgaaagtcgtatgcgtccggcagatatgcctgaacgacgattccggcggaataattcttgaactgcggcaggctgagcactgtcttgaagaggcgtaatgtgaaatgggtatctttgtactcctccatatccagattgataaacttggatcgtctgactccttcttcgtctgtataggggaaatcaatcgctttctgataaagcgcggacattcgcgaaacgagttccggaaaactttcttcataattcaaggcgtgtgtctgcgcatagattcccgatattttcactgatatgtagttgatgtcgggtgattcgagcgcttccagataatggtggtaacgatggtcggcttctccgttgccgagcaccacttcgcccagcaggttgacgttctgtccgattttctcctttgcacgggtggccaaatgcttcgtgagttgcggacgcgcttcgttgatgatgacctgcgaggtgtccatgcgcaggcgcttcttgatgatggggatggcgataaagtcgaaatgatggccgaatgcctgatacattctgaacaggaagctgtcccgcttgttcagaaattcgggaacgccgtattggtcgagaagggttttgatacgtttggcaagtatccttcggtcacggatttgcgaagattcatccagcatcttcacgaggaatttcttgtcctgcggacgttgcaccatgacagcatatttatgctgttcgcggcgttcggcttctgtgatggtttgctcacaggtattgtacagtttgagtacccaatcctgtacttcggtaagggtcggttgatattgtttgtccatactaatctgatctatgtagattatggaaattaagaaaaaaagaatctcaaatgcaatttacatagggtggcaggtgggactgaacataacagcacggtagcgatgcagggtttgcaacgcttgctgcgagaagcggtcgaacagatactgttgtgtcatattcgtcgttttttaaagtgattaggtacaaaaggctcacacttctcgcaaatataaaaatatcttgttgattttcaagcaaaaggagagaaaatattctctcctttcagtattattttttcttgcaataactacccgattgctttatagctattactgattcgcattatctatccttgcttaaaagaataaagttgcaaaacagcttgcgggctacatcagccgcagccgcagggttattcaggttatcaaccaaatctaaggttgaataatagattttcccttttccgcaagagatgattccgacagcagagcccagattaaacggagcactgctgtatgagcctgccactaattcttcattatctatatgtagccctaaacgtcggtcgccgttacgcaccagggcttgataaggccatcccattgctacattgaccggaagaccgttgaaaagagggtgttctttcacgaaatgaacaccgcctacccagttctttcctacggaataatagccatgataagccgaacctgtatatgcgctcacagcatccatccatgactcggccgattttaacaagagcaatgaagtaccgtcttcccttacgcgatccaataactcttggggagcaatcgccgcatggtccggaagagaccagactaattgtacgcttcccgtgggattgcgttgactgtattccacacggacagcgacctcatcacctgctttcaacaagaaagggcgaacgacggtcaattctttattatttctccattcatcaacaatacgctgtccgttgacggaaagacgcattccctgatcggaagtaaccccaatcatataggtgccggactgaggggcttttaatttcccatcccagatagctgaaaaagattggttggcaggaagcaaggggtccggttgggcaccgtctgcgaaagtacggtctatcttgttgtcttgggtcacccccgccaatgtacgtaagtcatcgtctttataaagagagagttccaaaaccgatttgccttctttctgacaaaatgcttcaacaggaacaggctgcggcgcatccagggatgaacgtgtcactacaatccagtccagtttctccatatccgaacggaaagcaggaagctcgcatccggttgctttctggtaaaaggtagcaacagggtcatcgggagtaccatataaagcaccttttcctttcaattgcttctcatcccagtaaatgccaagtacttcatctttcccttcggcgcacaggtgtcccgacgtattccgtaattgcgccttgacttgatataaaccggaagctccttctattgccaactggcagttctccaataatagctgtccgaaacagtctcctccggtaatgtgcacctctttttcgatgtgttttccttccttcccgtcgggtgtgcagacagacactgataaacggtattttccggaaagatttttttcattaacgatgtagaaatcgaccggtacttttcccggcaggtgtacaaactgtgtgcggggagagaccgctacatagagcggttgggtatagtaagtaaaggtggaaggatttcctttgcagttccggtagatgtctacaatgccggaatggttgtcatacggcatcgcttcccagccgttcactgcataaacgtctcctgtattctgcatacgcattccttgaatgcgccgtccttgatggtcgaaagagacatctcccatggcgcgtgtcagcgagtcaatggagccgaagtaaggcgccaggttcttctcatggaaaaactgctgaaatgcctcatactgattcttccagaataatccgtcccaccccttgattccggtctgttctatttctttggcaatttcggcaatgcggggaggggttgaaagagcgccttcttcgccccgtatatagatttcggtccggttgtccgtatacatcagattgtctttcggacctctatagtaatcttcctcccaagtggcaggccctgcggcacggtggttgtcgaaccatcccttccggtgcagtaccgaatcgaaaggcaacagatttgccttggcgtcttcttccgaatgttcggcagaagcccatccggaagtaaaagtcatcacccggctcggatcaatggtatgcgcctttttcatgtcttccatacgcagggcagtcagttctttatctctggcacgaggacctccccattcatttatcagattataaatgacgagacttggatgacttctgtcccgcaagatcattcgttgcagtttggtattgactatggtccggatgaagggatcgtgtcctgcggagtgaaaagctcccggctcttccagatatagcagtcccagttcatctgctttttcgagcactaccggcgaaccgatggaacgatggaaattcagcatattcagtcctaaagccttggctgtaagtatctgtttttcggccatttccggagtggtatacaagccgcccacaggccaatatccccaactgatggcagtaagcagcatcacccgctgcccgttcagtctcaactgggcatcttttccaatccctgtcggttcaaaccagcggaaaccgaaagtccgggaatctgcatcccatattcttttagccgatttgagttcgacccggcaaacgtacagatgcgggcaatccggattccagagtttcgcattcggacagttcaggtccattgttatcgtattttctcccctttgcaagataacgttcttcaaatccttgcgagctataattctcgatgggttttccttttcagcaactatgaacatgagttgccccttttctgtattcatcagggtattgttcactgtcagaatcgctttcactttggtatattccggttggttctgcatatagatgtctgatatgaacaaaggagagactgcatccagacgtacccggcctatgattcctccgaatgaccttccgggcggtatctgatagctgccccaattcatctccgtgaagtcctgccaatggaaattacctcccggatgtgtcacccgcactgccagaagttgctcttcaccgggtttcaccgcttctgtaatatccacgtcaaagggggattctccaatcatatcatatcccaccagcttcctgtccagataaatctcggcacgcatacggaccgattcaaaatgaatcagcacccgtctgcctttcagtgttgccgggagtttgatagttctaaaccaccagctgactcctgctccatcgtccggacttgggcgactggaaactgtacaatattcctccacggttcccggcacctgcacggctgtggcattggccggattcagttgttcccagcctcctgtcggaacattcacaggaaggagtgacaaatccgtagcatcttccggcagaaacagtttatcgtttttccattccgcctgcttgtcctgccataaatgccattctccaccatccagagaaagagtgtatcttcccgctgttttatcgtcctgttttgcatctaccgacacacttgtccatccacatagtatgcacaagtataacatccaactttttttaaagcattcattgtttttcatctgtttattgagaaagtacgtcagatgcaaaattataggggaggcattaataaaatagtgtgatggcgattaatacagagttaatttgcaattaaaacccattaatctgcgtttggcggcagaaaagtatgttttgtttggggtattacggtattacttggggtgatttatttttctttggattaagttatttaccagtggcttgctttgactcaaagtttagtatttggcttgatacttcttataaaagatcaggaaaaggatgaagccgatcaatgcgaacggaacacccgtcagggcgggataacggtagccgccgctgattgccagtcctcctgcataagctccgatggcatttcccagattgaacgctacctgtacacaggcagctccgagcatttcgcctcctttggctacacggataatcaatatctgttccggactggatacggcaaacagtcctgcggtgcagaggcacatcaatagcgcagccgcccatttgtagggagaaaggaagaagataagcaatagcatcaggcagatcagtgcttgtgcggcagttcctacctttccgggagtgtagcggtcggagagccgcccgctgatcagatttcccatgaccataccgaatccggcaagaatcatcagcggggtgatactttcggcagagaaaccggagatatgagtgagcattggattgatatagctataccagcagaatacgccgccattacctaatgccgtagcacccagaatgagccagggagccggagttttgagaaagcggaactgtcctttgaaaccggtatctttcagcccttctacctgaggaacccaacgccagatgtaatacagaatgacgattccccaaagacctaccagcaggaaggtagcccgccacgaaagcatggtgcttaaagaagttcccagcggtacgccgaacaggttggcgatggtcattccggctatcatgatggagacagcttctgaactcttgcctttatcggcgagcctttccgcgacgatagaaccgaccccgaaataggctccgtgaggaagtccggagatgaagcgggagataagcagcatccagtagttaggtgataatgccgcacagatattacctaccataatcagcgtgactaataccagcaatatatgttttagtggatatttacgtgctaatgtcaatacaggggcgccgacacaaacgcctagtgcgtaggcggaaatgaaatgtccggcagcagggatgctaatctttaaatctctggctacatcgggcagtatacccatcattacaaactcggcgatacccaatccgagggtaccgaatgccaatgcaataagactcttcttcatacgaaactcaacctgatacctgttactttttaccttctttatttagcgtatttttacggggtgcaaaggtaaaacaaaatctctcagaatgagttcgtcaggaatgattttgatttaaatcaatttattgcttttttatccactcagtcatgtctttcaggacttccggatttatcgtctcttccaattgtccgtattcggctaaagttcctttctcacaagtctgaaacaggtggttcagttttggataggctttgattgttacattcttgtttccgttctcgctgatgtgctgcttgatagcagtcagattcatatcggcatctacttgaatgtctttttctccgtttaatgcgaggaccggacactttatttttttcagacttgcagtcggatcgtatctcataaagtggagataccacggcgaggtcatggagtttatttgggcagatagttgttgtacggtattcaggtttttcaactgttcggcagacatggttctggtaacatcagcgtacacctcttttctgatttcatccgacgacttggccgtttgctgtaataaagagtatctgtggcgaacggatggtttcattgtctgccacaccggatcgggcatcccttgcgacttggaaatcaattccacttgtttaagcatcaagctgtcacctcgcacggcagctcctgccaatgatatgataaatgagatgttggggtctttggcggcaatatcaaatgcgattgttccaccgcagctatgtccgataatgccgattttccgggtattaatttcttttctgctgcgtagatagttcagcgctgcttccgtagcttttgcaaaatcttcattggtagcacttgcataatctccttgtgaagcagctgtgccacggtcatcgcatcttagtacggcaattccgttacgtgtcagataatcggcgataacaagaaaaggtttatgccccatgatttcttcatctctgttttgagcaccacttcctgtaaccaatactacagccggaaatttactccctttctccggaagggttaatgtgcctgccagagtgattccgtcctgcgtattctttacgctgacttcctcgaccttataaggaaaaggtggctgaggctcctgcgggcgtttaggtccgctaaactctcctttcgtcagattcaatgggaggggcattccttgtgtgaatgtgccggtaatggtttggtccgcattcagtttccctttataagaggcatggataatcggtatctgaacagtcagtgtagagtcttgaaaagaagttgtttctgtttttatatctttggttccctgatcggggctgtcaagagttgccacataagttccctgttccgtatgcttgatatggaatacaatggttaacgagccggcaggaagggagagtttaccatgccaagtgcccgaaatgtcttgtgcaagcaaggaagaagataatgtcagtcctgtcagtaacatagcgacagctgcaatcttagttttaaatgttgttgttctcatattataaataatggttgggagaattagaattcattctttacgtagtagtcaaaatatttgcattcgtgcacagcttgcttgaagaactgcgtgtcggaataggattttgccagttggtagaaatagctgtccaccttcttttcttcatccgaccgtttaaaatcagggtcgaggatgttgttccagttatcccaccagttttgggcataaaggtccattgtacaggaggatgccataaacaatgcgcgtgctttccattcacgatcggtaaagtaagtggcagcctgttcgtagagggcaagggcgttctccatgttgttgatagtcatgtattcttgggtgaagtccctgtaattgtactctttgctgtaatcgggaatacggtttgaaactgccgagccgtatgatccatacgcagaccaacagtaggaattatctctgaagtacgtgggaatattcctgtagtaaccggtaggggatatgttataataatagttggccagcatataggcagctcgtgcgctttcttccgtcatcatctggctttctttttccagttgcatcagggcagcggtcaatgtagccttatcgtgttcttggttcaggtagggatactgttcgtacatcgtatctgtcagctgcgaatcggcaggtacactaaacagtctcttgaatccattactgaatatcaatggggagatttttgaatagccgttgaactcgttcggcaggatttctacaggaatatatttctctgtttcataatcgtaatcatagtgagtgatactgtaagatggcggaactttggcaaaccatttcgcagcttcttcaaagttattcatgcgcaggaagtaagttccttccaattcgtaaagctgggttaacagtgcttggtcattttctttctcagcattactcatgagtgagttgataatattcggatccggattctggcgtaagtcctctatacggttgtgagtaaggaatgctttgccgtagtccttctgcatcttatagagatgaccgacaatttcgttgatgaaatcttcatcggcattactcgtttgcaggtattggcggatcgttttttcttcgtctgtaccgataaacttcagttgtgccagatagaggctgaattgtgtacggcttttttgtttcagcaatttgggtttcgtggttcggacggagtcgatgagtgcggatgcttgttggtagtctttgcagaggaacgacaggtgtgccaggtagagagcccaaaagtctttgtcgctcactttggggtgattcatcactgctttgataaccttctgtccgcgttcatactctgcaagtacttttccggaaggctgcatgaatgagcttgtgtcatctgtggcattcgaatgattgtagcgggtcagcacattcctttccatcttgttgatataacggatggcgagcagcttgatatagggggattcgggatatatttcgagaatattttccacctcttccagttcgttggagaaggtattataccctcggagcgcgtacatggccgctttctcccgattgtctttacaccaggtcatcgcttcgttccagtctacttcgctttggattctgaaactggaataggctattttctttctgttgtccgaatggtcgaacacacgggagtagaggtagttggcatttgccagtttgcctatgttgtagagggcgccggctgtttgttcaagggcggcgtagtagatataatgttcctgtttgagaggtttcacgtataggttatacattcggatggcttcattgttcttgttgcgcatatagtgcgccaagcgtacgagctggtagccgtatcttaattttagttcatgatatgggcagtgctggtagagttccagccctttgtttttgtagtgggcgtacgtctcttccgaaggggaggcggcacgtttcatgtcccaccagccatcgttttctgatagttgcgcgtagggttccagttcctttgcatattgtaggtaagtgagggtctgctttcctgcgtctgtcttgttcagggcgatgacgtatggggaagaaggttgctttaacgactggtaagaagcggaatagagcaatgttttgaactgtgctgtatccatctcttgcagggtgttgtttttcttgaagaatgtcatccacgcattcaggttctcgtcgggctgctgttcggcgtccggattcgtgtcttctccatagaatgcgtagtctgtggtcaggaggaaaggttgcagacctttgttctctaaaagaagttggtcgaaaagattatagtagttcatataatcgtagtaatcgcctccgcatccgttgacgtaggagtggaagggaatcaccgctatggcgagtgtgaggatagaacgtttcaggtatttcatgagaaagcgtttatgatgttagttaattgttgtgtggaatattgtttgagaatctctttgtccagatggtagaagatgatttccctgttctcttttcgtagtttcctttgtaggagttgggccgcttcgagcaaggtttccgggctgacctcttctactttgagttcgtagtctttgttcacccatactccgcccagatagtgcgattggagtatgttgtagacaccttctttcgtttgtttataatattcgggatgtgcgccgatagtagcttggcggattccgttaatcagtttaatctgtccgaacggatttctcactattccccaactgtagagcggcagggcgatgtccagatgcagcggataggagccgacgtctttgatatatgaagcagcgtctttattgtttaatatggtgtttttgttttcgaagtccgtaggttccgatgaagcgtaatacatcagcgttcccttgtccacaggaggtactccggttttgtccttgaacttgatttgatgaaggcggatggtgcaacttaccagggctcctttccttagtttccggatgtgtttcaggaagttgaagtagttttcttttgtctttaccgtccagtcgcagtcgaactgatattcatttgggagcttgttgaaatgcgaacggtaaacggtatctatccggtcggcgcaattgcgggcaagcttttctatatctgcggcaggacattgcaggatggtttggttggtgataaatataacggggactacctcttgctgaaagtcgggattgccggaagaaggcgaatagtctgccgtagggaatgccccatttcctttattgtctacatcgaacatacgggcatatatcttttggactccgagtgtattcagataagcagtatccgcgtcttctgcactcaatttgcttttccagacataaaatgcgggagtattcgtatgtctatcgatgcatccggacaggcaaatgagtaaaacagctagttgtagtagtcgaatctgcatatgttatgaagtatcccggatcattaagttatattccgacagaaaaagacaataaggatacagaggacaaagttatgaaaaaaagatgcttttacaattgaaacgcaaaagtaaaagtgaataaaattactaacttagaacaataaccagcaaaggatggtggttgtaaaacagtcaccctccaattttttaatttggtctttgatatatggggtacttcaaatagcgtaagggagttaaattggggtgatgtgaagttaggtttgtatattaagatagtgcatttatagatatggatggacattactccctattattaaacatatgttctatttaaataaataagcactgactaaatttgcatcattataaac

SEQ ID NO: 107 - DNA, 26672 bp, Bacteroides thetaiotaomicron
atggagtgcatacaagagccagtccattccaggatatattacctttaagaatggactggatagattttatacacagtttgaactgtatgagttaatcagctaagacttgtgtataaagggtagcttcgggaaggaggagtacccgcagggggaggtggtaggtgaatacgcagtccacttattcactgcaaattatagacaaccctattttacctaccaccccggctttcagccacccctccttcccgaagggaaggggagatactattgtctttttagtcaatccccttccgtctttttcagaccatctcagttctttcactttttattttgtgccacacgattattattcgcctgtggcttcaccactaccccatttccattcttcgtacatttaatacattcctttcgtaatgtgccctccttcagattgaaaataagattcggattaaaatgctgaccgttaatgcgggtttcaaaatgcacatgctccgtagtagcacggccggtacgtccggtcagtccgataggttgtccggctttcaccgtatctccgctctgtaccaaattcttgaagttatgactgtaaatcgtttccagcccgttcgcatgacggactacaaccaaatttccgtaagcataatatggcttcgacatacgtacgactccatcaaaagcagcacgaatcgtatctttggcacacgtctttatatctgctcccgaatgtcctccgcgagttccgtaagcggaaataactttggctcccggtaagggaaaagcatattcatgctcttgcaaagaatccaaatgcagatatatatgattacttttcgcaaaaagtccgggagtagcaacccgtacgtgattcacctccatagaagaaaaagaggatttactttgcgcataagcaagagttggtaaaagcaggactgtcaataaaataagtatgttcttcatgtatttctttctttgttattcaaaatagataagttcaccgccatccgatccggcataatccttcagtaaggattgaatcatttcagcagcttcctttagtccctcttttccgttatacccgttgactatcgcgagaatatgagtagtcccgatatccatcttcgtacgttcgtggtcactggtcggtgttccgattcctccaaaagaatctctgtacactggcaatccttcaatgttcaaaatgccccggccgataccttcgaaaggttcttccgctttgccaatgccaagttcaagatggttaccctgtatcttatccgcatcgaagccaccgatagaatgtccggtacggagagaaaccagattgataaggtcaaccaaagtatcaatctgatacaaagggatgccacgcatcaggcgacggcgcagcgcttctgccgacggacgataacgtcccgggtctttgccacaacgcttataagcctcacgggtagcagcaatcacaggttgcaacttaatgtctgccatttgggtggtagtagtcaagtcttctgtgaaagtatttatttctttccaaagtccatcgcagtaagcagtattcttcactgctgcatatacggctgctccggcaaaaaccggacaggcattctttatttcctgagatacttttatttcaaacatacttttattcaagtttatatcaacttacgttcaagtctattccaacctatgcgcttatttatgtcaatctatgttcaaagctattatttatgaatcatgatccccgacagaatccgtccggacttaatgcccaaacgccttgccgagaaaaactcgtcgtgatgaatatacgtacatatccgggcaagctccacctgtccggacggcacaccgaaagcaaggatttgcattcggttcgcttcccacaagtcgatatgatgttttccggtttcctctttcctgatagaaatacggggcatatcaaaaccattcttctgaaatgcttcgtacacttcctcacccacttcaaaagaagccaatgagatactcggaccgatacaggccaccacatcttctccactcgtgccaaactctttttccatccgcaacaaagtatcacgtacgatgtacgctaccgtccctctccatccggcatgaatggcggctatggcaccatgtttcttatcatataccaacacgggcacacaatccgcagtagaaatacaaagacaatatcccggctcgcgggtaatcaaagcgtccactccgtgcagcatctcctgtcgttgttgagacgaagccgataaataagcatcgccgatcagcaggtaattcgtctcatgggtctgcacaggaatcaccagttcttcgggtatctgcgacattccttccatcagaagcgtctgattccgccggaccttttctgcctcgtcgccactgtaaggcgtacagttgaatgacgcataatttccctcgctgcaccctccctgccgggtagttacaaaatgagaaatgttggagtatgagcttaacgactcataccccaacattcttttatcttttgtgattgaaatcatttttcctcccaatcctcttcttcgtattcatagtcgagatcatcgtcttcgtcgtcagcgtcttcctcatattcatagtcgagttcttcatcctcgcccatatctttgagttcctgctgcaaacgggtcacgtctttcggacggtgaacaatgtcttctatcttattactttccttgttcagttcctcccacagaatgtctttcaacactgagattcccaaaccggaaacagaagaaatgaatatatgcggaacaccctcgggcaatgtcggttcaatctcgtccatcagctcctgatcgagcatatcgctcttcgtgatagccagcacacgttgtttgtccagcatttcgggattgaacgtacgcaactcattcagcaatacttcatactccttgcggatatcatcgctatccgccggaaccatgaacaacagcaacgagttacgctcgatatgacgcagaaaccgcagtcccaatccttttccctgactggctccctcgatgatacccggtatgtccgccatcacgaatgactttccatcgcgataggaaacaattcccagattcggttcgagtgtcgtaaacgggtaatcggcaatcttcggtttcgcagccgaaatggcagaaagcaacgtagactttcccgcattcgggaaacctaccagtcctacatctgccaacagcttcagctccatgatcaccgtcatttcctgcatcggttcgcccggctgcgcaaagcgcggagcctgacgggtagccgtcttgaaatgactgttgccctgaccgccacgaccgcctttcaacaagatcacttcctgtccgtcgtccgtcacatcgcaaaggtattctccggtttcggcgttatacactaccgttccgcagggtacttcgatcactttatccgcaccgtctttcccgaaactacggttcttgctgcccgattcgccatgacctgccatcgcgtgacggtcatacttcaagtgaagcaatgtccagtaattacggttaccgcgcaagataatatggcctcctcttccaccatcgcccccatcgggacctccgttaggacaatatttctcgcgcctcatgtgcgtagagcctcttccgcccttgcctgagcgacagtatatctttacgtaatcaacaaaattcgattcagccatattttttatttattataatttgtctaccgcttcgcagatatcagcgaagataccatccatagtacccagaccgttgatgtgctggtatttcttttcgttcttgtaccagtcgatcagcggagatgtctgtgaatgatatacatgcagacgttttttgattgtttcttcgttgtcatcagcacgaccggagtctttgccacgtttgatcagacgcaccatcagttcatcttccggaacttcgagatccaacattacagaaacatcctgtcctctttccgccaacattttctttaatgcttccgcctgtgcaattgttcttgggaaaccgtcgaaaattacacctttgctgtctttgaagctatcgaatacgcttgccagaatatcaatcattaattcatccggaatcaactgaccctggtcgatgtaacctttagcagttttgcccagctccgtgccgttcttgatttctgcacgcaatacatctcctgtcgagatgtggttgattccatacttttctacaatacgttcgctctgcgttccttttcctgaacccggagcaccgaaaattacaatgttcaacatctttttaacctataaattaatttgtatttgaatttaatctactacagtataaatatcgggataattgcgtccgaaaccatcataatccaatccgtagccaacgataaaatcattcgggatttccatcgctacgtattctatgttcagattgaccttcagcttttccggtttcaccagcaaagaggcgatatgaatcgcttcgggattgcgtgtgcccagtgtatccagcagacgctgcatcgtcagtccggtatctacaatatcttctacgatcactaccgtacgtccggcaatgtcttcattcagcccgatcacttctttaattactccggtggaagtcaccccctgataagatgccaacttcacaaatgaaatttcgcacggaatcgtgatatgcttcagcaagtcggcggtaaacatgaacgagccgttcaacacactgaggaagagcggattcttacctgccaaatcacgattgatttcgttcgctacgcgaatcacttctttttgaatatcctgttccttaatggaaacagtaaattgcttgtcttttatctgtatggtatccataaccggtcattttaaaaaagttgtcgcaaaaatacaattttttattctaccccgtgcatcatcttctgtaatttcttcgagagaaggaacagaatcagtgaggcaacaccggacataatgacgaacagcatgaagaagtcatacatggtagcgatctgataaccaaggattgatttcacttttccgtcttcgggatagaggccactcagcatacctgcaaatttatttgcggtggcggtagaaagataccagatccccatcatcaaggaggcgaaacgtaacggactcaacttattaaccatagaaagcccgataggtgacagagcgatttctcccattgtatgaataaaataaagtcctgtcagccagatcatgctcacctttactcctggaatagcatctttcactccaaaacagatgaagagataaccaagagaaagcagcaacagaccgattgcctgtttggtaggggaagccggttccatgtttcgcttattcagaaagccccatataccgggcataatataggcaaggatcactacaaaaagcggattgaatgactggaaccacgaagccggcatctcccagccgaaaatgctgcggtcagtctgttcggaagcgaataatgtcagagaagctcctgcctgctcgtaagctgcccagaagaaaatgacgaagaaagctacgatatagattacgaaaatacggctacgttctactttggtcaatgaaccatccagcagaatgagtactggaaagacaatacaagccgtaaagatacccacactaatccagtcatcgctaaaggcatagctaaaaaaagctattaaggcaactgtaagggcagtaatgatgatgatattacgtactttggtacgtttgtccatcttcggatgtgaaatatgttcggctttatcctcctttttttcacgtctggcgtcggggacgataccaattggttcaccggaaggagagaaaaggtatttattcttctgagtttcaaagaggacaacagtgaacagcgtcatgattccggatgcgaggaatccccatttaaagtcctgcggattccctgtgtctcccaagaaaccgcaaatcaaaggagcagcgaaagaacctacattaacacccatatagaaaatggtgtatgcagcatccaaccgtttgtccccgggttcatataattgcccgacgagcgaagaaacggtaggcttaaagcaaccgttacctaaaatcatgaatccgagtccgccatacatcagccagtgggcaaggtctgtattgttcagtgaagaggcactcataaacatcaggaactgaccgactgccatcatcaccgctccccaaaacaccgaacgacggatgccccaatatttatcggcaatgtatccgccgatcaacggagtcagatagaccagtccggtatagctaccgtagatagaggctgccgcttctttatcaaaaagcaatgcctgcgtcagaaagaggataaagatggcacgcataccgtagtaactgaaacgttctgccgtgctcgttgcgaaaattaggtaaaggcctttcggatgccctttcaatgaactcatgaaattatgtgtttagtagtttatggggtgcaaaggtactaaaaagtagattaaatgcctcaaaaaagaagattcttatggaatagaaaaatacaggatggcatgcaagaagtctcagttacccaccttattaagttttcaacagtgtaaataatcaagtggatattctccttaaatgtgggtcagtcgccatttatccaaaagtaaattcaacattctcaatactggcatagagcattccttctttttttctaagcaggattttgttttcccttgccaaccagccgatagcaatcgctacatcctcgaacgtcaaacctaactcatggcacaaagtgaacatagactgttcgcccttttcatttaagatgcgccatactttcccggcatttgagccaattcttttcttttccatcatgcaaactttagaagattaaacaatttatatttataatctaaacattgtgagcacaggagaataacgtaaagcacattactgcactacaaagatatcatttttttcgaaaaaagcaaataatcaagacattagctgtttatattgtaccatatctactaacagctttattccaaacaccgaagacactcataaaggaagcagttctatagcaggccggagaaggcgtaactatctctcaaagtatcggaagattaagaagaaagcagaagaatagttacatcaaagcaccgatatcattaactgaccacggccgtgacaagcattgttcacgaccgtgattagcattgctcacggtcgtggcgaggtcttgtcacggccgtgagcaactaaagagaaaggcactttaagagaagaatacctgcatcttagccgaagagtctccgcatcttatctgaagaatgcccgtaccttagcagagaaatatccgccccccaactgaggaatcacagacagacaggacaaagccaccccaagataacttctgatttcccctgcatttttcaatttgccactttatctaaagccgaaaaccaaccggaataaaggattaattcagagtttttgtgtaagtttgtgcgtcgaaaactaaaagaatatcgcaatgaaaatatttccaagcagcagcattaagaagttagatgcttataccattgaacatgaaccgattgcatccatagatttaatggaacgtgccgcacaggcgctgactaaagccatcaccaacagatggaatccggaaacacctgttaccatctttgccggaccgggcaataacggtggagacgccctcgccgtcgcccgcatgatggcggaaaaaggatacaagatcgaagtatatctcttcaacacgaaaggcgaactttcgcccgactgtcagaccaacaaagaactggtagagatgatggaagaagtaactttccatgaaatcagcacccagttcgtacctcccacactgacaccggagcatctcgtgatcgacggattattcggttccggactcaacaaaccattgagcggaggattcgctgccgtcgtgaaatatatcaatgcctctcccgccatggtagtctccatcgacattccttccggactgatgggagaagaaaatacattcaatgtaaaaagcaatattatccgtgcggacgtcactttcagtctgcaacttcctaaactggcattcctcttcgccgaaaatacagaattcgttggcgaatgggagttattggacatccagctgagcgaagaaggaatcgaagagactgaaacaaactacgaaatgctggaaatcgaagaaatccgttcactgatcaaaccacgccaacaattcgcccataaaggaaacttcggacatgccctgctgatagccggctcaaaaggaatggcaggtgcatcggtactggccgcccgtgcctgtctgcgatcgggagtaggtctgctgacggtacacgcgccgttatgcaacaacgatattctgcaaacgtccgcccccgaagccatggtagaaacagatgtcagcgaaacatgctttgccgtacctaccgatacggacgattaccaagctgtcggcatcggtccgggactcggtcgcaacgaggaaacggaagccgccctgatagaacaactggaacattgtcagactccgacggtactggatgccgacgcactcaatattctggccaatcaccggcatacgctcacccatctgccgaaaggttccatcctcacccctcacccgaaagagctggaacgcctggtcggcaaatgtcaggactcatacgaacgactgatgaaagcctgcgaactggcgcacactgccaaagtacatatcattctgaagggagcttattccgccattatcacccccgaaggcaaatgttacttcaaccagaccggtaatcccggtatggcaacaggaggcagcggagatgtactgacaggagtaatccttgcactccttgcgcaaggctatcccgccgaagacgccgcaaagatcggtacttacattcacggattggccggagacatcgcccagaaaaaacagggcatgatcggattaatcgcaagtgatatcgtgacttgtctgccgacggcatggcgacttgtaagcgaataaaagttaagaacttacggtttattcaataacttcattaactttgtttttcaaaatcagctaaaaagaaccgaatatgaaaaagttaatcatagcaacaggactactaatggcaacttccgcctatgcgcagaccgaagtgctgacaggagtgacgcgaggaaaagactacggagtagtgtacgccctccccaaaacccagatagaaatagaaataaaagcaaacaaagtcaactataagccgggtgaattcagcaaatacgccgaccgctacctgagactgaccaacgtctctgccgaacccgaagaatactgggaactgaacagtgtcaaagtgaaacctgtaggtgtaccaaacagcgaagctacttatttcgtcaaactgaaagacaaaaccgtagctcctcttatggaactgactgaagagggtcttatcaaatcaatcaacgtcccctacagcagtaacaatgcaaagaatgcagcaaacaatgccgttgctccccaacgaaaagccaatccccgcgactttctcacagaagaaattctgatggcaagttcaaccgccaagatggccgaactggtagcaaaggaaatctataatatccgcgaaagtaaaaacgcattattgcgcggacaagcagataatatgccttcggacggcgcacagctcaaaatcatgctcgacaacctgaatcttcaggaagaagccatgaccgagatgttttcgggagtccgcaataaagaagaaaagacatttactgtccgcctcactccggataaggaattcgacaatgaggtagctttccgcttttcaaagaagctgggtatagttgccaacaacgatttggcaggcactccattctacatcagtctgaaagacctgaaaacggtgaagattccgcaagaggacggaaaaaagaagaaagagatggaaggcattgcttataacgtaccgggacaggcaatggtgacgctgacggacggcaaaaagaaattgtatgaaggagaaatacctgttactcagttcggtatcatagaataccttgctccggtattattcaacaagaactcgaccatcaaagtttactttgatccggtgaccggtggactactgaaagtagatagagaagaaagcaaataaaacctctaaaaaaacaaaacgatgggtggcgaaggacatatgctcgacatgatacgtcggctgaaagacggcaaagaagcctcccgcttacgccgtgaacggagaaatgacaagttagggcgacttagaagaaacaacgacccttatcttctgccggatacgactccggaagagatggaacgcatcatcaaggattcggaaaagaaaaaagaaaaagataacagctatttcgtatggggaacgcttatcattatgggcgtactgataggatgtgctgtcctcctgtgggcaatcttttttaatggataattatccatttaataaatccgtctttctgtaattgggaaagataggtagatacacgagactcgtagcctgcttcatattgaaagtggtctgcgagtttttctataatctcacgaaccgtccgctgcccgtctatcaggttccatacggccgtaccgtgttcttccagacgcacatgaatatctttggacattcctttcggcaataaataacgactcatccacgaacgtttaaaacgagggaaggagagcacaatagtctccccttcctgttcagctttaatatgttcgttacgacaaggtatcacctccaggaggtttattttctctttcgtagccatatcttttctcttttatatcttttcagatagaatatatactgtgattatttctgaatatttgcttcttccagtccgtagcctttcttcttgttttccactttcagcatcaaggcaacaatcagggcaagtacaccgaacatagcaaaaatagccatcggcaaggtataatcataagtctgtgcaccatctacaaccggacctttgcaataagagttcaacacccatccgatcagcaaaggcacgcccatcaatccccagttctgtacccaaaagatcaacgcataagccgttcccaactgtttctccggaataatcttcggaaccgaaggccacattgccgaaggaaccaatgagaaagcaaatcccagaataatcatgatcaccgttgcaaaccaccatatattcagaataggaagagcgaacatcgtgtgtacgaaaatcagcatcaccgacccgatcaccatcagcgtggctcccttaccgatacggtcatataatgaaccgaacaatggtgtcaggatgatcgcgccaatcggcagcaatccgggaatcgttcccgcaagtttcggatcaacattgtacttctgtaccatcaaatcggccgcatacttgatgaaggggaatacagccgaatagaacaatacgcacagtaatgcgatcagccagaatcctttgttggtaatgatatagacaatgtctttcatgcggaaaggttcttccggttccagcccttccgcatccagtgaagcatccagtttcttatcgtagaaagtatagatgaagaatgcgatggtacctacgcacaacatgacgagacagaacagaatcggagcgggaatattggtatggaatacgccgctctcatccgtagacccgaagaagtctgccaaaggaacggtaagcaccatggccaaagttgttccaatacgcgcggtcgccatttccagtcccatagcgagagccatctctttgcctttaaaccacttcacgataatcttcgaaacggtgatacccgcaatttcgactcctacaccgaaaatagcataacccaatgcagccaatgtgacttgcatcttgaatccgaaaagcatcgcaccttccgggaaagtagtagtaatagcataatatttcaatccacaaccgaacaccatcaataaacaggcacccattccggtgaagcgtactcccatcttatccagaatgataccaccaaagatgagcatcagcaggaatacattaaaccagccataagcactggtgaaaaaaccgtaatctaaactgtcccagagaagttctttttcaagcatgggtttcagaggagacataacgtctgtgaggaagtagccgcacaacatggtaaaagcgactaatgctagaacactccaacgcagcactgcggagtcattcagcttttgtttcaattgttctgtcattgtaatatttaaaaggagttaataatctcgtaacgggcaacaaagttaactaattatcatttgttttactaaaaaaggagaacattttataagaaaaaggacatctgaccggatattcctgtatgaagaagagcagaccgggcccaataataaagacagacgcgaactacacgtattacacgattctattagaatctcttgtaattcgcgtaattcgcgcctataatgaagagaacgggtcaaaaagcccgttcactcaataagtttaaaccgaatatcctgtcactgaattattctgctacaggagcaggagtttcagtagccggagcttccgttgctggtgcagactctgcaggagcagtagcatctgtctgaggagcagcagtaccggtaggcatattatacgggttggtttgttgttctttctgtgcttgttccaacaatacatctttagctgcagaagaagaaggaacaacgtaagcagtagcaacgctcatcacaaccatgaagatagccagaccccaagttgctttttccagaaaatctgtagtcttgcgcacgcccatgatagcgtttgatgaagaaaaaccagaagcaagtccgcctccttttgaattctgaatcagcacgatgaagcacatcagcaaggctgcaatcaccattaagataatgaataataagtacatttttagttattttgaattagcgttaataatcaatttctccaaaaatctgatttggtctgcaaagtaagcatttttttttggatatttcaagcttaattttttaattatttcaagagctttcgaatatcgttgctgttttacgtagattttggccaaagtttctgtgaaacagctgtcatcttcctcttctatggtgttggtttcagttgtttcgtctgttctgcccgtttcgtttgtttcagcggaagaagctgcctttgctttctcttcttccctcaaaggtttcaggtatacgactggatcagtctcgcttttttcgataaagttgtcaatcagctcgtgtcctttcagcttgggcattgcctctgccggctcgtcggcgacaggtgtctcttcgagaaggtatgccgtatagtccatggagtaatcaaagcttgtctgactggttacttcttcgggagccgtcgaaaggaaagcatcgatcagagccagtgtccggtcgacggtaggctcatctttcaatacttcagagagaggcaaccctttcttctgggattcgacagcgaagcgttcgccttcgatcagatgaaacagtttccgtcggtcggcaatatacagaacggctttccgcagttccgcaccgaaattaatgtcgtggagaatatacaggttcttgagatacaacaaccggagcgactgaaaatacggatacctcgcgagctggttgcgcagttcgtacaaagtatccctattcagcgtctcgggatgctgaatccattgttgcaagttaacagaagtcattaaattaccagtttgctacagttgcattaaatatttggtcggttatctctttactcatttccgctattaatccatcctgtacggccgtcagcagctggctggaatcataggtacggaaagctgagaattgttgttcgaagtcttcggcgtgatttgtgttgttgacaaagcgtacattgaccgtgatggtcagcttcgtttccgaagagtaaccatcggcagacactgcctggttatactggttgtagcccgtaatttcaccgtcaatctgcagatccgcattctggttcggtttcagcagttgcagacgggtctgtctgatgaagatatctttcaggtcttcattgaacttggtagccagcggagcatacacatactccgacttaatcgggaaatcagcaatcgaaatggtcttcaccttatcgtaattgatagaggagccattaaacttataggacacactacaggcgatgatgactgccggtaaaacaatcagtatcagcggtcgtgctattttcttaatccaattcatattcttttatttttctgtaaagggtacgctcggagatattcagatcctttgccgcacttttccgcttaccatgatgcctctcaagcgctttacgtatcatttctttttccacttcatcgagcgaaagggtttcttccacatattcttccgtgtcctgaatatcgtcatcgtcttctttgggacaaacagacggttgctgcacagcatggataatggccggcacagatggttggtgcgtcgtcgtcactaccggagtagccactacctgtcccatctgtccgacttgtcccgcacgttcggccatcatattgtgcaccatcttcttcagttccgccacttcctggcgcatatcgaacaagacagaatatagtatttcgcgttcgctctcaaagctcttgctctcgcgtgtgccgaacagtgccggaaggcgttgggtattctgtgccggaagataggtctgcagaatcgcagccgttatctcacggtttgtttctataatcgaaatctgctctgtgatattcttcaactgccggacgtttcccggccacggataagcaagcaatatcttcttggcatcttccgtcagctggatagccggcatccggtacttttcggcaaagtctgcggcaaacttacggaacaacaacagcacatcatctccgcgctcacgcaaaggtggtatctgaataggcaccgtgttcaaccgataatacaaatcttcccgaaaacgtccttcggcaatggcttgtgtcaggttcacgttggtagctgccacaatacgcacatccgtcttttgaactttggatgaacctaccttgataaattcaccgctttcaagtacacgaagcagacgcgcctgtgtaggcaacggcaactctcccacttcatcaaggaagatggttccaccgtcagcttctccaaaatatcctttccgctcaccaatagcaccggtaaatgctcctttctcgtgtccgaacagttcggaatcgatcgtaccttccggtatggcaccgcagttgacagcaatatactgtccgtgctttctccggctatattgatgaatgatctgtggaaaactttcttttccgacaccactttctccggtaatcagcacagacaaatcggtaggcgctacctgaatggcaacatctatggcacgtgataaagcctcggtattgccaataataccgaaacgctgtttcacttgttgtatctccgctttggtcatctatcttaatattaagtaataggtaataagtattaagtaataagtattaagtattaccatcattatcatctcgcttccatccgcatggctaatacttaatacttattacttaatacctattacttaatcttcgtctactgtatccagttttagtttatcactatcgtcccgtttctcgtaatactgcttccgcaacgggtttacccgtgccgctttctcgcgctggcggttgcggaatacatcaatcgctacataaatagcctggcggaaagagtcttcgctggccagtcctttaccggcgatgtcataggctgttccatgagccggagaggtacgtacaaccggcagtccggcggtatagttcacaccgtcttccatagccagggctttgaacggagccagtccctgatcatgatacatagcaaggattccgtcaaagtgagtataattgcccgaacccataaaaccgtccgcagcataaggaccgtaacagatgatccctttctcttccatttctttcatggcagggataatgatttcctgttcttccatacccagcagtccgccgtctcctgcatgaggattcagtgaaagcactgcaatacggggcgcaccgataccgaaatcctgtttcagacaacgatggaaaatcatcagcttttcctgaatcagttccttggtgattgttgtagcaatctcccttaccggaatatgcgtcgttactaaagccacacgaaaatcgtttttcatcaggatcatcagtgacttgtttccattgcccagacgttcttcaatatactccgtatgcccggggaaagagaactcttccgactgaatggtatgtttgttgatcggagctgtcacaatgacgtcgatcagcccctcacgatactcttctatggcacgctccaaagcacccaatgcagccttacctgcttcgggatcgggtttggagaattccactttcacttcgtcatctgtacagttcactacactcagacggttgtatccggcttcggaagctgtgttgacaatgctgaaattagcctgtacatccagtgctttacgatggtaagccgctactttaggtgaaccgtagataatcggagtacatagctcaagcatggtagggtctgagaatgtcttcaagatcacttcataacctaccccgttgatatctccttgggtaatgccgattcttattttgttttcttccatgtttttatttattagttggttccgcttctctggttacccccagtggaatctgactctgctgaccttcttgcggaagtttcagcgtataaagagatgcttccatctggcgaaccagattgcgtttcattttatcgggtgaatatacaaatatttctgctgtaataatacgttggttcttctgatccagacgagtatgggaaacgaacgggccacccatgaagtcacccttcatgcgccacaatccacgagcttccatcgtgtagtcattgtgcacgttgatcggacgaacatcggtcagtaacgagtctgtcgacatatatacgccttctttatatccggggatattggctttcatcacagaatcgcgcttatgaacaaagtattctttggtgaatgtatccttgtcagtataaggataagaatacatcacgaaattgcgatccgcgctgcctgtattggtagatgcccagaagaagtcctctcctgtcttggagttattcagttcggaaggtatccagatatcgcagccaaacagactatctaccttatttgagataaagttgttgtgcttttcctccagcaaagtaatctgacggttcatttcagcgcgagtgaagaagtcgataatcgtctgcttgttttcttcgacaaacttctcaaacacttcttcgttcggagcctgaatggtcagtatcatctgtggagaagcataaacgtctttcgcatacttgaaagtacctttggtataaatatcttttatatctactatcacaatattacggatcaacttcagcgtagaatcatagtccttcggtgaagtatacataatccggaaagaaggttccgactggggcagtcccggcatgtcagaatcaagcacatcatgcaaggcccttccggcggcacggtcccacactcccgcatctactacaaccaacagttcatacggacgaccgctagaggtatgattcccctttaatccacaagaagcaactacgaaggctaccagagccatgcttaaataaaaaaagtactttttcatgatgttcgatttttatattaacttttattattttcctcctgtttcgcagtcgacagcataccgcatgccgcaaaaatatcctctccccgcgaagcacgaatggtagtgaaaagcccgtgcgtggtcagatagtcacggaaacgggtcattgtatccatatcggctccttcaagggctactcccggaatagaatggaaacggatcaggttcatccggcaatccagtccgcgaagcagtttgagtaactccttggcataaacttgcgaatcattaagccccttaaaaacaatatactcaaacgaaagtcgacgctgtttgctaaaatcatagttttttaacagttccaccatttccgtgatagaaaaggctttctccgccggcatcagttccgcacgctgggcggtcaccggagaatgcaggctgatggcaaggtgacagtcgctttcttcgataaagcgccgcaatcctttccgcaatccgacagttgaaacggtaatccgcttcggactccatgcataaccataggacccagtcagtatgtccaatgccttcaacacctcttccagattatcgagcggttcgcccattcccatcatgacgacattcgtcagtttgtcccgttcgggcaaggagtgaatctgattgataatctgatgggcggtcaggttggcagagtagccttgtttcccggtcatacagaacttgcagttcattttgcagcctacctgcgaagaaatgcataaagtcgcccgttcatcatccggaatatacaccgactccacaaaatgattctcgcccacagggtacaggtatttcaccgtaccgtctacagagcgcatttcctccaccggagcttcagctcctacctcatagttctgcttcagtaactcccggtatttcaacgacaagttagtcatttcatcaatcgaagtcaccttcttatcataaagccaggatgcaatctgtttggctgcaaagcccggcattcccagacgtttcaccagtgactgcagctctataagcgtcattcctaagaggggatatttagacatcattctttctgttcatggtttatatttgcaaatgtaaggaaataaagtcgatttccgtatagcaaggatgtaaaagttagcaaaaaaggtcgttccaaagcatggaacgaccttttgcagttatcgtttttacgactaatcttagaagaacaggtaacgtgtatccttcacttttcctttcagatacaggtcgttcatcagacggcttgcgaagcgtgcgtgcatgttagccaatgtagcttcttcatctttagcgttgaaagtatcgctcagtttgtctttgccatacatctgaagcacaaatacaccggcattacctttgatcggagcgctcagtttattcatttcagccacagaagcataagcacctaccaacggttcgctgctgcgcaatgcagaaacataagcgggagcggcaaatgtaaccagcttcaaagaatcgctgactgcgccggacatagccttgtactggtcgagagaagttgcattggcagccttcatgtcagccatgatcttttcggctttcttatctttaacgatttcagctctcaactgatcctgtacagctttcagcggacgatatccttccggagtaacaccaaccagagctactgcaaccatatggtcgctttcgccacattcatacaaaccggaaacatcacccggtttagcggaaaatgcccatctcaatgcttctttagtacctcttacaccaccgatagtatgttctgagctatacaagtctcttctgtcaagcagtttgtatccggcttcttcagcgttagcgatcatcttttcagcagtaggattggcagcgatgaactggctgaaatcattgtaagcacggttataagtttctttgctgaattcaacttcacgtttcacaacagctactttatatttatccttcacagctttcttgttagtcacttgcaggattacattagcttgtcccaacggcaggtttactacttcgttcacgcctgtattattgatagcagagataaacttcaggttgtcaccatcgatctgtgcgccttcatactgtgcagagctcatccagttagtctcacccgtctgaccgtatttcttagccagatctgcgaagttagcaccgcctttgatagcagtatagatactgtccgccaaggcttttgtcttcaaagcgtcttctgcaaacacctgaatctgacggaactcgattgagtcggcagcagctgtttttgcaaccactttgaatgaattgatagtattgtcggcaccattatagtacggaccataaacagaaccaacggatgcagagtccagacgggcaactacatctgacgggaaagctgttttattatagaacaagtctacataaggagcttccgagcctacagaacggataaaagaagtatagtcatctgttgtagtagccagctgtgcagtagcttcgtctacttcctgctggatagcagctctgtcttccgcacttgcagtcacctgaacatcaatgtacttgatatcacggctttcctgatattgcttgaactgttcttttttcttgttataaaggtctttcagttccgattctttcacaacgattgtagaatctactatagaagaataaggaacggcagccatcaacaagtcatattgattcactcttgcgtcaaaagcgtcctgtgcttctaccgggttagagagaagcgcttttgctaccaatgcctgatatttctctgccaggcggctctgaaccaatgtcttctggatgaatgaccagtatttgtacatgttgttgtactgttctgcatactgagccggcatctgagattcgttcattttagcgtaatctaccaggaacttattgagcatatccttatcgaaagcaccggtctgcgggttgcggaaaggagtctgttgcaacaacggatgcacgcctgctttcaggatatcctgaatttcagcagcagaaactgtcagtcccaatgcttttgcttctttctcaaccagtttgttattaacgtaggaacgccatacttcgtcgcgcacctgattggtctgttcgtcgttcagtgcagtcactccacgggagagttttatcacttcggtatattcttctaccagattctgatactcttgagcggaaagagcatctccgttcacctcacctacgtcatgtgcctggtgcggttgcatcaccttccacgcgtcacccgcgatgaaagcaaacagcgccaaaccgataacaatcaccaatagaggtcctttcgacctaatgttttgtaatgttgccattttgattaatacgatttatgtttattattatttctttctattgtcattttagcgcacgaagatacaaaaaatgctaatatgcttctatttattagctaaaaatttcacggttatcgccattattccatgacttttaagcgtacaagttctatttttgtcgctgtcaccttgattattttaaactgataacggccgacacgtaccaattcgtgcagtttcgggaagctctgatattggttcagtatcaatccgcctaccgtcagatagtcgtccgattcgggcagatcaagtccgaacatttcattgactttttctatctccagacgggcggacaaaacatattcatcttcgtcaattttcttgcagatataggaagtattgtcatgttcatcttctatatcaccaaatatttcttctaccaaatcttccaacgacacaatgccggatgtacctccaaactcatctactaccacggcaatcgtcctcttttgcaacataaacagcttcatcagtttgtgggcagacatcgtttcgggtacgatcggcacgtctttcacgttatcacgccagtctttcggatcacgaaacatttccgacgaatgaataaaaccgaccacattatcgatatttccgtcatacacaatgatcttcgagatcccggattctataaaacgactcttgagttcatccagcgaagtagtaaggtcaaccgcaacgacttcggtacgcggaacgatacagtcacgtatttttatgtttgagaaatcaagtgcattttgaaagattttcacttccgtatccaattcttcttcattcgcagcattatcgatgctactctgcacgaagtagtccagatcgacttttccgaaagccttgtccgaagcatccttatttaccttcataccgaatatacgaagaaaaaggcaagacaaaccggaagataacttcgagacaggatataaaatgacataacaaataaaaagcggaatagcggcaacattcaagaccagattgggattgatcttaaacaatgttttaggaagaaactctccagtcaccaaaataatcagagtagagatgacggtctgcgccaacaccatcagaaagtggttatcaataaaaccagccaacagattatcaccgatgatctgtgccatcaatataccatagataaccaatgctatattgtttcctaccagcatggtagagataaattcgttcgagttcttgaaaaagatggaaagaatacgggatgtgattccccccttacgttccatttcaaagcgcaacttatctactgagacaaacgcgatctccattcctgagaagaaagcggagaaagccatagtgatgagtaaagagatataaatattcatagtttatttcacagaatcttttttcgtcgaatccggcggcaatgcttttacttccggttgagcagttcccccattttcgtcaacatagaaaatgccctcaatattctgaatgacataaacggtcatttgctgattggagtcaaaaccatgtccggtaattacacgatccggctgctggatacgtataaacttgtcggaatagactttttgagttgcctcgttccaataaagcaactcggtattgaaacgctcccctttccggttctgtatatctacattccctatcagtttccagagtttctgcttatcataataataagcggtatctgccttgatgctggcttcaatattaaagatagaatcaaattgttccagataaactcccttttcaaatgcccaataggaaggtttcttgcggtcgtacaccgtccattcttctgtattcacccgataacgtgtcactcccgagtcggatataagagtagttactcccagtgtattcatcaccggtaatgaatcacgttctgtgatggcgtcgcccagcgtattcttcttaccgccgcaggaagaaaatgaaagaagcataacaattgccccgaaggcaattgttatgcttatgcttttatgcaacaaacggttacttcgttttcgcaacataaattttatctaatcgttgtagtctctccgatccagccaccgatagtgatacggtcgccttgtttgtaacctaacataaataggtctttagcctgtggagtatgaccggaatatgtaccaatcaacttgtttgcttcttcagccacacttgggtcaactgcttttgcacgttgcagtttatcaattacagcgaagtaagtacacttattcaatgcagactcgtcactccagttaggactcattgcatacaagttagcaatcaggatataaggagcaccatagttctcgttgaagctaattgctttctgacagtatgatctggcttgagacaatttcttagcagaagccaatacagctgcagcagcatatgccttttctgctttcttcacgttatcagtttccagttggattgcttcgtcaaagaacttcacagcaccgtcaatatcacctttcttgaatgcctgataagcacatcctgtagcagcttcagctgttggctctatcttataagcgtagaaagatgcttgcagataagcttcgctttctgtacatctcatcattttcatgatatcgattacttttttcagataagccaagtctgtctggttagcttctacttttgggccatagatactttgcagagattcgcaatcagcagtaccactgtttacgaacaaagccacgaggttatctttgatacccataaagtttttcttttttgcttcattagtttctgcagcaatagcagcgtcagcatattctgaagcaagcagataatcctgaataaattgttctttatgattaggatcagctttcagtttatccaatgacatctgaaggaaataaaaaagcgtagcagctgccgattcgcctttcactgcatttacagactggctcaaccattgataggcttggttagcgtctactttcggagccaaagcaatatagtctacagccttgatacccagcgcttcgtcagcagaagacactttagttccttttgcaaggaattcttctgtgtatttcatacgcaaatcatgcgtattcatcaattcatcaaaatacttctgatattcaggattattcttatccttaatctgagccatcaagcctttaaggattttatatccgtcagtaaaagtgtaaaaacggagtgtgggacaattttccaacacagctttccagggagtatacgcatctttaaaatttcctgcacgcacagcctcatgcgaaatactactgtttgagttacagttagacgcatcctgtgccaccacagtggttgctccagccgaaaggaacaacatagccacaagcgttttaattttcattgtatctaaattttagttgtttatataatatcgtctattctctctctcacttttattactctaccctacgcttgaagaaccaacgttcgttgaacgtaagcccgatactcacgcggaagatattttcattcaccatgttcgtctccagtccttttacgcggacaaactgtccactgatactaagtatggaacgcgaacggggaacaggcagaccgaaaccggcagttacaccatattcacgtgaagcctttttcccatcaatcttataatacggtgtcgtataataagctcctaaacggtattttatgtgggcgaaataggaacgtcctatcaaattaggaatgtattccgcacctactgatatttttgtacgatcacaataagtgaaagtttcattaaagtcctgacgtacattctcgtcacttgttactacgccaaaattagtttttgaccattgctgtaagctataatctgcaccaactgtcaaacgcttgtcatagttatatgtaaatccgactccaaaggtattgggtaattcaaatgtagcatccaagacatccttatattcagttccataacttgaactagatgctcccatgattacaattgacgtataatcattattcaacttatgtttaggagaatatacagcaccaatcgtcaaagaactctttttattcaaagcctgtgtatattgtgcaccgaaatccaatttataatcagaaatcgaggttaccatttttcgctgataggaatcataagaagatgttcccggatagaacattcctcttgtacgggttatatctccccaaaaataagatgcattcacaccgacagagagattcttaagtacttttacaccagcaccaacgtacatttgatgcaaaccaccgtcgccggtaaaacttctgctatatgccaaaccattgtccgtagtctgactatcagacaccgtataccccacattagaatatggcaacaatccgacactcatcgccatccacggagccaaccggaactgcatagcgagataatcgaaactggcgtttttggcattcaacttcaggccaccaccactaatattcatattctgtaaactgacacccccttcgaacaggaacgtcaacgaatcaatggccgtataggaagcaggattcgttggattgatctgtgctccatccctgagtccgaaagcaattccacccatcgccttgctatttccgaaactttgatcggacaagtcgccatagccatatcgtgtgtaaggagagtttgtattattttgagcgattgccgttccggtaaccatcatgagcaaaagcgcccaaatcgtgtgtttaaatcctaccattattatagtttaaaattctatttaatcctttcaacactaaaaatctatctgcaaagatggcactttttacgctgctatcaaaagaaaagtcatctccgcccgttaaaaaaaccaaaagttcaggatatttatgcttcatagcctcaatataacctgaaatttcatattccattcctttcagcacccctgcacggatggcagtttccgtatcccttcccatcggcagtttgcgcccgttggagtctatcagcggcaagcgtccggtaaactggtgaagcgctttatagcgcatctgcatgccgggagaaatattaccgccatgatattgtcctttcgagtcaataaactcataagtgatgcaagtgcccgcatcaatgaccaagatgtcattatgaggaaactgctcgttggcccccactacggcagctatccggtcgtatcccaatgtctcgggagtttcgtacagattacctaccggcagcggagtctcatgattgagccataacagggggaacggcaaagcagccagttcggcaagtatccgttcgttcaaatcgacgacagtagctacaatcccccgctcaatccggtatttggagcaaagagcctccaagctatccaatgattgattggattcggtcaacacctccaccatctcacttctattgaagagggcaactttcgctgtcgtatttcctatgtcgataattaagttcaatacttttcgtctttagcggcgcaaaggtaaagtaaaaaaagaaaagttgaagcatacagaaggaattatcttcttttttcatttcaaatatcgcccccaaacgccaaaatcgaactatatatttttaaatatataatttattagttatcccttatta

SEQ ID NO: 108 - DNA, 26338 bp, Bacteroides thetaiotaomicron
catttttaatagaaccatgacacaagaaaaaaagaatggaaaaatcattgccattatcacgatgattttccttttcggtatgatttcattcgttactaacctcgcagctcctatgggtattgtgctgaagaaccaattcgacgtatccaatgctttgggtatgctgggaaacttcggtaactttatagcttatgcagtaatgggtatccccagcggtatcttgttgcaacgtgtgggatataagaaaacagcacttatcgcagtagctatcggttttatcggcgtaggtatccagttcctgtccggtcattcaagccctgagatggcttttgccgtttatttgattggtgcattcgtagcaggtttctctatgtgtttgcttaacactgtagtaaacccgatgttgaacaaactgggtggtgaaggtaacaaaggtaaccagcttatccaagtgggcggctctttcaactctgtaatggctaccatcactccgatgttcgttggtatcctgatcgccggatctatcgaaaaagctactatctctcagattttccctgtaatgtacaccgcaatggctgtattcgctttcgcattcttcgtactcctgtttgtacgcattccggaaccgaacgctgctgctacaactgaaccaatcagcacactgatgaaaggtgctttgaagttccgtcactttgtattgggcgctatcgctatctttgtatatgtaggtattgaagtaggtgtaccaggtactctgaacctgttccttactgaccctgtagaaaaaggcggtgccggtatcgcttctacaatctccggtttcgtagtaggaacttactggttcctgatgttgatcggtcgtctggccggtgcttcactcggtgcaaaagtttccagtaaagcgatgcttacatttacatccgctctgggattgattttagtattccttgctatcttctcttctacaggaacattggtgaatctgcctgtactacaacaaagcgcaactggcggtttgtcattcggttttgcagaagtgcccattaacgctatgtatttggtattagttggtctctgtacttctatcatgtggggtggtatcttcaaccttgctgtagaaggactgggtaaatatctggctgctgcttccggtctgtttatggtactggtatgcggtggaggtatcctgcctgtaattcaaggatgggtagctgacgtagccggtttcatggctagctattgggtaattatcgctgctctggcttacttgctgtactacggtctggtaggttgcaagaacgtaaataaagacattccagtagaataaaaaatctgaatttaatttattcaccttataaaattgatttatcatggatatagaacacgtaagaagtcgcttcattaagcattttgatggaactacaggatttatatatgcctctccgggtcgtatcaacctgattggcgaacatactgactacaacggtggattcgtattccccggagctgtagacaaaggtatgcttgctgaaatcaaaccgaacggcactgacaaagtaagagcttattctatcgacctgaaagattatgtagaatttggtctgaacgaagaggatgctccccgcgcaagctgggcaagatacattttcggtgtatgccgtgaaatgatcaaacgtggcgtagacgtgaaaggattcaataccgctttctccggcgatgtgcctctgggtgcaggtatgtcttcttctgctgctctggaaagtacatatgctttcgcattgaatgaactgttcggtgaaggtaaaatcgacaaatttgaattggctaaagtaggtcaggctactgaacacaactactgcggtgtaaactgcggtatcatggaccagttcgcttctgtattcggtaaagctggcagcttgatccgtctggactgccgttcactggaatatcaatatttcccattccatccggaaggttatcgtctggtattgatggattcagtagtgaaacacgaactggcttcttctgcttacaacaagcgtcgtcagagctgtgaggctgctgttgctgctatccagaaaaaacatccgcatgtagaattcctgcgtgactgtacaatggacatgctggaagaagcgaaagctgatatcagcgctgaagattatatgcgtgccgaatatgtaatcgaagaaatccaacgcgtacttgatgtttgcgatgcgctggaaaaagacgattacgaaacagtaggtcagaagatgtacgaaactcaccacggtatgagcaaattgtacgaagtgagctgcgaagaacttgacttcctgaacgattgcgctaaagaatatggtgtaaccggttcacgcgtaatgggtggcggcttcggtggttgtactatcaaccttgtcaagaacgaactgtatgacaacttcgttgaaaagacaaaagaagctttcaaagctaaattcggcagaagcccgaaagtatatgatgtagtaatcggtgacggttcacgcagagtagaataagttattattcatcagaattaaataagcagggcgtctttctggaatggaaggacgcccttacttttcaattaacaaaaatctaaaaacctattatctaacctaaccctataattatctgtttattgtacgccttccgttgtcatctgaatgcgtttcatggtaccgtcttcgttataatacaaacggtcgatgcagacggaacggcgaaaactgcctccggctgtattgatgcttccattatgataaatgaaataccagtcgcccttgaactcgataatagcctgatgattggtattggaattgccggctatctcattaaggatgcctttgtattcccaaggtccggtaatgctacgactcatggcgtagcatatcttttccggaaattcagaagcatatgaaaggtaataccagtctccacgcttatgtatccacggagcttccgtatatcggggcagatgaaccggtacgataggaccatccagctcgatcatattctttttcagtttgacatagtagcattgggtattcccccaataaagatatgcctgtccgtcgtcgtcaataaaaacagtcggatcgatatcttcccaagagatcttggtaaattcggtcgtcatatcattggtgatcagtgcggaaccacgggcatccacaaaaggaccgacaggcgaatcagatacggctacgccgatggattttccgtgaatagtgccgtgttctactgtcacataccaatagaactttccgtcacgttctatcacctgactagcccatgcttccccttttgcccaactaaaatctttggctttcaaaggtacaggatgctccgtccatgtcttcatatcgggagacgagaatacacaccattcattcaactggtaatgttcactgggaggaggacattcatcatgtccggcataaatgtacaccttaccgtcatgcaccatagcacccggatcggctgtatatttatattttatgatgggattgccattggctacaaaagtagtgtcattctgcgcagacagcccggaaaaggctgccaatgcgcatgaaatcataactagtttaacgctattcattttatttcttcgtgaatttataaactgcaaacgtgttcggtccgagttcggtggttaacgcatgaccattgatcgttaccggtgtctcctgcggagtgatggcaaacggttgttcaagcgtattatctttgtcctgatcgagtgagctaagagtgatgcaacgtccttcggacaatacatcctgctttttcagaccttcgaaagtcaaggatacaggctgtgtcttatcggaagtattagctactttgacaatcagttcgttcttatccttatcatagactgcactggcaaaaagtccattttgtccttccgcccctgttaccggtttcttgttcatagtgagaggaagtacattcgttcctttgttctgtgcgtacagctgctgcacataataacttacggtacgcaccgagttaagattatcaaaccaaatcatgtccggacgccattgccatccctccacatgagcgaaaagcggcgcataagtagccatatgtacgatatcggcattgcgttccaatccggtcatgaaggctgcttcgagcaaggcagcatggaagtggttccatttctttccttttccgtgacaagcatattcgccggcaaatactttcggtcctttgcggtcatagttatcatagcgtgctccctgactaaggaaccagctttcgggacggtagaagtgttcgtctaccagatcagctttcagacgtttcatctcaggccacaggtaatcgaattcttttccttcggagttcgggccggaactgcctacaatcatgatttccggatgcgccttgcgaagagccttgataaacggttcgagacgttcgggatactcttttccccactgttcattaccgatgcccagatatttcaaattaaaaggtgccggatgtcccatatcggcacgtactttcccccaagtcgtgttcacgtctccattggcaaattcgatcagatcgagtgcatcctgaatatagctgtccaggtcgcaaactgctacgtgagctttttcttcattgttctgatactgacaggcaagtccgcagttcaggatcggaagcggtgccgctcccatttcttcagaaagaagaaaatattcatagaatcccagtccgtagctttgataataatccggatagaaacgatgggtaaaggtatattgccagcgattttcgttcaatggacggttttctaccggccccacggatttcttccagtcataacgggtttcgagatccgtaccttcaacgatgcaaccaccggggaaacggaagactcccggatgaatatccgccaaagcctgcgcaaggtctttgcgaagaccgttctcatgtcccttccaagtatcgacagggaaaagggaaatatgctccaagtctaccgtaccctgggaagcaaggaaaatacgaagcgttgctttgggattggtaacacccgcttttaagattacctgatacttcttccagtctttggaatcaatggtcagtgtctgagaggcaaaagcctgatgttcgcccatagatttggtatctacaagttccacacgtatcttttcacctgtacctccgtgcggcagacgtgcccacacagagaagcggtattcttcaccttgcttaaccccgatgccgaagaaaccttcattatccagtccggtatgcttgtgggcatgtcccggattatcaagacgcacataatgcggattgcgttcaaaaggaccgtcatcctgcaaagtcacctttccataagtcttccatcccatcagacgctgagggaattcgaatgaacggttctttaccagttcggcataaagtccgccatcggcagcataattgatgtcttcaaaaaagagtccgtacattgtcggctggatttcagcacccaacttcttagtctggatcaccatttcattggtttgcgcatgaagcgccatgccggtagataaggctaatgcagccagtaattctgtgtatcttctcatggttttcaataaaaattatatatagttatttgattctttttccccagacagaacgtccccggctatcgagtccggtaaagagaattgtttcggtttcgttctcccaatcgtgtcctgcaaagataaccagattctcaatcttctccgagttcaaatctaccattaatagatgtttttcggtcaaaaaggaccattttccattcatttgaactatattccattcgttatcggtcatctgccctttgcacgtgccgtcttttaccaaagtcactcgggtggacaagttccattccttctctttcagttctccctctccccataagatctgtccggcttccagctgacgttcgtatgccggttcctgcactcgtatgatttcccattcaccgaccagatcttctttgctgaattgacgcgaagcagtccctgcatatctctcgggagaagcgaccggccagccttcgggagtgaagaacaactgccgtatatgtaacaccattaactgattttgcggtgacagacgtccctgatgtgccataaaatagtttccttcaccgtcagaaaagacggcacaatgcgctgtacccgcccatccggtatggttctcaaaacgatatggtgcagtcagtatcgggaagttgttggtcgtatctttcacagccttgccaaagtagtccgtaaacggaccttcggcagtatccgaacggctgacacgtacattataagtcgtcatcagcggatcataggaagtgaaaagataatattgtttcagctccggatgatagattatttccggtgcttcgagattgtccttccgatagttggcacgccgtgctacaaggtgccccaaatcgccttcgtttaaggctaatccggtttcaggattcagttcgacgcaatacagaccaccgaagaaggagccgtaatgcatccaccatttaccggtattttcatctgctatgacgctcggatcgatagcattcatggcagtagaatcatctgttttaacgatacagcctttctgtgtccatggcccttcgggagaagttgattcggcaagtcctatataggatgttttacgtccgaatgcggatacgcaatagtagaggcggtatttatctttataagggatgatatacggtgcccagatattggtcgccccctgccctcctgcatgagactgtacccattgaaccgcttcttccggtatttcaggaaatgcccatcccagaaattcccaatgtaccaaatccttagaacggcgcatctggataaatcccaacggcacgcctttctctctcgcttctttccggttctcaccgaaaatcgcatctgtagaatacatataataatagtcgcccagcttccggcaggacggatcgtgtacattgtatgttccccattgacggtaatcttccattttggctactgataaataattatcatcccaagaattagcagaaggagtcggagtaaacacggaagaagtgcaacttacaaagaagctgcctgctactaaaagaactggcaaaaacaagtttttcataatatctgtgtattcgttcatcaattatgctacaaaaatacgccccgtttcccctatgaaaggtggacatacgaacacgattggtggacaatccgataatctgctgaaaagaagctcttcccatttttgtgattgaagagattcttctaactttgcccttattaatacgtacatatatgaaaaaacacctacttatataccttataatatatagtatctgttcactggccggacaggttcgggcacaggaacggtttgccgaccgctataatattacgtatgtgaccatgaacgaggggcttccacataattttatcgacgatttgtacaaagacagccgggggtttatgtggatttcgactgccggaggcgggctttcccgttatgatggctatgagtttgtaaactacactcccaataatcaccaatgcaaactaaaaagcaactttatacgcaatgtctgtgaagacgccttccaacgcctttggatcgtctccgaagggggaacggatattattgacttatctactttaaaaccgattatcccccatgacccgaaagggatacttccaaagatactggaactaccggctacccgtatcatgaaagatacgcaaggctgtatctggcttcattgcgacaacgcccttcaccgtatcgaattcaatgacaaaggggaagtgcaaatcctgtctacactcagccctgtctatctgaatggtccggacattgctctgaaagacattgacgaggatgggaaaatatggatgggaaacaatggagaaatacgaaaagtggcattaagtccgcaaaagagactggtaaccactcccatagccgactgcctgaagttcgaagcgggaacttatatttcggatttcctcagcaaagagaatgaagtctggatctccagtgaccgcggactattccgctataataaaactggaaatgtgataaaacgatatgagcatgattccggcaatccctattccctgtcgcaaaattatctgacaaatttagctatcaccgatgacaaacaattaatcgtcgcgacactacgtggtattaatatctataacccgatgacggataattttgaacgtatagcctgtgaccttccaaatggcggcaccaatctgctgaacagtaactttattaattgcatattgactgatggagaacatatctggttcggtacggaaaccggaggtatcaatctgttgaatccacggcaactatcgatacggagctaccggcatgacaaggaaaatccgtcaagtttatcctataatcctgtcaatgcaatttatgaagatgtatacggaaccttatgggtagggacagtagaaggcggactgaacagaaaagaacggaacagcgaagatttcacccattatacacgtgaacacggagggctgagtcacaactccgtcagtgccctgactgccgataccgacaatcacttatggataggtacatggggaggaggtctcaatctgcttgatctgaaagctccccgacagatactggaggtaatttcctcacagaccggcggaggctttccgattaactttatcggagtattgaattatgaccctattaatgaaggtatatggataggcgccaatcaaggactctatttttatgatccggtaaaaaaggaaataactgctccgttaccggataaggctgctgaaaatattcatggctgtatcggttccattattgataaggagggtaaactttgggtcggttgtctggaaggggtttatatcatcgatctgcattcccgttcctctaaaggagaattccagtacaggcacctgaactacaaactggacgatccgtcctcccgcctgattgagaaaataacctgcttttatcaaggtaaggacggtactttatggctgggcagtaacggatatggcatttatcaacgaaaaatcgatgctcaaggaaaagaacagtttatctcttatagcacagcgcaaggactaccgaacaatagtgttcggggaatactggaagataacaacggtaacttatggatcagtaccaataatggactctcctgttatcatcaggcagagaatcgtttcattaactataccatacaggatggtctgattgacacacagttttattggaacgcctcatgcggttcttctcatgacttactctatttcggcagtgtaggcggattggttgcaatcgaaagtaatcgtccggcgatgtctcttccagctgccaaagtacgtttcacccgcctgcggataggtaatgaagaaatattgccgggcagcgaatacttgtcggaagatattgccataacgacggaactgaaactgcatgaaaaagagaaatctttctcactcgaatttgcagcgctcaactttgaatcaaacaatacagccatatacagttatcgtctggtcggttttgacgataaatgggtacaggttccgggcaaccgtcgtttcgccagttatacgaatttacctcccggttcatatactctacaggtcagatacactcctgatggtgagaacgagggagaaaacataacggaactgaagattacgattgtaccttatttctataagactgtatggtttattctattcatcatcgtattgttatctgtcagtgtatggcaattctatcaatggcgcatccgtaatctgaaacggcagaaagaatatctgcaccgcacggtagaagaacgtactcatgaactggaacagcaaaagcatctgttagaaaatcaaacggatgagctgtcacgccaaaaccagatgctgattcagcagaatgagaaaatcacgaggcagaaggcacaactgattcgtatgtcccgtaaagtgcaggaattgacgcttgacaagatttcattctttacgaatattacccatgaattccgcactccgattactctcattatcggtcctatcgaacgtgcgttgaaattaagctacaatccgcaagtcattgagcaattgaacttcgtggaacgcaattccaaatatctattgtctctcgtcaatcagttgatggatttccggaaggtagagtccggcaaactggagattgtgaagactcggggaaattttctgaaatttatcgattcactgatcactccgtttgaagtattcgcccaagagcggaacattgtgctcaaacgctattaccggatggaaatgccggagatcttgtacgatgaggaagcaatgcgtaaggtggtcaccaatctgttgagtaacgctatcaagtttactcctaacgggggaactgtgtctctctacctatctgctcttttcgccaaagacagtgaaaaagagactctgtatatttgcgtcaaggacagtggttcgggcatccctgaggaagacctcaatcggattttcaaccgcttctaccagtcgcagaatcaagtgaaatatccggtatacggacaagcaggaacaggcatcggtttatacctctgcaaacggattgttcaaatgcacggcggagagatcaaagcattcaataaccgtcatgcgggatgctctttccgcatcctcctccccttgcaacgaaatgaaaggaaagacgaaaagacaatcattattgatcacaacgattcgtccgcaactcctgttcaggattccggctctccaaaagagaaagaggctttaagtatactggttgtggaggataatgctgatatgcggggatatatccggtctattcttcgtgaacagtatcatgtactggaagctgccaatggcgaagaagcattacatatacttaatagtaatccaatagactttattatcagtgatttgatgatgcccgtcatggacggaatcgagctgtcccgaagggtaaaggagacatttgccatttcgcatattcctttcctgatgctgaccgccaaaacctcacaagaagcccgactggaaagctatcgtatgggagtggacgaatatctgctgaaaccttttgatgaaacattattattggcccgtattcagaatattctggagaaccggaaacgatatcaacgtaaatttacgcttgatatggacgtggacgtacttaatatggaagaagaatccggtgataagaagttcctcaatcaagtaatggaagttatcaaagagaactacaagaactcctattttgaagtcagcgatttttgtgaagccgtcggagtaagcaaaagcctgctgaacaaaaaactgcaaaacttaatcggtcagtccgccggacagttcatccggaattacagactgaacatcgcacgggaattgattctgaagaatcgggaaacgaagaatatgaatatagcggaagttgcctacgaagtaggattcaatgatcccaaatattttacaagatgcttcacgaaacatttcaatgtgacaccaagcgcactgctgaataacgaagaataactgatataagggttgctattatgaaacaatgatagcagcccttcgtcttaaaatgagctcattttaagagacatccgtccaagattatactcaaagtgtaaaaaagacacttatataaccgtttatccacctcgaaaattcatttgtccacctttaatatactcatcggttgtatttttgcgacactacaacgagtagaattattgttgaaccattaatatcaatatctatgaagacaaggaaatggccgttactacttatggcaattcttaccgttctcagcatgagttcttgtcaggattggggagaagccgatccaccggcaggaaatcaaaaacttccagcaaagccggatacctccgctaaattaatagctgaatttacatttgacgaagatttcaactctactgccaccgaaggcaaaacacctatatcgggggaaggttttgcatacagtgcagatcaagagattccggaaatcgtacaagatgatgaaagagaaagtggagttatgcacgccaacggcggatacctccgcattcccaaccctcttatcggtgcagatatccagacaggagtctcatttagtttcttcgtaaaatctactaaaacagaccatacaggcgcactgatctcattcagtgacggaacaaacaaactgtatttcactgcaaatgcttttttgagctataccggcacaggaggctatctggacgtaaatgatccggaagtcagtgtaacgaacgcaatgccttacgggacatggcattatgttgccttgactttcacagagaaaggatacgccatttatatcgatggcaccaagaaatacgataccaacaaccatgccagcatcagttccggaaagacaagggctgtgagcgtaggtgacttcgattattccaatatgatcgatttattgtcatctgcgacctatatatatttaggctatggttcggatacggaaacagccgaagcctattatgatgatctgaagatctggacaaatactttctcggacagcgatgctcagggaccgaatatcggtagcggaatacatgtgcccgatcctgtttataaagctactttcgaaacgactaccggactacagatcattggcggtggcagctttgttacagatgataatagcgccttcggaaccgtattcaagaatatccccggaggaatgcgtcagaattacttgttgcttccggaagatgtaatgtcacattctgccgaaacgaaggaaatgtctatcggtatgtgggtgaatgcgaaggatgccggaatctcatccacttatatgtggtcaccattattcagtgctcacgggcaggcaccgggcatagcaggtactgccaatacagacaactggcctatgtttgcattgtatgtaagaggaacattacaactgaataatgccggatggtgcaactttgatgatgcacagaatgtaaatggtaccaatgctctatatcatgacgccactgactggttagccgatcacgggtggcattactatacagtaactctcaccgctacttccgccaaagtatatatggatggcgaactgaagaacgaatggcaggtggcaggtaccggagataataatacaattgaaggtgcattcatttatggtgccaactacaaatacatcactttaggcggaaatcaggcgttcgactggggcgatcccgatccgggattcatgtttgacgacttcgcagtctataacaaagaattgtctccggaacagatcaaacagattatggaagacaagactttggctctgcctactcctgtctacatcaatacctttgaagaaggaaccggagatgcaaaaatcgtaggttcgggcaaaatagtttcagtggaagacaaagggttcggacaaatattccagaatgtagccggttctaaaggcactaattatctgatgttgcctcaggatgctctttcccactccgtagaatctcaggaagtgagtattagtgtatgggtgaatgccaagaatgcaggagcatcggacgattatcgctattctcccctattcacggcatacggaaacgagccgtcggcaggatcagagaatatatggccattgtttgtcctgcaatcccgcggacttgcccaaataaactgtaacggatggacagacttcaccgccgcacaaaatgagaaaggtgtcaacaccgtttattgctcggaatatgcagcagatggaatcgtttgtgaggaagactggctgaaggatcatgaatggcatctttacacagccgttctcacgtctaccacctgtaaaatctacattgacggagaagtcgccaactcatggacagtatcgggcagcggtgacggcaataccatctccggaatattcaccaacggtgcagacttgaaatacatctcattgggcggaaaccaggcatggacatgggctgaccctgatcccggatttatgttcgacgacatcgctatctacaacaaagcactgacaatcgatgagatacaggctattatgaaaaagaaaaagaattaaaccttaaagtttagtatacatgaaaaattttatactgatactctgcctcgccacattcagccaatgggtgtatgcgcagaacaagcagatcaccggacgggtagttgataccaaaggcgaagccgccattggtgcaagcatacttgaaaaaggaactacaaacggaaccattaccgactttgacggtaatttcaaactgacggtcggaccgaaagccgtgttacaaatcagttatatcggttataagacacaggaaataccagtagccaacaagacgaaactgaatatcactatggaggaagacacggaagtgctggatgaagtcgtagtggtcggatacggtgcgcagaagaaagaaagtgtggtaggtgccatctcgcaggtttcttccaaagaactgttgaaatctccggcagccaatatttcacaagcgattgccggtaagatttcgggtgtaatcacttctcagacttccggtgcgccgggggctgacgatatgaagatttatatccgtggccgtgcttctttcgcaggagacaaccagccgttgattttagtagacggtgtagaacgcgagttctcacagattgctccggatgatatcgaatcgatctctacgttgaaagatgcttccgctactgccgtatatggtgtgcgtggtgcaaacggtgtgatgctgattacaacaaaacgcggtaaggaacagaaaccgactgtcagcctgaccgccaactggcaaatacagtcccctacccgccaggatacttatctggattcttacaattcggttgtattgctggaagaagcgctggctaacgacggactgccttctcaatattcggcatccgacatcgaaatgtataaaagagcctcagcaggacaactcagcggaatcgatgccctcctctacccgaatgtagactggtatgacaccgttttgcgaaacagtgcaccggcacaacgctacaatgtcaatatacagggcggtaccaaacgtatgcgttactttacttctgccgaatattataaccaacagggattgttcaaggaattcagtcaggacgaatacggaaacaagtcaaactccagcttcaagcgtttcgctttccgtgccaatctcgacttcctgatgaccaaagacctgactctttccgtcaacttcgggacacgtttcgaagaacgcagaggaccgaactcgaatgaatcgagagacggaacttacagtcaggcattttatgaaatgaatcatacaccgggatggttgtttccggtatcctataccgtaggtgaaggtgaagaccagaagacattgtacagtggcagttcacaataccagaataatatcgtggcacgttttgccaaagccggtttctaccgctccaccaatacgatcaatgaaacaaatttcattgtggattataagatgaactggctcaccaaagggctggcagcaaaaggaatgttatctttcgactacgacgcttactataggcgtgctttcaatgccgactttgccacttatgagctgaatgaccgtactaattacaattcaatagacgcctatacccagttcaatacggacacggaacttgcttatctgggcaatgaccagactaccacttataaactttacatggaattccagctgaactgggcacgaaaattcggcaaacatgacattaccgctatggcactgtacaaccaaaatgactaccgttatcaggcagaccttgccgaacgttaccaaggactggtagggcgtgccacatacggctacgacgaccgttacctggcagaagtcaacttcggctataacggttcggaaaacttcatgcgaggcagacgcttcggtttcttcccttctttctccgtaggatggagaatcagcaacgaagctttcatgaaaggaacggaggagtggctgaacaatctgaagatccgtgcatcctatggtgaagtaggtaacgatgtatacaaagtgaatggcgtaaaacaacgtttcctgtatcaggcagtgtggacacagatagccaacgactatcacttcggaacaaccggatataccggtatctatgaaagccagtaccctaactatgcagtgacttgggaacgtgctcacaaatacaacctgggactggaatttggtttatggaacggactgctgaacggtaatatcgacgtattctacgaaaagagaaacgatatcctgactccttatctcacccgtccgcaatgggttggcgtcaatatggctgccggcaatctaggagaaaccaacaacaagggtttcgaaatcgaactgaaacatgcgaaccatatcggaaaggactttacctataatgcaagtctgactttctcacacgcccgcaatgaaatccggaacatggacgaacccgccacaaagacagcttatcgcaaacaggaaggtcatccgatcaaccaatacttcggtctggtgtgcgatggttttgtgacccaagccgacttgaacaatcccgattttccggtttctactttcggcaatgtacaggtaggtgacctgaaataccgtgatatgaacggagacggatttatcgatagccgtgatgaaacatttatcggctatagcgatgttcccgaaaacacttacgccttgtctctgggatgcgaatacaaaggcatcggattcagcatcatgtttcagggagtagatcatgtttccagatattatgatgcggaagcaatgtacgctttcgtgaatggcggtaaggtaaaagaacatcatctgaaccgctggaatcccaaccagtcggaagcatacaaccttacccatgccagttatccgctgctccattatgacagctacggcgaccataaccagcgtaaaaactcgttcttcctgaaaaacggtaacttccttcgtctgaagaatatcgaactaagctactcgcttccggcccgatggatcagaaaagtagccatgaacgaatgccgcgtctatgtaaatgcaaacaatctcatcacgtgggataaactggatggtctttgcgatccggaaagtgaaggttccaaccgttacccaattatgaagactgtgaactttggtgtaaacattaaattctaacagatataagacatgaaaaagacaatcatatataccgccttttggttggcaaccgccggaatcgccctgacttcctgtgaagatatattcggtggttttctggacaaacagcccagcaacgaactgacagaagaagaggtattcagccaatggactactacccgtgagttccatttcgatacttacaacttcctgcgccacggtgcctgccgcatcaacaactcatggatggatgcagctaccgacttagccgaaaccagctacgccagcggcggcacgcgtacaagtttcaacatcggtaactattatgccagcggtgccgccactgaactcaccggcacatgggaacactattaccggggtatccgcaaatgcaatatgctgttaaagaacatcgacgacgtgcccaaagctacggatgactcggaagaagcacacgctacctatgtgaaacaatacaaggcggaagctcatttcctccgtgcttatttctactgggaaatgtttctccgctacggtcccgtccccctggttacagatgtactcgatccggacggagacttgctcagcaactataccacccgcccttccttgaaagaatatgtagttgacttcattctgaaagaactgaaagattgcgaagaaggattgatggataaagctacttctgccgaatcgggcaaccccggacgtatcagccagccaatggcacgtgcactgtattcacgtgtcatgctctacatggcaagcgaccgtttcagaagtgaatcgggtatcagctggcagcaagccgccgatgcagcgcaaagcttcatgacggattacggaacactctacggactctacacgactgataccgatccgaagacatgctataccaacgccatcctgaagaacgcacatgacgagaaaaataatgaaacgatcttctggcgtaatgatgtagctgtaggatggggagcgatctataacgatacgccggtaggcgaaggcggcaacggaggtttgtgcccgtcacagaatttagtggatatgtacgatatggcgaacggacagtctcctttcagcagttatgatgaaaccggcgcccctgtttataatggaacagccactccggccatcaacaatgccagcggatacaagagcaatgatccttacagcaatcgtgatccgcgtctggcggcaaccgtgctctacaacggtgtgaattgggggaatggtataattaatgtactcaaaggacaacgggataacccgcaaggaaatgcaaatgcaacgccgaccggatactatacccgcaagtatattccggaagtgatcctgaacaataaccataccggcagcaactaccgtaactggattatcatccgctatgcggaaatcttattgaactacgcagaagccttgaatgaagctggcgggtcacgtgcggacgtactgaatgccatccagcctctccgcgaccgtgtagggatgactgccaaactcacagaccgcagcgatcttcagaccattgccgaccgccgtaacttcatccgcaaggaacgtaccgtcgaactcgcttttgaagatcatcgcgcatgggacgtacgtcgctggaatgtagcggaaaaagcattggcacgtcctatctacggaatggaggttaccaaggaaaacggaaagtttgtctatacacgtaaagttgcccagaaccgggtatttacggagaaaatgtatctctacccgataccggaaggagaagtatggaaaacgaatatcgaaaacaacccgggttggaacaattaactgaatgaatatgcaaccgatgaaattaaataacatacagacaggattcaaaagaatcctgctcaccgtagccacagttttcatgctgggcaacggatgggcgcaagatgctaaagtcctgaaaggacgaatcgtaaatgcagagggtgaacctatcgcaggtgcggtggtcaacgtagcggaagcaagccgcatcgcactctcggacaaggacggtttcttcactttgaagaatgtaaaacctgccgacgagctttatgtaagcagcgtaggttatctgccggcaacagccattgccgactttgatgagaacttcaagattgtcatggatgccgacctggatgaatatgctcatacgactccgcttcctttcaaccgcaaacccaagaagtttgtgacagagtccacctccatcgtcaccggagaagaactggaaaaacatccggtaaccgttttgcagaatgcgtttacctccactgtcaccggtgtagagacgtatgaggcgcaatccgaaccgggatggagtgaaacagctatgtatatccgtggcatccgtaccatgaatgccagtgcacgcagtccgttgatcatcgtcgacaatgtggaacgtgacctctcattcctcgatgcctaccctattgaatcgattacgatattgaaggatgccgccgccaccgctatctatggaatgcgtggagccaacggcgcagtactcgtaacgaccaaacgcggagaaaccggtaagactaaaatcaacttcacacaagaagtcggcttccagactattgccggaattcccgaaagccagaattcttataactatgcgctgagccgtaatcaggcacgatacctggacggattaagtcccgaatattccgatgaagacctggaatactaccgtcgtgtctgcaacggtgagcagttggaaggaatggccaaatacaaatacttcaatacgaactggcacgacaccatgctgcgggatgcagctccgcaataccgtaccaacctgtctgtcagcggtggtaatgcacgtgcacgctactatgtctccttctcttatctccgccaggaaggtttgttcgacaccaaatggacggaatggaacgaaggatacagcacacaggaagtattgaaccgttacaacctgcgttcgaacatcgacatcgatgtaaacaagtttctgaatgtatcgatggacttgggcggacgtatcgacaatatctcccaaccgggcattgacgtatggaacctctttacctggggagccggcgaaaatcttccggtgtatcccgtattctgcccgaacggtgaattctttatgccaaccagcagcgacagtaaaaacggtgccgcacaaatcgccggacgtggtgtggagcagaaccgccgccgtaacctctatacaaccgtaacggctaccggaaacctggatgccctcgttcccggactgaaagccaagatgacgttcagtttcgactcttacgaaacattccagaaggtgcagcaagccgatgtcaatgtctactactataactatatggctgatgtcaacgacccgtcggaatatacataccaacgcatgagaacgtacaaagcattgcccaatgccaccacttctccacgtgactattactataatctcaatatgaacggcggactggcatacgaacatacattcggcaaacatgccgtcaatgcccaggcttttatccgtacttatcagaatgtagtacgcggacaggaatcatccaaccgctacctctcttacaatgcacaggctacctatgtatataacaaccggtatatcctttccggtaatatctcccgcatgggcagtgataattatgccgacggcgaacgcttcggaacattccccggcggttccgtgggatgggtactttccgaagaatcatggctgaagaactcgttcgtgaatctcctgaaactccgcgcatcctatggacgggcaggacaagccgtaacaggcgtcagccgctacccgtaccaaggtacattcaccgaaggaggcggatataatttcggtacttcccaatcttacacggaaggtgtatatgaatcgacagccggcaacaagaatatcaaatgggaaatctcagatatggcaaacttcggcgttgacttcgacttgtggaacaagaaaatctacggttctgtggacttcttcaaggaatggcgttccaatattctggtatcccgttccaccgtgcccggcttattcggtgtaaacgctccgcaagactcttacggcaaggccgaaacgaaaggttttgagatcactttaggacatagcaaccggatcggtgattttgaatactatatcgacggtatgctgaccttcaacaccaacaagatcaccgaaatggatgaactgactcccgattacgcttatcaggcaagaaccggcaaccggatcgaccaaagccagctcctgatctggaaacaatgggccagtaatcccgacctgattccggagtcgtatgaagatgccgttgccaatcctcagaaatatccgtggaacgctgccggtaaatacaagctcggcaatgccgtattccaggatacgaacggcgaccgtaaaatagacagctacgacaaagtaccgaccggatacacaaatattccggaattaatcccgaccatccgtttaggtttcagttggaaaggtttcgacgcacgtgccgtgctgacggcttatctgaaccgcaccgttccctgtcgcgagaatatggactatggtttcggctggggaggtacttccactcatgaaatcaccaacacatggggatattataccgatgatccgacagacccgcgcaatatcaacgccaaatatccgcgtttgtctacttccttcagtgacctcgaccggaactatccttacaatgagtctaccatctgggtagtcaatggagatttcctttcattgcgcaatgtggaagtcggctactcacttcctgcacgattgatttctaaagtcaatatgacgaaatgccgtctttacttcagcggctacaacctgtgcaactggagccatctgcctaaaggctttgatccggaaaacccgaccaactatatctgggcatatcccaagacacgttcatttacgttcggtgtgaatatcggattctaatcattcaataaaacagcaaagaattatgaaaagaatatcaacttatatagttactctggtcctcgcactcgcaggcagttcgtgcagcgactacctcgacaaagagtacgatgcctccttatctgaaaagaaagtgttcaataaccagaacctgacacgcgagttcctcgccaacatctacacgaatctgccggacggactggcgccactgtcggacgaccagttcacaggtgcttcacgtgactgtatgacggataatgcagtgacctgctggggacttcattattatacaaagatcggcagcgacggatacaccgccggcgaccatcccctgctgggcttctggaacaccgacttatacgggattcggaaatgtaatatgtttctgaagaacgccaaggcatccgtagtaggaaatacggagaaagacggcgatgacaaccgcctttacgaccgttactgtgcagaagccagactgcttcgcgctatcttccatttcgacttaatctgctggttcggcgctgcccctgtcattgcggaagatgaatccggcgaaccgatcatcttcgacttgtccgatccttcggcaatgaacatgttccgtactcccgctgccgaagcacttgaatgggtagccgaccaatgcgaccagatcaaaaaccagctccctttccgctacagcgatgaagcatccaactggggacgtgtcaacggagccgccgcttatgctttaaaggcaagagccctgctctaccgtgcttccaaactgaacaatccggacggcaacaccgcatactgggcgaatgcggcgcaggcagcagccgacttcatcactcagaataacaagcaaagttacccttaccgactgtacaatacgggaaatccggagaatgactattacgaatgtttcacgaccaatccggtatacaacaatgaaattatccttgcacgctctgtatggaataccaatcaggtagaaaaagtattcctgccggtaggctttaccggttctttctccggaaacggacgtaccaacccgacacagaatctggtggacgcttacgaaatgagcaacggcaaacggatcgatgagaacggcagtacctacgatgccgccaatccgtataaagaccgtgacccgcgtctggcacaaaccatcttctatcaaggcatgatgtggggacgtgccgacaaagaagaaagacgtgccatcgacgtacgctacaactcggatgcggacaaaggagtggattacacctcagccatgggaggcacctacaccggatactatctgaaaaagttcgtgaataacatttcctgcaaagaaccggccacctatcctcacgcatggatgattttccgttatggcgaaattctgctgaatgccgccgaagcctataatgaagcggaaggtcctgccaaggcatacagttacatcaatgaggtacgcgcccgtgccggtatgccggcctacgcagatatgtcgcaaagtgaactccgcgaacgtatccgcaacgagagacgcatcgaactggctttcgaagatcatcgtttcttcgatgtacgccgctggaaactatatgacaatgtaacctctacgggagaaaccggaaagccccgttacaaccagttgctgaatctttatggagtgaaggtcaccggcaacgcagatactccctcctataccttcggactggcagaaacggtcaattcacgcacgtttgtcaatcccaagagttactatttcccgatacctgccaacgaagtgaaacgggcacccaatctgggacagaatccgggatgggacaccggaagcgcttctaacgaataaacatcaaaacaatctaaaaaagaaagactgagatatgaaatacttaaagaccatctatcttctactctgttgcacgctcgctctggcagcgtgcagcgacgacgatgaaaactccgcatcaggagctttaagcatcacaacgccggcatatacgaatgtggggtataacaaagcaaccttatccgccaatatcagcggaacggaaggagtgaatatcgtcaaacggggattctgctacgccacggcatcccatccggacatttatgacacgacctccgaagtcagaggatcggaaatcagtacgaccctgaccggcctgactccacagacgacgtattacgtaagagcctttgtcaccctttacaacgaagagcccagatactcggaggaaacttctttcacgactcccgccgagacactgagcgatgaactggcagcgtacgaagcacccacgtatgtagacgactacacaagtttctcagcctggagcaaccgttatgactggaaccttgccaacgtacacgaccctacggtaatgaaaaccgatgacggatattactatatgtatcagacagacgcttcttacggcaacgcgcacagcggaaacggacacttccacgcacggcgttccaaagacctcgtaaactgggagtacctgggagcaactatgagtgaaacgcccccgacatggatcaaagaaaagctgaatgcctaccgtcaggagatgggactggaaccgattgacaatccgtcttacggatactgggcacctgttgcacgaaaagtatcgaacggaaaataccgtatgtattattccatcgtaatcacgaactacatccaaaccggaaaaccggaaattgagaacaacggcaactttgacggttcatggaccgaacgcgcgtttatcggactgatggaaacttccgatccggcaagtaatatatgggaagacaaaggattcgttgtctgctctgccagcgataagggaaagacggattatgggcgcagcagcatcaatgactgggaagggtattttaaaatcaatgcgatcgaccctacttatataataacggaaaatggcgaacactggctgatctatggttcatggcacagcggtatcgctgccctacaggtaaatccggaagacggcaaaccgctgaatgctttgggaaatccctgggacatcacaggggaagacaattcgggttatggaaagataatcgccacacgtggcaccagccgctggcaggcatccgaaggtcccgaagtgatctatcgtgacggttattactatctgttcctggcttacggttcactgtcggtagaatataatacacgtgtctgccgttctaaaaacatcgacggcccttatgtagacatacacggaaattccgctatgggaagcgcgcaactatatccgatactgactgctccttaccggttcgacaacagctacggctgggtaggaatttcccattgcggcatcttcgatgacggagccggcaactggttctatacttcacaaggacgtttccctgtgaacgtaggcggcaatgaatactccaacgccatcatgatgggacatgtacgcagcatccgctgggatgccaacggctggcctctcgttatgcccgaacgttacggagccgttccgcaagcgcctatcacggaaaatgaaatagccggagactgggaacatctggcattgaccaccagtacgggcacccaacgaacgtccgaaacgatgacttatgatctcggtacgcataagataacttccggcagctggaaaaatgctacatggacatttgatgcagcgactcaaaccatcacgacaagcgccggagtagtactctatctgcaacgtgaagtcgactgggaagccagtccgcggacacatacgattgtgtatgcggcccagggtaatcaaaagacatattgggggaagaaactccaataaccctctatagaaaaataaatatgtgttttgctgtcaccgtcacaaagcagagcataactcgcttataatgaagaagtaaagcagtgacagcaactagtgacagcactgtgatggcaatttttgctgtcacagtgctctatatctaccggactttgccgacaggtcatgcgtagtgtcttaccctggatttggttgactactataagtatcaactaaaatgaataaaagatgaaaaagagtgacatgacctttagtccttatcagcttgaacttcttggcgatttctatcgttcgaatttctcagtttctcgttttgcccaagaaaaagggattgcccgcattacattttggcgttgggttcgtatctttgaggattctaatcct

SEQ ID NO: 109 - DNA, 26322 bp, Bacteroides thetaiotaomicron
ctacataagaattatctatttttgtcggtaaacaaaataataagccttctatatgttaaaatgtcattcagagttgtttaaatcgtcggtgaagttggcggatggtttaagattgagtacaaaagaagaattgaaagatatagcacagttgcttcttctttccgttccttcaaaattgcgaaaagaagagtatgtatcctgtcttgcagaagctgttcttacttgtccggatatatggatttcgcagttgacacattatgaatggttgctccttcaaaaattggtaaaagcaggagccaatacctatgtggaagaacctaatatgataatgacgagtacattagaattgctttcttttgttgcggtcgagtgtagtttgaacggagacaagattcgttatatgatttgtgatgagttgcgtgaagcggttgctccccatattgataagtttttgacatcgacggaagagaacagccgttttgtgctggagcagtatgctttaggaattttaaatctttatggtctcttaccttatacggaattcttgaagcaactgaccggatacttgaagggctcaatgacaaaggacgaaattgctaaaggtttatcaaactcaatgttgatgagacaactgacgtttgatatggaagatatatataattctgttatgtatgttcgatctcccttattattggacgttgaggacttggaggaaagattatatgcacatcgtgctataaaaagtttgaagaagtttaccgtcgaagaggttttgtcggctggaacgatgcctgtgttctatatttccaatccgcattcggatgaactgaaagggtttatgatgaggaaattaggttataatgaagaactggctgaggctaagatacagtggctgtggtatgcaatacagatgaacgaaaatccgatgtctgctattgtttcggcaatagacacgaaggtgctttctatgcaagaacttcaggaagtggttggaatagctgtaaactattgtaatgattgtccccgttggttcttgaaaggtcactcgtccaccgaagcatctgctttacttggtaggggtgaatcggtgaaaactcctcctcgtatcgttgccggaccaacgatgaaagcagcaggcatggatatcactcctgaaatgcaaaaaatggttgatggtatgttttatgatacattctccggaacgaaaatcggacggaatgatccttgcccttgtgggagcggaaagaaatataagaaatgttgcggtagggataactgaaaagggactgttcgtagagatgctatgtcggtataggcggactgttctttgatactttccgtcatcgaataaatgaacagtctgaaatggatcattcatataagatttttggtatccttgttggcttgatatggtaaagttcttacctttgtaaggtcatcaaaataagtgttcatgaagaagtctataaaacatttgcccaagcgaacgcaggaagaactgacagttctgctggacttagtctgcaaaagcgtcgataactgtcagatgattatcctgttcgggagttatgccaggggtaattatgttttatgggatactaaaatagagttcggtgttcgtacctcgtatcagagtgattatgatattcttgtcatcaccaacggagcagtcaagcgggcagaaagaaaactggagcgtatcactaacaaatatcatgatttgtttgaataccgtcgtcacgcttttccgcaattcattgtcgaacatataaatacggttaacaataatctagaggttagccagtatttctttacagatattataaaggaaggaattttgctttacgatagtggcaaatgtcaattggctaaaccacggaagttgagctttagggagattcgggatattgcacaaaatgaatttgataaacttttcccttatgcttgtgacttcctaactggtgtaaaggattattttatacttaaagaaaaatacaacctttctgcctttatgcttcatcaatcttgtgagaaactttataatactatattgatggtttttacgaattaccgtccgaaaagtcacagacttcaagaccttggtgggagggtaaagagcttttcgatggaactggtaacggtttttcctcaaaatacggatgatgaaaaagagtgtttcgatctgttatgccgagcctatatcgaggcccgctataacaaagattacaaaattacacgcgaacagctggaatacttaatttcacgtttagagattctaaaggaaatgactgaacgtctttgcaaagagaaaattgcagaatataatgcgatggcggaaaatggttgaacacacgaaatattttaaagtcttataactttgcatccgtctggctgtcactccctataaattaaaaagaagaatatatctgtcatctgtcaccgatttcattctaactatcagattataaatagttaatgatgtgacagcagtgggtgacagcactgtgatggcaattatgctgtcacccttgtatttgtgattcgggatatgttttgaagtcgttgatttcatcacggtatgtaactatcttttctaaaccttgaaacagtttgttttgcagtttgaaactaaagttccaaatgcttgaaaccatagttccaaacgcttgaaactaatgattccaagctgttggaactaaagtttcaagcctttgaaactatggtttctcttcgctgaaactatggtttcaaggcgacgaaactaattcagtgctataaccttatcatgacccagcttagattgcttctttagggtcagccttttctatattaaactttcgttttttcttgtcggtcccggatataatgagtaatttagcagtctcaacgacacgaagacgctgacacaaacaacctattattatataaatgaaaattacccaattccgtaaaaatggagatacaacagcgctcagcgtactggatcttgaaaaactggtaaacaaagtaaaaacagagataaaatcccgtccggtttccactttcagagaagaattaagatatatgcttccagatgatcggtgtatgtttgccgacaagcttcccgagataattcctgccgcagaatttagaaaagtaaacgggcagaagcagatgaaagcgtataatggtattgttgaactgactgtcggtcccctgtccaataaatcggagatagctctggtgaaacaaaaagcgagtgaacaaccgcagacccgttgcgcttttatgggttcgagtggaaaaacggtgaagatatggaccacttttactcgtccggataactcactgcccaaaacacgggaagaggcggaactgtttcacgctcacgcctatcggctggctgtgaaatgttatcagccccaaatcccgttcgatatacttcccaaagagccgactttggagcaatattcgcgattgtcttatgatccggatattatgtatcgtccgaattccgtgcaattttatctctcgcagcccacagcgatgcccgaagagaagactttccgggaggcagtgcaggcagagaagtctccgttgactcgtgccgtgccgggatatgatgcagaaaatgcttttttgatgctttttgaagcagcttttcggaaagcttatacagatcttagcgaagcaggcctccaattacgggaagataaatggcaaccattggtcgtacaattggccaaaaattgttttgcttcgggattgcctcaggaagaagtcgtgaaacgtaccgtttttcatttctatatgtataaacaagaagtgctgatccgggagatgattggcaacgtatatctcgaatgtaaaggtttcggcaaaaatatcagtctgagcaaagagcaacagctagccttacagaccgaagaattcatgaaacgccgttatgaatttcgctataacacacaaatcgctgaggtggaatatcgggaaaggctgtctttccgttttcgtttcaatcctctcgacaaacgggcgctgaatagcattgccctggatgcacaaatggagggtattccactgtgggacagggatatcagccgttatatctattcaaatcgcgtgcctgtattcaatccgttggaggattttctctatcgacttcccggatgggacggtaaagaccgtatccgtgaattggcagctaccgttccttgccggaatccgtattggacagacttgtttcaccgctggtttctcaatatggtttctcattggagagggtatgataaaaaatacgcgaacagtgtttcgccattgctggtcggggcgcaagggacgcgaaaatctaccttttgccggagtataatgccaccttcggaacgttcctattatactgacagcattgatttctcgcgaaagaaagatgcggaactttatctcaatcgttttgcgctcatcaatattgatgaatttgatcaggtcagttcgacacaacagggcttcttgaaacatattctgcaaaagcctgtggtaaatatgcggaaacctcatgccagtgccgtgctcgaaatgcgccggtatgcttcatttatcgctacgagtaatcaaaaagacctgttgaccgatccttccggtagccgtcgtttcatctgtatcgaagtgacgggagtgattgacacgaatcgtccgatagattatgagcagctttacgcgcaagccatgtatgaattggaacatggcgaacgctattggttcgaccaggaggatgaaaagattatgatggaaaacaatcgtgaatttgagcaagttcctccggaagaacagttgttttttcgttattttcgtgccgcacagcctgaagaaggggagtggttgtctccggcggagattatggaagatattcagagaaatagttcgataccgatgtccgtgaaaagggtcaattcatttggaagaatactgaaaaagcaggaaatcccctccaaacatgtacgtagcggtacgctttaccatgtcgtaaagttagtgaccgggtagcgggaacaaataataaatgtgtgattgcattgtgacagcaaaaatgccgtcacaatgcaatcacctcctgctgtcacgggctgattcgttgataattaatctgttatctcctgtttggtgacagatgacagcaacttaccatatatattcttctgtgtagcgttggtaagcaggctcttcttttattcctttgttacgaaacaattgttttatataagcttgatctttgggcataaggcctcgttctccacgatagaggcggtaatatcctgttttcccatagtgtcccaccaactgtgatcggatactgactgcgtcttcataaggaatcctgtcaagcaaccgtttaagtccccatgttacatgaacttttacagccgttttaaaacattcgcattgattcccgtccgcaggatagcgtgccggattaacgctggtgatataaagatagtcggctccgttatattgtgcagctatgtggcgtaagcatttggaggcttgtgggcattggtcgttgaagcaacgggcaaaattgtaagggacagacaggctgtcgggttcttctttcatttgttgactttgttttatttatgatagcaagggatacaagttttgtattctctacaaatgtaaggctttctttcaagaatgagaaatgattgataagctaataccattgttctatgcgatttctttttgaaatcactatctttgcaatggatctattcattaaataaagaagagattatgcttgcatacacatatattgaacacggaaaatttgaattgcgagaaaaaccggaaccgaaaattacggatgcacgggatgcaatcgtgcgtgtgactcttggcagtatctgtaccagtgacctgcatatcaaacacggtagtgtgccgcgtgcagtacccggaataacggttggacacgagatggtaggtgtcgtggaagaggtgggagctgaagttacatcagtcagacccggcgacagagtaaccgtgaatgtcgagactttctgtggagagtgtttcttttgtcatcacggatatgtcaacaactgtaccgaccccaacggtggctgggctttaggctgccgtatcgacggcgggcaggcggaatatgtcagagtaccttatgccgatcaaggactgaaccgtattcccgatacagtcagtgatgaacaggctctttttgtcggtgatgtccttgccacaggcttctgggcaactcgtatctcggagattacggagaaagatactatcctcctcattggtgccggacctaccggaatttgtactttgctctgctcgatgctgaagaatccgaagcgtatcattgtctgtgaaaagtcccctgaaaggattcagtttgtccgtgaacattatcccgatgtactgataacgacacctgagaactgcaaggagtttgtactccaaaacagtgatcacagtggagctgatgttgttctggaagtggcggggaccgaagatagtttccggatggcgtgggactgtgcccgtcccaatgcgatagtcacgattgtggctctttatgacaaacctctgctttttcctttgcctgagatgtatggcaagaatttgactttcaaaacaggaggtgtagacggctgtgactgtgctgagatcctcagtctgattgaagagggaaagattgataccactcctcttattacccatcgctgttcgctgaacgagattgaggaggcatatcgtatctttgaaaacaagctggacggcgtcatcaaggtagcgattgtatgtcaaactgaaagtaataaataagaatatgcctgttgtcgaaatatcctctttgtctcatcccggagttgagatattctgtactcttaccgaggctcagttacgcaatcgtatcgagcctgacaagggtatttttatcgtagaaagtccaaaggtcatagagagagctctggacgccggttatgaacctttagccattttgtgtgagcataaacatatcactggcgatgcctccaacatcattgaacgttgtggcaatgtgcctgtctatacgggtagcagggaactgcttgctacattgaccggttatgtcctgacacgtggtgttctttgtgccatgcgtcgtcctgcggtgcgcagtatggcagaagtctgtcgggaagcccggcgcatcgtcgtgatcgatggtgttgttgatacaaccaacatcggtgctattttccgttcggcagccgccctgggaattgatgccgtactactgacgcgtaactcttgtgacccgttgaaccgtcgtgcagtcagagtatcgatgggaacggtcttccttgtaccatggacttggatggacggttctctcagcgacttgggcaagttgggcttccgtacagctgccatggcactcacggacaactctgtttccattgatgatcctgtcctggcaaccgaacccagattggctatcgtgatgggtaccgaaggggacggactttcgccggaaacgattgcagaagctgactacgtagtccgtattcctatgtcgcacggcgtcgattcactcaatgtagccgctgcggctgccgtagctttctggcagcttcgtgctcgatagttctcataaggatcctttttattgtcgggacataagttccgcaaattgatcgagtgactggacattatatttctcaatgagatcaatgcattgttgaagataatcttcatccacttttactccattccattggtaccatcgttttaccatctcaatacctgcattatgcttcttggcaacattccaaatcgtgacgagatcatccttttgttttcttgattttaaccgtttcagctcaagtgcccctttgtagattttgatttcctcatcatagatgagctgtttctttagcgtcagttcatcatctcccagaaaagtgacatgggtcatgaattttagtccttcgctgaaatcggctacagcgataccatggtcggaaacgatgaaatagccgccattatttttgcgagtatacaagacttgcggattgttatacacaaagtattcgaatatgttttcccctttgcggtctatttgataatgatcgatgtagcgctctttatatcgttgcatgaaatgtgctgtgtaatgcatcaccctatcgcgggacttgaaccccgtcatttggatatagccattgcttgaagtgccgataatgggggcataagcctgaaatcctacgccttgcatatatgaattatgttttcccactactgtccacacatttcttcgggtggtggtgagggttatacgctgggtcgccaaaggatatggcagcatgttctttgttttcttacgaaccttatccatgaacatatttgctttggtcgatatttcgatgaggtccttatgcacttcggcatacagttcctcgtgagtcatacttgtcagatacatatttgtgtttttgaattgagacaaaggtagtggttatcttcagaattgacatcattgtcggatggctttttgcggatgatgccgaaaataaatactttattctttttagaacctgtacgctctcatatccattattttgtgctccaccattaatgctatggatacattaggtctttcaaaagtaacatcattgttcatcctgactttaatagaaagagacgagagtagtttaatgagactgaagctatgtgttaattgcataggttcagtcctaaattttatatgagtaggattctttttattcaacaaaatagagaactaagattctttaggcttcttataatgttcatttatcattctactaacttcgtccattgatatttctccctctatatgtttacgagctgtgtctatgagaaaatttgatacacgcagattatcgacagtttgtaagcctatggaagctctccataatttggctcgttcacgtttctcctaatctgtatcatttaaatattcatcaaatatgtgcatgttcttatcatctttttgattttcacgttataagttggggttcatgtagctacaaaagtacaaaaacaatcctgatattgaatataattcactacatttgcattataaaatcgtatcaaacaatgaagctaaatagactaaaggcagttcttttggaaaaaggtatctctcagacgtggttggcgaaacagcttgatatgagttttagtatggtcaatgcctatgcttgcaatcggattcaacctaatttgcagacacttcaacagtttgcatcgatattgcaggtagatttgaaggacttaataaccgataaaaaagataggtaataatatacaagcctttctgatgttattattgagtttaattgattagaatataaaaataagcaataagatggcaaacttaaatattgaacagaaaaaggtgaaaagcctttttcaagaatcgaaatacaacttccttatacctgattaccaacgcccatatgcgtggggtgagatggagtgtaaaactttatgggatgatttgttttcgttctctttcccaaatgatgactgtgaccaatttattgacgatgaagagtatttccttggtcctatagtaacatttaagaatagaaaccaaatggaggtaattgatgggcagcaacgtttaacgacacttatgcttttgttaagggctttttataataaactaggtagtatgaaagaccctcgctcaaaacggatgaaggaggatattgaaaaatgtatttggagagctaatgaatttggagagtttgaaacatctgctctgaaaatcaattcacaggttgctacggatgaagataaagaagagtttattgcaatattgaaagatggacaaggaattggcaaaaaaagtcgttacgcaaagaatttcaatttcttcgttgaaaagatagatgtttttttaagtaattatccatcgtattttgcatatttcccggcacgagtgttaaataactgtgtgcttttaccaatagaggcggaatcacaaaatacggcattaagaattttctcaaccttgaatgatagagggaaacctctctctgatgcagatatttttaaggcgcaactttataaatattattcatcgtttggtaaaaaagatgaatttatagaaacgtggaaaaatctagataagattactagcgaagtgtttcatccaatttatggtacaccattagatgaattgtttacaagatatatgtattatgagcgagcacttgcagagataaaatcatcaacaacagaagctttgcgcaagttttatgaaggagatggcagttatcctcttttgcatcagccaaagacattgagtaatcttgtaagccttgccaaattttggcaagatgttagcaatcaggagacagaacgtttctcagataaagtcctaaagcgtttgttcgtacttagttatgctcctaatggaatgtggacgtatatcacttctgtgtattttatgtaccatcgtaatgaaaatgatgaaatagaagaaaatgctttttgtcgtttcttggattgtataacagctttcatatgggcttatgctataactaatccaggtgttaactctttgcgtactcctgtatatgcagaaatggttaagataatcagaggagaagatgtaacattctcagatttcaaattttcagaagaacgttatcgtgcgcaaataacaaattatgcattcaataatagtcgtgcgattacaaaatcaatgattacttggtgggcttttcaatatgataatcaatcattattgtcattggaaaccaaattcgatatagaacatatatatgcacgaaacagactggataaagaaaaaggtttatcaaatcctcagaatgtagaaatacttggaaataaggttcttcttgaaaaaagattgaatatcagagcttccgactatcgctttgtagataaagtaaaatattataaaggttttaccactgctaatggtcaggaaaagaatggctctcaaattgtagaattggcggagataagtaattcatatagtgattttactgaaactgatattattaatcgtaattctaaaataattgattcgtttgtgaatttccttagagcgaatcaattattgaaagagtaaagttatagctttgaatatcaatttgttttttagcataaacttctgataatatatattattaagaatatgactcctgaagaaaaagcaagaataaagatagaccagtggtttgccgatgctggttggaaagtagttaatagggaggattatgaacctactggtacggctgtagccataagagaaggtttattgaaaggaaatcttgaagccgattatttccttttcattaatggaaaagcagtaggagtacttgaagctaagcgtgaagaaacagacgtttttgcttcaaaagtatgcgagcaagcagctctatatgcacgaagtgtcccaaatatctatcaggcatatcaaaagccattgccttttatctttacctcaaatggaaaagaactatacttctgtgatttccgtgaacaagattcttgtttcaaacagataataactattcctacgccacatgaattggtcaagaaactggggattgaggatacatttgccggacttcccacattgaaaaggaaggggcttcgtgattgccagtatgaagcggtgacagaacttgaaaagagttttcgtgctgggcaaaatcgggcattgatggttcttgctaccggagcaggcaaaacatatactgcttgtcttgctgcctaccgaatgctttcttatacaccaatgcgtagggtgttgtttcttgtcgaccgaaataatcttggaaaacaggcagagggagaatttggaactttccgactgacagagaatggagacgctttcaatactatctttacggtcaatcgccttcgctcaccttctatcccttctgatagtaacgtcgttatttctacaatacaacgtttgttttcattcttgaaaggagaagctattgaggataatgatgacgatgatgagaacgaacctgcagaggaagtaaccttgcctcccaatcccaatttaccgcacgattactttgatatgattattatagatgagtgccatcgctccatttatggaaactggcgcatggtattggagtattttgatacggcaagattggtaggtttgactgcgacacctattcccgaaacaatggcttttttcaataacaatcgcattgtcaactatacattagaaaagagtatcgttgatggtgtgaatgtggattgtcgggtatatagaataaaaacccaagtcacggaaacgggtggggctatattagagggtgagaaatttaaagaagaaacaagatatacaggtgaggtcaagactgtaagtagtaaggaaaccaaaaactacacaaataaagaacttaatcggagtgttattaatccggcacagataaagttaatcctttcgacctatcgggatgtggtttatacagaattgtttaatgacccgcaacgtaagccgaatatggactatttgcccaaaaccttgatatttgctctcaatgaagctcacgctacaaatatcgtacagatagctaaagaggtgttcggacggaatgacgaccgctttgttcagaaaattacttattcggcaggcgacagtaacgaactgatacgccaattccgtaacgacaaggatttccgtattgctgtgacctgtacgttggttgccactggaacagatgtaaagccactggaagtggtgatgttcatgcgtgatgtggagtcattgcctttgtatattcagatgaaagggcgtggagtgcgtactattggtgatgaccaacttcgcaatgttaccccgaacgcattcagcaaggattgtttttatttggttgatgcggtaggcgtgacggagcatgcgcaaacagtggcacctatagatgatggtcctacaacaaaaacgattactctaaaggagttgttagaacgtattagtcatggctatattcctgacgagtatctcaaacggcttgcggcaacgcttgcccgaatatacaacaaggcggatgattcgcaacggaaagagtttgtccgtttgtctcatgatgacatgaaggaactttctgctagaatatacgatgcgctggagaaaggcattcttccactgtttgtaagcactgatgagcctaacaatgaacgtaaggggctagtcgctccgcttgccaatcatgcggatgctcggaaataccttcttatacttgcagccggattcgtcaatacattgatgccgggtgaagatacgcttatctccaaagggttttccattgaggaagcaaaaagtacgacagaggctttcgaggagttctgcaaagaacacagtgatgaaatagaagcactacgtattatatataataatgaaggaacgcctatcacctattctatgttgaaggatttggaaaacaaactcaaaatggcaaacaaccatttcacttccaaacaactttggaactcttatgccatagtcaatcctaaagcggtaaggcgttccactaccaaagaagaaagcgatgcattgaccaatatcatacaacttgtgcgctttgctttccgccaaatcgaacgattggatagtgtagttactacctctaaacagtttttcaatctttggttaggacaaacccagcgtgaaataactgacaaacagcgagaggttatcagtcgtattgtggattacattgcttctaacggagcttgtacggtcagagatattcgagaggatgacgcaacccaagcggcacaaatgattcgggcatttggtaatatgcagaaagtggacgaagcacttcattccctttacacatttgtagtattaagaaaagcagcataaaaaatggcaacaaatagttcaactgagcaatcgctcaccaaaaaagtatggaatctggcaaccactcttgccggacaaggaataggattcactgattatattacccaactgacctatcttttattcttgaagatggatgccgaaaatgtagaaatgtttggagaagagtcggctattccaactggttatcagtgggcagatttgatagcatttgatggtctggatttggtaaaacaatatgaagagacccttaaattgcttagtgagctggacaatctgataggtacgatttatacgaaggcacaaaacaagatagacaaacctgtttatctgaaaaaggtcatcaccatgattgatgaggagcaatggctcattatggacggtgatgtgaaaggagctatctacgaaagcattcttgaaaagaacgggcaagacaagaaaagcggtgcaggacagtattttactcctcgtccacttattcaggcaatggtagattgtatcaatccgcaaatgggtgaaacggtttgtgacccggcttgtggaacgggtggattcttacttacagcttacgattatatgaaaggtcagtcagcaagtaaagaaaaacgtgatttcttgcgtgacaaagctttgcatggtgtggataatacgcctttagtggtgacgctcgcttccatgaatctttatttgcatggtattggtacagaccgtagtccgattgtttgtgaggattctttggaaaaagaaccgtcaactcttgttgatgtgatacttgccaatcctccttttggaactcgtccggcaggctctgtggatatcaaccgtccggatttctatgtggagaccaaaaataaccagttaaacttcctccaacacatgatgcttatgctcaaaacaggaggacgtgcggcagtggtgcttcctgataatgtcctttttgaagcaggagcaggtgagaccattcgcaaacgcttattgcaggatttcaatctgcatactatcttgcgcttgcctacagggattttctatgcgcaaggcgtaaaagccaacgtgttgtttttcagcaaaggacaaccaaccaaagaaatatggttttacgattaccgtacagacataaagcatacgcttgccaccaataaactggaacggcatcatttggatgattttgtttcttgctacaataatcgagtagagatctacgatgcagaaaataatccgcaaggtcgttggcgtaaatatcctgtagatgaaattattgccagagacaaaacaagtcttgacattacttggataaaaccaggtggtgaggtggacgaccgttcattggcagaactgatggcagacatcaaggataagagccagaccatcagtagagcggtgactgaacttgaaaaactgcttgcaaatattgaagaaaattgagctatgcgaaaagatattagcacaaatgataaagatataaacgacctgttcttaaaggttgttgaccttgtcacgcaggcaagggaacgtgtggcaacagctatcaatattgctgaggtctttactaagttccatatcggacaatatatagtagaatatgagcaaaagggagaaacaagagccgaatacggaaaggcggtgctgaaagaactctccaaacgtctgactgataggttgggagatggatggtcgtattcaacgcttaagaatatacggcagttttatattgtcttttctaaagggctaaccagtggttgtccaaagtcgagccaaaaggctaaccagtggttagccgattattcgaaggcagaggaacatatctctgaaccgacattcgctctctcatggtctcattatcttatactgatgagggtggaaaatccggatgcccgcagtttctatgaaatagaatgtacccaacaacaatggtctaaaagacaacttagccgtcaagtaggaagctgtctttatgagagattggctttgagccgtaacaaagatgaagtaatgcggttggctaaagaagggcaaactattgggaaaccatcggacatcatcaagaatcccatcacattagagtttcttggtctaaagcccgatgcagtttactcagagtctaaattggagaatgccattatcaacaagatgcagcaattcttattagaacttggcaaaggattcctatttgaagcaaggcagaaaaggttcacgtttgatgagcagcatttctttgttgacttggtgttttacaatcgtttgctacaatgctatgtgcttatagatttgaagatagacaaacttactcaccaagatctcggacagatgcagatgtatgtcaactattacgaccgctatgtcaaacaagactttgaaaagccgacaattggtattctactgtgtaaggagaagaacgatgcactagtggaactcaccttgcctaaagatgctaacatctatgcttctgcttatcaactctatctccccaacaaggctttattgcaagccaaggtgaaggaatggattgaagagtttgaagaaaatgaggaattaaagaaactggaagaaaatgaatagtatttgtgcagccaaaactgcacaaatacaaacagaaatacgacgatggatacaaaagcgttacgtcaaaagatactcgaccttgcgatacatggaaaacttgtaccgcaagacccgaacgatgaacctgcatcagttctgctcgaacgaatcaaggctgaaaaagaacgactgataaaggaaggcaaaatcaagcggagcaagaagtctgcaaagacttccgatacgccacattatcagaatgtgccgtttgaggtgccgagttcatgggtatggtgcaaattggaggattatgttaaaagtgtgactgatggcgatcatcaagcaccgcctaagtcagatattggcatcccatttttggttatttcagatgttgcaaaaggaaaactaaatttcttaaatactcgttttgttccacaagaatattatgagaaaatttcatttgatagaaaaccggaaaaaggagacttgttattcaccgtaacaggttcttatggtattgttgtacctgtaaacattgattgtaaattttgttttcaacggcacattgggttgataaaaactttgaatacgagtgaatatcttttacacctgctaaaaagtagttatttcaaaggacaatgcgatgagtttgccacaggtacagcacaaaagactgtaggattggagacattacgttcttttctattgccaattccaccttttgctgaacaacagcgtattgtaatagaaatagagaaatggttttctttgatagaacttatagaaggaggtaaggacgatttacaaacaaccatcaaacaagccaagagcaaaattcttgaccttgccatacatggtaagctagtaccacaagatcccaatgaagagccagcaattaagctgttgaagcgtataaatcccgacttcacaccttgtgataacgggcatagtgggaagttaccttataaaatacctaagacatgggcatggtgtagtcataattctatcttagatatatctggaggatcacaacctgcgaagagttattttgaaactatacctaaaccaaattacattagactttatcagattagagattatggagagtctcctgtacctgtttatatcccaattaatcttgcttcaaaacagaccgaaaaaggagatatattattagcacgttatggtggttctttaggaaaagtgtttcatgctaaacaaggggcttataatgtggcaatggtaaaggttatctttaaatttgaaaatctcatatacaaggagtatgcatactattattatttatctgacctatatcaaggaaaactaaaagaaatttcaaggacggctcaaacaggatttaatattacagactttaatgatatgtattttccactcccccctatcaacgagcaacaacgcatcgttcaaaagatagaagaacttttttcatcccttgataatattcaaaaatccttagaagtgtaattaattacacttctaaggatagataaaacttaccagtttactactttgtccacaattttttgctgttcactagctgttcgacggagataaatacgagtagtttcaatactttcatgtcccataaggtcagcaagtagagcaaggtcattgaatcggtcaaggaagttcttggcaaaacgatgacggaatgaatgaggataaaccacttccttattcattccgtattttcccgcaaaatgtttcagttgttgggctatgccacgtgttgtaatacgttccccaaatcggttcaggaatatatagccggaaataagacttttttctttgagccattttgtggcttctgtacgcaaatttttcggaatatataaacgacgtatttttccacctttactgtaaagatcaagatggccaacttgtacatgctcagctttgatgtgaagcaattcactgacacgtgcgcctgtggcagccataaaccatacgataaaataccactcattataaccatcagcttttaagcgtgtttttagaaatttgtagtctgcatcgctgattacgttttccaaaaagttcttctgctgtactttgacgaactttaccttcagtttctcctgttttgtaaattccaaatacttgttgataccttgcaatcgtaggtttaccgtttgcggtttaaagttctccaccagataccctttatatgttaaaaggttctttttgtttacttctccataatgattgaggaaatactgtactgtccacacatacgatgtaacagtgttttttgccaaattagttttggcgagatagcttttgaattttgttaccatattatattgatttataatgaatacggcaacaatataatagaatatatcgggcattatacgcagttgcctaatggatggactgttgcacctatgcaagtactatgctctttggttgatggtgataagcaaaaaggaatagaacgaataaatcttgatgtcaaatatttgcgtggtgagcgtgatgccaaaactttgacttctggaaaatatgttactgcaaattcacttttgattttagtagatggcgagaactctggtgaggtatttaggacttcgattgacggctatcaaggtagtactttcaaacagttgcttatcaacgaaaatatgaacgaagaatatgtactacaagcaatcaacttgcataggaaagtcttgcgagaaagtaaggttggttctgctattccccacttgaacaagaaactattcaaagcaatagaaattcctattccaccttacaaagaacaacaaaggattataaaggctataaccaaggcttttatgtctttagatttaataatggagagtttataggctctccattattaaatctaattgtgtaaagattccatggattgcatgaataattcgcttttgttctgccttcgatggtattggtatctctaattttgagtattcagaaatccaatatcgtttatgggtgtcacctaccaatttggttatgctcataaacattgccacataatcaacttcaatgtccttatgtacttttagaatcttcattgcagatgactttaccttaaaagggaaatcaactagtttcgaatcagttgtaaaatcatcaaagattatacaaggaagattcgagtatataccagtagcctcgttagtgtaaccaataataaatgatttaccggctgtcagaactggggttgaataagagtcatcataagctgtcgattctacaatataagctgtagactgttcataacctataatttggtcaagcctacaaaacgtccatccatcaggcaactgcgtataatgcccgttatcacaaggtgtaaagtcgggatttatacgtttcaacaattcgatagcaggttcatcgtttgggtcttgcggcacaagttttccgtgaatggcaagatcaagaatcttgctcttggtttgctttatgatggtttgcaaatttactttgctatgttctatttggtcgattaaagcaaacaatttctctatttccattacaatgcgctgttgctcactaagaggtggtaaaggaaaagccatttgttctaaactgtattttggtaatccttcacgaccactacccgtaatcttcatagatttagcgaagtatgaagataaaactagcgcatggaaatattcaggttcaactaaaacagaacgcataatacaaacgtgttgactaacattaccacaattaaaatcagcaggaactacagcacatcttcccaatgaaccaccagtaatattcaacaacaagtcgttagcaagtacctccgtacctttcatcttctgatgaacttcttcggaaatatatttgatatcatcataaacaagcctgtcattatatacattttgcgagcggaaaaaagggatcccgttcgcagaatagttacttccccttggcgtgctaccggaacctatctttgagcatatttcttcaatcgttgtccacacccatgaattcggtatttcaaacggcacgttctcataatgtggcatataccattttatatacggcttgtttgctcagccccaataaagttgcaacctccttgaatgatagatattctttatccttgaaataggatatgggttgttcactgattaccgtttggactttggtttctatttcttgtattctcttctgccgcaccgcttctttatatgcaagattattgcaccgatgcgaacagaagcgtgtcgttaacttttgggcatagaatgttgtgccacaccattcacataccttcttgattttcattttacttgttgccatattcgttacttttagaggtttatttctcttgtaatttctccattttgttcaactatcgtaaatcatagtcaaccatagtaaactttctccacgacctttccgacctaaaatcggagagtaacaagcgagcaacaaatacggtacaaaaatgagctgaaaaagccctataaacgataaccatcgcttataaggctaaaaagaaaggcgctcaaaatgaacgccttaataatcgttgatgatagatgctaattgttggtaaccaccacttactttccgatgcagcatattagaccagttgactaccaatgttttataaataaaatggtagaaaagtccgttttgcacttctttttcttcgctgaacgagtacaaaattagtgcattttttcggattatgaaagcaactgaaaaactttgtgcaaaatcatttttgaagggctgatttgaggtgtattagtgaaaagtatggaatatattgcatcgcattttgtcggtgatgatgttcgcggttatttcgctgattgtttctccaaggttgaagatgatgtagtgtattataaaggtgctgaccaaaagaaaaaatcgtttgcttgtcgaagtttttctttctccctctttttgactttactttaatggacgtatatatgaatacgaggataaagtaaagttgttttttcttttggtcggcaaaatagttttatcgaatcctatgaagtaatagctgaaaattgaactattattagtatttttacccccgaaaagtttaaaatgtggctgttatggaagatgtttattcgctctccgatgtcactgccgataaaataaattttgatcttttattggtctccgcaaaagtgcctctttcgtgtttcaagtcaacgaactttaatataaactttgtgttttcagttattcgaaaaaattgaataactgaaaatcttaagccccaacatatcatataatatagaaatagatgctttttcattcactatatgatacattgagacctaaaatattcttggtgggtctatgcctgtcacaagataaggttcttgcttggttcaaaaccattggtgatatgttcattttgacaaacatatcccatttgattgcaaacgacccttgtgccatttatttcagcatcgatgttggtgtgcgagtgcccataaatccaagcgtcaatgcgactgtcagctataagtttgctcaaatcagtagcaaatgcactattcaaaacagaacccttatgatgaggggcaaccacttctaatgtgggaagatgatgtgttaccactacaatgtgttctgcagtactttctgccagacttcccttgatgaaatccaagcagaaaatatgcatttgattaaattcttctgtttggagcaatttatcattatactttatctgccggaagtcattcatgcctttccacacaaaatattcgttagctggtgagatgtgagaccacaaagtgttcatgataaaatctgtatcatcaatccgtatcacttgattttgataatatcctacattttccttaaacatccatttccattgtaatcctctatccatcacatcacaataattgtaatactcgtggtttccgggtacgatgagcacctgacgataattagcagaagtccatttccagaaattactcaaaggtgcaaccttgtttttcaagtaaaatatatctccggcaagaaccagaatatctcccgttacaggtaattcattatgttttagccacctgctgttatcactgaactccaaatgcaggtcgctcatatattgtatcttcatcttactgtcctcctttttcaatttgtttggatataattctcttaacctgctcaaatgatacaggggtaaagttgttgttatcaactccgacatcgtattgtgttggatagagatactgaagccttgcagcgtcaattccggtgttgtttttccttgtgtgaacgtgcccgaacagttgccatacatctttatatccgccatcaaagcatagaaaaggatagtggttcaaatatatcctttgcttgccgacctctatgtgcatctgcattgccacatgttcaaatcggtcaatgtatccttggcgtatatttttcaaatcgtggttgcccataatcagatgtatcctgccgttcaatctgtcaagcattttagtccactcagctgaaccgccaagacaaaaatcgcccaagtgaaaaacaatatcatcttgtccgattgtattattccagttggagataatagtttcgttcatcatttccacatccttaaacggtctgttgcagaaatgaataatattcccgtgataaaagtgggtgtcagatgtaaagaacaccttgctgccatcaaatttatagttcatttcttttcaatttatatgtgcatcactgcacgttaataatcaagttatcagtacgcattagacggaaaaggcagaagagcatcacaaaggcgactgtcacaaatgggcataaaaacaaaatagttggaggtttggtaaggactctccaactattcagcttatattttcaatcaaagtacaaaagtgtactcgctatgttcgttggaaagtatttactatacgaggttcaatgcgtgaaacatgaacactcgacacagattcagtgcgtttattgctctgaattgcggttgtcattgataatatgttcattctgtttctctgcattgttaatattatatcgtttcaaaaacgaagcaaaattagcaaataaatcccatactgccattgttttacattaaaatcttttgtaatacagaaaaatacttagctcaaaatttcgtattatgccatttaaacattatgtttgcatgacataataaatatagaatatgaaattcgttgatagaatagatgaagcagcacggctgaaggatgctcttgcgagagagaagtcttcgttagtcgtcatgtatggtcgtagacgattaggtaagtcaacgcttatcaaaagagtgttgtctgacaatgatgtttattttctcgctgaccgttctgaaagccaatatcagagaacattgctcgccaaagtgatagcacaagtgtttccagatttcgacaagttggcatatccggactgggaatctatgtttcgtgcggttaattatcgaacagacaaacgttttactatatgtctggatgaatttccgtatcttgtggaacaatctccagagcttccatctgttctgcagaaacttgttgacgagaagcaactgaaatataatcttgtgctctgtggttcttctcaaaatatgatgtatgggttgttccttgattctacagcacctctctatggccgtgctgatgagataatgaggcttgcgccgatacgtttgccgtatattcaggaggctttgagtcttgatgcgatgaatgccattgaggagtattccgtatggggaggtgtaccacgttattgggaactaagggaaaacaaaagctcgcttgatgatgcattgtggcacaacatcctttctgtgaatggaacactttacgaggaaccagtcaaactctttcaggatgatgtgaaggatattgtcaagacttcgacaataatgtcttatataggtactggtgcaaatcgtctttcagaaattgctggacgatgcaatgaacctgcaactaatctgtcacgaccattgaagaagcttgtagatctcggattcttggaaaaagatgttccattcgggattgatgaaaagaatgcaaaaaagagcctgtataaaatagccgatccatttatggcattctactatcagtttgttgttcctaaccgttcgttcatcgagcttggtcgtcgtatgccattagaacaggctttggcagcccatttttctgagtatgtgagtatgaattgggaaaaactgtgcagggatgctgtaacgggaaatatagtcaatggaactgtttacggcaaggcaaaacgctggtggggttctgtttttaatgaggataagaaaccggaacaagtcgaatttgatgtaatggcagaatcgcttgataaaaagtatctgctggtaggtgagtgcaaatggacaaatcaagagaatgggaaacagttgacagccgagcttctccgtaaagcaaatctgttaccgtttgctaagaattacacgattattccggtcttatttcttaaaaatgctccgaaagatgatgttgagaatgcgatgttgccggaaaatgttgttgagttaataagataagttatctctaataagagtgtgatatatatggataagaaagagctattggatttgattgatcaagattcgtcttttatgaaggcgtttcttgatgagtatagacaagatggtgtaaattttggtgcagaagatcgtttgatgagcctatttgttgatatgaaacaaagtgttgtggaggatcagataccggaatctttatttggccgcttagtaaatttaatacgaactttagaagtggagaagctgagaacgcatcaaaatgaacttcagaaattacacaactttgagaaatatcgtgatttggcagagcatgtattcgttaatagcttttttgtgagtaaaacattttatttacttaaagcgattggttttacaagttctaatgtggttcttataggagcgaatggcagtggtaagactacatttgcaaattcaataagagaacaattagaaaaaacagataatggcattgttattccagctcaaaaattactagtatttccgacatacaatagtattccaacatataaatcagcttttgctgattatgagagtcgtcagaaagtttgtttagatgataagcaaacttttaaggcagaaaaaaatgatgattatccttattctttatcaaaacaatatagtgaagaactaagaatacttgtttctgcattaatttctgagagattagaaagaagaaataatttttgttcaaatgcgctagaaggagatattatacatcttgatgattttaaaagtaatatagatgaggttattgaagtttggaatcatcttatagaacatagaactttattatgtgataatttaggaaatcttcagatagagtgcggagacgaaaaatatcctgcatataaaatgagtgatggagaacgtgttattttttatgttgtcggacgtgtcatgcttgctaaagaatcgtctttgattatcgttgacgagccggagatgcatttgcataaagcgatacttaataaactgtgggatatattggaggaaaagcgtaaagattgcatgtttatatatttaacccatgacatagattttgcttctacaagaatagctaacaaacgttggttaaagtcttatagttgtagtgtctctggtgtttttgaaaattgggaaattgaaccaatatatgattccgagataccagaggcactgttaatgaaaatattgggtagcaggaaaaaagtactattttgtgagggtaaacaaggtagtttggataggcaaatatttgaattattattccagaattttacaataataccacttacatcgtgtaaagatgtaattaattatacaaaag

SEQ ID NO: 110 - DNA, 25985 bp, Bacteroides thetaiotaomicron
ttattaataaatatgatgttacttatgaaaaaaggtattttggggtgtaatattatatacttgtttatacttatttgcataggaattgccctccctatcaaatcgcaaaacaattacaaagtaaaacttacaggcactgtttatgagtacgaccacaacaacaagcgtttgcctttagaatttgcagctgtgtctattcctgaaattgcactagggacaacctctgatgaaaatggtagatacatactggaaaacgtacctactggtaaaattcgtatgcaaattcaatatttgggcaaagtctccattgacaccttaataaatgtaaataaggatttggttcttaattttacaatgaggaatgaggattttaagttgaaagaagttacagtaactgcaaccaacagccgttcaggcaaatccacatcttctcacatttcccgctctgctatggaccatatgcaagcgaccagtttatatgatgtaatgtcattgatgccaggtggaatttcacagaatcaagatatgagttcggcacaacagattaacatccgtcaagtttccagttccagtggtccggaagctccgatgaatgctatgggcaccgcaataattcgtgatggtgcccccatctcaaataatgctaatctatctgcgatgagtcctacggtattaagtggtacggaaacacccgcttcattggccggaggtgcttcgccggctggtggaaccgatgttcgtagtatttctactgaaaatatagagtctatacaaatcgttcgtggtatcccttctgttgaatatggtgatctgacctcaggagcagtaattattaatacaaaagctggtcgtgagccgctacgtgtcaaagcaaaagccaatcccaatatctatcaggtgtctatgggaaccggttttgaacttggaaaaaagaaaggcgctttaaatgtaagtgcagattatgcttataatacgaataatccaatatccagttaccagcactatcagcgtgccacaacaaagttgctctattcaaatactttctttaataataagttacgtaccaattccagctttgattttatttatggtaaggatcaacgtgaacgtaatcctgatgatgaacaaactaaaacagcttcggaaggccgcgatataggttttactttgaataccaatggtacatggaatataaataagggctggttaaaaacactacgctatgtattgtcaggtacgtatatggataaagacagttattatgaaaccgtatacagttctgctacatctccttattccatgaccactacaaacggtgcggtacttagtaactttgcaggtcagcatatctatgatgccaatggtaatcaaattactaattttggaccggaagacataaatcattatgctgtttatctaccaagcagctatttgggacactatgagatcgatagtcgtgaagttaatttgtttgctaaagtgacgagttctctattcaaggcgagcggtcatgtaaacaaccgcatcttgattggtgcggatttccggagtgacggtaacgttggtaaaggaaaaacttatgacccaagtactcctccttatcgtagtcaatacggtcataattcatctttccgtccacgtaactataaggatattcctttcattaaccaatttggtgcatatgtggaagataatttcaaatggtccataagcggtacgcatgatttgaacattcaggctggtgtgcgttatgatcatacctcagtagtaggaggcattttctcgccacgtgtaaatgcatccattgatttgattccgaatctattaagtcttcagggaggttacggtattgctgcaaagatgccttctcttctctatttatatccagaaaatgcatattttgaatatatcaatataaatgagcttaccaatgaaaatattccggaaagccagcgcttgtttatgactaccacagaagttcggcaagtagataactcagatttgaagattgcccaaaatcataaagcagaagtcggttttaatttacgagtgggtaaaaccaatctgaatgtaatagcttataaggagcgtctgaaggatggttatgtaatgagccaaaccttcaacaccttcaatacatttatctacaatgaataccagcgcacagaaaacgggatagagcttagtagtagcctaccggtattgtctacttatgcaaaaccaactaataatttaaatatagaaactaaaggtttagaatttgatttgaatatcggacgtattgatgctatccgtacggccttccaaataaatggctcatggatgcgtactaagagttggcgtcagggttatagcttctatgacaatagcgaagatgctgcttcagcccgtaaaccggtggccatttattctcaagaaggcaatgcaagttacaaacaacaatttgtaacgactttacgtgccactcacaatatcccgcgtatcggttttgttgttacgatgacagcacaagctatttggcagcagtctaattggaatacatttggaaacgattctatacctgtgggctatttagcattggaagatgcgtctgtaaatatgtttcccaaggggaaatataccactacccagcaagtaaaggatgcaggatatggatatatgttgaataatgtaagtcataataatgctataaaagaatcatacagtccttatttttgttttaacttgaatgtaactaaagaaattagcaatatgctacgtgtttctttctttgccaacaatatgttcagaagttatccgcgcagagaatccaaacgtaatccgggttcatatattcaattgaataaccgatttttctttgggctggaattatcactcactttataatgtttaggaagttatgaaaaaatatttaatatatttgtttacattggcaagtacccttttgataggatgcgattcgttcagggacatgtctggcacagcagaagtgaatcctatcacagtggatgtatatttggatattaccgttgaaaatatatccacactgaaagatctgactgtaaagttcgacaattacgatgaagatttacattatgtaaaagaagtaactgataatagtgtgaaagttgacggaattatccccggaatttattcggtaacagtatccggtacagcgatcgatacagaaaacaatgaatactacatcaatggcaattctgtaaatgcggcattatttaagcatggtagcgcattgaatattgaagtacaagggcttaaagtgagcccattaatattcaaggagatttattattgcggtagccgtccggaaaaaggaggagtctatttccgagaccagttctatgagatatacaataactctgctgacattttgtatttggacggtatttatttcgcaaatttaactccgggtacagctaccactaaattacctatttggccggaagcggacggtaataattatgcatatggagaacgtgtgtggaaatttccaggaaatggaaccgaatatccgttagcgccaggtgaatcttgcatcatttctcaatttgccgctaaccatcagttggacatctataaccctcaaagtcctatagacggcagtagttctgagtttgagtttaatatgaataatccaaacttccctgaccaggcagcttatgatatgcaacatgttttctaccaaggaaaagcagagatgggaagtataccacaatatttgacatccgtattcggaggtgcttatgtgatttttcgtgttcctgaaggagaagcttgggatccggtcaacgatgaaaatatgaagacaacagatcttagcaaaccgaacagcaatgtttattatgcaaaaatacctattaaatatgtattggatgctgttgaagcagtaaacaatgagtcaaagatgaatgcaaaacgtgtccccggtgtacttgatgcaggtattacttgggtaggagctacttattgcggtttaggtattgctcgcaaattgtccacagacgaagaaggtaatcctattattcgcgaagaaacaggtacatatatatatcaggatacaaacaacagtacggatgactttgaacgtggcgttgttcctgtaatgcgtcgtaatggagcaaaaatgccttcatggaatcacacattgtaataattaactaaaaagacagaacaatgaaaaaacaatatatgaactatatgaaaagctgcctgctggtaatgatagcctgccttgtaagtatggtgggagcggcacagggcttctctcccgccgctatggaacaattgaaaacaagacgactatggtctcattcacagaatgctgccggtatgccattcgatgatattcagaattattcgaatgttatattgggatatgacttacaggacggaaactattgccgtccgcaagaggggcagaaagaggctatcgtaggtgtatccagtgaaggctttatcaatctgaaaaatgcatatgtgtggggagtatttaattttgcacaaaaaaatctgacagatgccggatataacgcctccattgccgatccattcaggggaatgccttactatgtcgcagaccagcacttaagcaaatggagaaatcaatattacgatctgaagtttcgtgcagctactcctttacttggtaatcattgggcattggggttggaaggtaattatgtagctacattagctgccaaacagcgcgacccgcgtgtggatacccgtttttatacgctgggactgacgccggggattacttacaagttgaataattcacacaagtttggtgcaagtttcaagtatagttctatcaaggaagactcaagaatgagtaatgtcaactcttatgtggatcaggactattatatattatacggtttgggaacagccataaaaggaataggcagcggtgtaaccagcaattatattggagaccgtttcggtggagctctccagtacaacttcagtatgccctctttcaatttactgcttgagggcagttacgatgtaaaagcggaaactgttcagcagagctatacgactcctaaaaaaatagccggtgtaaaagataaaactgctcatgtttctttaacgatgattcaggaaggaaaggactataccaattatatgagaaccacatatacaaatcgtaacatcgatggtattcagtatatttctcaacgcgataactctgaatcacaaagtggctgggtggaattatataataacatccgttctacgtacaaggcacaaaccgcttctcttaattatgcattaagcagaaaccgcgggaatgaatatagttggaaagcagaattaaatgtgaattataccaagcaagacgatgaatatttaatgcctaattctgtacagaatgcagaaaatttatctttaggcttaggtggcaaaaaaaattttgttttaggcaatagtttgaatcgcaggcttttaatagatgttcatgttgcgtataacaataatctgggaggtgaatatgtatatggtggcagccatgcagactatccaactgtaaccgaattacaacaagggctgactaattattatacctgtgattactatcgtattggcgggtcgataacgtattcgcaacaagtcagagaaaacagacgtatgaacttatttgcaaaagttgtattcgatcgtgtaaatacctctgactatgattatgatgggcgtactcatttatcgataagtttaggatgtaatttttaatgctacataacgaaatctatattacaaaacatgcgtaaattaataactggaagtttgatgctctgcagcatattatctctgcgggcacagacatttgttaaaccggctgtgaaagtaaaggacacctcttttgctgtaattacagataaagggacatttcaggcttgtgaagccgagcttaaagcctatcaggagattctaggaatggaagggttgcctacgttcatcgtatacaatgaatggaataaaccggaagatgtaaagaaagttattgttaagctctacaaaaaggataaattggaaggagtggtatttgtcggtgatatccctattccaatgctccgcaaagcccagcatatgacttccgcttttaaaatggatgagaaaaacaatgactggagagattcttcagtgcccagcgaccgtttctacgatgatttcgacctacaattcgattttttgaaacaggacagtgtcgaaaataatttcttctattataatttggctataaaatctccacagcaaattcggtgtgacatatattctgcacgtgtcaaagctgttgataacggcgaagaaccgcatgcgcaaatcagccgctattttaaaaaagtggtggctgagcaccagataaacaataaattagaccaattcttctcctatacaggtgatggctcttactctaactcattgactgcatggacaccggaaacctttactattcgcgaacaaatgccgggcgtattcgataaagagggacgggcccgtttcatccgttataatttcagcgattatcccaaggacgatgtcattaatatgctgaaacgcacagatctggacttgtctatttttcatgagcatggtatgcccgaacgtcaatatctttccggtagtcccgctactaataggtggaatgctcatgtagatgcaatgaagtactattatcgtggtttagcgcgtagaaagcaaaacaacaaaaagtctttcgacgaaatgctggatatgatgaaaaacacatacggtttggacactacttggattgcaggctatgatgatcccaaagtaattgcagaagattctttactagacctgcgcaccggtattatcctgtcggaagttacagagtttaagcctaatagccgtatggtaattttcgatgcatgctataatggtgatttccgggaaaaagattacattgccggacgttatatcatgtcggaaggaaaatgcgtaactacttttgccaattcagtcaatgtactgcaagataaaatggcaaacgagatgctcggcctgttaggtatgggagcacgagtggggcaatgggctaaattgacgaatattctcgaatcgcacattaccggtgaccctactctacgttttcaatctatcaatgaggtagatgccaatgctttgttcaaagaaccatatagcgagtcccgcatgttggagttattacagtcgccctatgccgacatacagaattttgctttgcacaacctttatcgcaatgactatccgggtatttctgatttattaagaaaaacttttgaaacttcctcgttcatgatggtacgtttcacctgcttggcattgcttgagaagattagtgacaaaaacttccgggaagtcttacacttggccattacggattcctatgaatttattcgtcgcacctctgttcgtatgatgcaacatgtgggactgaacgagtatgtttatccgcaaatcaaagcctatgtagaagacaacctatccgagcgtgtggcatttaatgtgagtttggggcttcaagtctttgatcaggcagccgtacaggcggcaattgataaagtaatggctgagacctatgtgttgcaagacaaggaggagatgcgtaaggttttggagaatgccaataatagtcgtagcatgcaaaaagagttattaagcaaagaaacttccgaacgttggcgcatcctttattgcaattctctgaaaaatcatatggcacatgcctgtgtagacggcctcttggctttacttaccgactccagtgaaagtgaaaagctaaaaacctgtttattggaggcttttgcttggttcactcattcttatcggaagcctgacatccttcgggtatgcgatcaactgagaaaagataagagcttatccgagaaccttcgtgaagaagccgaccgtacatattacagacttaaaaattaattggccatgattaaaaaaataatatatctggcatttcttttgccattggcaggaaatgcacaaacaacagtcataaagccattggtcaaacaacctaccgcttttgctatcataacagataaccaaacttatgcaaataccaaagatgccatgcatcagtacaaaactgcggttgaagatgatggtttggcaacttatctgatcagcggtgactggcaaaatccagatcaagtcaaacagataatcatcaaaacatatcaagaatgcccttcattggaaggtctggttttaatcggcgatgtgcctgtcgcattggtacgtaatgcgcaacacatgactactgcattcaaaatgaatgagaaagcctttccttgggatcagtcttccgtacctaccgaccgcttttatgatgatctgaacttaaagtttgagttcatcaggcaagactcagtaaatcatcagcatttctactacaaattgacagaagacagtccccagcggctaaatcctactttctattcagctcgtatcaagtatccggaaaaaaaggaaggggataaatatgcggccattgcctcatatctgaagaaagctgctgctgccaaggcagataagcataatcaattagatcgggtattctcattcaatggtgcttcttacaattccgattgcctgattgtatggatggatgacgaaaaagcttatatggagaactttccattagcttttggtcgtcaaatgggattcaaacattggaacttccgaatgaaacaccctatgaaatataagttattcagcgaattgcaacgaaaggaccttgacttatttatgtttcatgaacatggaatgccaacagggcagcttattaatgatgaattggcatgcactgatttcaataatcgttataaaatgttgaagagtacactttataatgcagtcatgtcccatgttggaaaacgtgacaaagacaccttacgtattcagatgcaggaaaaacgacaagtgaatgaggtgttttttaaagacctggacaatcctaagttctgggaagcagactctcttcactacgctgatgaacgtatcgtaacggaagatttaatgaagagaaatctttccactaatccgaagatgataatgtttgatgcgtgctacaacggttcttttcacgaaaacgactatatagcaggacaatatatctttaatgacggtcagacattagtagcacaaggaaatacccgtaacgtattgcaagaccgctggactattgaaatgattggtttgttgtcccatggtgtacgagccgggcaatacaataagctaatcgcatcacttgaaggtcatttgtttggtgatcccactttccgttttgctcctatcgaagccaatactttaagtaccgatataacaatacacaaagatgacaaagcctattggaagaatttgttaaacagcccatacgctgatgtacaaagtttggccatgcgtatgctggctgacgccgatacccaaaaggaattatctccgttgctcctgaagaagtaccgggaaagtggcttcaatacggttcgtatggaagctatcaagttgttgagccgttatcaggacgacaacttcatcgaagcattacgcgaaggtttgaacgatacttatgaaatggtagctcgccaaagtgccatttatgctggatttgtaggtgacgattccttattgcccgctattgtggaagcattggtcgaacataatgaacgcttacgcgtacaaatgagtgccaacaaggctttaagcctttatccgaaagagaaagtagaaaagacaatagaagacttttatgcaaaagttgaccgtttgaatgaaaacgaagagaaaaaacgattactaagaagcctggaaagaatgtttgtacaagaggcaaaagtccatcagaccttgatggatgtagctgcaccggaagcaaaacgtatcagtgcaatccgcaatgtgcgtaactatacattccatttccacgtggatgattatttgaatgtaattcgtgatgccggtaatccacaggaagtacgtgtagtaatggccgaagcattaggttggtttactaattctgtacaacggccacacattcttgaagaaataaagaagatgcaacaaacagccaatcttccggaagatttaaaagcagagcttgaacagacaatcaaaagattaagtttataaatatgaataaatacatccttttggcaattaccgctttgtgcttacaggatatgcaggcgcaaacagttgtacatcctagtataaaaacaaagactacttttgcaattgtagtcgatcagaaaagttatgatgaagcgaaaagtgaaattgatgcttatcgtaccagtatagaaaaagaaggtttaggtacttacttgctaattgatgattggaaaaggcccgaacctattcgtgagcaacttgtcaaattgcatgagaatgagaaaacgcctttggagggttgcgtatttataggtgacatccctattccaatgattcgtgatgcacatcatctatcttcggctttcaaaaggtctcccaaagccaattggcagaaatcaagcgttccttccgaccgttattatgatgacttcggattaaaatttgattatattaaacaagacagtttgatacctgactatcattatatgacattgcgtgctgattctaaacagtatatttcaccggatatttattcggcccgtatccgtccattacatttagaaggtgagaaccgttatcagatgctacgcgattacttaaaaaaggcagttgccgaaaaagcaaagcaaaatgcatttgaccaactgactatggcccgtggccatggttacaattctgaagatcctttggcatggagcggtgagcaaatagccttacgtgagcaattgccgcaaatattcaaatcgggtaatacagtgaagttctatgattttaacatgcgctatccgatgaaaccattatacttgaacgagattcagcgcgaaggattagatgtcatgctattccatcaccacggtggccccaccatgcagtatatcaatggctatgaaaatggttccggtattaatttgagtattgagaatgccaaaatattcttgcgaagcaaagtgccttcatacgccaagaaacatgggcgtgaagctgctatcaaagaatatgccaagcagtatggggtgcctgaaagttggtgtgcggaagctttcgatgaggagaaaataaaatcggattccattgtaaaccgtaatatggatatctatactgaagatattcgtcttttgactcctaatgcgcgttttatattgttcgatgcttgtttcaacggttctttccatttggatgacaacattgtaggctcttatatattcaataagggtaagaccattgctactatgggatgtacggttaacaccattcaagataaatggccggatgaatttctcggcttgttagctgccggtatgcgcatcgggcagttcactcgttttacctgcttcttggaaaatcatctgatcggtgacccgacttttcacttcaccaataatgccgggctggatatggacatcaaccaagctttagttgcgcaggaaggaaatgttacattctggaaaaaacagctgaattcccctatggctgacatgcaggcaatggcgctccgtcaattgtcaatggcaaattatagtggtctcgttgagttgctgaagaaaagttaccacgaatcgaactatttcgttgtgcggttggaagcattacgcctattagctttgaactatccgacagaggttgccgatgtattgcagacagccatgaacgacagttatgaactgatccgtcgttatgcggtggaatacgttgaaaagaattgcaatccggaattgttgccggcatggatagaaagctatttattacgcggacatgaaaaccgccatcgtttcagaatttttagtgctatcaacacgttcgaccatgatatggctttgaatgaattgaagaaacaggctgccgattggtctttctacgattcttcctatgtgaatgaattgttagaataccttcctcgccaaaagaaaggacttgaaagagattttgcacttattgacagtccggaaagtactaccaaacagatacaaagcgaaataagtaggttccgaaataaacctattgctaaagctattgagccattactgaacattataaaaaatgaaagccaagaagaagaacttcgcatattggctgctgaaacattaggctggtataatttatactataataaagcagatataatcaaagaacttaacacatttagaacttccaatcaaaagctaatgaacgaagttaccaaaacaattaataggctgaaaagtcaaaataggtagaatcatccaaacgatgagatagaccggatccaaagggcggttctgccattcctgagcagcctggttgactttgttcgtgatgatggaaatagctgatgtggacagttctatctcatagatttcacgcatctcctcttctatgtctgacacgctcattcctttggcatatagggagataacaagtttttctttaatattatcgacactatacagggacattcagtaaatgtctatagtataactcctcaaccagttccagacaccaatcattaaaacagggatattcctaaaataataaaatttaaggcaactaattcattgcgagttagttgccttttttgtatctttaagcattccccccaaaaaacggtttgacggccaaaacgggggtaatctaaaataaaaacacatggtaaagatacaaaaaatctcagaaatcgaacctcgtttaggttttaccgagttcgatatgctaaaaaaatatcgtcaaagttttgcaacgagtgaattaggtcgcctccatgctctgtttcctttctcggaactggcccgacaaatgcatttgaagtcctctgctttgggtcgtaaaagttatttttctcccgaaggtaaaatagccttgatggtcttgaagtcctataccaacttttccgatgcacaactgattgagcatttaaacggtaatattcattaccagttgttttgtggtgttcagattgatccgcttcatccactaaccaatcctaaaatcgttagtgcaattcgtcaggaactagcgcatcgccttgacgttgagcccctccagctcattcttgccgagcattggaaaccttatcttgagaaccttcatgtctgtatgaccgatgccacctgttatgaaagtcatctgcgttttcctactgataccaaactcttatgggaaggtattgtatggcttcatcgtcatctgtgcaaacattgccagaccttgcacatacaacgtccccgtaacaagtatcttgatgtacgccgtgcctatcttgcttatagcaaactgcgtaaacgcaggaaatcacagactcgtatgattacacgaaggttacttcagttattggaattcaatactgccaacagataatccaaatgatcgcctgtcataatataacaggcattgttcattacataattgttggcatcatatgcaaaagccatttggtttccgattattttccatacaatttttggcttagaaaaatcctcccaataactgatgctatcttgtgtttcaaaccactcgttactagttttctttcgggcttttatttttttgccattaacaatatgagtttctcctgtttgttctaaacgctctatgccaattgacagaagataatttttcaccgcaggataactttctatatcataatgccgcgaaggaaatgtggctataatccacaagtccgcccattcatattcatatctcttgatatccctgccacgaagaatcggtcgtataagttcagccgtccgaacacgttcatcttctgtttgacaattcgctagtatctcatcacgcttttcggtagaaatgataaaagcatcattgaaaccagtttttatcccatagttgatttggatgttccaatccttcaagggtattcccacagactcaatcttctgcttgatgctctgttcaatgggagacaatatcacccatgggatagaatctgcaaagttacacttcacgccttgttgctgcacgaaatcgctcaaattattcaagccattcgaatcttgtaccaaacaagcttgtgtgttaaaaatatttgctgctttttgagataaaagaatatttgcttctaccgttattgcatcgaatatttttatacctgcaaaatctaccaacataataggattggtcttgcttgcgaaataacctcgcaaggcttcaccataccctgcacgcatccatttattagacgtgatatagcaaagaaaaccattgggagtaagcaggttcatacccaactcatagaagaggcagtaaatatcaccagtgcgtgcataagttatgtaacccatgcattctaatacatcggcactcttacccatagattgtaactgaatgtaaggtggattgccaatgatacagtcaaatcccaagaagttgccttcggcatcgagtacttctggaaactctatacgccattcgaatgcaccaagataaattttgttggagcgtatttcctcaaatatattttctaaagtcgcaatttctttctttaaatcggcaatgcgcttgtccgacgctttcttttccttttttgtcggttcaaacagttgaggcgcttgtaagtttgccaactcagagcggcgtttgttcaatctaaccaatcgtgcatcccggcggttgatctctgttttcagtttcgacttgatttctgttataaacgtttccaaatcctgcttttcgcttttactttgggcatttttatatttagctacagcctccttatattggctgatgctgatactagactctcgcagtacggtctgaatactgtctgtcaaagcgaatcggtgaagcaaagaatttccacatttgatgttaatgtcgatatttggtaaggtttctaaataagtgtaattactttcagccgtatagtaagcattcttcaacaattcaatccacagtcgtaggcggcaaatcttcacagagttggggttaatatcaacgccaaataaacagttctcaatgatttgacgcttctccttgaaaagagtttcctgcatgcggcgactttccgcattgagtgggttgtaagcaaataaattaccttcggtatcggtaacaatcagctcgtcattttcaatggcaagttgatagtccgctttgcggatacgcttaccggtagcatctaccaaaatacctaattcgtatttcaagagtatcagttcattgagagcagacacaagaaagtgacccgaaccaacagctggatcacacagtcgcaaactgttaattagttcattagcttcgactatattgtcaatatggttgtatagttctatacgggtggtacaattccagccataataaccattaaacttttgcaacacggtcttggtgattgcttcacggcacatgaacatagtgataaagcctggagtgaatactgaaccatccttgtgaccatttattttctcgaatataagccctaaaacagaagcattgatgagtgttttagcctcttcttgcacttcttcactgccttcgctcgcaaagttataagcgtcgagaaaagcaaacaaatattgcagggtgggtaatgcgttgacttgtagattacgttttttatttcgtaatacgctactcgccaagacaggaagtaccgtacgttgtgaaaggctgtttatcttaattgttttactttccaaatctgtcacctcgaaaagagaactgttaagatagggaacgtaagcaaaatcacgcataatggagtgtgtgcggctgcccatgtcacgtgcaagcacttggaaaaagagtgtgttgagatcatcatagtcatgaatcttagttattgaaagaaatttatagattgcatctccattgtggtatttcaacatctgagcctccaacagtttcaagaaaaggatacgattcatccaagtaatacacaattccattgcaacattgaataaccgttcctcataatcattcccatacaaactaccatttatgtgacgcaaacaatcttctgcatccagttggttaatagtattctctagtaatgaagcctcgtcacgccgttccacagctttgcgtacaatcacggttttattattctctttgcgttcctcaataccaataatgtgtagcagctcagtgtagaatccacggttgagcgaattgctgtcattttggaacgatagcttcaaaagatgtgtatcgctgaatatcttataaagttcgataagtttgcgtgaagcgctactgtctgttctatcaagcaggtgttgatagtcttgtaagttgaagtaagtgtattcaaggctatctttcacctcctcaatataggttgttgcaatttcagtatagaagaaatcggttttgttactggttttgcgtccatccacaaagtcttgaaactcacgacgtaattgtttgttctgatagaatttgcgttcaaactcatgggcatcaaaaataaagaattcatgaatattagtagcgatgagatatttaatatcattgttcttcttattgacacgttctttaagatagtatagcaataattcctgcaaagccttacgattaagattgtcattagaaatcatctcacctttgttggtggtactctttacttcaatcaataaccctatattggacttgatagttttatccaatcggatagccaaatcaatatcttcttcgggagccatgtagtatggcttgtagaacgtttcactcagaaaattacgtaaatgttctttttgcgtgtgttctctttgcccatccacaatattgtctctcaatgtgcgaagggcatttttgaataagtcaaaatctgttgtttcaatcgcaacctgtctatatgctttgttcaaaacttgattcggtttgagtagtcccataatgtttggtaaatgagttaataaaatacaaaggtagtctaaaaacttgataataaagaatgaacgtattggtttaacgaaagtttgttctactgccagccattatcaacaaacaatagcagcagtagatttgacatgattctacttattatattgtaatagccagccaaagtaatcttttcacatccggatctatcacaggttggataagttgttaacctgaaggtaaccgacctgatggtataggaacaggaagaagtctgtaatcatggcatttacccggatagagaagccacattttttattgccggacttccggcattgcctcatccatgtgtgaaaaggagttttttctttcaccacaacgttcctttcacatacccaaagggggtagtggatccagacctgcttcggctttctttttccttcccatatgacaaaaaccgactatccatgactattcctgccagtgtgccggtcgtgcttgcctctcatggtttcttcccttatattcgcactgatatttaaacgagttgaaaatatggaaatatgctacatcgaggccggtgtccttgagaggatgctggcgcgcgccgagaacctgtccgcacgtgtggacagattgtatgagagaaaccgctgtaaggaacccggagagtgactggacggccaggatgtctgcctgcgccttgacatctcgccgcgtaccctgcagactctccgcgataccggacggctggcgttcacccgcctccagcgcaagttctattacaagcccggggatgtggagaagttgatggtctacgtcggcatcagacgtaaggagaaggaggtgagagaaagaaggaagaacggaaacctttaaagagcggaagagatggaaggcattatcgacaaggagaacgaacgtgtccgcaggttctttgccctgctggacgacatggagaaaaaagtggaacgtcttgcccgtgacaaccgtcctcccttcaacggggaacggttcctgaccgacagggagctttccgggatgttgaagatcagccgcaggtgcctgcaggattacagggaccaaggacggattccctatatccagcttggcgggaagatcctgtacaggcagtcggacatcgagaggctgctggaggagaactatcaccctgcattggtataatatcgtatttaagtttaaggattgtcgccggaattgcatttacgattccggcggcagtttttatttagcctgcggcttccttgccggccgcgggctttcttctttccatcagccggttcatgtccgaggatatcttccggtcggtgacctgggcgtagacctgcgtgctgtcgatgttcgtgtggcccatcatcctggcgatgctctctatcggaatacctgcggtcagtgtcagggtcccgaacgaatgccgggccatgtggtaggacaggttctctttcatgcctaatgccacgcccattccatgtacctcataccagaggacgtcgcggaccggcagcgggaataccggcctgtcgtcatccgtggtgttgtaaagctccagtatctgtccggctatgggatgcagcgggatgaacgcctccacgtccgttttggcgcggcggatgcggatataccttcttccttccgaagtcgttccgatgtgacggggatggagagccctcgtatccgcgtaggccagaccggtcagcgaggagaagatgaacgtcctgcgtgccagctccatcatcgggtcgggcagcggggtttccatcatccgcttcagttcactgcggctgatatgccttagtttaggtgtttctttcctctcgtatgccacgtcctctatcggattggctcttagtatttcccggtccacggcgatgtagatgagccggttgagccagcacaggcagtggttcacgtgtccgttcctgtgtcccagctccttcttgagaaagaccttgaacgattcggcgaactcctcggtgatgtccgaaaaggtgatgtccttcatcccgcgggattcgatgaactgcctgaggttgagctgggtggtcttcgactggcggtaggtggaagtggagttgatctccttggagcggaccctgagccgttcgcgttccacctctccggcctgcaggaggtattccggtacggaattggcgcctgacacggtggtcttgagcagttcggccgtgaccactccctggttcctcagcaggttcccgtacgcctcttccaaccggctgcggaaggcggcaaggcggttgttctccctggctgttttgatttcacacttcttgctgtcccagtccccgggtttgcaatagacgcctgtcgtgactgccgatttctttccgtcgatgctgatccggcagaggacggcggtcgtgccgtccgatttcaccttgttacggttgatgtagaataagagcttgaatgtactgcgcatgataatgattgtttagggattaaaggataagtttcaaatcgcgggttgcctcgacgaacctgtccatgtcctcgaacagcttcttcggggttacgcgcgcgtatatctgggtggtctttatgttggagtgtcccagcattttgcagatggtctctatcggcactccctcctcgagcgtgaccagcgaggcgaaagaatgccgtcccatgtggtagacaaggtcctggctcagccctgccatcaggcgcagggatttcatattggccctgagcgtgtggtagtcctgcggcgggaaaagagtctcgcgggtatcgtcccggtatttctcaatcaacgcgacggcttccggaagcagcttgacacgtccgaggtagtcggttttctttcgctggtatttcagccagaggctgccctcgtcatcccggaagaggttcttccgggtgatgcttaccgcatcggcataggcggtgccggtgtaacaggcgaagaggaagaggtcccgggtgatgacatgtgacctgcgtttttccggtatctccagatcacgcagcttctcgaaattctcacggctgagtgctttcggtgttgtctccttctgcttgggcagcttgaagtggcagaaatggtatttctccgagtggccctccttgtaggcgatgcggcagatctttttcaagatggccaggtagccgcgaagcgtgtccacggcatatcccttttccagaaggatgaaatcctgatagtcgcggatgaactgctcgttgagctgcccgaagacaaggtccggaaccttgaatttcgccttgatgaattcggaaagcgtgcggtaggtgaagaggtaggtcgagagtgtggtgggcgcacggtccacaccgacacgggccttcatttccccgttatgccggtcgagaagtttgagcagggtcatctgcatgcccgcattgccctggaacatgtccctgaccgcggcggcatcgaaatccctttttctttccatgagggaattgaaggccgagtgtacggcaagcagcagtctttctattttttcattggtctccaccgcttcccggctcttgccgttcagccggctctcacgcgcgttccacagcccgggggtgcaggagagcttgcagctgaactgcgccatcgtgcggttgagggtgatccgtcccatgatcggggctttgccggtcttgtccggctcgctctttttcaggtagagcagcaccttgaatttttccactttcataacgctcttttttaggttgtaaaaatactcctttgaaaagcgttctttggcatgcaaaacattgagaaacagtgaatacaaatccgctttgttcttatcggtaaaaattcggttacctgccgtcgtttccgaaacaggcggctaacagtctggtaactgaaacgtcgcaatattttgttttcttttgcaggtctgtctgttctgcaattctcgcaaaatgcttaattataaacgttttacgtttaattatcgtcattctgttttttattgcatttctaaatattacttacactgcccgtcatacctgggctacgatggcatactattgtgaggtacatcccggtgttatttccgaagcgatggggcattcttccatcaccgtgacggaaacgtatctgaaacctttcaagaataagaaaattgatgaagcgaatgtagcggttatttcttccttaaagaaggtctatagtgtaggtaagttgttgaattagagaactgttactttgtaggtaacgggaagaaaagacgctgcaaatatgggtatattttggaaaacatgcaaacaaaaatgatattttttctgataaactactaaaaaaaggaaacacacagaataaaactgcggattttttgagaagaacacggcctggtctttaatttttgcaaaagatttccctcccctctgccatcgtctgagagcaggggttaaaaatattctttacttattcaatgaatgtagtccgcagacgcctctgtcggggtggaaaagtacgctttcccgttacctacaaagtaacggaaagacagaccaccaagatgagatggattatgaaatgacagcaaacaaattttttatttattaattgtataacatttaatttacttttatgagaaaatggacgtatttggtcgcaaccttgctaatggcgggtacgacagctacattcacgggatgtattgataccgatgaaccggaaggtatcgttgatctgcggggagcaaaatccgaactgattaaagcacaggctgcggtaaaactggtggaagtggaatggcaaaaagcgcaagtagcttatcaggaactggtaaacaaatctaaagaattggataatcagtacaaagagtacgatgttcagatgcatgctttagacgtgaaactgaaagaactggaagtagaacgcgcacaagctgctaccgaacaagcaaaagctgaggcggaagctaagattgctgaagctaacagaaacaaagcttactgggaaaataaaatggctgaagaagctgaaatcttcaaagcagctatgttgaactatcagactcagacagcacaggcacaggaagcttatgataatgcaatgaaactcattgaagctggaaaacttctgctttctgatggagaaaaagcaattattgataaagcacagcaaagactttatgttgcttctgctagcctgaaccaatattacactgccttaaagacagctcaggataattattatgatgcattggttaatcctaatcttccgacattagctagcttacaggctgaattgaagttggcacagattgcagttgaaaaggcagaaatcttattggatgagaaaaataatatgttagctttggcagaagactttgatgcagctgcatgggatgataagatcctggatctgaagaagaagaaatctgaatatgaaagtgaaaagagcaaagctgatgttgagatcgctactattaagacttccgcagattataaagctgcagaacaaaaagtagccgaaaagataaaagcgcgtaaagctgctaaagaggcatatgataaagctgtagcagactctacaacacaggttaatactcagcttgatattgcagcttataaatctgaacctattaatgaaggattgaagacattatttagtagtagcaatgattttacatctttagatggatatactgttagtacgggtgtgtttgattatccggctgttcagtatacacaaactgagtacaatgctgatttgaaaatagaagatgtaacagccagaactagtcaggcatctcttactctgatgaaagtaaatgcctggattgatgctttaggtaaatattctgtagacgaaaatggagttgaatggaataagttgactttggcagaaaaagaaaagacagccaaaaatgctaaagaaaaatttgaaaaggataaagctaactgggaaatttctgcaaaagcggtaaaaggtacagcaactacagtgccaactactgatctgaaaaaggcgacagatacttataattcttcttatgccgcagtagaatctgcagtaaaagcttataatagtgcatgggatgccgtatatcaagctgcttatgatgatgctgtagaaaaagaaaaagcttcggtattggagaaaacataccgtgacaatatgattaccgcattgtctcctactagtaaggctgcatgggatgcattgactcctgctgaacaaactaccagtaaactggaagctatattggacgatacagtgaaacaagctaaagcaaaggctgatgctaatgctactttggctgaatggctgaaacttgatcagactgttgctgaattggctgccaaaggtgaagctgcaggaaatcaagctcttgccgatgataaagataagaaagtagaaaaggctaaagctgcattggttaaagctgctggagaggctgctactgctgttgctaaggtggctcctgcaattagtacttattctgctcttgctgctaatccttatggtcagatactggctaatacagttagtgttgaagatatgacaggcaaagatgctttctataaagaagaggaaaaagatggtaagaaaactggccacatgcaggcattacgctctgatatttctgcagatgaatttactaaattaagtgcaactaagttagatcgcaatacagctgaagatgctttagagtatacttctgatgctacttttggtactgtgattcctggcgaagacagacttgttgaagtaacagaagcaatggtccgcgcttatattaagcagaataatagtgctgttttgactgactttggtactttgggagctatgatggctgctaatgacgatgtacagacttgcaaagatatgattgctgctgccgatttgattaaaccattgaaggctcaaatggaaggtgtacttgctgatctgaatgcagaaataaatacgaatactgctttaatggatccgtttattgcaaaagctgacgaaactcgtattgctctgaagactgctaaagaagaggtgaagaaagcacaagaagaacaagatgctttgactgctgaagctgaggccaatagtaagaagtttgctgaattgatccaagattacattggcttgatcagtgttgttcaagatcagattgatggtatcaacggtggtgttgtcactggttctgtggtaactgtagaatctgttctgaattattggaagaatcaagttgctactcaggaaaaatcagttgaagaagctaaacagaaggttactgcagcagaaaagagcattgaactgttcaacaagggtgaatacaaggaagcttatgtaatagaacagaagaaacttgctttggaaacagctcaagaagcttatgatgtagcgaaagcaatctatgatactgctcttgcacaagttaaatccgtattggaaaccttgagtaagtaatttcttaatcacgtaaaagtaacaaaatgataaagaaactatgcacattacttttgctgacctgtataacagctgcgccttcattggcgcagcgttacagcagcagtgatgatgcgtcgtttgctccgaagaaaggacagtggcaggtttcggttttacttggtagcggaaagttcttcaatgagaacacctcttatctgcttcccaagttcaccaacaccgaaggagtcgtcggacttcccaatggaggaacggataactccggtgacctgaaccgctatctgaatatcggtagtctgaataataatagtctggtcaatatagccggaatcgaaggcaagtattttctgtctgacaactgggacatcaatttccagtttagcatgaacatcagcctgactcccaagaaagactatgtagaaggcgacaacagtgtacccgatatgatcatacccgcgcaaagttatatcaatgcgcagatgactaataactggtatacctctgtcggctccaactattacttcaagactcgcaacgaacgtattcatccatacgtaggaggcgcccttggcttccagatggcacgcattgaaactacagaaccatacaccggcgatacctataaggatagcgatgattcggaagaacttccttctcaggtctataccgcaggaagcaaagccggtcagatgtatggtctgaaagtagctgccgtagcaggtatcgagtatagcattgccaaaggatttattttcgggttcgagatgcatcctttagcttatcgctatgatttgatacaaatttgtccgaaaggatttgataagtacaatgtcagtcaccataacatcaagattttcgaaatgcctgtggtgaaacttggcttcagattctgacgaacaatgattatacaaatgtataaatgaaaagtgaaagccgctctgctggtattggcgggcggcttttctttcttttcaagaagaaataaaagtccgatgaatagatgtataagacttttgccctttttcattggggtattagtattgggagcttgctctcaaataaaaggttacagaattgacggtagtgcgcctctgccggaatttgagggtaaaatggtttacatgaaagatgtttcgacggatgcccctgttgacagcgcaaggataataaatggaaagtttgcttttgcagacacgacaaaaatagaaaatccggtcataaagatactttcgatccatgccagtaaaatgggactggaataccgtttgcctgttgtgattgaaaacggtaccataaaagcgagtattgccgatgtcgtttgtacggaaggaacgatgctgaacgaacggatgcaggattttcttctggctatagatgcatattctgctgcttgtacggataagccggtggaacagataaaatccggtttttcggaattactaaagagatatatcgagatgaataatgacaatgtaattggtacttatattcagacggcttaccagtcatcactataatacgataaatattctttttcatttctataataaataagatatacgaatacagagataattaaataaacaagagctcaatcata

SEQ ID NO: 111 - DNA, 25834 bp, Bacteroides thetaiotaomicron
gataaatacagaatataaaatatgaaagaaaataaactggattacatccccgaaccgatggacctttcattggttgaccttcccgaatctttaatccaattatcagagcgcatcgctgaaaatgtacatgaagtgtgggcaaaagcccgtatagatgaaggctggacatatggcgaaaaacgcgatgatatccataaaaagcatccttgtctggtaccttatgatgagttgccggaagaagaaaaagagtacgaccggaatacggctatgaatacgatcaagatggtgaagaaattaggtttcagaatagaaaaggaggattaagttatgaatgctcgttggtttgaccggattatttatggcggggcttggaaacagatacgtttcctgattattatagtcgtttcgctgattgttttatcttgtttgggagtgcactggggaagcaagtatcagatgactccttcggaagagatgactgtgctggctactgactctgcggcgaaccattcttttcagaagaccctgtggaatgtatacaataactttgttgattcgggcaacctgatcagcataagtccggaagaccgcccgtgggcattgattattagtttgctgggttccgtcgttttgggcggattgttgatctccacgctttccaatatcattgaaaggcgggtggaaaattgcagaaacgggttgattcattataaactatctgatcattttgtgatcatcggtgcagatgcaatgttaccctgtctgatacgacagttatgccaacgggagaaggattgcacgttagtcattcagacttccaaagacgtcaatgaagtacggatggaattattttccaatctcacaaaggatgaggagaagagaatcgttttggttcatgccatgagagactctaaagaagaactgaaaaagttgtatgtggcggatgcgaaagaagtctttatattgggagatagcggagagctggatgatgtggaatattatcatgactcgatgaatgtcgactgtctgaatctgataggcgaactttgcaaggaagagaatcggaaacctcctttgaagtgcaacgtactctttgaatatcaatctacttttgctgtcttccaattctcggatattgatgatgatataaaggaatatattgatttctgtccgtttaacttttacgaaacatgggcgcaaaaagtatttgtgcgaaatgcgtgtagtatccgtgagattaattatctgcctctggattatcagcctgtcacttacgaatcagagaaatatgtgcatctggtaattgtgggaatgtcgaggatgggaattgctctggctgtcgaggctgcccatatagcccactatcccaactttatccgggataaaaagaagaaaacgcgcatcacttttatcgataatgaagcaatgcgtgagatgaacagcttcaaacaagcgtatgaaaacctgtttgatgtatcttattctacctttatagatacagaaaacggaatggtccgcagggatgaacctgctgaggtctatgctcatttgggaacagattttatagacatagaatggcagtttgtacagggaactatcgagtcgccggaagtccgtgatttgattacaggctggtgtgaagatgaggatgcgctgatgacggttgcagtctgcctgaacctgactcatcagtctatttcttctgctgtctatctcccgcgttgtgtctatgagaaaggtgttccggtgctggttcagcaacggataacatcggctatcattgaaaaattatccggtaatccgttgaagggaaaaggaggaaccaatcagcgtttcaagaatcttcgtccgttcgggatgttggatgattgtttcgacttgtgcatggcagacgagatgtatgccaagcgtgtaaatgcggtgtatgaaaagtgtgaaggagataaagtcttgacggaactgccatctgcgaaagaaatggatgaactatggcacaatccgaagttcaaaacggtaaagaaatggtctaatatttataatgcgaatgccattcctaccaaattgcgttcaatcggctacaccaaggaacattgggacaacggaaagcaacttagcgaaaagcaggtggcgattttggcagaggtggaacacaaccgatggaatgtggaagaactgttactgggatatagacctgtgacaaaaaaggaacaggaagagatagaacaaaaggcagccttgaagaataaaaagcgggatgaagaatatgctcattatgacattcgcccttacaacgatttgcggaatggcagtgagaaatatgatattgctttgacacggcatctgcttttgattgcgaagccggacgaaaaactataaaatggattaggatttgtgatatggggaatcatcaaaaggaaatattcttagtgctctctatctttctgattggctttcagtgcgtttgggcacaaaccactcagaagggaattgtcatggaaatgagtagcaataacaagcccgtagccggtgctgaaataaaagtagcgggtgcttcgcctacggacagcgatcaggaagggcggtttattctgaatttcaccgcttccttgccgggcgatccgttgatgattaatgatatctataagaaaggtttcaaaatagtcaattacgagaaagtagccaactggaatatatcgtctgcctccgaactgaaaattgtattagggcgtaccgaagtcatcaatgcgttgcgcaagaaatattacgatataggcgaatccaatagcgagaaagaatatcggaaaacattggctgaactggaagaactgaagaaacagaacgcattgtccgcagtggaatatgatcagaaagttgattccatgtctaaaagtatgatggaatggcagaaacgtctggaaatatatgcgcttaaatttgcctgcatcaatcgtgacgagcttgatgctatggaaaagcaggcaatggaactgctcgatcatggtgatgtgcatggagctattcgtctttatgaagagatgaaacttgattctaccatgacattgaagattgcagtcagacaggaagccaaagaagatatgaaactgcttcttccatccttagtgaataatttccagttgctgaagcaagccgatgataaagtggcgtgtgactctgttgctcacttgatttatgagatggcggcggatatcaagctgaaattaatgtcggtagagtggttctttcagcggaatgacccaagtgaagttctggatcagtatagcttgatcgtaaaggatacgcaaagtatgcaagagattgagctggtggagaatagccttcagcagtcattgaaagaagtaaaactgaaaggagaactgaagaaaaaggcacagttggttttcgaacgaatcgaagaccgaaagaaatggatcagtataaaggaaaaaatatagaaacagatgaagaagatcaagatttttattgcatcatcggcggagttgaatgaagacaaacagatgtttgacttgtacttttcggataagaataaactttatcgtgaccggaatatagacttcgatcagcgtacgtggatggacttcagcagttcgctgaatgaaggtcgtctgcaggatcgctataatgactatatccgcgaatgtgatattgtgatttttctgttccacacacggatggggcgctataccaaagaagaactggaagtggcccatgaaatatatctgaagactaaggctgcaaaacctaaaatatttgtctatttcaaggaggagggaatcgttgatgagtctctcaaagattttaaatcttattgcgagaagaatctcggacacttctgcgacttgtataccaattatgatgatttgcgtctcaagttcgacaaacaattgcagattttggagaatgaaggctttatcaagcccgatccggtagatgtgaaacggacattgaggttcgtattattgtatgtccttgtacctgtactggtggtggcactggctttctttgctttctattattattcgccggtcacttccacggtgcgtcttacggatacttccaagtcttctttgcctttttatggcgctgatataacattggagtatgccgataagagcgaaacccgtcatgtggacagactttctgacgaggttgtcttcaaagaaattcacactaaatatctgggtgagaatgcccgtcttaagatagaatcgaaaggatatgtgacggtagatacggtactgagcctggaaaagaatgtgactcttggcatcagtcgtgattcttcattggcgatgattttcggtactgtgaaagatgaggataaccgtccgctggcggatgctactgttcaagtgctggacatgaaaacggtgtctgacggaatgggaaacttccaactgcccatacctgccgagaaacaaaaagaggagcaacgggtgacggtatacaaggatggatatcaattatgggacttcaccggaccggtatccgataaagtctcatggaagattattctgagaaagtaatgcctttactttctgtaaatgctattattgttggtccggtagtcattgataaggtagagcagaacggcatcgttaggcagcgtgccgctcttatactccagaccagtttttaataattcctcggagccgggctgagataatttggccagaaggtctcctttggcaaaccggacaacaagagggtaggagctgaaaagctgattgagttctttcagttcgtttgcgatgttttccgcctcttgcagaaatttcagagcctctgcattattgctgttctgatagtaggcgatacttgtattgagagtcatcagtagatagttcgtgccaagttgggctttattatgcggatacagtgtcttgatgatttcgtatgctttcttttgtacttccagtgctttggcatattttttaagtttgccgtatcccaacgacaggttattgtaggtagtggtgatactgcccatcatatccacgtcgttcggcttttgtttcaggtgcttttccctgtctttctttactttttccagatgttccactcctaattcatacagtcctccgcagaccattgcggtacctatgctgttctctgttctcaagtcctgaaatccccatactccttgcatggtgtataatgcttccaggtcgatggcggctttcagagctttgtcatgttcggaaagttccaggagcatatcgatatacgatgcctgcgcactgataatctcaagaacaaatcttgccggattcaactgattcagtttttcggcatattggtaagcttgttccacatgcttcctttcttcgggtttgtttccgtttttggagtaatatagaatgtattgtttctcaatattgtacaataatgaggtcttttgttcttcgctgttgattttgaattcgttggctaccttgtcttcaaatgcttttatggtcgtgaggaagttttccggttctgtttctgtgcttacgctgatgtaggcgaagttccataaagcataccagtaggcacgggacaagggacgcatcttatacagtttctcggcttttgccagaatctcttttatactgccggctgccagtttgtaatccgctttctctactgcctgatggaatagggattcctgccttcctatttcagcttcgagtatggcctcttcattatctcctgcattctttttatttagctcgaataatttctctgacagttcgttgaccttagatacattgccttccttcttgtaaatgtctgtcagcgaactgtatatgttggcaagctgagaactttgaatatttatgaacagctgattgtcgctgtctgctatctcttcactgatttctttgatctggtcttcatagatttcctttgcttctttgaattcgttcatggcttcgtatgtctttcccattgaatagaacgtctgatggtagatagcatagtaatcgcccgaaggcatggagatatttttgttggacaggatttccagtgcgttgatgtcatactccaaggctttgatatagtctttctgatgatgacgtgcaagggtactttttatgttcagtacttgtacgagagatttctcgtcaaatgaaagtttctggcatttgtccagccattccatggtatcactgtcttctagtcctattttctgcaatgcgtatttaaacacgtatgtaaacctgtcgggaagtgcttcggctacgaacttgtaggcatcatttgctttcttctcgttttccattcctccggtcagggcgcagaggtcggcatatcggtacattatttcggccagtttgtcgatgtcttcctctgcttttgttttctgtgacagcttctctctggcttgagtgataattccggatttattgtatagctcgatggcttcagacagttttccggcattgaccagttccaatacttgcttctcgatggtgttgatgtcatccggatttattctcgcaaacttctcagcatactggtcgatctgattcatgaatgatctggattcttccgccatcgctttcaagcggtcgctacgctcttgcagactgattttctgtgctatatatagctggttgatttcttcaatggctttttcttgttttttcgaaaagtgggcaacggagatggaataatacttgttcttgctttcttctatagtaccttcgggagccattacaatgctcagcggacgtttttcggatagaatccacccgttgatcatgtctttattcaccagttcatatcctttcttatatacattcggagaagcgatagccattcccggtttctgtttgctgaagttgaactggaaattcccgctggcatccgtatcggtggcaggggcatcggtagctgttagttgtactcccggtagtggggacttatttgaattaaaaatctgtactgtacctttttgagacatttgtgcgtaagcacttccggatagtaataagaatatccagaaacaagcgtttttggttttcatagcttttatttcttaatgatgtatatgcaagtcaacaaaaggaatgtggagggagaaagtaatcgggactgactaaaaagtctgaaagctgattatatcctttttagtcggccccgggtatattggcagggagtcaggatcagttgtgtactactgttcctatttcttctccgctgattacttttttgaggtttcctaccgtgtccatgtcaaaaacaacaatcggcaggttgttttccttgcacatacaggtagctgtgaggtccatcactttcagaccgcgtttcagtacttcatcgtatgtgatgtcactgaattttgtagctgtagggtctttctccgggtcggctgtgtagatgccgtctacgcgggtacctttcagcattacgtctgcttcgatttcgatgccgcgcagtgaagagccagtgtctgtggtaaagaaaggatttcccgtaccgccggacatgataacgatttcaccgttttccatgcattcaatcgctttccatttgctgtagaattcaccgatcggctccatgcggactgctgtaagtacacgggcctttactccggctgctactaatgcggaacttaatgcaaggctgttgatgacagttgccagcatacccatctgatcacctttcacacggtcgaagcccttgttggctccgcttagtccacggaagatatttccgccgccgataacgatgccgatttgtactccctgttcatggatttctttgatttgtgcggcatattccgccagtcttttttcgtcaatgccgtattgtttttcccccatcaggctttctccgctgagcttcagcagaattcttttatactttgccatatctttttacatttagtttagcgcaaatatagagataatttgttggatagacctcatagttgcgcgataacttttatatcgctttcttcactatttctcttccgatgaaggtctgcacgattcccctcaatgaaaggtaagtgatgaaagccagccataaagcgtgatttcccaagagattgtggaaggcatagtagatcataaaaaagctgacggaagcaaccaacatcgaataaagcatctggcgggtggcggtggcgccgataaacacaccatcccataagaaagcggagaaacctgtcaatgggatggcgagtgcccaataaaagtaagtgtctgaggagcttattaccgaaacatcatttgtcagtaacccgagaaattcttttccgcctattgcatataaaagggtgaatgctgccgaaagtccgatgccccaatagaaaaggtgattgaccgtattgcggagagccgtttgatttcttgcgccgatatagcgtccggctaacgcttcccctgcataggcgaatccatccataatataagagaagagcgtgaacaattgcatcagcagtgtatttactgccagaacgacttctccctgtgcagctcctgcagaggtgaagaacatcgttacgattaccaggcagagggtacggaaaaagatgtcacggtttacccggaagaaacggtacattgcctgcttctgtatgatatctttccatacaatacgttttcggagcgtgctgtaataacgcatatacaatagtatggccataaagaaacctgcatactgtgcgataagggttccggcggcgactcctgccactttcatatccaagagatagacgaaagacaaactggcgataatattgacaatattctgcgtgatggcaatatacatcgggaagcgtgagttctgcattccgataaaccagcctgcaaatccataaagacctagcattgccggagctccccaaatacagatatagaaataggtagttgccagttgctttacttcttctgtagtctgtatgagtgtgaatgccgcattaaggataggatattgaaggatcagcaggcatagggcaataaagagtccgacgccgacagaacgtatcagtaaccggttgatttcgtttaagtcatgctgcccgtaggcttgtgaggtcatgccgcttgttcccatacgtaggaatccgaagatccagtagatgatattgaacaacattcctcctacggcaatcgctccgatatatgccggagagccgagatgtccaacgatagtgacatcgataagtcccagcaatggcacggtaatattcgaaataatcgatggtacggcaatctgtaatattcgtctgttttcggaggtcgtctttttatttatcatcttgtagaaacacttttatcaaatagattgttctttttgcgaacaaaggtacatattttattattttattgtatctttgcgtgtcacgaactagaaacaatgtaactgattatgaaaaccttaactctccttcttttttctttgttttcgttgccgctgatgctgaatgcacagacggccgatgaaatgttgcataaagtcacggttgctattgaggccggacagcatggacaggcggttagctatttccgtcaggctatcagtctgaatatagaccgctcggaaatgttctactggacgagtatagacaagagtagtgagatcagctcgaaactttctaatgagttggctcttgcctataagaagaatcggaattatgacaaagcctttttgttttataaagaactgtcgcagaaggaccctgataatgtagattatctggaggctgttgccgaaatgcaggtatgtcgtggacaggagaaggatgcgttgcgtatgtacgagaatatattgaagttggatgcggataatctggcggccaatatctttctcggtaattattattatttgatggcggagcaggagaagaaaaaactggaaagtgactacaaaaagctttcttcaccgacaaaaatgcaatatgcacgttatcgggacgggttgtcgaaattgtttgctaccggatatgagaaagcacgaagctctttacagaaagtagtgctacggttcccatcgacggaggctcagaagacgttagataagattttgaggatagagaaagaggtgaatcgctgagcggttcacctctttctatttaataacgggatataataatcttattttatcattcctatacggttcaatcttggtgtagctatcactagcatttgttctttagcttggttaactgcccttgtaggagtagtaacttcatttcctgaaatcagactgattgctttggcatataaaggatcgctttcagctccaaagtctccatatccttcaaaatattctccgttaggcttgttctcatttatctcgtaatcgggtgtaaaaccgttctcgaagtctccaaaacctttggcattgtatgcttggaaagtgatagggaaaagcaaatatttgtctgttcctgcagtaagttctactccttccattcctacatttttcccatgtgtggtggtgccaataaggataacttcgatatcaatacctctcagtgcattgattactaattcacttgcagatgcagagtcgtcagtaacaagacagtagatttttcgtaaatttaaaccaccggcagagagggaagtactcaaattatcatattgagaatatgcgaatttctgaataggccgttggttgccaaggaccttcatgcgttcatcgttatatcggtatgaagcgaatgttttatctatgcataaatctccggcaatgcagctggatataagattagccgatgttacatctcctccgccattgtagcgaagatctaaaattagctctgtaatattctgacttttaaactctttgaatacatcgaatagttcttggtcgaagccggactcaaaagctgaatacaccagatagccgatcttttcgtttacttggtggtgaattatcgggttcgcataaataggtccggaatttattgtatatacttttccatctttgtcttttacttttatagaggttggagaggatggtttaattaatttagagtaacaagcttgcacgttagtcgttgttattctctgattgtctatttcggttatttccattcctcgttttagtccttctttatcagcagatgatcctttatgcactccttgtataacaagaccataatttgaattattacggtttccaacggctataaagtttacgaatccataattatactctagtgtttttttctcttttgcactgcgggaagtttgtaaatccggatctagcttctggataaatgaaaacaatgaataagtgccattactatttcgttttttgtctaatgtattagttgtcatgcttaataatgtgtttctcaaaaactcatcataagcttgtctgaaattgggcgttaataacttataatcatcattccataagtatttttctctcaaatattgatccacactatagtttatctcataaccttgcacatcatcatcgctcaactggattttgatattgctggcagatgaatatccatttactttaatcgtaatggtgccctgttcctgggaagacttgtgtactgtaacttttatggtattttcccctgaatttcctgcggtattgtctaatgacaataatgcagtggaactgttttgagcagtccagctagacaaggttgtgaaagtaaaagtgagggtttgctctgctgaggcaaaatatgtttggttagtagaccagctttgttctgtaattccactacctcgcagtagagtgtcatcatctttacatgatatgttgaggaataataaaatggtcagaagaccaactaacttgacatactgtattttcttcataaaattaaaggtgtttttttatatagcaaactcaaaggtaatgttttattgtttagaatgtatgtgttatatcaataaatattctacctctttaaacatatatcctctttttttctgcgcatcatcttccagaatcagcttcccttcgggttctacgcaaataattctcgcaaagaactctccatcagcatctttataccgatgcatcccttcttttctgaaaagagctttttcatatcggtgggctatgggttcagtatcaccgttccggagcaattcataaccggattgaatgcggagcatgatattcttgagaatttcgaaaatgtcatactgctttcctgtgatttgccggagcgataccggatttggagcagtactatggaatacttcctgattcacattgatcccgattccggaaatactctgactgatattgcgtcccatcaaatcattttcgatcagcatcccacatatttttttgtctttccagtagatatcattcggccatttgatggaaaaatcgtcagcatagctatctagttcctctttaatagccaaagacacaatctgagaaatcaagaactgccggcgtgcttccaagaaatccgggaaaagaacaaaactgaaaagaagattctttttgggttcagattcccacgaattgccacgttgcccacgtccggatgtctggaagtcggcaactacagtcgtaaatgctgcaactccctgttgcttggcacaaagagtctgcagataactgtttgtagagtttgtctcactgatgtgaatcaatgggacaggaaatgacatatcaggggagggcatcatattcagcacgcagtttcttagtgaatttcttgataacttcctcgtaagaatgatcgacgagttcctttattaatttatcgtctacatctctatcgaagtaaacgccattccaatattttttgttgaaatggtaggctccttcaatgcctgcataatgttcgcgcagttcaatggcacgttccggatcgcatttcagtgagatggagttggctccttccaagtcgatgagggcaaacattttgtccagcaccttcataaccagcgatacatcatcaaacgggaatgattcggtaaccccttttttacttaagcagtattccctgatcgtttctacattcataagtctttcgattttatgtttttgctcttagttaaaatacttgtttcctattaaaataaaggaggataaaaagcttcctttatatggtctattctgaaatttccgttctcgccaatgacagtgatgatatcgaaacgtaccggaacgtcaatctgaaatagtttcatatatgcgtcggcagcacgtactgtccgtttaatctttggtaaatcgacggcttcttccggttgggcaaacaaagtgttactgcgtgttttcacttctactatcaccaattcgttctctttggcggctacgatgtccagttcgaagtgaccttttctccagttccggtggcggataagataaccatgctcttcgagataggctactgcggcattttctcctgctttccctaattcattgtgttcagccatctttttttgcaaatttacagcttttattctttgtttttacagaagtaaaagtaattttgcagaagatatgagaaaaaggagcaaaaagtgcctgaaaatgcacgctgagtataccaaacgggaacggcggatgagcattttgttgagcgaagacgagcagttgattgtcgatcgttatctggaaaaatacaagataacgaataagtcacgctggcttcgcgaaaccattctcatgtttatccataaaaatatggaagaagattatcctaccctcttcggagaacatgacatgagacgctgatgatgacgctggacgatacttacttcatgaaacaggcattgatagaagccggcaaggctgcagagcggggcgaagtccctgtaggggcagtggttgtctgcaaagaacggatcatagcccgtgcccataacctgacagaaacattgaatgatgtgacagcccatgctgaaatgcaggctatcactgctgccgccaatgtacttggcggaaagtacctgaacgaatgtacgttgtatgttacagtagaaccctgtgtgatgtgtgccggtgccattgcttgggctcagaccggcaaactggtttttggtgcggaagatgataagcgtgggtatcagcgatatgcggctcaggcgctgcatcctaaaacggtcgttgtaaaaggaatccttgcagatgaatgtgccacattgatgaaggactttttcgcttctaagagaagatgaaacagtgattagtaagttgctgactacacgttactaaccactttctatattatattattttacttcctcgaaatccacatattcaccgtcatcctgagtgaatattttcttatgtttggttcttggactgttttcagcaaagatttccccttcgttatcggcacggctgtccgtgttctggttatagctgggacgaccttgctgctggccattttgtccactccttgcctgcttcgtccgggaagacgaaccacggccaagcccgaaaatggctcttaatacaaatccgacaatcgaaaggccaaatatgacaatggcagctagaaaaagaagtaagaataaaagtatatgcattgggctatgattttatgttgtaacttcgataaaactcatagtacaacaaacgtgccaagagattgtttatttactttttcttgtaaaaagtgaaagtaaaatataccagacaatgatcgctgcgaagctgctgatacctaagaaaacaaggaatgggatacatacaatcaagaaaatgaaactgattttatttgtattccatgaaagattcttgaatttcagcgagaacattggtatctctgacaccagcaaccacgaaaacagacaaaccaataaaataaggtagacaggatggcagttctcggaaacgaggaagtcatgcgcccctactacgaacgatccccagaataaggcgtttgccggaacaggaagacctacgaaagaactggtctgccgggtatcattattgaatttagccagtcgtaacgctgagaatacggaaatcaaaaaggctgcgtatggcaggtaaggagcaagaaattccatatttgccggatagtacatctctttaaataaggagaatacaatcagtgagggagccacaccgaagctgacatcatctgcaagtgaatccaagtcttttccgatgattgagtgtgcattgagaatacgagccagcatgccatcgaaaaaatcgaagactgcactcagaacaataaaaagcagtgctaggtcataacgggcttcgaaagccatgacacaagcgatacaaccggagaaaaggttcaggcaggttactgtattcggaatattgttctttataacatttgtcattgtgaccgaattatttaagtttggcgataaccgtctggttaccggtcgttaattgtcccatgttgacacagacttccgtgccgaggggcagatatacatccacacgggaaccgaatttgataaagcccatgtgttcgtcgatatagcattcttctcctacttctgcgtaggtgacaatgcgtcgtgccacggctccggcgatttgtcgggtcagcacttccactccttccggagtttctatgactacggtagaacgttcgttctccgtactggctttaggcaaccatgctttcatgaagttaccgttgtggtgggctacctttttaatggtgccgtccaccggataccagttggcatgtacgttaacgatgctcatgaagatagagatcatcaaccggcggtcatggaagtattcgttttcgtccacttcttcaatgactacgattttgccgtcagcaggagcgacgactatcttttctgtatcctttccgaaaagtcggatcggacagcggaagaagttaaccatcagcagatatactgcaatactggctactgcaaccacataaaaaggaattttgcaatctattccccaataaagggccgcattaatcagtagcagtagcagaaagctagcccataatatatgtgttccttcgcggtgaatacgtatcttttttaatttctttagtcggcccatgaatgctgtttaatgatattgtgtgcaaaaatatacttattttaaaaaaacagcaagtaaatgagcagagaaatgcgagtgttgataactttttgaggattatttttgtttataacgcgggaggtagtaattttatgccttcaaattaactacttatcattatgcaggatttcgttcatttacacgttcatacgcaatattctctactggatggtcaggcaagtgtcgcccgtctggtagataaagccatgaaaaatgggatgaagggtattgccgtgaccgatcatggaaatatgttcggcatcaaggaatttacgaactatgtcaataagaagaatagcggtccgaaaggggaaattaaggatctgaaaaagcggattgcagggattgaagccggcacagtggagtgtgaggataaggaggcggaggtagctgcctgcaaggcgaagatcgtggaggcggagaacaagctctttaaaccgattatcggttgtgagatgtacgtcgcccgccgtacgatggacttgaaagaagggaagccggaccaaagcggttatcacttgattgtacttgccaagaatgagaaaggttatcataaccttattaaattagtatcgcacgcgtggacgcgcgggtactatatgcgtccgcgtaccgaccgcagtgagctggagaagtatcacgaaggtctgattgtctgctcggcgtgtctgggtggcgaggtgccgaagcgtattaccgcagggcagtttgccgaagccgaagaagcgatccaatggtataagaacctgtttggtgatgactactatctggaaatgcagcgccataaggcgactgtaccccgtgccaatcacgaatgttatccgctacaggtaaatgtgaacaaatacttgcaggagtatgcccggaagtataatatcaagctgatctgcaccaatgacgtccactttgtggatgaagagaatgccgaggcacacgaccgtttgatctgcctgagtacgggtaaagacttggatgaccccagccgtatgctatataccaaacaggaatggatgaagacccgtgaagagatgaatgaactctttgcagatgttcccgaggcactgagcaatacgctggaaattctagataaagtcgaatattattcgattgaccatgcacctatcatgcctaccttcgctattcctgaagacttcggaacagaagaaggatatcgtgccaaatatacggagaaagacctgttcgatgagtttacacaggacgaaaatggtaatgtggtgctgagcgaagaggaaggacaagccaagatcaaacgtttggggggatatgagaaactgtatcgtatcaaacttgaaggcgactatctggcaaagttagcatttgacggtgcgaaaagaatatatggcgaccctttgtcggaagaagtgaaagaacggctcaacttcgagttgtacatcatgaaaacgatgggtttccccggatacttcttgatagtgcaggactttatcaatgccgcacgctcggaactgggcgtatcggtaggccccggacgtggttcggctgccggttcggcagtggcttactgtctgggtatcaccaagatcgaccctatccaatacgacttgctgttcgagcgtttcttgaatccggaccgtatttcgttgcccgatatcgatgtggacttcgatgacgacggtcgtggtgaagtgcttcgctgggtaaccaataaatatggtcaggaaaaagtagcgcatatcatcacgtatggtacgatggctaccaaactggctatcaaagacgttgcccgtgtacagaaacttcctctctcggagtccgaccgtctggcaaagctggtgccggataaaatccccgacaagaagctgaacctgcggaatgccatcgaatacgtccccgaactgcaagcggctgaggcatcgtccgacccgttggtgcgagacactcttaagtatgccaaaatgcttgaaggtaatgttcgtggtaccggtgtgcatgcctgcggtacgattatctgtcgtgacgacatcaccgactgggtgcctgtaagtacagccgacgataaggaaacgggcgaaaagatgctcgttacccagtatgaaggttcggtgatcgaggataccggattgatcaagatggacttcctcgggttgaaaacattgtctattattaaggaggcagttgagaatatccgtctgagtcgtagtctggagatagacgtagaccagatcgatattaccgatccggcaacttacaaattatatagtgacggacgtaccatcggaacgttccagtttgaatctgccggaatgcagaagtacctgcgcgaattgcagccttctaccttcgaagatttgatcgccatgaatgccctctatcgtccgggtccgatggattatattccggacttcatcgaccgtaagcatggtcgtaagccgattgaatatgacattccggtgatggagaaatatctgaaagatacgtatggcattacggtctatcaggaacaggtgatgcttttgtcacgtctgctggcggattttacccgtggtgagtccgatgcccttcgtaaagcgatgggtaagaagctgcgtgataagctggatcacatgaagcctaagtttatcgaaggcggacgcaagaacgggcatgacccgaaagtacttgaaaagatttggaccgactgggaaaagtttgcctcttatgcgttcaacaaatcgcacgctacttgctactcatgggtagcttatcagacagcctatctgaaagcgaactacccgtcggaatacatggcggctgtcatgagccgaagtttgtccaacattaccgatatcacgaagctgatggacgaatgcaaggcaatgggtatccagacgctcggtccggatgtgaatgagagtaacctgaagtttacggtcaaccacgatggtaatatccgtttcggactgggagcggtgaaaggcgtaggcgaagctgccgtgcaaagcattgtagaagaacgtaataccaacggaccattcaaaggtatctttgatttcgtacaacgtgtcaatctgaatgcctgcaataaaaagaatatggaatgtctggcgttggcgggaggtttcgacagtttccccgaattgaagcgggagcagtactttgccgtcaactctaagggcgaagtattcctcgaaaccttaatgcgatacggtaaccgctatcaggaagacaaaagagctgccatcaattcattgttcggcggagcgaatgtcgtcgatatcgccactcccgaaattcctcagggagtagagcgctggggcgacctcgaacgtctgaacaaggaacgcgacctggtaggtatctacctttccgcccatccgctggatgagttcgcgattgtgctggatcacgtctgcaatacccgtatggcagatttggaagataaggcggctttggcaggccgggagattacaatgggtggcattgtgaccagtgtccgtcgtggagtcagcaagaatggcaatccgtatggcattgccaagatcgaagattattcgggctctacggaaatacctttctggggaaatgactgggtgacttatcagggatatctgaatgaaggcacgttcctgtatatcaaagcccgttgtcaggccaagcaatggcggcaggacgaactggaagtcaagatcacttcaatggaacttctgcccgatgtgaaagaagaactggtgcagaagatcaccattatcattcctctgtcagtgttaaattcgggacttattaccgagctggccactttgaccaaagaacatcccggcaatacggaactctacttcaaggtgacggatgatacggacagccgtatgtcggtcgatctgatttcccgtccggtcaagctttcggtaggcagagatttaataacatatttaaaggagcgccccgaacttggattccgtataaattgattatctttgtagcgcaaatctacaaacgaagtaatacataataattaatacttaatacttaaaaagaaatggctttagaaattacagacagcaactataaggaaatccttgcagaaggaaagcctgttgtggtggatttttgggctccctggtgtggcccttgtaaaatggtggctcctattattgaagaattggccgcggagtttgaaggacaagtcatcatcggtaaatgcgatgtggatgataacagcgatgtggctgccgaatacggtatccgcaacattcctactgttttgttcttcaagaatggtgagattgtagacaagcaggtaggcgcagtcgccaaaccggtattcgtggaaaaagtgaagaaccttctctagactttgtctaatatttaatacttattacttaatacttacaaccatgggactggaagatgattttttattagaagatgccgatgacgaaaagaccgtcgagtttatcaagaactatctgcctcaggaactgaaagagaagttcgaggacgatgaactgtactattttctcgatctgatagacgagtactattcagaaagtggcattctcgacgctcagcccgataacgacggctacgtaaacattgacttggaagaggtcgtagcttacatcgtgaaagaagccaagaaggacgaaatgggagaatatgatcccgaagaaatcctttttgtggttcagggagaaatggaatatggaaactctctggggcaggtggactaattgtcgctagtcaccactgtagataaatgaaaggaatatagcctgaaagattcgcgtctttcaggctatttctttttccatccttatgctttcgctctccggtatttcctgccaagtacattcgctgcaaatcccttgaataaaaactgttttctctttgctatatgacaaacgctcagaactcctgtgagaataccgatttggtaatgcagtaatcccatcggagaattggctccttcaataccgaacagtgatagtcctgtaataatgaccaataagaaaacaacagacaaggataacacgacttttcttttgcctttgcagccgattgttttcaagcctttataccatccccaatggcttttgacatgaactattcccaatatcatgaatagcaggctggcattaacatggaacacggcccagttatgccatatttcatggttgtcaccctgtcctgcgatatgtaattcgacgcctgtgtaaaacgacaaaatgaatatgggaactaacattaaatctgtgagataaataaatctgtttctgctcatcttttttgatggcaaaattacaacgaactgattaatagtgaaatagacgatgtgaggttaaagttgtactattcaaggtatttctttcgataggaggtcgggttgacgcctaccgctttggtgaacaatcgggtgaagtatgcataatcctctattcccaagtcaatggaaatctctcttacgtttaaggaagtgtataccagcattcgcttggctctcaatattaattcattctgaatatatttgctcacactttcgcctgtgacatttttaaccacttcattcaggtataccggtgagatgtgtaatgcttccgcataataagatacacttctgtttagttgtttttcttctgaaaacagtgctttgagcgctaatgtgatttcaatatgccttctgttcttgtggttttgtcctatatacttctgaatgttgtctgtaatgatgccgacaatggcacatgataaattctgtatgacggctttcgatttgcaatcaggattccccccgttcattcttcgcagaatcatggagaataattggcccaaatcagtatattgtatgtcgtttatcttaaacggtacgggcgataatacatattcggcaatgatttgcttggttggagtatctataaacactccgtctataaaaagaagaagaacgtctgcgtttcctgtatcaatgatatggtgaacttggttgggctgggtacagacaacgtcacctgccgagaaaacatactctttgaaatcgatgcttacatgacacgtaccgcttttcactacgcccaaaatgtaataatcatctcggtgtacgtaattaatcgtccgattcggggaaaagggagatacttcctttgcaaatattccaaaatcagattgttgaacagctttatgtgtagggatacctgtcattcatttttttgcaaagttagtgaaaacagttgagaatacagtttatgcaatatggcaatcttattctatcgcttattaaaactcatgcggaaaatagtttcggggctttcggatttttagtatctttgttcgttgttttattgcgtatcacttaagtaagataatcaaattacttaagtgatataattgtcttacttaagtaatctattcgtctcacttaagtaatacgaaagaatgtagccaacaaacaactaattacttaaatagaaaccattaagttattaacagccaaacataaaattattcttatgagcatttattacgacctttatgaaaatcccaaacaagaggatgctgaagaacagaagttgctacacgcacgggtagtgccaagcggaacatatacaaccaaagaatttgtggagcgggtgtccatgatgcatcatattccccatgcgcaattagttggagcggtagaggctatcaccgatgagttacagacactgctgtccagaggatatattgtggaatttggagatttagggcatttttctttgaccctttctttggaaaaagagattattgacagaaaagaagtacgctctccatctattcgcctgaaaaatattaagctgaaggtaaaacaaacatataagagagaactgaactctaaaatggatctagaacgaatatcttccccgacacgttccaatgcgaaaatatccgaagacgagtgcttgaaaaaattgcaggactttttagagaaacatccttgtatcaatcgggcagattattgtgctattaccgggatgagtagattacaggctttgcatcaattgaatcttttcatagaaaaaggaattattcagaaatatggaaatgggaagacggtagtgtatatacgtgttgtgtgagttcttattttagatttcctccaacgcataatactgataatcccgaagtaccgtttgaagaaacttctcctgattattctctcgtggagtaacagataagatttcctgcacctttttggcgagtaacgtaacgcgccttacccgatccttttcaccggattccagcgttcgggtgattacgttcacctgttccaatgataaatcggcagattgtggatacgtcggatgataattcttggtcaggtaatcaaattcatcaaggctgacgtgtatcttgcgataattcttttctttgatcaccatcgttccggctgctaaatcacccagccgctgactgtttttagtcagcagaacgactaaaagtcctaaacctcccgtgccgggaccgtcaatgatgaagagaagccagcgcagcagataagcactgatgctgggagtagaaccgtctgattttacgacgcgtatattcatcagacgttttccaaaactctgcccgtggttgaacatttcgcagaggaacgagtaaagaagtacaggcaaatagacgaggcacagaataaagaccgtaccgactccggaggataaatgcagtttaacaatgagtgtcgtcacagaatatagataaatcacaatcagggaataatcgatggccaaagccagcaatcgttcgccgatactggcgggcgtttggctgattcgaacaaactgaccggtaataatcgtagattctgccattcttggttaaacatttttaggtttaagttgcaaatatattataattcttttacttttgcttctgctctcaaacaaaacttattcgaaatctattaaaagtgatgaatgtaaactatgtctatggaatcatcttcctgtttttaacatcttgcctttctcccacagatagggtaattccttctttattgcatgcagattctttgatagaagttggatgtgcagatagtgcattgagtatattggaaggtgtgaatcttgcagagttgtctactatacagtctagagctaagtatgccctattgttaacacaagccaaagataagaactatattactcatacggatgattcgttaattcgtgtcgctgtagattattatgatacttccgatgatattaccctacgggcaaaagctcattattatcttggacgagtttgtcaagacagaggtgatattgaaggaactgtacgtgaatttttggtggcaatgcctttagctgagaaagtggataattatgatttgaatattctattgaaaagtaatttgggtttattgttttggcagcatggattgcaggaagaggctgattctctttatagacagactattgaattggcagaaacacatcatgattcattgcgtttagccgtagtgctagtaagttgtgcagatatttgcatggagcgaggagaagaatattatacagatgcagaaaaatatttaaaacgagccctaaagctaataaaagatacagataaacaacatattaaggagcttgtgtttagttctcttagttatcttctagaatatcaagggaaatcacgcgaagctatattgtttgcaaataaaggtatgcgattggtgttagacagttctgaaagatatggttactatctagttattgggagtgcttatttgcaattggaacaatatgattcagcctctgtttatttgaatagaggtatatcttctgataattattatgcaaaaacaaatgcatatatgaaattatcagaaatggcaacgaagttggggaaaaaaaatgaagcattggaatacgaaactttatatgctatatataaggattccatgaaattggtcgagcaaccggttgaggtagtttcttctttgaaggatgtgttatatcatcaatcaacggaacgctatgaatcatttttgactcagtatcgtttttgtctattgttacttgtcctattgtttattattacgatttgtttctttttgcaaaggcgtagaaaaaggaaggaagaaatggcacaattagtcaataaacgacaattattgtataaaagtatagagactatcaagaaagagttagagaaaaaaaatatagaaataaaagaaatacagcaacattgtgaatatttagagtcagatgttaactccaaagcacaattagatagttgtcttaatgaactattggaacaataccatttaatgcaagaagatttagaacgtcggcttgtagaaagagatgaggaagtaaagcaattgagaaatctgaatctgaaatttatattaatgtcttctcctgtttatcaaatgttgatagaattgtgtgagtataataaacttaatcctgatggaatgaagaagattactaatgatgaatgggatattttattgcatgaaatagatatggcatctttgggatttgtagaaagattaagcactaaatatgagtatttattggaggaagatattcgtttttgctgtttagttaggttggattttaaatatgccgatattgccagtctttggggatgcacttctgctgccgtatataaaagaagttggtctgtattggagaagatgggtttaaataaagataagaaaataaaattggttgatatattacgcaaaatctaagttattgtattattacattagtgtcccattaaaattgggacgaattaaaaattaaataaacttggcccatttggtccgaatcgttctttgtcattttgaaatttagttttatcaaagaggtctctcagatgagtcttatca

SEQ ID NO: 112 - DNA, 25588 bp, Bacteroides thetaiotaomicron
ataaaaatactctgaatataaggttgtacgccggatggagtatcaaaaaggagcagaccagcccgactacaaaaccggaaagcacttcgcccaaagtgtgatgccccagcacaatccgcgccgaacccaatatgcctgcaatcagaataaacaggcacaaccacactaccggattatagctgaacagcgcactgaacgaaaccagtccgccgataataccgcccatccccgccatgtgttcgctcagtttccatttcagattgaccagaatgcagatgatcgatatcaccagggaaacaaaaatgattccggtcatataccagggaatattcagtttacgcatcatcagcaggcagaacacatacgaaatgatagtcagcaggataggtacataacgtttcttacgctcactcagttcctgacgggcaaacccgttgatcttccggaacaggaaaatggtgatggtgggcgtcagtatggtgaagcagtaaacgattcccaacacaattcccttataaagtatcggcatgatacggagataagaaaacaggaataacaccaaaaacgccagaaacggtatagaaaatggagtaaacacgatggaggtgatccgtgccacccgcaacattgttttatccgctatgatatgctctttttctttatccatcagcacctaatacttaatactttatagttaatactttaaactcactttctcagtcttgccaccggtatattcaactgctgacggtatttcgccaccgtacggcgggcgataggatagcctttttccttcaggatatccgccagttcgtcatctgtcagcggtttctttttgtcttctccgtcaatgcattctttcagaatcttacgtatctcgcgtacggacatttcctctccgtcttccgtcgtatagccatcgctgaagaagaatttaagcggatagatgccgaagttggtctgtacgtatttgctgttgctgacacgggaaatcgtagagatatccagtccggtacgttctgccacatctttgagaatcatcggtttcagcaatgactcgtcgccttcgaggaagaaaggacgttgcaagtcgataatcgcctgcatggtagtcatcaatgtattctgccgctgcttcaccgcatcgataaatccttgtgccgcatccatcttctgtttcaggaacatcatggcttctttcgactctttggactggttcgccttatttttggtatgctcctccaccatctcggtaaagtcgcggctcatccggagttcgggaacattgcggttattcaggcttacgttaatcgttccgtcatcgtaggtatccaccagaaaatcgggaacaatctgctgtaggtttcttccgatggtctctccgagcgaagcgcccggacggggattcaacttggttatttcggcaatcgcctcattgaaagtctcttctctgacatccagtttcttaatgattttctcccagtgcttccgggtaaattcttcataacagtcactgatgatgcgctcttccaggttcaatatcggcgacggcttcttctcttcgctcttcttgcggagaatctgtatcatcagacattcctgaaggttgcgtgctccgatacctgccgggtcaaagtcctgcaggatgcacagagcctcttccagttcttcttccgtagattcgataccggcgtagatagccagttcgtcacagatactttccagcgatttacggagcagtccgtcatcgtccagcgaaccgatcagatattccaccagttcgcattggtgttcggtcaggttacgttcacggagttgttctttcaggatttcataaaaagaggtggcgtcggagaaaggaatatcttccgcctgctcgtcccgcgagcggttgttctcctgcaatttatagtcggggatatcgtcttcggtgagataatcacttaaagaatcataatcattggcatcgttatccatgccttcttccggactgacgccaccggcatattcatctgtagcagcgtcttctttgccttcttcaagcgccggattttccaatagttcagcatggatacggtcttccagctcaactgcgggaagctccaacaacttcacgaccagaatctgctgtggcgatagcgtttgtatctgctgttgcgcctgcgattgtatttgacgggaaccttgtgccatattcgtttttgctttctactgtttctcgctacaaaagtaactttttaacgagagattacacagattagtgggattatttttaatcctataacacaaaattctttatctttgttgcacgaacttaaaaattaggacagtatgtttgccaaagagacgtatatgcagcgcagagccctgctgaaaaagaatttaggctccggagttttgttatttctgggaaatgacgagtgcgggctgaattatgaggataacacgttccgttatcgtcaggactccacttttctttattatttcggtctttcgtgtgccggactttcggccatcatcgatattgacgaagacaaagaaattattttcggtgacgaattatccatcgatgccatcgtatggatgggctcgcagcctacgttacgcgaaaaatgcgaacgcgtcggcatcagggaaatgatggcttccgccgatatcgtcggctatctgcacaaatgcgtccagagtggaaaagcaattcattatcttcctccctaccgccccgaacataaactgaaactgatggactggctgggtataccacctgcacgtcaggaaggttccgtacctttcatccgtgccgtcatagctcagcgcaattacaagtcggcggaagaaatcgtagaaatagaaaaagcctgtgacgtgactgccgatatgcacatcaccgccatgaaggtgcttcgtccgggaatgtacgaatatgaagtagtagcggaaatgaaccgcgtggcagagtccaacaactgcgaactgtcgtttgcaacgatcgccaccatcaacgggcagacgctgcacaaccattatcacggaaataaagtgaaaccgggcgatctgttcctgattgacgcaggcgcggaagtcgagtcgggttatgcaggcgatatgtcgtccacgattcctgcggataagaaatttacaactcgccagcgcgaagtttacgaaattcagaatgcgatgcatctggaatctgtcaaggcgcttcgtccgggcattccttatatggatgtatacgaactgtccgcccgtgtcatggtagacggaatgaaaaatctaggactaatgaaaggaaatacggaagatgctgtccgcgaaggcgcgcatgccctgttctatccgcacggattaggacacatgatgggactggatgttcacgatatggaaaatctgggtgagatatgggtaggatacaacggtcagccgaagagcacgcagttcggacgcaagtcacaacgcctcgccattccactggaaccgggattcgtacataccgtagaaccgggcatttacttcatccccgaactgattgatatgtggagagcagaaaagaagttcaccgattttatcaattacgacaaagtggaaacttacaaagacttcggcggtatccgtaacgaagaagattatctcatcacggagacaggtgcccgccgactcggcaagaaaattccgctgacacccgaagaagtggaagctttaagataacccctgctttaaaggataaggcaccggaattcacataaaacgataaatgcctgtactacaacaagtataggcatttattatttcaaggggacggtcatatttttaagtattagtgtcaaaattcttatgtctatgcaggacaataagcactatatttgcaagtatcccccatcataacaaactattaatactttaaactaatggcacgaactactttgttacttttatctattctttttctgctacccacgaatgcagcaatcaaaaaactacaggttgaatatctgaccaatccgatcgggctggacataacagctccccgattcagttggcaactagcgtcagcggaaagaggagtcagacaaacagcctatcaaatcacggtagcgaccgatgcagcctgtctaaatccggtctggacttccggaaaggtggcatctgacgaatcattgcacatctgttatgcaggaccggctctcaccccttccacccgctattattggaaagtaaccgtgtggaacaacaaaaccggagaagagacttcgacggaaaaggctttcttcgaaacaggactactgtccgacggatggtcgggagcgcaatggatcaaggcgactcaaataaacaagaattccaaaatcaatccggaagacaagaaacagacaaaggcacgaatgctgctggaaatggatgtcaccctgacttccggtaacgcatccgttcttttcggcgcacgcgatgcttccaacgtgttcatgtggtctgtcaatacgctggacaatgaaaaagaacctttgatcagaagacatatttatgacggaggacgcttgcaaagttcggatactccgattggcaaattcttcaccaaatccgacttgctgaataaagaacaccatctggcaatcgaagcaaaagatggagtggtcaagacttatattgacaaggtactggtggatacctataccgacaccgattccaaactatcgaacggatatatcggcttccgggcattcagagggaataacaccaacgaaacggccatgtttgacaatatcgtactgacagagtacgaacagaaaggcgacaaggaagaagccaaagttgttctgaaagaggatttcgaaaaacctcagtccacctttgaagaaggagaaatcgtaactgtgggaggtaatcgtaaactgaatatggtttccacttccggcgactatcgggtattgcaggcttctatgagcagagtacccatgttccgtaaagaattcaaggcaaaaaagaagatagcatccgcccgcatctacagttcggctctgggcgtctatgatttgtttatcaacggacaacgggtaggaaacaagatggaagacggcagcatacgctatgacgaattgaagccggaatggacggatttcagcaaaacagcccactatcagacgtatgacatcaccgatttgctccggaaaggagaaaacgcagtcggcgcccaggtatcctccggctggtggaacagtgatgtcgctcatggagagtatggcgccaacgaagtaggattcatcgcaaagattttactgaaatatacggacggcacttcggaaacggtagtaacggacctttcctggctgtcatccatggacggtgccatacgaatgggagacatctaccacggagaaacctatgacgcccgaaaagaaagtgtatggacgaagcccggatataataccgccaactggaacaagacggctgtcaaccctcacttcaaaggagagttaatcgcctttgccggccccaccgttcaggtacgtccgcatctgagccgtatccctttgtctactaccgtttaccaaggtgaaaaagatggtaaaatcaatgtactgagtgttacggacaaaccgactcctatccgcttaaagaaaggtgaaacggccgtctacaacttaggtcagaacatggtcggctgggttcggttcaaagtaaaaggtgtatcgggaacggagatgaaactccgtttcggcgagatgctgaacgacacgggagataaatcgcgcggagacgacggtcctgccggaagtatatataccgccaacctcagaagtgcaaaagcaacattgaagtatatcctgaaaggaagcaaggaaggcgaatcattccatccgtccatgaccttcttcggttttcagtattgtgagataacggcaagtgaagacatcgaggtactttccctgataggggaagttgtcggttccgctaccgaagagggagcttcgtttgtcaccagcagccggtcaatcaatcagttatacagcaatgtcatgtggggacaaagaggcaactatctgagcatccctaccgactgcccgcaaagagacgaacgtctgggctggaccggagacacgcaagtgttctgccgtgccgcttcttataatgcgaatgtatccgccttcttcgaaaaatggatgagagatatgcgtgacggtcagcgaagcgacggcgcctatccggatgtagccccgcactcatgggtaggctacggacaggcagcctgggctgatgccggtatcatcgttccctggactatctatctgatgtacgacaacaaaaagatattgcaggacaattatgcatctatggagaaatacatggagttcctgtcccgtcaaaaaggagacggttataactataacggtgccggaacaaattatggcgactggctatcgtacgaagataccgaacgccgctatgtcagtgtatgctactacgcatatacggcacaattgatggccaaaatttcggaagcattgaaaacggacgactgtgatgcctacgcttccaaagcaaaggcttacagaaagctggcacaggaaatcaagaaagaattccagacacgctacatcgatgcagacggagatttgaaacaaaagagccagacggcctatctgcttgccttgaaactggatttattcccgacagaagaagcacggaagaaaggagtggaaacactggtccgcaagattgccggcaacggtaaccgcctgagcacaggattcgtgggtacagccatcctgaatcagacattaagccagttcggagaatcaaatacggcttacgatctactgctgcaacggaacaacccttcctggctgtatagtatagaccagggagcaaccactatctgggaacgctgggattcgtataccaaagagaaaggttttggccccgtatcgatgaactcgttcaatcattactcgtatggagcagtctccgaatggatgtaccgcacaatgggcggtatagatatcgacgaaacacgtccgggattcaagtacatcgtattacagccggttccggacaaccgtccggaagttgccgccggtcaggaacggattgactgggtaaatgcttcgttcccttcctgttatggagatatcaagagcagctggaaaaaagaaaatgacggaacagtttcttaccaagtgacaatacctgccaacaccaccgccactcttcacttgctattgcctactctcgactatgtagtagaagaaagcggaaaagctgccgtgaaagcggaaggagtttcttcggttactttcatgaatggaaaggcagtattagaactacagtccggtacatatcagtttgtggttaaaaaggaaaacaaatagacagaatgaaaaaaatatatttagtgactgcacttgcatgttgtgcactgcaacccacccttgcacaaaagcaagaagaatgcaagcccgtgaaccttcattgcgaccacctgatcaatccgctgggtatcgacaatgccaaccccagattgtcgtggatgctggacgatgcccgacaaggagcccggcagactgcttatcagataatagtcagcacagactcactgaaagcaaacaacgaaaacggggaaatatggaactcggggaaaaaagaatcggatcaaatccttgtcacctatccggaaaagaatcttcaaccctttaccaaatattactggaaagtgaatgtatgggataaggacggcaaaaaggctacttcggacatcaacagcttcgagaccggaatgatgggaatggagaactggcagggtgcgtggattggcgacaacagagacatcaactataagcccgccccctatttcagaaaaacattcgacacccaaaagaaagtcaaatccgccagagcgtacatcgccgtcgccggtttatacgaattatacatcaacggagagaaaatcggaaaccatcggctagacccgctgtatacccgtttcgacagacggaatttctatgtgacttatgatgtgaccaaccaacttcagaaaggtaaaaacgcgattggcgtactgctggggaatggctggtacaaccatcagtcaaaagcagtctgggactttgaccgcgcaccgtggcgcaaccgccccgctttttgcatggacctgagaattacctacgaagacggcactacagaagtaatccgctccgaaagagactggaagacttcttcgggggccttgatcttcaacagcatctatacagcggaacattatgacgcccgcctggaacagaaaggctggaatacggcagattttgacgattcgaaatggaaggaagcaggttacagagccgtcccttctcaaaacgtcgtatcccagcaggtacaaccgattcgtatcgtagaaacaataccggcaaaagcgcttaagaaagtgaacgacacaacgtatgtattcgactttgccagaaatatgtccggagtgacccgcatcaaggtatccggagaagaaggaacggtagtaaggctcaaacacggcgaacgcctctatgacaacggacgggtgaatatgtcaaacattgacgtataccatcgtccggtagatgacaaagacccattccagacggatattctcatcctgagcggaaagggagaagacgagtttatggcacggttcaactacaaaggcttcaggtacgtagaagtgacaagcaacaagcctgtcgcactcaatcaaaacagtctgactgcttatttcgttcacagcgacgttccgcaaaaaggagaaatcaacacgtcaaacccactcgtgaaccgattgtggtgggctaccaacaacgcttacctgtccaatctgatggggtatcccaccgattgcccccaacgggagaaaaacggatggacgggagacggacattttgcgatagaaacagcactatataattatgacggcatcacagtctacgaaaaatggctagccgaccaccgtgacgaacagcaacccaacggagtattacccgacatcattccgaccggaggatggggatacggcacggacaacggtctggactggacgagtacaatcgccattattccctggaatatttatctgttctacggagacagcaaattattagccgactgctacgaaaacatcaaacgatatgtagactacgtagaccgtaccagcccaagcggactgacttcatggggaagaggagactgggttcctgtgaaatcgcattcgtccaaagaactgacctcatcggtatacttctacgtagatactaaaatactggccaatgccgcaaagctgttcaacaagcaggaagattacaaacattatcaggcgcttgcggaaaagatcaggcaagcgatcaatgacaaatatctgaacagggaaaccggtatatacgccagcggcgttcagacggaactgagcgtaccactgatgtggggtattgtccccaaggatatgaaagcaaaagtagcccgcaacctggcgaagaaggtggaagaagccggtttccatctggatgtgggtgtattgggagccaaagccatactgaacgccttgagtgaaaacggagaagccgaaaccgcttataaagtagccgcacaagacacctacccgtcatggggctgctggattgccaacggagccaccaccctgctcgaaaactgggatttaaatgctacacgtgacatttcggacaaccacatgatgttcggagaaatcggaggatggttctataaaggcttgggcggtatcttccccgacccgcagcagccgggttttaaacatatcctcctgcgccccaacttccccagtgatttaaagcagtttgaggccagacaccgttctccgtacggagagattcagtcccaatgggaacgtaagaaaaaaagtgttgtgtacagcgtgacgatccctgccaacagcagcgccactttatacgtgaccgatactgtgaaaggagaacgtgtcatagagttagaagccggaaaacatacattcgagtggaagttgctctaaatttacacttaatagaacattttatcgacctctgtttttctaatctttcctaatattgcggcgtaattaacaaaccgatcagatggaaaatagaatgagaagacgaatgacagttatattgaacagtaaaatgaatatgagaagattttgcgtatcagcagcgttgttactgacaacgctgctcgcagttgccgaaaataatccctaccggagtgacgtattctgggtaaccgtacccgatcatgccgactggctttacaaaactggagaacaggcaaatgtagaagtacagttttacaaatacggcattccgggagataacatagcgattaatttcgaaataggcggagaaatgatgcctgccgataccaaaggaacagtcatcatgagaaaaggaaaggcaacaatccccgtaggcaccatgaagaaaccgggcttccgagactgccgcctgaccaccaccgtagacggaaagaaatactcccatcacgtcaaagtgggcttctcgccggaaaagctccgtccgtataccaccatgcctgccgactttcagcaattctgggagaaccaaaaggcggaactggccaaatttccgctgacatacaccaaagagcacgtaaagaaatactcgaccgaccaaatagactgctatcttatcaaattgcaggtgaaccaacgcggacaaagtatctacggctacctgttctatccgaagaaagaaggcaaataccctgtcgtactatgtcctccgggcgcaggaatcaagacaatcaaggaacctttgcgacataagtattacgccgaacaaggctgcatccgttttgaaatagagattcacgggctgaacccggaaatgagcgaagaagaattcaaagaaatcagtgccgctttcaacggcagagaaaacggatacctgtccaacggtctggacagccgcgacaactattacatgaaacgggtatatctggcctgtgtccgcagcatcgacctgctgacctcactgccggaatgggacggaaagaatgtagtcgttcaaggcggcagccagggaggagcattagcactcgtcaccgccggactggatcagcgggtaacggcctgcgtagccaatcatccggctctaagcgatatggcaggttacaaagccggtcgtgccggaggttacccccatttcttccgaaacaccgtagacatggatactcccgaaaagatcagaacaatggcttattatgatgtggtaaactttgcccaattaatcagggcggacacttatatgacatggggattcaatgataacgtttgcccaccgactaccagctacattgtatataatgtattgaattgcccgaaagaagcattgatcactcctattaatgaacattggacctccagtgacacagagtacggacacctgctttggataaagaaacatctgaaataaaagcagtagaaaaagaaaaaccgccgaaagcggaagtaactgttatcatatcattattcaggcacggcttacagagtttttacggttctgttttaatcgaaaccatattaatctgtgtaaaccgtgcctgaataaattcgcaagagagttttagcgtctctctattcttttagtcttcccattccgatttcgggaaggttttcttcccataccatttcatccaggcataggattttctttttctcatataaacggcatcaccacaataggtcaatgcctcccagttaaaaaccgaatgagaactaattgctttttcaaaccagtaaagcaagtgatatgtcatgaacggaagcaccatccaccaccatgagaaccatagtgataaacccaatgctgggattaaagtcaataaaaaacactcccagaattgccgtgcatgtattcttaactccatttcttcccaaacttccaaatacttgtaccgagtaaagaataaccctcctatcataaaataatgcttctttttccctagaaagcattttgctagtaaattgttataaaatatcatataccctttttttgttgtgtaataacataaacggaaagaacgtacaaatgttcattatttaagcctaatcttacagttatttcctttccctggaatacaacaacatattgccacgcttgttttttgcggcgcgaagttacgaacttatatttatacaataactataaattccaaaataattctcttaaataaatttattatctaatatttgaagctacttcctcccaaaaactccctgagtaaagacgtcgggggaatttccttatcctgcaccggaacgaaatatttaataaatttcagcaaccggtacgcctcacaatattccggacaattgcgcggaacgcccatcaaaataggttccgcgtgcaggcgaaggactgcaaattcaaacaacagcgccgagttgaacatcacatccgcattctcctgataagggaatatccatttatcttcgccggcacgcacactaggccagcgggagatagtctcgcgggccgaatatccccggtaattaaagtcgcggataatgcggcgaagcaaacgattgtctgtcgtaggaatccagttatgatcgtccaaagaaatagtggtcaatgccgagacataaatcttgaacttcttttcatccgggatatgcggtgtcagttccggattcaacgcatgaataccttccagaatgagaatcgtattatcttcaattttcagtttatcacctttatattccttcttccccagagagaagttaaagcgcggaagctccacttcctcaccgcgcagcaaagcctgcaactgctggttaaacaattccagatcgagcgcatacagagactcataatcatagttaccgttttcatccagaggtgtctcttcacggtctacgaaataattgtccaaggagatcgggaagggtttgagcccgttcgtcatcaactggatggaaagacgtttgctgaaagtggtcttacccgaagaggacggaccggaaatcaaaatcagtttcacccggtcaccgttttccccacgatggaagatcgtatcggcaatctgggctattttcttttcctgcaacgcttccgctacattgattaaatccgtagcgtgcccttcttcgcaggcgaggttaaagtcgccggcgttattaagtcccatgatataactccagttgagatactccttaaatacatccagcatcttctcctgcttcaccacttcctccagcacatccggattctctttattgggaatgcgcagcagcaggccatcatagtatttcacgatgtcgaacaacttgatatatccggtactggggagcagattgccataataataatcgaccgtatcgcccagcgtataataataggtatatagcgaaccggaagtttcgagcagcctcaccttatcattcatcccgcgttcgctgaacacacgcacggcctcagccgtatggcattcgatgcggtgataagagatattttctgcgataatctcctgcatacgctgtttgatacgcgtcacatcttccaatgtaatggggcggccgatccgcagattacagaaataacctttggataccgggtgttccacaaacagcttcccttcgggaaaaagttcactgacagccttgaacaagacaaagcagagtgaccgcacatacgtacgcataccggatgaatcgcgcacatccagaaactctatatccttgttattatatactttgaaattgagaccttcggaacggttattcaccttggcactgactacctgataaggaaaattaagattaaaaccgtaataaatatccaaaagtgagcttccgatagggaattctttataaatattattatttttgcaacatatttgtaacatctgtttcatcgtagtctttttaataaggtgaataacatgggactaaatatacttagtaatcagatagagaacaaacaaccactaaaattattatagatggaatattctttttatgattttttaaagctcataggctcgttagggctcttcctttatggcatgaagataatgagcgagggcttacaaaaagtcgcaggtgacaggctacgaagtatcctgacagctatgaccaccaatcgggtaacgggggtattaacaggagtgttaatcacagcccttatccagtcctcctcggcgacaacagtaatggtcgtcagtttcgtcaacgccggtttgcttacactggccgagtccatcagtgtcatcatgggtgccaatatcggtacgacggttacggcatggattatttcaattttcggatttaaggttgacatggccgccttcgctcttccacttctggccatcgcccttccgctcatcttctccggcaagagcaaccgcaagtccatcggtgaattcattttcggtttttccttcctcttcatgggactttcttacctgaaagcaaatgctcccgacctgaacgccaatccggaaatgctcgccttcgtacagaactacacggatatgggattcttctccattctcctgttcttattcatcggtaccatactgactatgatcgtacaggcctcagccgccacgatggcaatcacattaattatgtgcgccaacggctggatcagtctggaactgggagcagcgctcgtactgggcgaaaacatcggaactaccatcacggccaatcttgccgcattaacagccaatacacaggctaagcgggcagcattggcccattttgtttttaatgtgttcggtgtgatctgggtattgatcatcttccatcctttcatggaactggtcaactgggtagtggataccttcttccagagcaataatccggaagtagccatttcttataaactgtccgctttccactctatctttaatatctgtaacgtatgtatcctgatatggggagtgaaactgatcgaacgcaccgtatgcgcattaatccacccgaaagaggaagacgaggaacctcgccttcggtttatcaccggcggtatgctttctactgcggagctttctatcctgcaggcacgcaaggaaatccacctgtttgcagaacgtacccaccgtatgttcggaatggtgcaggacttgatgcacaccgaaaaggacgatgactttaacaagctgttcagccgcgtagaaaagtacgagaacatcagcgacaacatggaacttgaaatagccaattatctgaatcaggtatccgaagggcgtctgagttctgaaagtaagttgcagatacgtgccatgctgcgcgaagtgacggaaatcgaaagtatcggcgacagctgttacaacctggcacgcaccatcaaccggaaacgccagacgaatcaggactttaccgaaaagcaatacgagcacatccacttcatgatgaagctgaccgatgatgccctcgcacaaatgattgtggtggtagagaaaccggaacaccaaagcattgatatcaacaagtctttcaacatcgaaaacgaaatcaataactaccgtaaccaactgaaaaatcagaatattctggatgtcaacaacaaggaatatgattatcagatgggagtctattatatggatattatcgccgaatgtgagaaactgggcgactatgtagtgaatgtggtagaagccagcagtgatgtaaaagagaagaaagcctcttaaataaagaggaactcaatcaaagaaatggatagccaatttatgcgttgcagcataaaattgactatccatttcttttttatttccacacagacaaaacaactcatgtccgtttacaaggacactcacactttacaaagacgttacattttttacagacgttacgattacatttcttttccgtgaagttcccgttaagcttttactgcgcctattgcaggtcttttttttgcatatacatttgcgccaaaatacacaggggcctatgtttagtaccattttccaatgaccggacaaaggcattccaaaagaaaaccaaatctctaatttaaagcaaaagaaatgaaaattaaaaaagtattgatgggagttgcactggcagcaatgtgtttaatgagcgcacaagcgcaacgccgcaatgagattcaagttcccaatctgaatgggtacactactttaaaatgtgactttcacatgcacagtgttttttcggacggtctggtatggcctaccgtacgtgtagacgaagcatatcgagaaggactggatgccatttctctgacagaacatatagagtaccgcccgcacaaaaaagacattatagcagatcataaccgctcttatgaactgtctcagaagcaggcgaagaagttaggaatacttctaatcagaggcagtgaaatcacccgttccatgcctccgggacattttaatgcaatcttcctgaacgactccaatccattggaacaaaaggcatataaagacgctttcaatgaggcaaaaaaacaaggagcctttatcttctggaatcatccgggctgggcacgccagcagccggactccaccctgtggtggcctgagcatacacaactctacaatgacggctgcatgcacggcattgaagtagccaacggtggtcttttcatgcccgaagccattcaatggtgtctggacaagaatctgaccatgataggaacttccgatatccaccagcctatccagacagactatgatttttcaaaaggcgaacaccgcacgatgacgtttgtctttgccaaagaacgttctccggaaggtatccgtgaagcactcgacaatcgccgcaccgccgtttattaccgcgaactggtgatcgggcgtgaagaaatcctccgtcccttctttgaaaaatgcgtagacataaaagaagtgaaacgcaccgaaaaagaagtgacattttctgtcatgaacgctaccgatctggtactgaaactgaaaaagaccgcacatgatccttctttggtctatttccgcgaaatgacattgaaaccacatacgcagcatacaatctctgtgaagtttgacaacggtatcaaaggaggcgactgcaattttgaagttaccaacttcatcgtagcccccgataaaggtttggattacaccatcaaactataaagttccagccatcaaagccatgtaatatcaagatatccgacgaactacatgcggataatcgtttaattttaaattattactttatgaatcgttacttatccctagcctgctcgctggtagctttcttctatttatcgagttgcgaaagctacagtgagcccaccgagaaagcccaccaatccgatcaaccgattgtactgacctccttctatcccaaagaaggcggagcacgtgacaaaattcttctggacggaaaaaacttcggcaccgacgtgagtaaaatcaaagtatatttcaacaatgccagggcctccgtcgtttcatcaagcggaagccgtatttatgccattgtaccgcgccttccgggcgataatccccgtatctccgtagtggtcgacaccgattctgtcgcttacgaagaaacatatgcttatcatacacaggcattggtcagcacggtcaccggaaacggtgaaacgagcttccttgccggaacactctccaccgctcaggtatatggcaaatatcttgatctggatgccgaaggcaatcttttcatgtcatggcgtgacggcggcacatttggaatcgcccggataaacgaacaacagaacattgtgactcctctcattgaagcagatgccgccaaccgtatcttatatgccaacggcttaacggtggaccgtgccaccggaatgctgaccgccgcacacgaatcggtcaaagaagtgacgtttaccttcgacccgcgtgaagcctggtatccccgccagcgtaacataaaatactcacagtcggatctgaactcaatcgtagatgccgacagatacaagaatttcgtcaccttctgcccttatgacggctatctatatacacgataccgtgatggaaagatcgctaaaatagatcccaacacattcgaaggacacattatccatcaaggtcccagcggatcacaatacggacaggcgattaatcctgcgaagccctggcttctgtatataacgcttcactccaacgcccctaccgcatacagacaagggatttcggtgctcgacctccgcgatccggatggaacaggcggatttaagcgtctcaatgctcccggcggcagcgctttccgcgacggtccgattgaagatgccctgttcaattatcccaaggatatcaagtttgacaacgacggcaatatgttcgtagccgactatggcaaccattgcatccgcatgatatctgccgacaatatcgtcacgacagttgccggacagcccggcgtcgccggatacaaggacggaggaccggtagagtccttattcaagaatccctggggagtggctgtcaatgaacagggagacatttacattgcagactggggcaatgcacgcattcgcaaattggttatcgaataacaaagtaaactcacaatgaaaatcaaacagattttatacttaatgtcgttctgcttattgctttcggcaacaaccttcgcgcagcaagttcaggaatttaccgtttcaggaactgtcgtggataaggacaagctatccatgcccggcgtatcggtatacatcaaagacaagccctccaaaggtaccacaaccgacaatgacggtaatttcaagctgaaagtggtttatggagacaaaatgatattttcttttatcggcttcaaaccgtcggagcacgtggccatcaaaccccaaaccgacttaacggtcacactgcttgaagacaacaattcccttgatgaagtggttgtcgtcgcactgggaaacgttcagcggaaaatcagttcggtaggtgccattacgacggtcagcactaaagatatccagtccccctccccttccatcagtaacttgttgggaggcagggcagccggtgtcatttccttgcagagcagtggcgagcccggtcagaatatcgccgatttctgggtacgtggtatcggtacgttcggagccaacagcagtgcccttgtactgattgacggtctggaaggcgacctcaacaccatcgaccctgccgatgtcgaaagtttctccatcctgaaagacgcgtcggcaactgccgtgtacggagtaaggggagccaacggagtcgtattggtcaacaccaagaaaggcctttcgggcaaaattcagattaccggacgtttcaacaccacgctgtccgtcctcaaccgtctgccgaaatatctgggagcttatgagtatgcgcagttagcaaacgaagccagagcagtacggaacgaaacacctttgtatgacgatacggaaatgggaattatacgcgacggtctcgaccccgacctctatcccaacgtaaactggcaggatgagatactcaacaaaacattctggcggcacacttattatgtaagcggacgtggcggaagcgatgtggcacgttattttctgagcctgggaggtaaaaacgaaagtgcggcctacaaggtagacaagaacagtatatacagttcgaacgtcagctacaacacctataattaccgtatcaatctagacgtgaacctgaccaaatcaacgaaagtttatttgggttctgacggattcctctcccagttgaatcagcccggcgtagccaataccgaatatatatggggagcacagtcgcggcttactccattgtccattcccacccaatattccaatggtatgctgcccggacgcggtgccggagagctgtcatcgccttatgtcatgatcaaccatacgggaaaggctgccaacgaagtgtacaagggcaaatcaactttggcaatcaatcaggacttttccgaattgatcaacgggcttaaattacgtgtacagggagcatacgatatccacagctacttcaatgaacggagaagcgtgcagccggccctctacaatgcgctgggcagagcaagcgacggatcactcatcatgcaggagaccgtacaggagaaaaaagcctcgtacagcaagtccacccgccagtaccgcaaataccactttgaggctacgctcaattatgaccggcttttcggtacagatcaccggacatccgcgctggtctattattacatcagcgattctaaagacacggacgacgctacaagcaacttatcagccattcccttgcgctatcagggagtatccagccggtttacatatggctacaaggatacttacctgctggacgtcaacttcggatataccggttccgaaaacttccagcccggcagacaatacggtttcttcccatccgtcgcattgggctgggtgcctaccggctacaagtttatacaagaggcgctcccctggctcgactatcttaaaataagggcttcgcatggttcggtaggtaacgaccggattaccgacgtccgcttcccttaccttactaaagtgaacgaaggtaccggatcagcttggggcgttcccgacatcgagattattggcgagacacgtatcggagccgataacctggcgtgggaaaaggccatcaagtccaatgtgggtattgaaggaaagttgtttaataacaagatcgatttcgttgtcgatattttccatgatcagcgtaacggtattttccagcaacgggtacaggtgcccgagttcgtaggagtggtctccaatccatacgcgaatgtgggtaaaatgaaaagttacggtgccgacggaaacatcagcttcacgcaggatttcactcccgatttcggcttcactttacggggtaatttcacttactctaaaaataaagtacagaactgggagcaggcttatctggagtatccctatctggaatacaataatttcccgtacaattccatccgcggatatcaggcagtcggactgtttaaggacgaagatgacatcaaatacagtcccaagcagactttcggagaggtaatgcccggtgacatcaaatataaggatatcaatggagacggtatggtggacaagctggacatggtgccgttgacgcacagcacttatccactgctgatgtacggcctgggagcagaaatccgctacaagaatctgactctgggtgtattgttcaagggaaccggcaagacctcttttttctatgtaggtcaaaagacgacagtgaacgacgaaacccgcctcaacggaatggggtacatgcctttcttcgagggtaacaccggaaacgtactcaccctggcagccaatccagtcaaccgatggattcccagagattatgccattgcacacgggatcgacccatcccttgccgaaaacccgaacgcgcgtttcccccgcctgcaatatggaaataacagcaacaacagccagttatccaccttttggcagggcgattcacgctacatacgcctgcaggaaatcaccctgaactaccatcttgcgacagcttttctgagacgcataggtgtttcttcactggatatccaattcgtaggtaacaacctctatgtatgggataaagtgaaactcttcgatccggagcaagcacgctggaacggccgtgtatatcccatcccttccacctattccctgcaattatatgtcaatctctaataaatacatcatccgataaacgataaaatgaaaacatccttaataaaaaaaacagcaagaacgttcttcttggttcaggcagtcatgttagtaacgtcttgcagcaacttcttaaacatagacaattactttgatgatgaattcaacatcgactcggttttcaccaatgcccgatatatggaagcgtatatgtggggagcggcagccatgttcccggatgaggcacagaccatccgtaacgggtacacaccgggaccgatggcgaccgacgaaggatttaacggactgaccggaagcggaacggccaatatctatcacggcatggatttcgccaacggaaagatcacacaggatttcctcggagacggctcccccaacctgaaccaatggggcaaatactacaaaattatccgtaagtgcaacagcatcctgcaaaacctcgaccgcccgaaagacctgacaaactcggaacggctcagattggaaggatacacacgttttatccgtgccttcgcctactacaatcttttggtcgattacggtccggcaatcttgctgggagacgaagtagtgaataccaacgaacctatcgaatactacgaccgccccagagccacctatgacgaaacaatgaactatacttgtgaggagttcgaaaaagcggcacggctgctgccctcgcctcaggatgtttccacgctggacttcggacgccccaccaaaggagccgcactcggcctggtagcccgcctgcgattgatacacgccagcccgctattcaacggggggcctgttgccagctcctatttcggcaactggaaacgcaagaccgacggtgtgcattatgtctcccagcaatatgacgaaagccggtgggcagtagctgccgccgccgcaaaacgggtgatggatatgggagcgtacaagctctatacatatgcaaaagacgacaatacgccggaacttcccgccggagtcacttccgaccccaatttctatgacgcctacccgaacggagccaacggaatagaccctttcaaatcttattcggacatctttaccggcgaagccgtagcgtccatcaacccggaattgatctggggaagaaacacgacgtacctcaacgaaaccatcagcaaaggttctttccctccctcgatgggtggatggggacgtttctgcgtcactcagaaagtggtagacgcctatctgatggacgacgggcgtacgaaagaagaagccgccgccgacggatattactcggagacaggcttcacttccgaaccgcgtaacttttccggctatcccctcaacgccggtgtatataagatgtacgccaatcgtgaaatgcggttctacgcatctgtaggattcaatgaggcagtatggcaggcattgtccagttcgactctcaacaaccacacagccaagtactactatcaggatgaagacggtcgtggcggtgttacagccacttcgcccaactatcccatcaccggatacgtaatcaaaaagtacaataacccgatggatgcctggaccggcaccggagcccgccatatccagaaagcctatcccatcatccgctatgcggaaatcctgctatcgtatgcggaggcactcaacaacctgaccggcccccacaccgtagaactggacggtcagccttataccatgagcagagataaagcggaaattaaaaaagcattcaatcaagtccgctacagggccggactgccggggctgacagccaatcaactcaacagtacgccggaagtacagaaacagatagaacgcgaacgtatggtagagtttttatgggaaaacagacgtttctatgatgttcgccgctggggtatttatgaagagacagagcaggaacctatccgtggaatgaatcccgacggcgcaaccaaagagacctactaccagcgtgtcatccctagttcttcctcattcctgacgagggtggttgacaaaaggtctgtctgggtgcccataccacgcaacgaaatgagaagactgccttctctcgaccagaatccgggttattaatctaaataacaaaaaagaaaatgaaacgagattttataacgatactcgcacttatgacagcgctttcgtcatgcaatgacgatgcgctgtttgaaaaggaaatgtacaagaatgtagtggccctgatcagcagtgactactataacacgtttgaagaagtggtcaccttgtcccctaccggagaagaggcgacaggatatatcgcagcctgcaccggaggtacccatgccccaaaacaaaacatggtgatcgggctggaagaagacctgacttcactggaattctacaaccggtctctttacgacgtcgatgaagcctgctatgccaaattcctgtccagtgacaaatacgagatcgtagattacaagattcagatcaatgcaggcgaacggacaggcagaaccatgatcaagatacgtcccgaaggactgtcgccggattctacctacttcgtaggattaaaagctacggatatctccggtgtcgagattaatgaaagcaaaaacaccattctatatcaaatacttatcaagaacgattatgcaacgcagggcgaaaacgtttactattcaatgaccggtctggcagacgggatggcaaccgcaggtaacaagaagatgtttccactcacccacaacagcgtacgcgtgatagccggaacggagtcttttgaaagcaatgtggatcacatcaacaaaaccgccatcatactgcaagtggaggaaaacaatcatgtcacgataaagccgtacaaggatattgaggtaactcagatagacggtgactccaaataccccaatacattcaaggtagaggaatctttcggtcatacttataatgtatttctgctgtcgtaccgatacacaaaggatgggaaaagcaaggtgatgcaagaggaattgcggctggaaataaataattaacgcaaaaacctcgtaaggttaacccttttctctttaatattaataactttgtatgcaaatcttttttcgtaccactatagtggcacgaaaaaagaactatagttccccttgtgtcccactctagtggtccgcacggggaactgtagtagaacgaattaatatttaagccggattccttagtttataggaacggaaacattaataacacaacaaaataacttaagttatgagcgcacagtatgacctttacgagactcccgatatcaagcagacaggagaaaaacagccccttcatccccgcattgttcccaaagggactatcggtcaggacgaatttctagaccgcgtgcacaaatttacgggaatcagccgtagtttgctggcaggagcaatgcagtcttttcaaaatgagttaaaagatttactggctaacggctggattgtagaattaggcgagatcggctatttctccgtatcgctgcaaggaccacccgtaatgcacaagaaagatgtgcgtgcacaatcaatcaaactaaaaaacatcaactatctaccgaccaaacaattcaagcgggaagtagggtatgacatgagattggaacgtaccgaatctctcacccgccccaaaggtaacggacgtagcgaagcggaatgtctggcactaataaccgcccaccttgaaaaatatccttgcatgactcgcactgattattgccatatgaccggtcacgacaaaaagcgtgcactaaaagaactgaacgcttttatcgaaaaagagatactgatgcgctacggagcaggaaaacaggtggtttatgcgaagaaaatgatttgatgcatatagcttatgtccctaattgaactcattagatgaataaggagaatatgttttatagatagccaatatttataaaagtatattggataggaaggcttttaaac

SEQ ID NO: 113 - DNA, 25529 bp, Bacteroides thetaiotaomicron
atataatatagtgttagtattcaaacgtgattcccaaagtcggcagcagtgtaccgctttcttgcttgagcgacttcatgacataccgttgttcggctatcggtgcgtccggattcttgattactccggtgctcattaatacatctgcctgtttcagcttgctgcccgcgatattctgcagatcgatgtagaaacccagcatacagcgcttcagatagaatgttttgtctatgcggatatctacctgagtgaaggccgggagtcgttcttcattgtatcgggtatagtcgtaatacggttttccctgtgcattccaggctgttaccagagatgacttgtcggcatcataaggagtatagggggcaccgcctatacagctgactttcattccgacgctccagtgccgggggagattgtaagttccccgcaagttgaaaataaagcggttgtcccatgcggaagcgatgtactcgctttccttatcagtacgatattcgcttttaaagagcgtgaaagatgaggcgagattcagtttcttggcgaccagccatttaaggagaagctctgctccgtaagaccgtccctgtgcggtggaagtaagcagctcattgccaatcactccgtaatcgtttcctttgcaggtcaacggaatgccgtcggctacggaaagaggaattttgtcataatctttatagaatccttcgacggatacttcgaaggtatcgccctttctccagttcagtcctacgctaccctggctgacttgcatatagcggagcgcatacttgttggcatagagtccgttattgtttttaaagccgagagcggtgtagggaggcagttgataatagagtcctgcgtttccgctcagcgaccagtgctccgtcagttgataggagagtgacaggcggggagagagctggtcggacaggtctttcatggctgccgagtagttgttggcatcggcacgcagtcccagagaagccgtaaaacgctcgtctatggaggtgtaattgactgttccgaaaagtccccaacgcatgatgcccagataggtatggtagtcgaacgtctgcgcacggtcggtgtataccttctgaaaggtggtgttgctatactggctatagtccagactggttccgactgtgactttccagttgcggaaagacgaactgttctcaagacggagctgagtattttgttccgtagaacggaggcggagcatcagatgctccggatcgctttcgtcgttctgctgatatttggtgttccggttgttcagataactgtgactggcaacgactgactgcacgtgtgcccccgcatagtgccggtatacggcacctagagtgaacgtctcctgctgaatcttaggcaggtaactgaggatgtattcgttgtcttcatcgtcggctttggtgtttagcttcatcttatcaataccgcccagccctagtacagtcaattcattccgggcgtcaaaccttgttttcagcttgaattgcgcatccgtaaaagtcggcagaaagggcagcccgagcatatcaaacaagaattgcaggtaggactgacggacggaaaccagataggaagtctttttgcccaaatgtccgttggaggcaagggagacttcggaagctccgagagtagctttcagggaattgcgttccatgtccccgtcgcgcaatttgaagtcgagcacggaactgagcgcatttcctttgtctgtcgggaaggctccggtatagaagttcacttcccgtatcaggtcggcattaaggatacctaccggaccgcccgatgctccctgtgtgctgaaatggttgatattagggatctctactccgtccaggtaaaagcggttttcggaaggcgatccgccgcgtacgatcaggtcgttacggtatcctatcggtgagaaggcaactcccggataagactgtacgatgcatgagatgtcccggttggctcccggacttttttctatttcctgcagtccgatgatgcgcaggctgaccggactttcaatgtcccggcggaaaggggaggcggtgacggtcactccttccagttccgtctgattctcttccatctctatttgtatatgtaggtctctggtcgaaagtatgtattcgggggtagtgacagttttgtatccgatagcggacgcttgcaggcgatagatgccgggcggtacttgcccgatcgagaacttaccttcggcattcgtcactccgcctttattgagtccgacaatcattacattgataaattccaatggctgacggctggatttatcaatgactgttcccttcacttggtggacaggctgtgccagaaggaaggatatggttatgttgcaaaacagcagaagcgacagtagtcttttcatgttatttgtagtttagcgactgcaaagttaatggaaaatagtttcacatttcaattttatgttctatttttgtgggaataataaaatctggttaagtatgaaaaccgtaaaattgattacctgtaatgacgcgatgaaggcgcatatccttcaaggggcgctggagaatgagggcattgaatctattctgcataatgagaacttttctactttgtataaaagttgcgtgagcagtattgcgggagtggatatcctggtagcggatgaagattatgagaaagccgttcaggtgctgaggcagaaccaaagctggcccgaagaactgacgctctgtccttattgcggttcgtccgatattaaattcgtattgagaaaaggacacaaactgcgtgctgttggcgcagctgtactttccatgctggcagcggcgcctccgggggacaatcattgggaatatacttgccagcagtgtcatcagacttttgagacacctgttgccgaatttcaaccttcgggagaagacgaagaatgattggatctaaacatattataaacacaatgaaaaagaaaaaacttctattaatcgctcttttgttagttggggcagcgtcttcttttgctgccaaagtagatacgttattagtgaaaagtccttccatgaacaaggacatcaaggtagtagtagtcactccggatgcggcattgggaaagaaagctacggcgtgtcctactgtttatctcttgcatggttttggcggacatgccaagacgtggattgagattaaacccaatctgcctcagatcgcggatgagaaaggaatcatatttgtttgcccggacggaagtaccagctggtattgggacagtccgaaagacccgtctttccgatatgaaacttttgtctcatcggaactggtgaagtatatcgacggacattacaagacaatcaccgaccgcaaggggcgtgccattaccggtctgagtatgggcggacatggtggtctgtggactgctatccgtcataaagatacctttggcgcttgtggaagtacaagtggaggtgtagacattcgtccgttcccgaagaattgggacatggcaaaacgcctgggggattatgaatctaacaaggaaatatgggatacgcatactgtaatcaatcagattgataagattcagaacggggatttggcaattatctttgattgtggcgaggctgacttcttcattcaggtgaataaggatttgcacaaccgcttattggaaaagaagatcgatcatgattttatcacccgtcccggaggacataccggagaatactggaataacgctatcgattaccagattttgttctttgataaattcttcaagaaataaaaccggaaaagcttgacttttgcatccggatgtcgtatctttggagacataatcatatagtagattgaaattaaactacgatagaaggaggaagtgaaaactttctcctttttttgtgtactacttggtgaggaactgttcagatcggtgctgggagtggttcagcttggtgcttattgaaatttagaagggatgtcgggaagaattagaaggtatgttaaggcaaattacatactatgttaagtgtaatcagatgctttgttaggtgaaaacggaggctttgtttcgataaacagacttttatgtagcggaaaaggtcagtcggagttaagaatctataaatctgctcttgacaagaatcgggttattcaatcgtaattgagatcgtgcgattcagataagatatacttttgccattaccatatttagtgctgacctttagactgacaggtttcttgtttttatcaaagctataagtatattcggttctttcggtgtatgtgtcactggttttctccggataagaggcggtagtaaggtgttgtgtcggtttgccaagcatgccggcaaacaaggcttcacgatggaaggaaaggggataagtatccgccaccagcatacagggaagacgataataattgatatcttctcccgcttcataattagtctgaagctttccgtaaccggtggatgattcatagggcagtgaaggagagatggtggaaattaaatcgcccttgtcatactgtagagaaagagtgtgcgcgacaactgcatcgctgcttccttcccggggcataatcttttcattcacttgtgtcagatagccgtccgtatataaaaaggtatattgtctcttctggtcgagagaagcatattcgcattgcgtggcgtatccttcttcgtttagggtgtatttacgctcagtccctatttcgtctgtgaaagtaacactgcttctgttgtttccgtattggatggtaagcgaatggctgatgatctctgtcaagtccgctatcgaaacttcttgcgtgtaggtataaccggtcagccaggcatcttcgtagcgaaactcttcttctttagtaacgtcagatactccgattccatcggacttgcaaaattcggagaacagcatcttgcttatttccgggtcaggaacttctgtgcctactttttcttcatcatccgaacaaccgaacattactatcgcacacaacagaagtgctatctttttcatacttgtttatttaatccgtaaccctccggcaaatcttctgctggcaggactgctgacacttttttctatcttaatactcttggtacttcgagtttcttcttctttgtcttcgtctttcggcggataggttccctccaatgtctggatggctatgcttagcattctttctttaggattgccgaaagggaggaactggctgtaatcagtagtcccgttaatagacgtttcgcttattttgaatttatcgctgggaacaagcacgaatgcgtcttcgcctgcatcatggtcggagttgtaaacggtgcataccaccggattgacagaccagcggtaggtttcattgatgaattgctctgtagctactgtttgtcccttgcttgcgctacccatgacaataatgttaggagcctgctcctctttgtataggctggtcagtagcatttctgctgctccggctgttgttccgctggtgattgctaccaaagtgttttgattcagattgacaccggtcttcagcacctcctgatcgaaattgatggtcgcgtctttgtccaagttcttgtcgttatattccagataagccatcggagtgcccattcttgcatttggcacaaggatggtggcaagtaactgaacacagtccagcgatcctccttcgttatagcgaaggtcaaggatagtggcttgtacgttggcttcctgaaatatcgttgagactttacgtaattcattattatacttctccggatcgttattggttccggcggtgaagctgttgtacatcagatagccgactttagcaccattgtctaaagtcagaattttgtatttatgtaccggttggtcttctatagactgggcggctcccaaatccagcgtgacaccgttcggcactactttatacaccataaccggttcttccggtacttcttccccttcttcgggctcttcctcgacttctttccatacccccatcgaaagttctcttgctattgtaccttgcagtagttgcgtttcatacttcttgctgatataggaagtgtctactttcataatccagtcaccgcgttggagtccggctttttcggcgggtgattcggggataacataagtaatcaaggcattgtatgccgtatcgttatcctgactcttgacgagcgagtagtcgaatccataggttggcaacggagcttccaggacagaatctacaaaagagtagctgtctttgtcccattttgctttggataagaaggtggcagggtcctgaaacaggtttacttcatcgtagccaggcatatattgataccacagataattctgttgcatgatatcatacatccatgtatccagttcagtcaggtgggcatattccggccagcggtccacaccacacgaaaagaagctgctgacagatacgacgatcagggcaggtataagtagtattttgcgtaaattcgtcatcttaaaaagcttttcagtgtgcaaatgtaggaaatactttgcttatctaccacatttatggtataaaaatgccttcaatatgtgataggttgttagcaaatcccgccttatctttgcaacatcgaaaatgatcaataggtattcatataaatagagagagaataattagaatccaaagagagtgatatagagtaaatgatttttggatggaccgtaacctgactttgataaagatttaatgaaacagatttgctgatgtgctaatttgtcggtgattaatacattggcatcttagcacaacttttgttgtttaacgaataattatgatgatgaatatagctgcattattgtccggaggtgtcgatagctctgttgtcgttcaccttctttgtgagcaaggatacaaaccgactcttttctatatcaaaataggtatggacggggcggagtatatggattgttcagccgaagaagatattgaaatgtccactgccattgcccgtaagtatggtttgtccttggaagtcgtggatttgcataaggagtattgggagaatgtggccgcctacgcgattgataaaataaagaaaggactgacaccgaatccggatgtgatgtgtaacaaactcataaagtttggctgtttcgaacagcaggtcggaaagaatttcgattttacggcgacagggcattacgccactaccatccggcaggacggcaagacgtggcttggaacagccaaagaccctgttaaagaccagacggatttcctggcccagatagactacctgcaagtttccaaactgatgtttcctatcggcggactgatgaagcaggaagtacgcgaaatcgcaagcagggcaggattgcccagtgcccgaagaaaggatagtcagggaatttgctttttgggaaagattaactataatgatttcgttcgtcgtttcctgggagagcgggaaggggcgattatagaactggaaaccggaaagaaagtgggcacgcatcgcggctactggttccatacgatcggacagcggaaaggacttggattgagtggcggtccctggtttgtgatcaagaaggatgttgaggaaaatatcatctatgtctctcatggatatggagtcgaaacgcagtttggcagtgagtttcgtatcaatgatttccactttattacggagaatccgtggaaagatgccggaaaggagatagatattaccttcaagattcgtcacactcctgaatttacgaagggaaagctggtacaggaagagggcggtcagttccgtatcttatcttctgagaagttgcagggcattgctcccggtcagttcggggtgatttatgatgaagaagcggggatatgtgtcggaagtggtgagataacccgataggctgttccctttcagaactgaaccggctgtcaaatatagtattccgctaaatccacaatccctgcacgcatcgcgtacttggtagcttcgtgcacattgttgactcccagcttccggaagatattctttcggtggctgttgattgtatgaaagctgaggttcttttctgccgctatttcttttgtcgtcttccccagtgcaatttctttgaggatattcttttctgtctgcgtcagcagatgatcatccaccgttgcaggggatgcggcggaagaagccgttcccgaaagcagcagattgctgacatgattgcagatataccgttgtttgcgtgaagcgcattgcagggcggacatgatttcctcttttgagttatctttcatcactactccgaaagccatactgctgaataatacctgccggagaaaattgatacttaactcatcggagaacagaatccagtcggcctctttaaaccgctcctgcaggacgatcagttcgtccgctccggcaaaatcgaataaggtataatccagaataaccactgcttgcggatacaggcgcagctgctgaatcagttcggccttgttgtcagcttctaaaagaacggatacatccttttgccggcttagcagaaacatcattcctgccttgctgatatcctgattatctgcgatgatatattccctcataatgatcaattaaaaaaactccgctacaaatgtacgcattttgcgcgatttgtagcggagttattcttatattcttctgttcggattaccaggcacgtcctttgaagatgtttgactgatccagtgggacgatgttaccgttcaatgtcaggttgttgttattgaagttcgggctgatagataccgaagcattgttgttaccgctgctcatattaataaatacctgagctgagataccgatgccctgtacactgaatgaacagtttacatttcctttcttatcgatattcatcttcatgtccgaagagttaccgtctacagtcacaccaccgataccgttagggccgggataaggagtgttgaacgctgtctgtacagtggctctgtttccgttcatcaggacgaagttagtgttggaagtcacgaaggaactcataccgttacggaagatcacctgattggcttccagaacaaactgtttgttcttcaaagcctgtacagcctgctggtaggctgccatgtcctgtacctgttcttctgcgcgaagttttgctctttctgcgtctctttctgcttttctgtctgcgcggcggatggctgcgttactttcctgtgcatacatcattgtgctcgcacttactaaaactaatgctaataatgcaataaactttttcataacttttttttgtttaggtttaatacgttgttcgtttattgcaaaaacaaagtgtatgccagattgttcacgggcgttttacaattttatatccgatagctgcgacagcgatactcattaaaggactgataatgttgaaaaagcaataggggaggtacaccagcgtaggcacactcaggatggtagcctgagtcattccgcaggtattccatgggatcagtacggatgtaacggttactgaatcctcggtggtccggctgagcaggcagctttcgtaaccttttttagcataaatgtcgcgaaacatattaccggtcaggatgatgctgatgtactggtcggcagttgccagattgaggaaaagccccgaacagacggtagccgatacgacgctgaccgttttcttcatgaaacgtacgaagagcgatgtgatgcttcccagcataccgctggctgtcattgccccgccgaaacacatggcacataatatcagccagatggtattcatcattcccgacataccacgggtggcaattaaatctgtcaaaacagcattgtcggtctgcaggcttgtcttgccgtagatggtcatcatcagtcctttaaatagggagtcgaagttggaaacggcagcccccgaaatttcccgcaacaaatccggttggaagatcagagcgaaaatgcccgccaatagagtggacagaaacagggtaatgatggaaggcactttccgtgcaatcaatatgcctgttgctatcggtataatcagcagccacggggtgatatggaacttttcattcagggcagctgccacttccgcgatgtgctgggtattgctggcgtcatgagacagacctgctaccgtaaatataatcagtgtgatgatcagtgagggcaccgtagtaatcatcatgtagcggatatgacggaagaggggcgtgtccgtgacggatgccgccaatatggtcgtctcggacaagggagaaaccttatcgccgaaataggcaccggagatgatagctcccgcaatccagccttcttcaaatccctgtgcctttccgatgcccatgagggcaataccgatagtggcgatcgttgtccatgaacttccggtcataacggagatcaatacgcaaataatacaggtggatgtcaggaagaaactgggatggataatctgcatcccgtaataaatcaaagtgggcactactccgctaatcatccagataccgcttaatgcgccgataatcagtaagatgatgatggctgttgtcactcctgccacgttgttcgtgattgccagttcgtagtctttccaagggattttgtagaaagccatgccgataaggatacaaatggcggtggtagtaagcagcgatacctgacttccgccattgagggcatcactgccaaatacacgaatggtggcgaatagtaatatcactaatacgacaatgggcaatagtgatacgaggggagatggagctttcttcattctaaatataacgctttattatttaatctggtggtttaggtttctttattatgtaactgccggaccttcaatgatgtcggatgctttattgatttcaggcatcgattccggtaaatgtctttagagcatatcctatcaggaagctgataccagccacgctgaaactgagtacagccatttctgtaaaccgctttcggaagctttcaccacgggctacggaataatagtagttgaaaagggcaatgatgataagtgccatggtcagcatcactcccaaagctacgattacattgctgatcagtataaacggagtaaccagtgacactaccgtgatcagataggcgattcctgtatatacagctgcttttaccggatgtttcttatcatccccttccgatttggtagaaagatattcggaagatgccattgacagtgcagcggctatccctgtgatactgccggtcagtgctatcagtttactgtcactcaaggcaagtgtgaaacctgccagtgcacctgtaaattcaaccagcgcatcattaagtcccagtacgaccgatcccatatattccagccgttcttcattgattagtgaaatcaacttttgctcgtgcacttcttcttcatgtgccagccgttgtaggtccggtatatgggcatatttatcataattattatgggcattttcctcactggactccattaatttgatggcgaatgtgatacctagtatgcgtgccagaaagtagaaacgggcgatacgcttatagtccggaccgatttcttttcctgtatatttcttgaggatagcgtaatgcgacttttcttctgctgctatcagtcggagcgttttgcggttattctcgtctttttcgatagatgcgagccgttcatataagatgctttctgttatctcgtttcgttgaaagcgggtgaattcggcaatatcctgttgggttggaatcatttctttatttttttggtcgcgcaaagatacaataaaaagacagaattctttttgccttgccggacagcacaataaaatttattataagtttatattttattggaatatagatgctttcctgttacaccggattcgtcttgcgcctcagccaccagtaacggatgaagagtacgccggtcaggatcagtgcgatggacagtcctgtgtagaagacagatataaaactttcgggcaacaggtggaagctgcggatggtgatgcccatacagatcataaagatcatgacgatccagcttttgacatcgaagaaggagaaagggcagttcttctgttcctttttccgttcgatcctttgagtatgcttgtaatagagtcttttgaagattaatacgaagaacagcagaaagacgatggttgcttctcctatcttgaacatccagccttcggagttattaagccatgtaacgatgcctattcgcaagatattggcaccggcgataatccagacggtgcctgctgtgataagtaagatttctttgttaactccgtatttcatgtttccctttttttgtattaaacggtttactgctccgttttgttgactcacttcttcgacaaagttgtaattagtaaagaaatgcaggtcagtgtagctccaattccaataacaccatgccatccgtacaattgccagaatgtacccgcaaggaaggttcccagggaaccgccgacgaagtaggtcgtcatgaaaattgtattgatgcggttggaggctcggggtgacagttcgaagatactggtctgattactgagctggatgcactgcatacctatgtcgatgatgataattcccagaatgataccaaggtaggtgttttctccgacgaagaagagtagccatgaaaagaggatcagtccgcaaccgatgaagttgaagcggcggacacccactctctttacgtatttccccacaaaggaggcggttaatgctcccgccacaccgcataatcccagcaaaccgatgatgtcgctgttggcatgaaagggggcttgccccatcttgaaggcaaggcaggaccacatggcaagaagggaaccgaagtttaacgccgcacgaatggaataaatgcgcagctgcggaaactctttcaccaaagccagcagggatttcatcaggtcgccgtacttgccccggaagttggtctgaatatcgggaaggactttgagcacgacaatcgcgcagacgaacatcatggctgcggcgatgtaatacatttcgcgccatccgaacagttcgccgacgaatccgctgaccacccgtgaagcaaggattccggtcagcaagcccgataggacgatcccgacattcctgcctttgttttccggacgggagaactgggcggctatgggaatgaatatctgcggaatcatggagcaggctcccgtgaagaacgaagcaaggagtatcagatggatattatctgccaaagcaatcgtcagcagggagaatatcaggacaaagaaattgacaaggataatctttttccgctgatacaaatcacctaagggagtgataaacaagagtcccgctgcatagcctatctgtgtgaccatggcaatcaggttggtacggaattctgatatgccaagttcatggcgtatcatatttagcagcggttggatataatagatgttggctaccgagactcctgccacaatggcgagcgtccacaggatggatgccggcagacctccgttttctttcaatgactgtttcatgccgcaaagataatgaatatcactcaacaaagaaagtggtggagatggtatttccttcaccgtctactgccgtcagcgaatgtttgccggcggcgggttgcagggagattttgtgaaagtcctgtgtctgggcttggtaggtctcgtcaagatgccagaaaatggtagcattaggattgctgtgcgccagttctacagtcaggaaacctttgctgccatccagttgcttgggcagtttgatgcgtgcgttcatcggaggatagataaattgcatcggctggaaagtatcttctccgcatccggctttgaaaggaggcagcggtttatactccggatgatgttgtttgtaataccattcccatacgggtggcagtgtgaaccagcttttctgaagcgtaggctccgtgttggcgcaattttcataaatacgctggctttcatcggctgataaagtgacgaggtggtgataggggcatgcctctgtccgcagtcctgccggtaaaacaagaagcgtgtccgtttcatcacagaaccgtcctttcagatgtcccgatttccggcagacctctgcttcgacaaagatgcccgtagggcgtgtaaaccacgaagaggcgggaagcagattaaaaatatcgaatagtacgggacccgctgtctgtgcacccaccagtccgggctttccttctccggtggcatttcctacccatacgccgactgcatagcggggcgtaacacccaccgcccaagcatcccggaatccgtagcttgttccggttttccatgcaatggtctgcatggaaggaatggatttccagtcaatctcttcgggacggttgacttctttcaaggcatcgaatgtctgccatacggcgcctggctgaaaaggatcggttgattctgtgattcggcttgtcgggagcaacaggctgcaagacctttgcggcagttgcaacaaactgcgtcccatcattgcatatgcgtttgttacatcccataaagtggcttccgctcctcccagaataagtgataaaccatagtgggaagaagaacggttgatggtttttagcccgatctgttgcaggaagctatgaaacttcgggactccgtatctttgcagcatcgtgactgcgggaatatttaatgaacgcgcgagagcttccgaagcgggaacagctccttcgaactgcatactgaaattctgtggcgtaaatccgttgatattgacaggtacgtccggcagcaacatatccggcagtaaacttccttcctgtaacatcgcgtaatataagaaaggtttgagaatactgcccgtacttctcggagcctgaatgacgtccacttgatttcctccctgcttttggtcgaaatggacgttgccgcagtatgccaccacttgattgctcggaatgtcaatcaccagaatggccagattacgaatatcacttcgcctgaattcgttgctccatcgttccgccaggtcttctatctgagtctgaatgcccttgttgatggtcgaacgggagtattcgccgtttcgttcctgatagaaccggctgaccagatacggtgcgatctgtgggagcggatgaggctcatcgggaagtggctcgctgatagccagttcgtaggtagacgaatcgatggttttcttttcgagaagctgtttcagcaggcggtttcgcttgtcaagcagcgtttttcgtcctttggacagatgaatcatggcgggcgcgttgggaagaacggcaagcatggcagactccgcccacgataggtcatcggcagaatgtccgaagtagcgccatgcggcggcatccagtcccactacatttcctccgaaaggggcatgggagatatacatggaaagaatttcttctttggaagcgcgaaattccaggcgggtggcccagatcatttcaatcagtttctcacggaaggtgcgcgattcgttccgtgccaggcggatggtctgcatggtcagcgtactgcctccgcttacgatgcgtttattcttcacattctgatagaaagctcttccgatagcgaacggattgactccccaatggtgatagaaatgtttgtcttcgaaagtaatgaggcattccttgatcttttccggagtcgtgtttcggggaggaaatctccattggccgtcggaggcgatgcgtgcacccagcagttcctcgttccggtccgtcactactgtggagtaggggacatgaaaaaggtggcggggaagacaaaagatatatcctgtcaccaaaaaagcaagaatacaaagtattacttttttggtgacggacaatcgtttgaagaaattcaagattttgcttcccatgcacttatgctatctgtcaatgctgtcttattgttcagagtcttgtcagcggctgacagtcgttcttcccgctttggtgcgtgcctgtaccgctgcgtcgtacatagcttcgcactgaatggccggaagaataaagttacctgcataagttgcctgcaaccttacggtaaatgttttcgattcaccccgtcgcaggtcgaaataagtcaatacccggtcatcacgaatatctttataggtatacttaccggctgaactttccggaacattcgcctcattggtactggaagaggacacttccggaacaatcatccgttcattatatatttcccatccggacggtatgatatgcgtcagtgccagattgctgtaatcggaagtaccgctgatattggatagggtgaccgcagacataaagtccgttccctgtctgatgtcttccacggaaatcggtgaacctgccatatctgtgtatttcacatccagccggatattatcggcaatggctggcagcgtatcattcagcaattgggtacgtgtaatcaggtctacactcaatgctcctttgcccttgttcttcacagagactgttcccgatttcggagaagtagctatctccttttcaaatacggctttagcagatttcacggcgggctgttgcttgccgttccagttccatgtgaaatccagtgtaccggataattgctccgcaaggcgtcccattgccatcagggcaaaggcggtagactgcgtgctgaaccagttttcctgtgccagattctgtgataccttcttagcctgttgcaacgcatcccgatcccgcttcatcagaatgagcgtttccagaatcattgcttcatcccggtcggacgaaccgtaaatcaggttcatggaagaataaggaatgacggtcgtttctgcgttgtatactaattctccggcaggtttcatcttaccggtcagcgcataggcggctgccagtctccatttggcttggatggagagtcccggctgttccttcatgcggttcatggctccgtattccggtgcaccggccagtgcaagggtatagaggcggaaggcctgctgcaattccgattgccatatctgccagttgcttgcttcctgcggcatacgccagttttgggcggcggcacgctggaagcgtttccatttgttcagtacgttcggatgaacggcataccctttttcttgtgccagtgtcaggaacatacccgtgtaagaagtgatccattcgtcggcgacggcgttgcccggccagtatacaaatccgccgttgggaagctggcgggcatatatctgccggatagcttcctgtacattcgtctttattttctcggcctcctgttcgtccaccgccttgaactgggagacgaataagagaggtaatgctttggaagtcagttgctctgtgcaatgatgctgatagttgtataagaagtcgaatctacggctgatgtctaccgacggaatgcgggagacttccagttgcacctgattgttagccgaagaagaacctgccagtgtgtatgacagttcggcctcctgaccggcttctatccattggctgttgcgtaaggtaaccaccggattcggattccggacttctatttcgatcgtttcttttgtctgctgtccgttgccgcttgccgtcaggtggatggttgcctttccggttttgctgcctgttttcagagtgaagtatgccagttggtcacccggctggtcaaaagtgagtgactgctggcgattgcccgtgatctgtacgcctgcgccggatgcttccagcgatacggtcacgttcttcacttggttctccatagcgaatacatttaccggaacggtaatttcttcctgcgtactcaatacacggggcagagtagacaacagcatgagcggtgtccgcacaaatgcagtcttttccgcatttccgtaagcgccgtcctgtccggcaactaccatcgcacgtacagaacccacatacatcggaagcttcaacgtatgtgtctgttgcttaccttttgcgagatagaaaggaccgatgaatttgaccaccggtttgaaacggttggctttggcatctgccggtttcagcgaggcatctccacccgtgctgaacaatgaactgtaacgtccgccggaagcacccagcacatcgtcgtacatatcccatgtacggatgccgagagcctcgcgtgcataaaactcgttccacgggtcgggcgtcttgaagttagtcagatcgagcagaccgtcatccacaatcgccagtgtataagtcatcggttttccgcttttctcgctgacagtcacgttaaagtcagtttccggacgcagcacttccggcatcttgatctgcggttgcagaatcgtctgacggttggtcacaaataccggagcaatgccgtacatacggatcggcagatcattgactgtctgcgcatgaggctgcaataggctgatatgcagataaacattcggagccatttccggtgtaatcttgaaggtgagtttcgtatctccctgatcggacacttcgagccattgctgctgcaagacggtcgaaccgttttcgagggataccagcgcacgtcctccggcggctgcgggaatgattgccgtggctgtttctcctatctcataagaatctttgtccagtgagaaagcaagcatcttgatgccgctcgggtctgtcttgttcgaacgtccgcgccagtcgggccagtcgatgtagacggttcctccggtggcgtgtccgctttcacggtctttcacgtacaccagatagcgtccccaatccggataattgatgcggaacttgaaggaggcttttcctcctgtggtctgcaggttaccactggcaacgggagtgatggaactgttgttgatataggttccgaaagactcttcaccgttttcccaccaccagctccagctgatccggtagattttatattccagattggaacggttcaccggctgtccctgatcgttgaccgtcacgatatcaaacacatgatctttgtctgtttcgatatactttcctttcggctggttcagattgatgcccacatacgatgtgaacggagagaagggaacagtctgcgagtagatgcttgcatctcctcccggttcgaagacacgggtggtgagcgttgcattcagcatacccggagcacccgttgctaccggaagctgtatgttgacgcctgctcttccttccgcatccagtaccccgttgaacacatccgcccggacggtcgtaaagtccgttgccggattgttgaacaggtattgtccgtagttcttgaactgcgtattgactttcgataaggacatttcgacctttgctttcagtcgcgatgcggtggctcccgtcagccatgaagaagtaagcggggcatatacgtctttgctcgaagcctgaaggatggttggcaaagccagcgtaatcttcagacggttcggcttgatggtttcgatgcgcagactcttgtggaaagcggttcctcctactttcacgtaggcattccataatccggtgggatcgtcggcttgcgtgggcacggcaaatgtatagaatccgtttgtcccctgggtagagatcattttggtatagaactgtcctcttggattgtaaatctccaatgctaccggatgtttgtccggaatacgtttctcacggtcttccagcatgaaagaaatatgcagtgtatctcccggacgccatacgcctctctcgccatagataaatcctttcagacctttctgaatgtcttttcctcccacatcgaaccggctgaccgactgctcctcgccatcgaccacgcgtacatacgccttttgcttgtccgcttcggccaccgctatgaaaggaactcccttcggagtgatttctaccagcccttcaccgttcgtctctccctttccaatcggctgaagctggaagttataaatcgtcacttgtgctttcgctaccggtttcgtatccaaaatgttatttactgcaatccacaatttattcagtgaattacgtttcacaatcattcccagattggaggcaaggatattgcaggcggctatccggtcggaattcatatagtaggacggatggcaggggttatcccgttctgtccatcggtactgactccagtccatcggtacgctgccattataataatagtatgtttccggagtgtcccatactgcttcatcgtcttccgacaatgtctctccgctgactttggtcaggttgtcggaagacttgttgtccgcaaactgcatttccttgttttcacttcccccgcaaggataagcggagtattcctggcggaacgagaggatgacacggtaaatggctcccggctcctgatgaatcaatccggcaaggtctatcgaatagtcttcccagcggtgcacatctttggaagaatctttcgccagccacaatgtcttcttataaaccagtcttcccgaacggcgcaattcattggctgaggagagcgagttgttctgcatgaacatcaatacgttgttttcgaaaatacggatcacgctcaaatccaccgcatatagattgacggcacggaaggggatgatcagacttttcgaatcgggcaggatagcggcggaagtagccatttctacctgcggtttcaggttcagttcgctgaatgagatggagtgggaagtgcccagcggtttgtcctggctgtttcttattccttcatggatattcagcgtcagtttgttcagtttgccggtttcgaagtaaacgaatactttattttctttgatctggaaaatagaggaagaaacttccggaacgtcgatgagtcctttcaaatcctgtgtgttggatacagggtcggagaatatgatttcaattccgttttccggttggtcgatgcgtacggcggacaggaagcggaaactgttctttgccgggatcagaatacttttgttttgggtacggtcgatgcctgccggattgcctttggcggtaatttccagttggtaatcttccgcttctttgattatctgactgatgctaaatgcgtatcgggtcgggtgatctgtctgggtgatttcaatcggatagcttttgttcttttcgcttccggctgtgagcattttctctacttcctcttttttcactacatcgctgaaacgtatttcacccgttacggtcacttggtcgggctgggtggctgtgacggttatcggatcggtatgaatactaaagtttcgttcctgcacgcggaaggagaagttgaattcttccagctttttgtctacatcgacgaaatctcccaggtggaaggttccttcgtaaaaggcacctggtttcagtgccccttcttcggggacaaattcaatggtattgttgctgacccaatacgtttttcctttcaatgaaggagagaaactgaacggattgtctttcagttcctgattcaggtctaccatcggctggtcctgtgtcagctctatgcgtatcgttgagttttgcgaaatcactcctcccgtataagcattgacgtatggagcgtattcggcagaaggaataatgtctttctgattacttttacaggacgaaaatcccgcaattactgtcaaaagaatcaagaatagtccggcagcagcgctgcatctggttttaatttgtcccatagcgatgagtttttatgattcaacaaacaaatatacagtttttatggaagatttctcttaaatctgcttacttttgtacattcaaatcatgtatttatgggaagaaagcaagaatataaagagacgaatttggagttcttgaaagaattgtcatcgcaggaaggtgtttatgccttgccttgcggcatctattataaggttttggagaccggtacggggactgtttttcctaatgtgcggagtattgttaccgttcattataaagggagtctgattaacggtcgggtgttcgataattcttatgaacgtaattgtccggaagctttccgcctctgcgatgtaatagatggttggcaactggcgctccaacggatgcgtgcgggagataaatggatcatctatataccttacacgatgggatacggaacccgtgcatccggtccgattccggctttttcgacattggtatttgaggtagagcttttgggagttgcataactaacgaagaaagatatgaaagtggaaataagaagcaaagtggtgatattgctatgtatcgttctggcagttttttcttcctgtatcacggacgatgatgatgataggggagactttgctcttgttgccggtgacgcccttcctcagttttcggtagagatgagtgatgggggagtgttgaatacgcagtcatttagcgggaaggttggagtgattgtcttttttcatacggattgtccggattgtcagaaagaacttccggttattcagaaagtttatgatacgtataaagagaatccggatgtattattgtcttgtatcagccgttcggaatcgggctctgaagtacaagcctattgggaaaaacattcgttttccttgcctttttccgctcagaatgatgatgctgtcttttcgctttttgcttcccataccattccccgtatattgataacagacaaggaggggattattcgtgctgtatatacagatgatcctttggcgacctatcaagaattggcaaaagatatcgatgctgtcttaatcgataagttgtccgggaatgaacgatagctcatttgttgcaaatcaacagatggtttaatctggctttttctatttttaatggtgcaaatagtatacatctgtgtgagtgcgaaagaacagatatacggcactgtccacaattttgtgtaactaatctcatgtctttagtaatgttatgacttcatttctaagctttggcagatgattaataaccatgctccaaagtatatctacagatagactatcatagccatgtatgatataatttctggcatctactattttacgagaattggttatagctatatccttatcaacttttagtattctattcatagcttcaccaatgatttctatattcctttcaacggctcgtctaaggcataggttactatagaagtcatcataaactttaggagcattgccgaagaaaccttccacttcttcaatggcagttagaatatcttgcaagtgtttctttattaagtcatccatagattaaagttttagttgcatccacattcttcttcagatatggattcttaatcgtttgttcttccagtaaatcaacttctctgccaaacagattctctaaagcatatttgaaatcaaagtaattatcaaagtaatcacttacttctgctttattgaaatctactactaaatcaatatcactgttgtcgttaaagcgatttgtaaggatagaaccaaacacaaatagcttatgtaccttatgtttcttgcataagtctataatcttctggatattgttctctattagtttcatgtggctgtctcctttcaatgcaaagataatgaattagtttctaattaacaatcttgtttatggggaagttgtcagattcaacctttttacattaacactaacatgagttcaaatagagaagcatggaccagtaggctatttggcggatgagataaaggagactgtagtaacagagtatgtatatcatcctgtagatgtcaccctattcaatatactattaccgtttcttccgaatcttaaatgtagcaagattccctttatggtcgctgggccaaatacaagaaggcgtcagaatcttatccttagaatcgttttctgttatttttccccggacaactgtttcggagggacctaccaacttgctatccttcatggaaagcatcgactccaatggataataataaatgaaatcaatccggtcacgttcgtctgcctcaggcgcccaagctaacttttccagtttagcctcttctgcgagtttgtttccggcagggaatgtaaaaccgggatatcgaactgtattgggaaatttttcacgataagcatctttgaatcctgctttgctcagcatcattgagcagtcccaatgaatgatagccccattatgatcccacaaatcctttgtatctgcctgccagtctaaatgagagggctcattaaaatctcctcccatgattatcgggcggccttgttgaatgtcagattgtacttcctgaataaaagcacggatggtttcatcccggaaagactgtctgtttgctttcaagacttcttcttcatccgttatcggcttatccattttcttccaggtagtaccattatatccacgtggcatatagcattgataatgccggtagtccaaatgacaagaatagaaagatacgggttggccttcgattgttgcaaccattttcaccatagcacgaccttcgtcaccaggtacgatgcagcatttggtccaactgtccggcttgaatttactcaaaacaccgattgcaagatcaaacgtttcaccatagtaatgttttcctctcttctccagctcttcgatcacatgagggataaactgttttccgtctctgatttcgcacagaaaaacgacatccgcatccatctgatccagtacatcaataatgccttgatctccgttgggtactttagtacatccatgccacaggtttaattggaaaacggtaaaagtgtctttcgcttttgcatggcaaacattgaccagacaaaacaagcaaagtaataatagtaagttctttttcatatcgtgtcctttatattctttggaatttcagtcattgtgaaattcattgatatattccataccataggtcattaagaattcatgcaaaagtaatacattttttatttattccaatctatttatgtgctttttgaattttcttcttcggctagttcttttatttctttattcagaaagactgataatacagttcttactataactacacctcctaaaatagccagttcgtctaaagtcgggtctactacggtctttagtatgtctgatgcaattagaaattctaatcccaataagaggtaactgccgaaatcagctctcagctgccggacattattgatggtataggttccgttgatccgtttgaattcgttacggagaaaagctatgaatcctacgaatactccataggttacaatcaataaactgattacgccaatgatggtggccagtatgtttaaaaatgtcagtagcatcgtttcatgatgtttggttatattgtaataacaagttatcctgtataaaagttttgtattgtgatgtagaaaacggataattagttgtaatagtcaagacttgttctgacatttgactactatggaggaacagtcgatgaaatacttgctgccccgttttacctgattatgttatttcattatacatattggcaaattcaatctgtcttgtacgcctctggtatctattctgctttctttgggacctggaatcagtgggctatagtttaagatatggcgtattctttttcgttgttctaaagttatttcattataaaagcaatatgcatagtccataatgttgtgtgcttcatattctcctttttcacagctatatcgtttagctaaatcttttaattgatatttattctgtttatccaaattgttaagccattgttcatactc

SEQ ID NO: 114 - DNA, 25125 bp, Bacteroides thetaiotaomicron
atactatagatttatttctaaatcaatatggttaactgcacttatactatttatagctgcatgtagcaatgatgactccaacggtggaggctcgtcacagtcaggtgatgcctactggaaaatttcctccactgtaaaatcggcatccggatcgtctgccataatcatcacaggtactcctgggacaatatggaatgcagaaatcactgagggcacaacatggtgttctttcagtagcaatgatctgaccttatcctctaaatccggagaaataaaagacggactcaatgttttatacgtgtattataatagcaatacaggtaaagaacaacgtgtagcaaaagtttcactccagtttgcagaccaagaggcgaaagtctttgatttagtacaattatctgaatcacagcagaacttgccagctttcaaactgtgggctgaagttcctgatttcaaggaaaatgctaattatcagtatgtaactcattatgctctattgaataataaaacaatacgtaattattctatttgttttgataaaacaaagaaagcagctttatgggtagcctatccgatacataacgcatacctcaaaggttcaggagaacgtacagaccgttgggccttcgaccctatcattcctcaaagttatcaggctgattgtacattaagatcttatggaggatcttatgaccgtggtcatcagcttccatcagccgatcgcctaggaacagacgaaatgaatgctcaaaccttctatatgtccaatatgaccccacagcttaatcgtttgaatcaggatatgtgggctaaacttgaaacaaaagttcgggcaaataactgttctgataccttgtatgtagttaccggcgcatattttggggcaggtgcaaccaccactacggatggagcaaggaatacagttccggttcctacgaactacttcaaagtacttctgcgtacgaagagtggaaaaacaggaaagaacatcaaagattgttcagacagtgaactgatatcaataggattttgggtagatcacaaatcgtatggaaacattgaacctcctaagtctatctgtacttctgtagcagacatcgaaaagatgacaggatttaccttcttcccacaagtatccaacagtgtaaaacaacaaaataatcccactcaatgggggattaactaataagctagcttatgaaaaaactgttattagtaaccgcgctctttgcgctgctgatatcgttcagctttgcgcagaaaccgtataaggttgtattttacaatcttgagaacttcttcgatacaatcaatgatccggaagttcacgatgatgaatttactcccgaaggtcctaagaagtggaactcagccaagtacaataagaagttggctaacacagaacgtgtattcttcgatattgcagctatcaacaaggattatccggtaattatcggtgtatcggaagtagaaaaccgcagtgtactggaagatattatcgcaacccgcaaactggctccggcaaactatcggatttcacatttcgactctcctgaagcccgcggtgtagacgttgcttttctgtatcgtcccgatgtgtttaaaatagaaggagaaaaagctgtaagaacagtcatcccttcacttccggacttcaagacccgtgatatcctgacgctttggggaacgattgaaaacgaacccttcttctttatggtagcacactggccttcacgcctgggaggaaaagaagcttcagaatttaaacgtatcgctgtaggcgaacagatgcgcagcattgcagactctgtaatgaaggccaatcctaacacgaaagtggttatgatgggagacttcaatgatgatccgaccgacaaaagtatagcacaagggttaggagccaaattcaaactgaaagatttgaaggaaggcgacttcttcgctccttatgccgatatgctcaaagcaggatacggaacactagcctacggagatgcctggaatatctttgataatattgtagtatccgagaatttagcaaaaggatcgacaggaaagctgaaattgcagcaagctcccggatctaaattctatggaaatatcttcaagcaactttacatggtgcagaaagaaggacaatacaaaggatatccattgcgcacatacgtaggtaataacttccagggaggttacagtgaccacttccccgtatatatctatataggtaaataaaaaaataagtttatatgaaaatcaaaacaatcctattcatggtattatctttgatgtcattcactgtttttgcacaaaacaatggtggagtcaaaggtaaagtcgtttcccgtacgacacgtgcggccatagacggcgtaaaagtgacattaaccccgggagatgtaacaaccaagactgatgcgtcgggtaacttcgttatcgaaaacctggcaaaaggagaatacactctgtctttcgaagctgcagagttcgaacctttaactctggctgtccgtgtggataagttgatcagagatatcaataacgtcattttgatccctgaaaacgttgctcctacgatggacgatgctatctttgccgaatttgacacagaaacgctggaggatgcacaatcacttccctcgtctctgtccgcatcaaaagacgtattcaataacatcgcttcctacaaattcagtgaaatgcgtttcaatgtacgtggttatgattctcaatactccgacgtttatatgaacggtattcaactgaatgacgcaatgacaggatatactccctggtctttgtggagcggcttgaatgatgcgactcgtaatcaggaagtcacatctgcactgaacatgggggatatgggcatcggcggtatcgcaggtacaacaaatatcaatacccgtccttcacagatgcgcaaaggccttcgcgccagcgtagttaacggtaactccatgtaccgcttccgtggtatgctgacctatgcatccggattacaggataacggctggtcttatgccttctccgtatcaacccgccaaggaggaaactcttatgtaaacggtgtgtactacaatgccttcggatattttgccgctgtagaaaagcaattcaattcacaacaccgcttggcattaagcatcctgggtgctcccacagaacgtggtgcacaacaagcttctactcaggaagtctacgacttagtaggcaacaactactacaatccaaactggggttggctgaatggaaagcgtgtcaacgcacgtgtgcgcagctatcatgaacctattacgatgttgaattatacattcgacatcaatgaccgttcacaattaaacgttgcaacctctgtacgtttcggacagaacggttactctgcgctgacttggtacggtggtcccgacccacgtcccgactattaccgttatttaccgagtttctataacaacacttacgtcggagcacaactgtatgaagcatggataggaaatactaataacatccgccacatcaactgggacaacttgtatcatatcaaccaaagccaggaagagaacccgacctatggagccggtcatcgtgccatcaacatgattgaagaacgccatgccgatcagatagactggaatctctacacacaattctctcatatcttccgtgacaattctaaaattaacggtggattgaacttgcgtcgtaatcgcacagaatattatagcgaagtgaaagatttgctgggtggtgattactgggtagacgtagacaagtttgccgaacgtgacatgggtggtatgaacccaatcctttaccagaacaacatggagtactatgataagtacggtcatgcccaagctgtcaagaagggtgataaatacagctacgactactacggaaatattatcaacgcacgcgcctgggcacaatatagcagaaacttcggcaactttggagtcaatctgggtggagaactcggacatactactctgtggcgtcatggtatttggaaaaaagggttgttccttgacaattctcaaggagactctaagaagcagaattacctgacttataaactgaaagccaacttcagctataagttctctgctgctcattctattgatgccaacatcatctatatgcaggatgctcctgccttccaagcttcatttgtttctccccgtacccgcaactctgcgactccgggtatttcaagcgagaaggtatttggtgtagacgcctcttataacttgcgttggggggatgttaaagcacgtatctccggatactatacgaagtttatggatcagtccaaagttctctcttattatgatgacgtagaagctaccttctccaactttgcaatgagcggtatcaacaaacgtcacttcggacttgaagcagcagcttctgtacctatctatgcaggactttctctgaatgcagccatcagctggggacaattcacttatgacaataacccggattatgtacagattcaggataatagtggagaaatcaaaaaccagggtaaagtatactggaagaacttccgtgtagaaagcactccgcaaacagcactgaacgtaggcttgtcttaccgtggtcctaaaaacatatttgcgtcattagatatgaactattataataatatgtacttatctatgagtccgctctatcgtacagatgccgtactgacaccgggaatgactgaagaagatatcgcaacgttacgtaatcaggagaaattcaactctgcttgcgttttaaatgcaagtgttggtaagaactggtacattaaccgtgcctatactcttggtttcagcctggaggtaaagaacctgctcaacaaccagaatatcaagaccggcggttatgaacaagttcgtctgctgaagaacaaggatgaaagttatcaaacttaccaaccgtttgattcgaaatatttctatatgttcggtacaacctattacatgaacatttatttccgtttctaaggacatcataagtaaaaagaacagttatgaacaaaatatttaaattatttatgcttgcggtagtagtgctcggtttcagtagctgctacaacgaatttgaagagcctgctccagccaaagtctggacaaaagaagacttctcaaatagcaaactaatctccatcaaggactttaagcaacttttctataaagaatacggaaacggtgcagccagtctgggaaaaactctggaaatcacagaagactatgtcatcagcggaaaagtcatctcaagcgaccaagccggtaatgtatacaaatcagtatacatctatgatgaatcatccaaatcagccattgaactgaaattgatggttagcaactatgtttattttcatgtagggcagactctctttgttaaaaccaaaggtctggctatcggtagctatcgttatatgttaagtgtaggtggaatgccgacagcagaagacatttccaaaggttatgcaaaccgtaatctcgagaataccttatttgtagatcaacatgtattcaaaggtgaactcggcagtctgacagaagacgacatattggttatcaatgaaaataattataaaacagaattgaatgatgatgcattaggacgtttggtacgtttcgaaggactgacttacaaagaaggcacatacgacggcgacaagtatcctcaatatctggaaacaacttacccgaacggttcaaccaccgctgtatatgaaaacaaatattatgcagaagaaggattgactccaacctatgcttacagctatggaggtaatcgctattatggttcttcctggtttgcttatgacaatgcgacatctacaggtggcaactatatcctgcgtgtcagcggatattcaaacttcgcacttcagcctctgcctgcagatggtgccaaaggtaatatcaccgctatttataccaaatattcttctaaaagtggaggatatattaaatatcagttattggttaatagcatgaacgatattgatttctaaataacttcattaaaaaaggcatctgtttctcagatgccttttttagataataactcagcacacccttctgcaatagtcaatatcatctcttttccctttttccgaggaatacgaatgctctctccaacaatcagcatatcttctatagtaggattaccatgattattaacagaggtagcatgttctccattatatccgttattgcatcgggtcaagtcataagccggagctaacgcccagttcccctctttataaatgaaactaaagtttttggcatggtcatctttattatccgttaagacattgaacaccatacgccggaacatttcatctacctgtttagggtcttgggtaagataaccaaccaagtgcagtaaagtcttataatccaatctgggttgcataatagattcattaagtagtgcccctgccgtagcaatatgatacctaataccattttcaatatcaaaacgtttggtagcaaaatactttccatccatcaatttaaagtccggtactgttataccacatttacgagcgacttcattataacgatactccatcgctcccatatctttcggatcatatgtatgcctgaacttcaccaaccaagctccttctgtatcgtgaagtaaacatttagggcggcatccacctgagttgccactattaaagtaaagtacctcttcatcctcatacgatttctctgacagtatgtccaatgccatttgctgaaggcaatctagtgtcggaagagatttttcttcgccaatgtatgtctccggtatataacaaagagctcccatccctgatgttccgactatactcaaccgttgcaagggagttagctcgctatcattcaccccttgttttttgagtaaacgatgaagtaaataacgcccatatccatcagggagactgtcttcaaaaataccaaagtttccccaaaaaggttgtggtttagcaataaacaaatcaggttttaaaggcaagtcaagcggagagatagaaaacccattagccaaccactctctatcatactgaaatgcgcatagccgattatcaggtgtcatactgagagttccaacacttctactatgataggttactatcagtttatttactgatttcattacgccccttctttctgtttttattcttattaatcatttccaactcctccattgtactaaacagcggttcagataaaagttccttgatagctttagagtaacccaacgcttttgctaatgccacataggatgccaatgaaatagtatgcttttgttcgaacttggcaatagtaggcgtcggaactccgctaagttcggtaagagcttctcgggaaagtcctttctcaagcctgcgtttctgcagattctgagccagaattgccagcaactcttcgggtctctctacatcaaaattataaagtaaaggcatacaattatattcaattaattaaaaaacagcactattcagatactattatatctaaatacaaagatagtttctttattcaaaaaaacaaaatataagccagttctattgagtgtattcggcaacaaaaaagatgcccccccttttctacaaatagaagaacagaagcaacacaagatttaccccgatcaccgtcccgaatcctcccaaaatccagggacgtaacttactacctttccctgcaaaaaacaaagcataaaacatattcaccagaatattactgataatagcctgcatactgcaagccacaacaaccagtacagctacgctccctgtattctgcaaaaggttcaagataaaaggagtaatgtcactaagtccggatacaaaagaaagcagattcaatccgcctgtacccgcataaaccaaagtatagtgcgtcagcactgtaaacacaacgaagagagtggcaaaaatcagagcaactttaaattcgagcgggttactgctgtcctcatcttccgactcatcggtcatatccttggagcgtcgatgacgggaatggataaaccacgcaacaacggcagctaccacagacataatcaaaagataaggatagatagatgtaaatatctccctgctaaagatcagaatcaatatcataaaacgcagaaacatcatgctgaccgcaagcagcatagcagctacatattcgttcgcctcctgctcggaagcctttctacttttacgggccaataccgaaattgtggcagtactactatataatccaccgataatgccggaaaccaatactcccgattcatgaaacacatagcgtttcagcaagtaagacaaatacgagataccggagacgacaaccgttgccagccaaatagaataaggagtgagattaatatccggaatcaggttcttgtgcggtaacataggcaatatgataccactgatagccaagaactttgccagcgtaatcatctcatcgttcttcatccgctgggcaaactccgtaaaagtgtgtttaagctccgtcaataaaagcaccgtcacaatcaccatcacataaaaccaggaaggctgggtagaaacaataggagccagacaataagtaatcagtgcaataataatggtcgttacaccaaaaacatggaattgagactgcttgacgtaatagttcaagcccagcaataaaccgagcacagcaccaccacccataaacagacgcatatccgtaggatcgagtatatagagcaaatagcctagaataccaatgaaagtaaatgtacggtcagtcccgaagagagttgtttccccttcacgcttcagactgatccgtcgttgtgacagtccgataagtaaagaaaataaagtaaccagaacgaaagttatcagttctctcggtagataattgtacaactgttccatatactgctcttttagtactaggaacaaatatacagcttatttgttaacattcaccacgttttatacggttttttcatcaggtgagagttatagtagcgtatatccccggtcacttcttcgccaataaacccgggcttgacaaacgcctcatcttccgtgcccagctctacttcagccacaataagtccttcattctcaccgtagaactcgtctacttcgaagacatgattgccactacgtaccagataacgggtcttatcaatcattcccggttcgcaaagtttcatcagttcttccgcttcggacaagggaagttccttttcccactcatagcgactggtacccgattcgttggaagcacctttgatagtgagataacctttatcgtcacgaatacgaacccgcaccgtccgaccacgggcgctgcaaatatatccctgcataatccggctctgcgcaaaagcaaaggatttaaaatcaccggaaactaaaaatttacgttctatttcttgtgccatagcacaaagataattaaaaatcaaaatctcgtcataaactcaataacgattttatcacgctccgattctttaggaactccggacttctgatagaaatacttctcaaagttgagacggagatcggcaataaaagctttggaaaggctcagcgtgataccgcctgtcacacgatgacgggcatagtcgtttatcttcaaaacacctgtctcactgtccgccagcccattactgtggtcagtcatcatatcataacgggccagaaaagaaatcttattgaatacttttttcaacggcaaatcataattcacaaagctattgaccgcatgaacgtccttaaacgcttcgtgtccatacattttatacaaatactccgcttcgatatgaaaacgactattctgatagtagatgccggcatcatacatattaatacgggtatgttccggctttatcatttgagtgctcaaagtgagattccaatttttattaggcagcaactgtgcttttatcgaataattcaaggtcttatgccattccttctgattagtcagtccggagccgttaaacaatccaccttcaaggataaaaggaagaccttctttttgtgtataacaaccggtgaagccgacatcacgcacattgcccacctgcttggctataaaagaacgattggcaaaatactgctgatggggagaacgatgggcgtcgatcgtgaaaggtacacgcatctgaccaatcgtaaaattcaggtccttgacaggaaatacacgggcatacgcatcaagcatcttgatggaaccctcgtcggacaaatcgatctccgctttataggcaacaatcggatgtacatttcccgaaacactgaagcgggcattccgcacttcaaaacggctttcgttggtttctgtctggaactcatattttccccggattgtcccatgaatttcaggcaaataatctttcagttccatggtctgcttatccagctgtttgccatccccggcatcttctttagcctgtccgcaggctgctgtcgccaacaaaagcagggcgacggttgttgtaattctactcattcagttgtttgctacttaattcgcggcaaaggtacaatgagcaagatacggagagattacaaaagagatacggtgaaattacagaatggttacaatactgttacacggataacaaaggggttacaaaaaaagaattcaccacggactaccctcgtcagcatggatattcaccgtcgacaatcaacgtgtccccgtccatgcaaaactgtgtaacctgtggtgaatcaatcagccgaaaaaggaatatgcgatcagcataatcagcgccaaaataatgagtgaaacaaatactatcttgactacccgctgggcctgctcctcctctttcttactatgtgctacttttctcttacttttacccataatgttagctttaaagttcaacgctaacaaagtaaaaacaaatcttttaactttccaaaaataacactcgctaatttttgtttttatgattcctgcgatgaaaattccatcagataggctttgatgaattcctcgattttaccatccatcactccgtttacatccgaagtctgatagttggtacgatggtctttcacgcgacggtcatcgaatacatagctgcgaatctgcgatccccattcgattttcttcttaccggcttccactttcgcttgttctgccatgcggtgctgcaattctttatcgtataagatagagcgcaactggcgcattgcattctcacggttcttcggctggtcacgagtttcggtattctcgataaggatttcctcttcttctcccgtataagggtctttgtactgatagcgcagacgaacgccggattccaccttattaacgttctgaccaccggcaccaccgcttcggaatgtatcccatgaaatgcaggcaggcagaatattcacttcgatactgtcgtccaccaacggagtgacgaacacggaagcaaacgatgtcatgcgcttgccttgcgcattgtacggagaaacacgcaccagacggtgaacaccgttctctcctttcagataaccataagcgaaatctccctcaatattgatggtacaggttttgattcctgcctcatccccttcctgaaggttggcgatagtagccttgtaaccgttcgtttcagcatagcgcagatacatacgcatcaacatagatgcccagtcctgactttccgtaccacccgcaccggagttgattttcaacacacaggccatctggtcggcttcatcacgcagcatattcttgagttcgagtgcttctaccgcttcactggctttcgcataagccgtgtccacatctccctcagtcactaattcttctttataaaaatcgaacgacagttccagttcgtctgccagcgtcttgacttcattatagccgtcaatccacttttgcaaatctttcaccagtttcatctgggcttccgctttcttctggtcatcccagaatcccggcgcctgcgttcttagttgctcttcttcgacttgaattttcttcccgtcgatgtcaaagatacctcctcagcgcatcagtgcgctctttcacgtctttaagttgttcaatagtaatcatgtgatttacaattttatcatttacaatttacaaatttctcttttcggtgcaaaggtaagaaaaattccgctacctttgtttctgtcactaaaatgttgtcacaatatgaacaaactcctgaaactttcatgcttatcgctcttccttgcattagtgatgagcagttgtagctcacaaaagaagtatagctacgagacagtgcccaatgacccgctgaaagcccgcatctacacactggacaacggattaaaagtttacctcactgtaaacaaggaaactccccgcattcagacattcatcgccgtgcgggtgggcggaaagaacgacccggcagaaacgaccggactggcacactactttgaacacctgatgtttaaaggtaccgacaagtatggcacacaggattatgctgccgaaaaaccactattggaccaaattgaacagcaatttgagatataccgccagacgacggacgaagcagagcgcaaagcgatctaccacaccatcgacagcctctcttacgaagcatccaaatacgccattcccaacgaatatgacaagctgatggctgctatcggttcttccggcagcaacgcctacacatggtatgaccagactgtctatcaggaagatatcccctccaatcagatagagaactgggcaaagattcaggcagaccgcttcgagaataatgtcatccgcggtttccatacggaactggaagctgtatacgaagaaaaaaatatgtctctgacccgggacaacagcaaagtgcaggaggcgatcttctcctctctcttccccaagcatccttatggaacacaaaccgtattgggtacacaggagaatctgaagaacccttccatcaccaatatcaagaattactataaacaatggtacgttcccaataatatggcgatctgtatgtccggagatttagacccggatgaaaccattgccttgatagataaatacttcggaggcttgaagccgaatccggaacttcccaaactgaatctgccgaaagaagatccgatcaccgcacctgtagttaaagaggtattaggtccggatgcggaaagcgttgcactggcatggagattccccggattggccagcaaggatttcgaggttctgcaagttgtttcgcaagtattatacaatggaaaggcaggactcatcgaccttgatctgaaccagcagcagaaggtgctgaacagctacggttacccgatgggactggcagattactcagccttcatattgggcggacttcccaaacagggacaaacgctggaagaagtcaaagacctcttgctgaacgaaataaagaaacttcgtgccggagagttcgatgagaagatgctgcaagccaatatcaacaacttcaagctctacgagctccaaagcatggaaagcaatgaaggacgtgccgacatattcgtcaactcattcattaacggaacaaactgggaggacgaagtaaccgccatcgaccgcatggctaaactgaccaaagaggatatcgtggcctttgccgataaatatctgaaggaggataattatgccgttgtctacaagaaacaaggcaaggacccaaacgagaagaagatgacaaaaccggagattactcccatcgtatccaaccgggatgtggcaagtccattccttacctccatacaggagaatgcagtaaagcccatcgaacctgtattcctcgacttcaagaaagatatgagccagctgacagcgaaatccgacattccggtactctataagcagaatactaccaacgatctcttccaactgatctacgtattcgatatgggtaacaacaacgacaaggcattgggaacggctttcgactaccttgaatatctgggcacttccgacatgacaccggaagaactgaagagcgagttctatcgtctggcgtgtactttctacgtttctccgggcaacgaacgcacctacgtggttctttccggtctgaatgagaatatgccggctgccatgcaactattcgaaaagttactggcagacgcacaagtaaataaggaagcttacaacaatctggtcggagatatactgaaagcccgtgcagatgccaaactgaatcaaggacagaacttctcccgcctgatgaattatgcgatgtacggtccgaagtctcccgccaccaatttactgacggaagcagaactcgccagcatgaatccacaggaactggttgaccggattcataatcagaacaactacaaacatcgtatcctgtattatggtcctagcagcagcaaagacctgctggctaccatcgaccaatatcaccaggtaccggctactctgaaagatattcctgcaggaaacgagttttcttatcttgaaacaccggcgaccaaagtactggtagctccttatgaagccaaacagatctatatggcgcaaatttccaatcttgataagaaatacgatccggctatcgaacctacccgcgaattatataacgaatatttcggcggaggcatgaactccatcgtcttccaggaaatgcgtgaaacacgcggactggcttattccgcatgggcaggtataatgccgccaagctatctgaagtatccatatacgatacgtacccaaattgcaactcaaaatgacaagatgattgatgccgtcaatacgttcaacgatattatcaacaatatgccggaatccgaagcagccttcaaattggcaaaagaaggattaatcaaccgcatgcgtaccgaccgcatcatcaaaagcgatattatctggacttatatcaatgcacaggatttgggacaaagcgtagatccacgcatcaaactctataatgacgtgcagactatgacattgaaagatatcgttgatttccaaaaggaatgggtgaaaggacgcacgtatgtgtattgcatcttgggagacaagaaagaccttgacatgaataagctgaaagcagtaggccctatcgaggaactcactcaggaacaaatcttcggttactaaagcatagtgttctccataaaatagcagacacatagcctattgatacacaaagaacaaacggtgaacagcttgccaaatatgcagcttgttcaccgtttatcgtttatcatcaggccagaccgagaaaagccttattcttcgtacatcttctcaatcagttctttatagttttcagaaaccactgagcgtttcaacttcaatgtattagtcaattctccacgctccatgctgaaaggttcaggaagtaatgtgaagcgtttgatctgttcataatgcgcaaattgctgttgcaaggtctctattcgtgcacggaacagaccgacaatctttggatgctgcaacagttcggccatatctttgtattcgattcctttctccttcgcatagtccttgacaaacccgtacaccggaacgatcaaggcagaaacaaacttccgctgatctgcgataatagcgatttggtcaatataacggtctatcaccagtttggtttccaatgcttgcggagcaatatatttaccattcgatgtcttaaacaaatccttaatgcgctctgtcaggaataactgcccattcttgaaataaccggcatcgcctgtatggaaccagccgtcagcatcgatagcagcggcagtagcctccgcctttttataatatcctttggttatactttttccacggagcaggatttcattgtcttcgcctatcttcacttccagtcccggcaataccacacctaccgaaccgatatcataacctaccggcaaagtacatgataccgtagccgtagattctgtcagtccatagccgaccaccatgttgattcctaccgaatgaacaaattcattgatttcatcgggcacggctgcaccggctgtcgggaagaaatttccattctcaataccgatcgtcttcttcagcaaagaataaatagtcttctcgtagaacttatatttcagttgattcatcaccggaggggtctttcccaaccgaagataatccagattatggattctgccgactttgatggcatccagcatcagcgccttcttcaatcctgtcgtttcattgatcttctcctgtacaccggcatataccttttcccagaaacggggtacgctgcacatcagtgtcgggcgaatttctttaatggttgtctggatatctgccggacgaagattgatgcagatctgtactcctttatgaatacaaagatagcaccacgccttctcgaatacgtgtgtcaacggaaggaagttcatagaaacgtccttgtcggtcattgtcgtcagacgctcatcatgcgtatggaactgctccagatagcacgaatgatgcaacatcactccttttggctcccccgtcgtaccggaagtataaaggatgttagccagatcatcgtaagaagcacgtgcggtacgttcttccaccacctcattatgcggcaatccttcgcccattgccataaactcatcaaaatagatggaggagacatcacgcgggtcttttactaccgaacggtcgaaaataatcagttgttgtaacgaggaacaaaagccgaagatgctgaatgcagaatcatactgatactgttcgcctacaaaaagataacggatttgcgcatcgttgataatgtattgtgcctgtgcgggtgaactcgttgcatagaacggaatagtaaccccacgattggcaaatgcgccgaaatcgacatagaaccattcaggtttattctgtgaaaaaataccgatattctcttgttcctccactcctatcgcaacgaaagcattagcagcctgtcgtacagttccggagaattgattccaggtaatcggaatccattgtgctgtctcatagtcgcggtatctcaatgctaccctgtcgccatacttttcagcctgacgatggaccaagacagataaatgatgataagtcatactctttgtattgataaatatggtacaaaggtattagttttatttgaaactattgcgcaaaacgagtatctttgtgcaaatattaagctctaaattaataagtttgtatatgaaatacgatattccaaccatgacagccgaagctgtaagcctgttgaaatcactaatcagcattccgtccatcagtcgggaagagacgcaagccgctgatttcctgcaaaattatatcgaagccgaagggatgcagaccgggcgcaagggaaacaatgtttggtgcctcagtcctatgttcgaccttaaaaagccgacaatcctgctcaattctcatatcgacacggtaaaacctgtaaatggctggcgcaaagaccctttcacgccccgcgaggaaaacgggaaattatacggattgggcagtaacgacgccggagccagtgttgtttcgctcttacaggtgttcctgcaactatgtcgcacttctcaaaattacaatctcatctaccttgcttcctgcgaagaagaagtttcgggtaaggagggaattgaaagtgtattaccggggttaccccctgtttcattcgctatcgtaggcgaacctacggagatgcaacctgccattgccgaaaaggggttgatggtactggatgtaactgctacgggaaaagccggacatgccgcacgcgatgaaggagataatgccatttataaggtattgaacgatatcgcctggttccgtgattatcgtttcgagaaagaatcacctttactcggaccggtaaaaatgagcgttacggtcatcaatgcaggcactcagcacaatgtagttcccgataaatgtacatttgttgttgatatccgaagcaacgaactttactccaacgaagatttatttgcagagatcagaaagcatatagcctgcgatgcgaaagcccgctcgttccgcctcaactcttcacgaattgatgagaaacatccgttcgtacagaaagcggtgaagatgggacgcatacctttcggttccccgactttgtcagatcaggcattgatgtcctttgcgtcggtaaagatcggtccgggacgctcttcacgttcacatacagccgaagagtatattatgctgaaagagatagaagaggctatcgggatttatttagatttgttagacggactaaagctttagtccgtctttaccactcatcaagtagaaaatcggctatatgccgatgcttaaccccttcaatattatcttgccatagatcatccatactaaccacatatttaggataatgatcatcaattgccagtaaaggggcaaactcacgatcgatggttgcttgcaagccaagttgataagtaacctgcacatatattttctcttcacgcctaatggctacaaaatcaacttctttttcatcctgtttacctacatatacttcgtatccgcggcgtttcaactccatgcaaaccaaattttcgagcattccccctattaagcggtcccgatatcccatcacagaataaattaatgaaagatcacttacaaaatacttttcattggtttgcagaatctctttgcccttgatgtcataacgtggtatacgttgaatgacaaaagcactatctaaagcattgagataattataaatcgtattgatatctactttccgttgctgacttttgaaatagtcggcaatatttttcgcatttagtttattcccaatattatcaaaaacaaacttcaccactctttcaagcatttctacgttacgaatgctatgcctctgcacggtatcacgaagaatgacagaagaataaatatcatacactattttgtagatagcattataatcatagtttgccgtatgaatagccggaaatcctcccatacgaagatatttcagaaactccgttttacggtcggatacagaaattgtcagcgggagatcatgaaataatagatattctctaaaggataaagtcataatgtgaaaggcaacgtatcttcctgccaaataagtcgaaaactcggaagatagtaaacgtgaattagaacctgtcacataaatatctacatccaagtcaaccaaaaaggcattcactgccttttcccaatctgtaacttcctgaatctcatccaagagaatataatattttcccgaggctttcgtagcttcccgaatatgagcgtataacgccttcgcctccttcatgtctatccactcgaaactttcaaagttcatataaataatataatcctcagatactcctcttcgtaaaagttcctcacgaattaaacgcaacacgaccgacttgccacagcgacgaataccagtgataactttcacaaatggcttatcaataaaaggagtgatttgctccatataaagttcacgattaatcatacaactgaagtttttagggttatagacacaaatataaataattaatcggaagtttttaggggtatacccctaaaaacttccgatttcaagtatgttttatggttatagacagaaacgacaatggcatttatgaaaaaaggggcacctcctgtatctttatctaagataagaaatttagccaccatcataataacggtggctaaatcaaagaaaaacaaccagtttcaatggtctattcaatccatcccggatttacaaagagcatagagaaaaaagtttacccgattcatattatatatcaaatcagacatttccatgcgatccactattgctcattttgttaagatactgtttccatatcaaaaaggcaattatgcctaacagattaaataacaaaaccaaaatgacccataaatatttatatggtttagtaagttgatgacttttcaacacgaccaatatcccaatcaacaaaatcagaacataaacaatttcaaaaaacattggaggcataatcataatttttattctcaataatcattaatatgcagaaactgtaacacttccctttcccgcactcttatcgtatgtccctgaagaattaataacataagaaaggttaaagccaacaacctgagttatagttgccttaattttccccgtactattaaatgatatagcatttcctgatacatagccactcgcataagattgagaatacgtataaactgataatcctgttatatctgtcattactgttacatttttgttatcttcgatcaaagttacactaaaccatgtaagattccaaatccaatcactgaatgaataaatttcactacgtgttttagcaagcggcacactaggtttctgctctttagtagaataaaacatacagccattttcttctttatccttatacatctttaattcaacagggtgttctctaagttgttttatatcacgaaacaattcttcaatttcttctaatgacatctcattttcagttttttctgaaggattaatctcaaagaaatcgacgtttacatcatatttttcagctaatgatgcaatctttgttttaacttcttccttcttaacttctgaattagcatcaaactcttcatttgtacatgcaattattactaccatagtaacaactaaataaaataaacctttcatattcataatgtttttatttaaaataataaatcaactatatcatattgctccgaatataccttctaaaagacattaagattctaattattccttttccaacaacctgataaaataggcacctactacagtacgccccgtaaatcctactatagttttcccatccgtatttatcaaatcagccattggtgtgcgatctgtagtctcattcataaacttatgaagcggcaacataagcttacggaattgcatacggtcagcactcaacgaagcagtccatactgtccaatccactttcgtataactatgtctgctatccaacggacatccaaactcattcatcttagtaagatagaaatccgtctctttctgaataactctctccgggaaaagattcaagccaagcagcctgtcccacaccagattatacttcatcccccaactatccggttggtcaaaagccagtcggtaatggtcacccgcataagcagccatttcccattctttagccatctcaccggcaacgttcatatacttcttagcttcttctttcttattcagcatttctgccagacgtgcatatgctgcaatacccagaatacctttggcggataaattagcatgatgaggacagtctcctgcaaaattatctgtagtaagctgatcaccggtatccgtgccgttttccaataaatactcagcccattgagtcaatgtcttccaatgcttttctgcatacgaagcattcttttccattttagcaatagcagcagtcattatcaatccgtttcctgcttcttctacaggcatatcaccacctatcgtctgcccgtttacgataggatatcctcctaaatcatgcggaggaaatggctttccccatttcccgctttcactataataaaagaacggattaagcatcgcttttaccaaatcgggattgtagcgaagatatagcggtgaagccggataatattcatccaccggacctacctgcggagtaaaataaagcaattctccatccgaatcttcagacatctggaaagcggatacagactgacgataagccaaagcacagagttcagcatattcttttcctccggcaaggtaagcatccgccatcaattgacggtcaaaagcataacattttgccatcacttctttataatctttctctgcatctgcatacaaatcttctatgcttgattttccgtctttattccaataaggtcttaagtcctcgccgaaataagccattgtatacagtccgtcaaaggctgcagtgagatgttgcgggaaatcgctgttcatatccagcttctgtgcaaatgcagcatagcgtttctcggcagactttctcatttgtttcagatctccctctttcataaagtatgccctcatttcggctgcatccccctgtgcacaggtcacgtcatcctttgttcccagatagaaatatccccatgaccgtccatctttctctttatccacccataatttctgattttcctgtccggtcttcatcagagccagtccatccttttcatatatttgtgtagattgtccggcacgaaatgccttgtgcgggtctatttcaaaataaacagcaacatcatgttctttgccatccaatgctttagcctgataagagatataattgaccggacgggcaagtgtctccagatcgtccaacagataaggagcggtaaagctaagtttcagttctacatctccacattcgaaggtataatgtgtttgggttgcttgcacatcgacagacgtttgttcagcttccctcaattctgcatatagtccgaagtcaaccaatgcacctcccatacgattctcacaatgagcggcaatcacggctttcccatctttcatagtttctgcaatagaatccgggatatttactctgagatcacttttccactcatatcccgtgctgaccagttgcattccattcacatacaattgaaatacatcatcatgggaatagcgtaaatacagttgcttgtttttcgccaatgccgggtcgaatgtcagttcgcgcctcacccatatattaggtgagaaccagggagtatgcacatttcgctgatcatccgtgccgaaggccgcctgtccttctgtccatgttgtatcgtcaaactctttggcttcccaattttcctgaggttgctccatagtatatcttcccgtccactctttttcataagagatgggggctaccttttccaccggcatagtcggttcctcggcaaagagtccgaagtctaccaatcctcctcccacacgattctcacaatgagcggcaatcaacgcttttccacttttcattgtttgcagaattgagtccgggacttccactttaaagtttgctccccagtcatatccggtattcaccaattgcttcccattgatgtacaattgaaatacatcgtcatgagaatagcgcaaataaatctttttatgctccagaagatacggatcaacttcaacctctcttcgtacccaaatattagaagaagtccattgtgttcttgcttcccacatgccaggcgtgccaaatgccccttctgacaattgccagtacttgtcatcaaaatccggttgctcccatccttcatcaggaactaatgaagtgaactttccttcccacttttcatggtcaagcgccatcggagcgatagcttgcatcggcagttctttactacccataaaacggtacatagcaccgtctacccgtaagaagccaacaaaaggaagttgtgtgctgccgccaaaagtcatattctgtttgttcagttcatccgtcatagaccaaagtttcacatgcggatgcaaagttaataacggataagcaggcgcacgaaggtcacttttagtagtttcatcagagtaaggagtacttttgcaagctgccaatactgctattagcagataaatgaatgttttattcattagtgttttataaattctcattcggttactatatttatttctattatcacacaataaacaatccgtagattcctaaatgcacaagcgaagtgattgacaacaaccgtattaattccatattcattctagttttatagacatattcattttttgtatttctctttccatttctcttttcatcatcctaatagtagttgtcttaattttcatcggtttgctaataacggcctcagccatagcaagcgatcgttctttttcaccattcgttttgtataaatggaatagtttataaagaggtagaaagcgcgaagggcacatcatagatgcactattataatatttttccgccagttcaggtttgttaagctgctggtaattttccccaattattaactctaaatcataatctgcccaatattgacgacattttaaagccacttctagactttcggtatattgcttcatttcttgaagaacagcagcataattatagagaaaatagggattactcacaaacatcttttctaatctctcataggttggaagagtttcattatatgacttacataacgctagcgtagaagcttttccccagtctaattctgcttgaatacgttcgaacaatttactactcccgaaaagagaatatgtaagtatgaacatacaagctattttctttattaggatattagaaaataaaggtttgatatattcactagttattatgaatatgcttaaaaatgtcacaacccaaacgaaaggatatgcaaatggataagaaaagaacgagaatattcctattgaagacaaagaataaaaggctatttgcttttctacacttggattcttcctatagcaatatataattattaccatcaataacaacaatactaataaaccaataatcccaaaatttaaaagaagtccaagatattcattaaatggttgtttcacattatctgccaacatagaaaaacggctttgtccgcattgcttaaagaaatttgcctgataatccatatagtgcgcttcgaaactacccaacccatgacctatccaaggagcatcttttaccatatttataccacattgccaaatcagcagtctaccatcggctgagtttttcttcatccaatagcaaccaaacaacaataatatcagactgctacataataatagatacttccaaattcttttctgtttaagcttttgaaacaaaaatatcgcaattactattgcaacactaataattccagctcttgaatatgatagtacaattgctattacaacaataatccctaaaaaacatactagataccgtatttgcttattttcatttaataattggaatacaacaaaaaagggtaaactgacacaaagacaagcagaaaatcccgtaggattttcaaaactccccattatcttataaaaagtattaaaggtggttatattaaaacattgagacagaccatatattgcttgtaaactagaaacaataacaatactcatcccagccaatcgtgtatcaaattttacagattttcctaataacattctaattgaacaatatattgt

SEQ ID NO: 115 - DNA, 24920 bp, Bacteroides thetaiotaomicron
tatgagtacattaaattgtttttgagatgtttaatttgatggccgttgttattaataaacaaatgaataaagttttttattgcttcgatcctaacttcgctcgtaatatttctattattgcaggcaatattgaaataaatataatagcgataatcaagagtttaagattttcctgtacgaacggcagatcgccaaagaagtagcctgcatagcaaaataaaactacccatatagctccacctatcaaattgtagatcataaaataatagtaatgcatttttcccattccggctataaatggagcaaaagtgcggacgataggcacaaagcgggcgagaataatcgttttcccaccatattttttataaaattcatgcgttttatcaagataactttgtttgaatatcctggagttgggattatgaaaaagtttgcgtccgaaaaaatgtccgatcatgtagttgcaggagtcacctaatacggctgctgcaaataagattaaaacaagaatatggatatcgatcggcataccgggtaatgcggaaatggctcctgcaacgaaaagtaaagaatcaccaggaagaaagggagtgactacaagcccggtttcgcaaaatataatgatgaataggatagcatatgcccaagtatggtaatcctgcactatattaatcatgtattgatcaatgtggagaataaagtctaatataaattccattatatatcaagttattaatatgtaaaagtgaaatcgtatgcatattcccggcaatggaaaagactcttcttgctttcttgccttgaatataaagagataaaatgggcatgaagatacactcatctcatcccatagaaggaaaagagatatttaaataagtattcgtcctagtgtatagacgtaatatctatatgagaatttggtgagatttgtgtagtaggggagaccagtccatttttctttcggaaattgatattttaaggaacttagtatccgaattgtaacggaagaaacgttgaatcttagaattttggaaagagaagtggtacgggataaaagtgagtttcctaaaataccatcggcaatgttgcaatcatattttccatcatatttcccttcttggaaggagttgttttctttaccggattgtttgactacagctttggatcggtaactctgtgacttattatgggattgtatagtggtagtaccggcctctgtccggaactcctgtaattctttatcgggcactaaattgcatccccatatcagaaatataccaaataatatacagaaaatgtatttcgccataacagtcgcaaatgtagaaactatttttataagaaatacatattcgaaagtataattaacaattagatttgggctccggggaactggaatctaatggtaatatcttcttctttatttgtttgatatgagtttcatcggagtataactgattccgtttgtttgttgcctgtcgtttgttttttcaaatcccagagattcgtaaaacctgatagcgtatgtagatgagtttacagttatttcatttgccggacaatcacattgggaatagtcaaacagttgcttgcctatcccttttctatggaattcctttttgatgaaaaacaaagaaatgtgtttgccctcattcttggttcccataatacctattagtttattttcttcgaaagctccataaatgcagagttcattcatcaatttatcgttgaatataaaacttttgaaactctcaagaccttcgtcttcgaaatcatcctgaccacattgcaagtatacttctaatgctaaagttgtcgcctgctgaaattctgctttatctaatttgcgtatcataattaatcatttgttgagaatataatttttgtctgtcgggcaagatactgattttttttatttcagacaatagggtatttgcagattgaacgatcttatttatagaagcaggaattatttactttaaaactttattaagatgaaaaagtcagttatacttttggttggatggttattagcttttctatggatagggagtgctgatatatgggcgcaggatgcaggagattatttcacgattgtcggaatggtgaaggataagcaaaataagagaacacttgaaaacgtgaatgtatctgtgcaaggaagtaatatcggtacggtgacaaatgcagagggagagtttgctctgaaagtcaggaaagaagaagtgccgcgagagttggaaatctctcacataggctatatcaatagtcatgtatctttagataagaataattcttctaaattgacggtctggatgatacctcatactaaccagttgaatgaagtggtcgtttatgccaataatccgcgtacaattatagaaaaggcgattgagaagattccggtaaattatagtgccaaccggaatatgcttaccagcttctatcgggagactgtgcagaaagggcgccgttatatcagtgtatcggaagctgtacttgatgtgtcgaaaacagcatacaccaatcgcactacggattatgataaactacaggttctgaaaggacgccgtctgctaagtcagaaagttagtgatacattggcagtaaaggttatgggtggtcctaatatatctgtagttttggatatcgtaaagaataaagaggcgctgctggaaccagaagaattgaacaactatgagttctggatggctgaatcggcattgatcgataaccggatacaatatgttattaatttccgtccgagagttcttttaccatatgcgctgtttcatgggaaattgtatgtagattgtgataagctgtcgtttacacgtatcgagatgaatctggatatgcagaataaatcgaaagcaattgctgctattcttcatcagaaaccatttggactgagattcaaaccgcaagagttatcttttctgataacctataaaacgatagatggaaggacttatctgaattatatccgcaatgatattcgttttaaatgcgactggaaacggaggcttttctctacgagctatgcagtaacctcagaaatggtggtgacagatcggagggagagtccgtccgagataattccgcggaataaagtatttacctccaatcagattttctatgataaagtcggaaattactggagtgaagacttctggggaaattataatatcatagcacctacggagtctctggaacatgctgtcgataaattgaaaaagcaatctaattaaaatcagaattgttttcttatatttgggaacaatcgtaaaatgatagaagtatgctgaatgaactgctcatactgacaaaaataaaggcaggtgacataaaagcgtttgaggaactatttcgctgttactattctcccttgtgttggtatgcggcaagcattaccggacggatggaggtggctgaggaaattgttgaggaactgttttatgtgctttggaaggatagggaacagttacagattttccagtctgtaaaaaactacctctacagggcgacacgtaatcagtcaattcaatactgtgagcatgaagaggtcaaagagcggtatagagagtctgtgctgactgcatcttcttcggaacaggtgacagatcctcatcagcagatggaatatgaagaacttcagaagctgataaataatacccttgagaaattgccggaacgcagaatgcagatatttaaaatgcaccggacggagggaaagaaatatgcggaaattgcagtccagctttctctctccgtcaaaacggtggaagcggaaatgacgaagactttacgaactttgcgaaaagaaatagaaaattatattcaaatgaaatgatgaaaacggatattcataaaataaagacggagcaggcttggaatcggttgtacgaccgattggataaagatcatctgcttgtagaagaccatcggatgcctaaaatcccgatgtgggtacgctatggcactgtagcggcgatggtggtcggtttggtttttagtactttgtattggggattcggtcaaaaagaggaattacctgactttataacacaggagaatcaagatgttcctacattggtcacgactctggaagatggttctgtcgtgtttttggcaaaggagacttctatccgatatccggaacattttgtttccgacaaacgggaagtcagtttgcagggagatgccttttttgatgtggcaaagaaacagaagcaacctttttggattgatacaaaggaagtaaagattgaagtattgggtactgcttttagtgtaaagagcgtcaaagatactccgttccgtctctcggtgcaacggggaaccgtcagagtaacccttaaaaagggaaataaagaatgttatgtcaaagctggtgagacagtggtattgcaatcacagcaacttttgctcagttcgactgaaaatgccggagagttgaatcgctatctgaagcatgtctgttttaaagatgaatctttggggcatattctgaaagtaatgaatatgaatgcaggcagttcgcagatacgtgtagcttctcctgcgcttgaaaaaagaaagctgacagttgaattttccaatgaatctccagagactgtggctacattgatagcctatgcgcttaatttgaagtgtacacggcagggggatacattcatgctgacagaataaataaaaaaaagtgagatgaggctggtttatcgctatatggtgattctgtgtttgttctttatcgtaccggatacgttgagagctgacggagaagatgtgctggagcgtatgatcagcctgccgaagatgaaaggaacggtctattcactgttaggcaatatttctcagcagtcaggttatctgtttatctatgacagtaaagtagtagataatgatgtaacggtgaagatacggaaaggagagcgaaccattcgtcaggctatttatgagataacaggagataccagcctggaatttaaagtaatagggactcatattctgataacttcttcttcaccgaccaaacagcaacaggcgaaaccttcatccgttcaccctgtaaatctgatgcttaccggaactttactggataaggaaaccggaatgcctgttgcttctgcatccgttggagtccggaggacatctgtggggattgttactaatcaggaaggagagttcagactttccttaccggattctttgcaaaacgattcggttgttttttctcatataggatatgtttcacaaactttggaagtttctgttttggcaggtcgccatcatattctgagcttggaaccaaaggttgttcctttacaggaagtagtggttcaatgggtcgatccttataagctgctgaaagaaatgggaaggcaaagagagcagaactattctcattctcctgcctacctgaccacattttaccgtgaaggagttttattgaaaaataaggttcagaatcttactgaagcagttttcaaagtttataagatcgcttcgcattctcccgtttccgatcaggcgaagctgttgaagatgagtcggctgagtaatgtcgaagccaaagacagtctgcttgtaaaggtgaagtccggcattcaggcatgttttcagatggatataatgaaggatatgccttcattcctgatacctgacgcaggtgataacggttatctgtatacttcgcagggagtgacattcatagacgaccggtgtgtgaatgtcatacactttgcacaaaagaaggagattatcgagcctctctattgcggagatttgtatattgatgccgagacgaatgccttgttacaagctcgttttgaggtagatccccagcgtgtaaagaaagcgtcggaaatgtttgtagaaaggcgcacgcatggcattcagataataccgcaaaaggtggtttatactatttcctacaaaccatggcaaggtatctattatattcatcatatccgtggagacctttctttcaaggtgaaacggcgacggttgctgtctgctagtccgcagatgcagatctggtttgaaatgatcacttgcaaagtggatacggaacaagtgactgcattcccgcgggcagaaagattaccgacgcgtactatcttctctgatctgaatttcaaatatgatgaagacttctggagggattttaatgtgatacctctggaagaggaacttggtaagctgattgagagaatctctttgaaaatagaagaaatcggcccttgatttgttttgccattcgccgggattgctgtaactttgcgcccggtttaaaagattgtagaatatggaattgcctaaagatccgatggtgctgttcagtgtcatcaatatgaagttgcgtgactgttattcttcgctagatgagctttgcgaagatatggatgtaagcagagaagatattgtcagtcagttgaaagctgcaggttttgaatatagtgcggaacataataagttctggtgattttcagtcaacttcggcttgtatataaagagttaacagcgcctccatggtcttgaaaaagattatggaggcgtttttttattccttgtatgccaatgtcatatttcctcttttctattaataaatgtaaaatcggctcttgtgcatttaacttcgttccttttcggcgttctaataaccaaagctcagaaataatagatgataaacgaagataaaatccgaaaagcttgttcctcagatcgcgagcggggattcaggttgctggtggacagttttcaggaaccgatatataattatatccggagaatggtagtgtctcacgaagatgcggaagatgtgctgcaagaagtcttcattcgtgtattccgccatttggatcagttccggaatgaaagttcgctgagtacatggatctacagaattgcaacgaatgagtgtcttcggttattgaatagtcgtaaagaagaagtaatatcagcggaagatgttcaggaagaactgatgagtaaactgaaagcttctgactatgtcgactacgaagatgaactggctgtaaagtttcaggaagctatattgactttgccggaaaagcagcggatcgttttcaacttgcgctattacgatgaactggaatatgaagatatcgcccgtgttctggatagtaaggttgagacactgaaagtgaattatcactatgcgaaagataagataaaggaatatatattaaacaggtaacatcatggataaggattttgattttgacaatattggtaagcggacaccttatcgcactcccgataacttttttgaggagacacagcgtaagatattggaacgtacggttgacgagcaacgcaagaagcgtcggctgaaaaggattattcctactgtgattgctgtagcagcagtattggccgggattttgtttacgccgtctctccgctatatgaataccgacacaccatctgcttcaaatatattggctgtcgataaaaataatgtaacaacagatccggtagataaatggattaaggaattgtcagatgaggagttggaagagctcgtcagcttctctgaaaacgatatatttttaaactgaataactcaattaattattaaaacgtaaagattatgaagactaagtttatttatgtagtgttgatggctttatttttgggaagccagatgaccctttctgcacagaatgaagaaaacaaagaaagaaaacagcgtcctacaccggagcagatgatgcagatgcagaccaatcagatggtgagagcgctcatgctggatgatgcaacggcagccaagtttactccgatatacgagaagtatctgaaagaacttcgtgagtgtcgtatgatgaacttcaaacccagagcgagaaaagatgcagctcaaggtacggaagccaatactgccaaagaaactccaaaaccggttatgacagatgcggaaatcgctaaaatgttgaaagatcagtttgcgcagagtcgtaagatgctggacatccgtgagaagtattataatgagttcagcaagattctgtctcaaaagcagatcatgaagatttatcagcaggaaaagagcaatatgaataaattcagaaaagagtttgaccgtagaaaaggacagaaaccgggacaaggtcacaaacccggacaagaccgccagagacaaagacagcatacccctcatcaaactcaaaagtagataatggattaggtattatttattatagtgttttattttactaaagtcaacacaaattgggcataggcagatatatctattcttttcagtatcgtttgattattcattgtgtcttgttactgataagttttggcagcctatgcacagtccggcaaagagagctttgccggacgtgtagttgatgctgactcatgatacatggtattctgcgtctgaatctgctggaaggataaagctgattaaatatttatcagtctgaaacctctgcggggtattaattgttgtatccatgcgaaaacaatgaaaactttgctgaatggagtttcgactgattaaaaaattaaaggacagaggacgttggcgtatcttcaaactcaaattgattgatgcgcggctttactttgtcagtatctttgtcgggttactgacggggcttattgctgtgccttatcattacctgcttcagttcttcttcaatcttcgccatgacttctttgattctcatcctaaatggtattggtaccttcctctttttctgttaatgtgggggattcttatatttgtctcctggctggtgaaaaagatgccgttgatcacaggaggaggtattccacaaacacgtggagttatcaatggaagagttgcgtataaacatcctttcattgaggtgattgccaaatttgtgggaggaatacttgcgctaagcaccggtttgtctttgggacgtgaaggaccttcggtgcagatcggttcgtatgtaggatgtctggtttctaaatgggggagagtgcttgccggcgagcggaaacaattgttggcggcgggtgccggtgccgggttggcggctgcttttgctgctccgttggcttcctcattgctggttatagaatctattgaacggtttgatgcgccaaagacggcgattactaccttgctggcaggagtcgttgccggaggagtcgccagttggctttttcctatcaatccgtattttcagattgatgcgattgtaccgggaatgactttctggtcacaggtaaagttgtttcttcttttggcggctgtggtttctgttttcggaaagttcttttctgtcactacgcttcaggtcaaacgtatctatccggccatcaagcatccggaatacgtaaaaatgctatatctgctctttattgcttatctcatctctatggcagaagtcaatctgacaggaggtggggaacagtttctgttggcacaggccatgcatcccgatacccatattctttggattgtcggtatgatgttgttgcattttgtattcagtaccttttctttttcgtcaggactgccgggaggaagtttcattcctacattagtgacaggagggcttttagggcaaatagttgcattgattctggttcagcaaggagtgattgcttatgaaaatatcagttatatcatgttgatctgtatgtctgcttttctggttgcggtcatacgtacacctctcaccgctattgtgctgattactgagattacgggacatctggaagtcttttatccttctattgtagtgggaggactgacttactatttcacggaaatgcttcagataaaacctttcaatgtgattttatatgatgatatgattaattctcctgcgtttaaagaagaggctcgctacactttatcggtagaggtcatgagcggttcttacctggatggtaaaatcgtggatgaacttcgcctgccggaacgttgtattattattaatgttcatcgtgaccggaaaaactggcctcccaaagggcagaaactgatgccgggggatcaggtgcagatagaaatggactcgcaggatatcgagaaactctatgagccgttagtcagtatggcgaatatttattaaaaaagaagtgaagcgtttattcaacgcttctcaaccatgcaatttcttctgcccacttgctttcatcgggtgtttcaagaataagtggcatattatcgaatcttgaatctttcattaatctttcaaagaatgcactcccgatcagtccctggcctatgttatcgtgacggtcaacatgactgcctaattcttttttagaatcattcaggtgcataccacgcagatactcgaaacctacttctttttcaaattcgtcaaagactttatcgtaatcattcactatgtcatatcccgctgtatatgtatggcaagtatccaggcaaatacctacacggcttttatcattcacccggtcgatgatatatcttaattgccagaattcacttcctaaattactgccttgccccgcagtattttcaataacggccgttactcctttagtcttctccaaagtcaggttgatactttctgcaatgagtgcgagacaatcctctatggagattttattcagatggctgccgggatggaaattgagaagtttcagtcctaattgttcacagcgttgcatctcatctaaaaaggcagctcgacttttctccaatccttcttcttcggggtgtcccaaattaataaggtaactgtcatgcggtaaaatatagtctgtttggaaattgtacttagtgcaattttctttgaaaagacggatgttttcttctttcaatggtttactcacccattgacgttgatttttagtaaacagggcaaaggcatttgctccaatctcatgcgcattgacaggggcgaattctacgccgccggatgcgcttacatgtgctccaatgtatttcatcttttattctatttaaattttatctgttgatataacatttatgcaggtttcaatgtttgcgtagagtaccaacataggcaaagatacaattttttagtagtaaactcaatgctcattatgataaaggtacagtgatctactgtctttttatatcccacatctcaggtattaatggttgagttgtcagatgttaatacctgaaaagtcagatattaatacctgtcatggacattattaatgcttgaaatgtggcataataagcattgtcaccttcaataaaagacaataaaagaaaggagctattcgtaagtttataataaccattgaatagctccatattgtgtgccagaattgagaaattatatctcaaaatccggtaaatagtcagtcagaaccttattgacctgtttcccttgtacttgatctgtgatgatagtcgcaccttccttcttgccggcatcgtatttcaaagaaaccttttccgcttgatgggtgacgctgattgccgctttccctttctccgtcagattgcaggtaataatccagtcgcctacttgtacggtattgccttggcgaaccactttcatatccgcacggttatttccatgtgtatccataacggtgaggaaacgggcagttttacatggaatggtagtagacgaaaaatgccagtgattgggatacttcacagcttttccttgggcattggttacattcttccagttggttggagcgcagaagaaggtatctacgatggcctgttccgtctttgccgaactgaaaagatgagcaacagagatgcctccatccttattctttcccgtaactttcacttcatcaggaagttcctgcatttccatcggaagttctaccgtatgcagcagatagctccatgtgaccgcttcttttccttccagttcatcataaatcacatacactcccgtattgcctaattgaatgatgtgccgacggaacatcttcagtttgttctcatcccatcccttttcgggagtgtactgcgtgccggaaagttcaccacgtttcaaccagataggagctgtgatctttccgtaagcattggaagcgtctcccaccatatacgaaatcttttctccttcataccaacggggaatccatccgtaaccttccgttcctatagtctgagtcattccgttgaccagaatactattgtgcgcacgggtgtttcgataggaatacatacaatggtcatcggtaaaaccggtacgatgtccgctgctatagaagatcgccttgcctccatagaaggtattaaatgcattctgattggccaatgcgtgcgaagttgaaccgtatggactggaacggaatgacaacattgtgttcttttctatatcccccaacgaagtatgcatcgtagcaattcccgtttcattaaatactttcgtcatcggcaactctgccaatgagtgttcttctttcgggagtgccttgtcagtaatgcagcgataccaggtcagatcacctgcttttccaagaaaagactttttcatgatatccggttctttctccagaatggtacgtgcgtaggcggctgcccacggattattgcattcacgtgctaaagcatccgcatagccgacccgtgtcccgttcggtttcattttcgtttcatgggagttgccgtgtcccgcagatttggagaacggaggctgatgatagattacatagagcgcattgttgttataccagggatcggcaaagaaatcgaaaccgctgatacgtgaatagaaagcgggaacttcgatcaatgtacgaaggttgacatggaaataagagtcaccgttgtgccatcctccgtcggtgttgagtcccggcagacgggatacccattcgttatagcaataatctacccaagtggaagccatcggcaattcaccgtatgtagcaaaagctgccatattcagaatacggaaagtcatctgccatacatgattgtcggcaatacggttttccagatgattcacatattcatgataaaacttatgggcgttttcgctgatcgtttcgagaagcaactgtttctcggcaggcgttaacagattgtaccatgcatcataagcggaagtactcatggacagaatcgtggagcggttgaaatctcctgcgaagtacttactgtctttccacgaaagaatttcggaaagacgtttgataccttctttgtagtacacttcgtctttcgtcagcagataagcgcgtaccatagcttctatgttcgcttcttcgcggtctactatcttgcggctttcccgaatcaatgccgagcgatattgtacgatgttcgtcaatttgactacttgggtggtatcgatttcctcctccagatgtttcaatggatgattgaggcatttccttgctttctgaatatagagctgcgcttccggattattcttgttccgctcgatgatctgatcccagtctttggcatcgagcaggatacggggatggctttgagagaacttcgccagcacttcttgcaaggagggaggattgaacgtacgtgtctgctcgtccacatagaaatgatagacgggcgaccattcttctttgccgtccttatcaaggtaggcgtgctgccaataccatttccctttttcaaagagtttgaaaggattgaagaaagcccagtttctttcggcggtcattacttccgatttaaactcaggatcacgtgcgatacggatgcggtatgtcacttccggtttgtgatcttcttcttccactccgtcaagcacaggtccgaggtgggggaacttatccggccacatgaaacgcggcggattgactgctatgtgctgaccgcccagtggagaaggtgtttcgcggacttcatgcatcagcgtctgctgactcagacgcaggatgcttttctgcgcatatccactataggaaagcatagctacaaataacaggaaaatataatatcgttgtttcatcatcttatttttttaagagttctttcagactgattgtcttgttgttgatcagcggatgtgcccagaaaccgatgaaggtgatatatcccacaaagagcaggatagacagcatacctgtacgcagggacgtagcatctgccaatgtactcacaatcatcggcccgcctgctccacccacgatagccgaacataaaattccggcaaatgagccgtgatgctgtgaagccgagttcagcgccaatgagaagacgatagagtacatcatggaaatactgaatccgatagcaggaaaggcgattagcgaaacatccttgcttccgaataaagcggctagtaacagcactatcgtcaatacccccgaaacctgtagcaggcgtttgctgtcaatcagtttcagaagaatcattccgaccagacagcctgccgtcatcagtccccagaagtagctgactgcctgcgcaccttccgtctgcgggtttacaccgtgatattgttcgaggaaggtactcatgaagatagaggttccttgttccgtactgacatagcagaagattcccagaaagaacaaccatacatatttctgcttgaacagggcgaggtaggaatctttcgatccgcttttctcatcttctttcagttcaatcttcgggaaatgcgaaacgccgacggcaatcagcatcaccagcaacaataaggtaaatacccagtagagagatacccaaggcatatcttgtggcgtcatatccgccagcaagtcaaggataaggctttttcctgctgtataagtggcaggatcaagttcccgaatcagataagtatatgccaacgggcttaggaaggaggcgataccgaacataaattgtgccagttcagcgatgaaagcatagttttcttctcctcctacagtacgttggagcggattcagcacggtttgcagcattgccattcccagaccgatgatgaaagatgaagctagcaacatcggataagtatgcatacaggcgaacaggatggttccgataaacggcatcaggaatccacagaacaagacaggcttttcaccgaaacggtcgatcagtagtccggcagggatggacataatggcgtaagccagaaagaaggaagtcgggataaaccccgccatcgcaagatcgctcagattgaaattgtggataatgtccggaataagcggtcccagaatattggtaataaacgagatagtgaaccagaacgccataatcagcgccagcattcctagatttttcttcataatcttaaataagttgagaaggttttctgctcttcatttaattcggttttctatttaaaaagagggaggcggcaccgatacttccggctttgttgcctaaagaggctgccatgatttccgtgttcacggcacagtcggggatggcatagcgaagggctttctcacttactttctgaatataaaagtctccggcttcggacagtcctccgccgataacgactctttgagggctgaagatattaataaatccggcaatgccgtgaccgaggaaatcacaatgttcgttcagcgactcagccgcaatcttatctccttgtttatagagacggacgatcaattctccgtttatttcttcattcggataagagatgccggcttcggctatccgtttgctgaaacgacggaccagtgcggcagtggaagcataatgttcaaggcatcctattgaaccgcaggcgcaaggttcaccattagctatcaaggggacatgtcccaattcagtacctctattggcgtatccgttaaacagtttgccgtcaattatgactgcgccaccgataccggttcctacagtcagaaagaccacatgagtggctccgtttccggctccgtacatcgtttcgccaagtcccatcagattagcgtcatttcccagttgggtaggaagtccggtctctttttccatccggtctgccagtttcagattttcccagccttgaatattctccgcacctcccaatacgatacgattcgtacaatcgacaattcccggcgtccctatcccgataccggctattgtatacctctttgcttcggcaaaggttttcacttcattgactgccttgactaattgcccgatgacagcttcggctgatacgtcggcattcgacggtagcttcccttgaaagtgaaatacgccattattatcaataagagcgtatttcacagaagtcccgccaagatcaattcctatagcgtattctttttccatataactaggtatgttttaaattcgtttatactgtgccatgcttgtgccaccgtattggcacgcttgtgccaaaggcttggcatagcagtgccaacagcttgacacaactgtgccaacggcttggcacaagcaaagcaactgttttctttcatataccagtttatactctttctgcccagataggtgaactccatgcccattgcccgtcacgctggcgaacacgcacgtagtagtaatctgtatcacgctgaggctctttatcttccatatagtgttccacagtgaaacagctttcgggcatagcacgattgaagagaatcgcttcgctcagccagccgatcatgaagtgcgaacgtgagccttcgagcaattcgcccaatgtgtgttcaaacttcttgccgttgaaatcagcaatcacttttccgtctttcggcatctctacttcgaggatgacagcttgcatggcagcggtagtcgtattcggattcttgctgctgtacatatccagttcggtttctttttcgtctgcggatacaatgcggtttacgtgagtatggaattctgtttccccttcttgcggagaagtgaaggctgcaccgcggaaacatggagtgacgctcagaatgcgtcctttgtctacagacaatttaccttgccagtgtacatactgctcttcacggttccatccgaaatctactttcactttgcagcggacagtatcaccttcgggggcaaccggagtcaacggaccattcatgcgggccagaatctgaccgttcttgacgatatccacatagtcgatgcaactttctccggtaacattcagataaatgcggcggctgttgccacgcactacgtcacccatgaaagcatcgttgaggcggaagtcaatcaaaattttatcgccggttgcggcgcatacgtggcgggtccgaagtgcttcccatatagcgtcgcgggtcaatgacggagccagtacaccgatacggccgtcaccataactgcccggataacccgaatgttggtcggtagaagccataataccgaatttattacccagttccagaccatattgaatggttccttcccattggcgggggcccatatcgtgcaagtatggatagtccccctgatcgctttcggccagaccgtgacgggaatacatttctacgaacggggtctggtctccttcggtaaagcatttccagttatagccgcgataaccaccctgatagcccatatggtgaggagtgataaatactttgtgtcctttggctttctgtttccagtcttcgatggaggtacactctacaagcggtgcatcgagatcgtagttcaaggcaacatggtcgccatgttccatgctgtgtgcttcatatccaacgaaagtgaggaattctccttctttattatattcgtttgtcatggctacgtacttctcatatccgccttcgcgcaaacgtttgaaagcaccggtatggtagtcgattacccatttcaggcgtggatcgtctgctccggggatatccggccacatggcgtggggtgttacacttacaaaatccaactgtcctttcgctgcttcaaaagcatcgcgcatatcgccgtgtccgtatgtgatgttacaatggttgtgcaggtctccccagtacattttgaggtcacttgccgatggcattttctttttggcttctttacttcctgccgcacaagagccgagcaggctgccggatgctgccagtcctaaaaaagaccagccagtattctttataaaatttcttctgtccatgatatgattgttttgggttatttatcgattttccatcagtcttctgtctcctttgaaaagcactgtctctttttcatcgggatcattgtctttatattgtttctgagtttcttcaagtagttgcatcaactctttttgtttcttagcatattccgctttcccgaagatattgttcatttctcttgggtcggctttcatgtcatacatttcccattcgtcaatgtcgttgtagaaatgaatcagtttgaagtcctgcgtgcgaatgccataatgacgttttacggagtgttctgccggatattcataataatgatagtaggctgctttacgccagtcggcaggagttttgccttcgttttccaatacaggtttcagtgatgctccctgaatatcagatggcacttctacaccggcaaagtcaaggaaggtaggggcgaagtctacgttcatgctgatggcgctgctggtgcttccggctttaatggccttcggataacggatgataagcggcatacgctgacattcttcgtacatgaatcgtttgtcaaaccagccgtgttcacccagaaagaatccttggtcggaagtatagacaataatggtattgtccagttcgccgatcttttcgagataattcagcagacgaccgatattctcgtctacagccagaacggtagccagataatcgcgcatatattgctggtatttccagctgattaatgccttgcctttcaggtcgcctttgcggtattcggcaatgcgctgtgcataggcggaatcccatttgtcctgtacttctgagggcatacgcttataaacgctatacaggcggtttgtcgtatctttcagcatttcttcgcgagtgagcagtttcaagtcccagtcattcgtcagcgtatgttcgatcgacatatcttgttcccgtgccgctttcccgcgtccttcgtagtcatcgaacaggtttgcgggttcggggaaaatagtattgttgaatatacccagatggcggggggcgggcatccagttacggtggggagctttctgatgatacatcatgcagaaaggtttgttcttgtcgcggttttcgaggaaattgattgccttgtcggtgataatatccgttgcatatcctttttctacgatgtgctttccgtcttcccaaaagtcagggtcgtagtagtcgccctgctcatgctggccgctgagtatgctccagtggtcaaatccctgcggttcgctgataagatgccatttaccgatcatggcagtctgataaccggcttgttgaagtagtttcgggaatgtctgctgatcaccgttgaaggtgcttgcattatcggtaaagccgttctcatggctgaattttccggtgagaatgcaggcacgtgaagggccggagagggcattgactgcataacaattgtcaaaacggataccctcattggctatgcggtccatgttgggagtttggatgaggttgccaccatagcaggacatggcttgggtggtatggtcgtcggtcatcatgaagatgatgttcggacgtttggtttcttctttttgggggttggcacaggaagcaaggcttagtgctgccaatggaagcaatagggtagaggggttgcttttcatgatagaaataacatctgatgataaaaatgaccagtgaggagccgaggccttttccgtagcgggcatatatccgcatggaaatctggcctcagtgcctcgctggtcactggattataatttatattttaatgactgtttcttgccgtttactttcacttctatttccagtccgttttcatcgaacgttttgttcttgaacttagcgtcaaatttaggggcatctgcgctcttcttgactgggtaaataactgtgatgtaacgtaccgcattctcattgtctttctttacgttgaatgaaacattcatacgtttgtagcgcttgcgatatgcagtagaacaccatcccggctcttttttcatgctcatgccttcagggccgaagcattgaagtttcatgttgcttccatcttcgaattgagtcaggaatgtcatgtcttcacggctgttggctatctcacctttcggcatctgatagtgcaggttgacagaacctttggcgctgcctgatacttcatctacaatgacaaagtaggtattgtctacgaagaagaccgaacggcggtgcttgaagttcttgtagcttgggttttctgtaaccaaggtctggatattgccttccggctgccacagtttagtaacagattcggttgtttccagattcttattgtccagagtcacggtgttgtgtacggaagtctgacgatgccagttgcgttgttccatcacttcgccttcaccggcatacacatacgaaccggagtctgggaacaggttcttgccgttaaaccacatttcgaaagtaccgttatccggctgacagtgccagaaacctttcggaccggcttttactaccatttgtgtagcatccattccccaggaattgcggaacacaaagaaacctgatttcaggaaacctttcgacatataatcgggtaacgcgccttctttgccgtctgttgccaaatacttgatagtttcgtttttcgggaacagtttgctccatgcacgatagttcttcagcatttctttcttttctgtgattttagcatcactgaaacacggatttgtgtaatccgggaaagaaatattggcatagaacatgatcatcttttcgatagtatccagatattcctgtgggaactcattacggaatccgttaacatccgcgatacccaatgccttgcagaagatattgatagcagcaagatgataatgcgggtcaagttcaaactggccgccatcgttgtaaacctgtacgtttacttcacggttcagaatgtcgataccgctttttctccaggccggagcttctttaaattccgggaagaatgcacctgcataaatcatacgctgggcttcgaacaacaagtgattaccctgatcagagtaattagccagaatatgtacggcatgtttatgatagttcaccagaaattcagtcaggaaatccggagtgaaagaaggagaggggaggaacaactggaactgggtagtctgatcctgcagacgattactgacttccagcggacgccatgcgaaacgtacattttccacttcgcctttaatcttaccgtcacttaccagttcgtattctttcttgtccatcttcaccaacggattctttttaatccagtcgatgtattggtatgcccattctttggcatatttctcgtcacccgatacacggtatgccttacccatcggagtaaaccatttatgacggtgcaactgccagcggagttcattgtctttcaccggccagtattgccagttgatatcttctccgtagttgtaagaaggctgatagcctttgtgaacaaagaatgtatgcttcaatccgtcatccgcccattgctgttcttctttgccgatagtgatctttttcagattaatatccggcgtcttcacattcgtacgtgcacggtagtagtcgagcagtgcttttgcggcatcctcatctttgccttcctgatgtaaggcttttactttctccaatccggggtagtccaggttgagaagcgagaatacctcgcttttcaactcttgggcatagcctttgcctacgaaacaagcaaatgtcagcaggacgatatatttcagggttttattcatgatatcatttattattctgcaaattacaatttagatttgaattttctcagctatgttactcaataactttcacctctccattctccaatctcaacttcttcaagtccatgaatctcttcaatgcttccaaatagtagtagtcagcataattcagcggagtatcgatttcagaaccgttcggcaatgatccgacagagtgcattaagatgaatccctggttttcgccgactttggcaaggtatgcgtcgcttgaaaggcttttcagaattttttctgcataatccagatatttctttccgtcgggtaccattgtgctaagttcaatgaatcctgcggctgttacagcagcagccgaagcatcgcgtggagtctcttcggtgacaggagcatcgtagtcccagtaaggaattgcatcgtctgttttcacgcgctccatgatcatgtcggctatgtttacggcaaagttcaggaaggtagtgtcatttgtttcgcggtagcaggaagtgtatccgtatacagcccaagcctgtccgcgcgaccatgaagaatcgtcgtttttaccctggtgagtctgtttgcgttctactgtgccgtcgttgttatagcttactacatgccagcaagtatagtcaggacggaaatgatttttcatcgtagtgatagcatgcttgatagcgacatccttgtatttgttgtcgcctgtccatttgcttacagtgaacagaaggtccagattcatcatgttatcgatgattaccgggaagttccagctgccaaagtcccatgaacggatggctccgattgaatcgttgaaacgtccgctcaggttatcggcagtttctttcatgacagctttgatggtatcgttaggagccagacgctcagcgtttccgtagctgcagttgatcataaatcccaaatcatgtgtacctttataatagcgtaccggattcagcaggtttgtatattgaatggcatccgctttcagtgtatcatttccggtcagttcgtatgcgtaccacagtgatccggggaagaaaccgcttgtccagtcgtatactacacataaacgacgtttgcccatttgttcggcagtaggttgcggacgaagtgaatcctgaaaagtggaaggatctctttctaattggcggcagaggaaatccatgtcatatccggtgcggattgaacgtggaagcttaccggttccgtcaatttcttctgctgtaagttgtaactgggcagaagctacatccagccctttcttaatccaactgtagtcttcctttggagttgtctggcacgatgcaagtgcaatggcaaccgaagcaaagagaacaagtttctttttcatgttattcattttaagtgattgtttttagaagttttgtaactgatgcaaaagtagatgaatgggtttaaattatgtgataggattgtttaaaaggcattcaatacctgcttttctagttttgaatttgtcgaaaatgattttaatattctccaatatgccgtgtcacgggcatattggagagagttttattcagttaccatttgggattttgattaaattggatgcacaagtccatgtcccgttgtggaatagggaacagctcatgtttgccttcttctgtataagtggctactgaataatttggtgatcctgtaccttcccaccaataacctaattctttagcggtcgcttgcactgttttataataaataccccaacggattaggtcttgacgacggtgtccttcaaatgataattcataactgcgttctttgcggactgcttcacgaaaacttgtttcatcgagtccttgtggcagatcgcatgcgcttgtgttacttggattgccataaccgcggcgacgtacggcattgattgcattatatgcctcagcatcgggaccatgtttccattcgtttaatgcttctgcataaagcaataatacgtctgcatagcgtaagaaataccagttcacattagatttatcattgttgatgaaactatttgttgttacatacttctgaatatcccattttgcaggagtatagttttgcttatttttctgagctttagtaggatcagcatctttctctgctgcactttcatctgtatcactggcgccggctacccaaagagatttttttgtgtcagtatattggtagttggctatagataaatcacgacggatatccgatacatcttctctccagtcaagcacaaatgtatgaactacttttacgttagctgcacaacttccgcgtacacctgcaatagcggttgttttaactccgttccacttaccgatacgtcctaccggatcactgttgcctgatactgtcggtgagtaaaatgatatttcaatcaaactttcagtcgggtcccaagtgccattacaggtattcttccatagttgttcgtaatctttcaacagtccatgtttgccggattctaccaaaatgcgtgcggtttttgcagcagcttcccatttggattcatcctttaccggatagccagcccaggtagcataaactttggtcaataagcctaatgctgctccttttgagaaacgatagtcgttgctttcgcgatattggtcatctgtcgcgtatggtaaaatgtcacaagcgtacaacaagtcgtcttctatgtattcgtataccttttctggagctgattgtacatatgtagccggattctgatttgacatctgagtacttgtcattaagacaacatttccaaatcggcgtactaattcaaagtagaacatacctcttaaagctctcgcttccgcaatgtataaggtggcgagttttttgtcagttgtagtatatgatcctattttatttgagatacgttccagaaaatcatttgctctgtaaataccggtataaagtgctgcccatgtttgctgtacttcagactgagtggttgggaatgagtttgtcggaatgatacggaaattttcattaccgctaccttccacttgtgaaatatccgttcccaggttaaagagtatggataagtaatatccatacatggcatctaaagtgtttgtacgataaactccaagcaatacgtcttttgcttcctccgcattgttcatgtagtttttcttttctacttcagttctggtttcttcctcaagtgaacaagaaaaaggaagcaaacacattaccgacattgctatatag

SEQ ID NO: 116 - DNA, 24719 bp, Bacteroides thetaiotaomicron
cagtataagcatacgattgaagatccggaactaaaactgtaattaaaataagaatatcaattattaaaatgcaaacatcgttttaacaattaaggtcttgcgaattaaaatactccttcagacagaagtaaaaacagaaatgaatatcgtattatcttccgggaaatggttttctttgttatgtattcatatcactaatctcatattctgcattaaaaaataaaaagaaatggaagagaataaacaaacactttacaatgatgagttgctagatatcttacctgacggagttattatatttaatattagtggagaagtaatacagcttaaccggcaagctctgaccgaacttcatgtgcattcatcagtcaatgcaatgatgcctcttccaaccaatatccttttcaaattattaaataataaagaagacattctttctgtcatcttagaaaagattcgtcagggtgaacaaacttattcgctttctgaacatactttcatgcaagaacaggtggattatacacaattcccgatcagaggtgattttgcaacgatcaaggaagatggcaatctgaaaaagatattattcttttttcgtaatatcactgtagaattgacacaggagtatattctgaacacagccttacaaagaaccaggatatatccgtggtattatgatataaaccgaagtgagtttacccttgacaaccgttatttcgaacatttgggtatttcggccggagaaaataacactctgactatggaggaatacgtaaatatgattcatccggacgaccggcaagctatggctgacgcctttattgtgcaacttagcggcatggaaacgttcgataaatctgtccccttccgcctgcatcgtggagacggaacttgggaatggtttgaaggccagtctacttatattgccaatatctcggggcatccctatcggttggtcggtatctgtatgagtatccaggaatataaggatatagagaacaccttaatcgaagcacgtaagaaagctgaagaaagcgaccgacttaaaatggcttttctggcaaatatgagccatgagatccgtacgccactgaatgcaatagtcggtttctccgatgtaatcggttctacgtatgatgaattaagcgaggaagaacgtgccgattttgtgagattaatcagtatcaacagcgaacacttagtaagactgattgatgatgtacttgatttatccaagattgaatcaaatacgattaaatttactttcactgactgttctctccgatctctcatgatagatgtagagaaagaacagactatgaaacctatatccgaaatcgaaataagagcgttattaccgaatgaagatgtctatatcaatacggatgctacacgcctgaaacaggtaataagcaatttcattaataacgcccggaagtttacagaaaaaggatatatccattttggttatgcagtggattccgtcgatgcaagctcggttcatgtctttgtggaagatacaggctcagggattccaaaagaatgccaaaaggaaatattcgaccgcttctataaagtagatacatttaagcaagggaccggattgggactttctatctgcaaaacaatcgtagaacatctgcaaggagacatctctgtagagtctgaaatgggaaaaggcagccggtttatcgttactcttccatttgaaaggcagacagaagattaatgtcctctgtattcctgcggagtgacaccggtatgctgcttaaagaatttattgaagaaagagatattattgaatcccaaagacaaagcgatattcttcacaggttcattacttgactttaaacgagacttagcatccatcagaatgacggaagcaatgacttccagcggggtattccccgctgcctttttaattgttgaacaaaaatgaggcagactaagtcccaaatgatcagcataaaaagaggcaccatgatgaactgtataattcttcatgaccagttgcaggaactcctgatatatctcatactttcttgattgagtagataaataccgattgctctgtagcttataaatctctgttgccccctgaataaacatagtgagtacagcctttacgatttctttattggccaatgtcttggcagaagcatacgcaagaatcaatgactcataaaacatcttatagctacaggcttgcaatggagacaaattgataaccggattttctactattatcggaagcagatgctgggtggacttcatcagatttatattttctatgaactgagatgaaaagcctgcataataaatatgaatatcagatgaaaactcatgaatttccatgaaataattaggtggcagagtgattaaatcattttcgacaatattatatcgttctccattaattgttgcctgtattgtccctttcacacaaagtatgaagaatcctgcctctattttacaatgaaaattcttatacccattcagtaagtttatcccaaatccttctcccactatataatcaactgttaaatcgtacctcggtatatcgctttccatcgttattttgttttttacttcaaatatagagattatttaaaatctacgctcgaaataattaaaatctgactatcgaatcataaaaaaataacatatatattctatttataggaaaaaggtttcaaaataagaaacgggatgcagaaagctatacaagcttctttgcgtcccgcttttttactactattgcaaaagttcagtctgctaacagatttattgaatatccaaggcatcaaaagccagaccgtccatattttccgctgaaagtaatactttataatgtccggcgttgataaaagttccggtggtggtactcatcatcttccatttgtccggtgtttccgggaaggtcagaatgtcttctttgagcactactccctttgaatcgatgaacttcattaaaacaggcattggttttccggtagtattcatatacttaaagcgaagggcataaacctgtgccagtccggtagagatattccattcaatactgttaccttttcctttatcaaagaatactcccgtttgcttgcgatgttctttcttccggaacttgcctttcagggttgccgtttcagcttcatacgctacactgacacgggcattcttgtcttcgggaagcaactctttcggagttttttccatgacttctttgccggccttttcccaactccagtcggatgcggggaatacagtaggttgcagattcgaatcaacagaagcaatggcaatacctgaaatcagcccctgtcctgctttcacttccgggaaatgaatcttcagtactccaccttttactgtagcgtacactactttcttgcatactccgtcgtgaccactctctgcccaaatatcaagatcatccaatactaccgaatcattcactgccacatcgaagatgcgcaacccctcgcagtcggtggaagcactgcctcccgtcccatgccaaggctctgtgaaatagagttcaatccgatatgttccgtcagctaccgggaaattgtactccagttgatgacgtccgaaacggaagtgctggaacaacttccagtcacggcttccccgaatcggatcattcgtcgtgcgctgactggcaaggtatggattcaattctttaaagttcgctgcccatgaacgggaataatgggtattatcctgcatccataactgaccgaaactatctgtatagtcgtctcctccacagttaatacggtacaggtaattatatccgtcttcccctttcaatacaggtttcgcattctgatacagtacgtcaaagtggggagcttgctccagtccgttgagtacaattatgtcttcggcaaccggcttccctttgtaatatcctacagcacgaagtacattataacgaatatcccgattctcccacatgaagtgggtgcctgttccattattctttttgcgtcccagataagtcactttgtcattgatcatgtcgttataaagcaatacggaatcacaattgctgtaagcctcgatagtagcccgacgacgtcctttctcgaaacgatctgcccaggtatgtgataccaggtataccatcgggtcctttgccgccggcacatagttggcacgatacatataatatacatccagtggttcttcccacggagtcaccagtcctttatagttgaacggacctactttatctattttccggaatgcttcatccggctggcgacgtccgggattgtcgtggctgctgaaaatccattggaactgtccgcaaacactgtctttggcctgttctgccagacgaatctttgtttccatcaactggcacatacgactttcgctccatactccattcacttcaaattcgccgggttccgtatgcagatcaatacttctccatgcaccgtattctccattcagcaactggttcttctgcgaaagttcctttccgtatttcgtaacgtctcctccatacgtgccgctccaattctgaattacattccagtcggttccttcaccgccgttacaggtggtgatgatacgcatcgtacgtgctgtcgggtccatttcgcgaatgatttcactgcattcctgtgcaaattcacgaggcaatgtactttcattctgcaatccccatatcactactgacggagaattacgtcgctccttcacccattgacgaagcagctttttaaagttctcacgaaactccggtgtgtcataccatacatgggcagaaagctgtgtccagaacaagacgccttcttcatcccaatatttctgataatcgagatgatggggctgatgggcatcacggaaagcgttgaagcctgccgcacgtatttgtttcactctcgcagctacctgctcccgactgaaggcatgactttgcccgaattgatgttcatactcgcatacaccattgataaagacaggctttccattcagatagaaacgcccatcttcgtcatttctctttaccggccaactgattgtacggataccgaaaggcgtagatatctcatccgttgttttggtatcacgcttaatcatacttgccaatttataaagataaggattctccgtatcccataaaacaggattctctacaggagactgttgacgaatcaccttcatctctcccggtgccaatgttactttctctactagacggaacacttgtttaccgtccgcattgctcaacttattgactacttctattgtctccgtggtcttgccatagttctttacttctgtttcgacaaagacattagccgccttttcgtcattccagatgtgtactccgaagggttcaatacggatctcgtctgttgcctccagcaccaccggacggaatatacctaacggctgagatccttcgctgaatccccactctgacgaacagccaccacatacccacggcatatcggctatcatttccggatgctccgcttttacttccagacgattcgttccttgtttcaatgcattggtcacatccagtgtcaacgtggtacgtcctaccggatagcgtccgaaatcatgtccgttcactttaatagtagcatacgtacctaccccctcaaaacgtaggaaataacgtttttttaattgagaattgacagttgacaatggacaattatcgagggagaagtctttcacatacatggttgttccgtgcaggttgccatgagtcagttggcgataaccgtaatagtcatcccaattatgaggtatttgacaattaataatcggggattggtgattgccttttgaattgtcaattgtcaattgtgaattgtcaattaaccaggttttccagccttcattcagttcagtgatcatccggcgattcttcgtttccggcttcgggaagcgaacggcagagcgtcccatcggcttacttgtagcaatagcaataccacgctgttcggcattgttcaccgcgcaataaaaatgataaactactccgtcgtgtttgatcacatagcttttatgcgcaaataattcgtcgtaattcttggaaggaataattaaatcagctccatgccagtctgtccagttgacgagatcataacttgcagcaaacgtattaaaggctttatacttgcgtgacggctcaaaggcagagaaataaaacatcacatatacgtcacccatcttctgaatatgagcatcaccggtgatcgttccgtccgcttcgtgtgcaaagaccggattgccgggataacgtttccaggttttcatatccttggaaagtgcgattcctacccgttcaccctttaaatcagtttccggatgacgtcctcccgcattgtaaaacatcacaaacggggcacccagtgttttgtctttatcccagtaaacggtacttttatattgagtcaacttttcccaccactgggcatctttatcatggatgctcagaattggcttgtccagagattcccattcatgagcggtggaaatatctcctttggtagatgccagtccgacaaagagtggtgcttttacagcttcataacctgtaccttctccaccgatataagtcatccagtggcggcctttgtaggtctgaagttcgtagcttccaccccactccatatccggcagtgcagggaatcctccacgctgattacaatcccatttaccgtcccgataagaaagtacacgtcctaaggtacgccaatcaagcagattatcactttctgcaatccaggtttcgtatccacgaccatccgtgccggttttgccattataaacgacataagtcatcagccacttgtctccctgacgaaagacagtaggacaatcaatcttatgataattgtcggtcggggcaacagcaagtccgtacttatagggcgtctttacctcttcataaatctgctccatccgttcctgcgtgactttacgttgggcatacagtgagcatacggcagctatacttaaaaatgtcagtaataacttcttcattatacttttgtctatcatctttttgttgagttgccgctatttgtttcaagctttggaacaaatggtttcaaggcatgaaactaatagtttcaagccttgaaactaaatagcggcttacagcaatcgttcattagtaaaacaaccagtccatcgtttcttcgtctccggcaagtccggcattacgagttttcatatccgcagccgtaaatccaagaacctgaaggtagcctttgggcaacatcaacgtatgttttcctgccggaaagctatatgcgtgtacattcgctaatggcattccattgatatggattgcattggtcagtacaggttccgcctgaccgtaatcgttggcagatgcatcaatctccagtttcggagctttggcatacttcttctgatcgtctttaaagtaggctactaatagtttgactggagcatttgtttcaaaagtaatgcttgttcctttttcccgttgttcatttccattaaagcggaatgccttcattcccttcagttcaggagctattgcttctattttgcccggaagatccgtgaacaaggaagttccttcattcagtttcactgtcggataattcgatattaagttcacatacgcaggagcccaggcagcgatctctaccgtttcagtcaccgcattgccattttgcttttctttcagcatggcaaggttcgccttgaagttctccaattctttttcgtagtgtaccagcagttctttccatgtcttattatggccatcgtccccgccgataggaatacggcgctgggcagtctgcatactgttggcatataaataatgctcgtctgtcagttccactagtttgcggtaatgttccagactttgttccatcagagggatagcttcttccagattcttcatgtcttttccccactgatagtccaataccagtttcgcagctttcactttcagattaaacgcataggcaaactcacggtaacaatgcatatcattctgcagacgtgcgaattcttctttgttagaggagatggaaccggctgccttgtcaatcgctgctattgccttatcaccgtgttcaatcacctgagcgacaatgtccagcggcatctcacctacatgaggctgattcttccattctttctctacaaattcgatcagcttttcgccttccggtccgcagctttcatagaatcccggatagatggtatatttgtacggattgacaagctggctcataaacatacccaacaataacgtctgacggtttccttctgtgataccaaaacgacgtaataacttcggggcaatttctccgctttcttcataagcaatgcgaatattgcctgcattctcgtcggatgttccgtagaactgtcccagttgatgattccagtaaccgatctcgtcagcacgatcccgatggctgttccacgcataacgtccccaggtctgataccagatccagtcgcggtccagttggaattcccgttcgtcatttggcagtttatcggctgtatatggccaatcccagtacgaagcctgcggataaaggtgcaatgcattggcaccgtgcacgttgtgcatcgcttgtaccgccttctgtacgaagtctggagagccccaacggaatggttccagatttgccaggatatgtacattactgatatgaatagatcctaaagagctcaaatccgtatgaatcttcgaccaggggccacgaggctcgtaagttgtcagtgattcaccattatacttatgcatcgtataaagattcttatatatcggcaatgccgcatccattaccagtttgcagtccgtatcgtgtgcgcgcagcaaaagaggcggttcgtcggtacgtcccaatgcctgtaatccgtcttttacacccggaatgatggtctttgtgaaccattccacatcatcttctaccgtacacatggcttcacccaaacaaaccagcagtcccacattcggatatttctctataaatgcggcaatgcttttacgggtatagtctgcaatcagaggagtgatgggacggttacggtcctgcgttttcagtccataatgctctgcaaatggtttggaaaggatgatattgtagaacatctgtatcacgaagataccacgtttgtccgcttcttccgtaaggaaagaaaacatctcttcattcttcttgaacgtctcttcgtctacttccagcgcaaacggataatcttccagtttgaccaacgatgcaaacggatgaccattccagagatacagggaattcatgcgattggctaccagcatatcgaggtatttaatccattgttccttatcataaaaccaagggaaactttccggagtatacggatactcatacacaccgtgtcccggcaggtaagtcattttctgcagaccgacacaagcaccgcggagcaccatttccggaccatctttcaactcttccggaaagtcaagcttgccatcagagtcgttcacacggtctatcagttcgcgacttccgtagatcactccgcttccgtctctgccgcatactcttgtcagattaccggcagtcgtaatatgaaagccttctttcttaagcgtcgtatcattcacttccgtcagcagaatcgtctttatttcaggatcggagaatgtggtatccccttgttgcatcattacctgataaccggctttatccagggtagactgtaactgttccgcactgaacagaacgcggtttgacgcatccggcggagtcattattttcacggtttgcttaccacacgcagctaagaaaagggtgcatgccgcaaacatgaacaatttggtatttttcattcttctgatgtatattataaaatgtatagtttcattcttttataaaagaaagacgaagtaagtccttgtttgtactcatttatccactcttccactttttgataccatattaccacattattcatccaaaacatctgtaatcccctttattctttaaaataatatctatatttgccggacagtattctataataaaaaaagaaaacaagagcaaacaatatggaagggcaattgaatttggactgtgaacgatttcaacaaattactcaaatggcgaaaatgggatggtgggagtctgatgtaaaaaatcaacagtatatttgctctgattttatcgttgatctgttaggacttgaaagccatcggatcagctttcaagagtttcatcacaggatacgcgaagatcaccgcacgcgtctcagaaacgaatttatctctcattcaaatcttgaaacttatgagcaaatgttccctatccaagctaaaaacggagaaatatgggtatattccaagatcagtttcagaaaacctgataaagaaggatacagagacatattcggttatttgcaatacgtggacaaacctgcggaaaacagatgcggaaacatcgacttctttcatgtaaacagtctgctttatcagcaaaacagcatctcctattcattgctcgcttttctgcaatccgataatatcgcggagataatcaatcaaatattaggtgacctgcttaaacagttcggaggagaccgtacctatatcgtcgaaatagacagaaagaaaagggttcagaattgcatgtatgaagctacggcggaaggggtatccgaagagcgggataatctgcaggatatactttgggatgaatctttttggtggaacaggcagatttcaaacaggaagtccattattctgaatactttggacgatatgccccaagaggctcaggaataccgcaagctgctcgaatcacagaatattaagtcactaatggcagttccgctcatatccaaagacaaaatatggggatatatgggcattgatatggtgaaggcttatcgcagttggagtaatgtagatcttcagtggttttcttcattggcaaacattatcagtatatacatagaactgcgcaagtccgaacttcaagcgaaggaagaccgactggcactggatcatagagaaaagattctccgtaatatctataagaatctgccggctggtatcgaactttacgataaagacggttatctgattgatatcaatgataaagaactggaaatattcggcttaactgataaaaatgaggtcttggggatcaatctgtttgacaatcccaatattccgcaagaaataaaagagaagctaagggcgcggaatgatgtagacttttcaatcaattatgatttctccaaagtaaataaatatatagaaactcaacggaaaggagtcattaacctcactacgaaagtaactacgctttatgactctcagaatcagttcatcaactatctgtttatcaatatagatacaacagaaaccaccaatgcatacaccaagatacaagaatttgagaatctgtttctcctgattggtgattatgccaatgtggggtttgcacacttcaatatactgaccagagatggctatgcccaagatacatggtatcggaatttaggtgaaaaagatgggactcctatgactgaagtaattggagtatactcacatgtacatcctgaagatcaggcggttctgaagagttttgtccgaggagtcaaagaagggaaagctaccagtttgcggaaagaagtccgtgttagcagagagaacgggaaatatacatggaccagtatcaatgttatggtcagagattatcgtccggaggaaggcattatcgaaatgctgtgtatcaattatgatattaccactctgaaagagactgaacagaaactgattatcgcccgtgataaagcggaagaactggaccgtctgaaatcagcttttctggctaatatgagtcacgaaatccgtactccgctgaatgcgattgtcggcttttccagcctgttggcagaaaccgaaagcaaggaagaatgtcaggactatatcaagattgtacaggataataatgaccttctcttgcgactgatatctgacattctcgatcttgcgaagatagaggcaggaacattcaactttgtatatgccgacttggatgtaaatgaggtctgctctgaaattatcaagtccactggtatgaaagtgaaaggaaatatcaagctcctttttgaaaagcaaatccccgaatgccatatctatacagataagaaccggtttatgcaggtgatcactaactttataaataatgcactaaagttcacccatgaggggactatcgctttgggatacgaacagatatcttctcagaaaataaggttctatgtgcgcgatacaggcgttggaatccctgccagcaagataaacagcgtattcgaacgttttgtaaaactgaacaattttgtccagggaacgggactgggactttctatctgtaaaagcatcattacacagatggaaggagaaatcggggtagattcaactgaaggagcaggctcctgtttttggtttacacttccttaccacacaaatgagtgaaaaaaggtatatctttgcacttcatttattaccattattatgcagacttacatagaaacatcccgtttaattctccgcgattggaaggaagaagatattccggcttttgcccgcatgaacgccgaccctcatgttatggaattttttctccatccgctgactccggaagaatcacttgctttttatcaccgtatccaaaatgagtttcagacctgtggctttggcttgtatgctgtagaacgtaaagaagatcatgcttttatgggatataccggactgcatcagatcacatttgacgttgattttgctccgggtatagaaatcggctggcgattggcgcacgaatattggggacgtggttatgctccggaagcagcaaccgcttgtttggagtatgctcgtaagagtttagatatcaaagaattgttctcgtttacttctcttcccaaccaacgttcggaaagggtgatgcagaaaatagggatggaacgggttagagaatttggtcatccgcttgttccggctgagcatccgttacatagacacgtgttgtattacatagatttaagaaagcattcatcgtaaggtattcagtgcaatgacataaaaagagaaagggagtaatgtatcaataatttatcgattcacttagaagatacagaacttttcaaaatcagcaccaacatctatacgaaagacattgactaatgatacagtaacttccagtcatttattaataaattctttcatcgtttattataaacgtccttccagtttattataaactcgaatttcgatcttactgcaaggaatatcaattttaagcaacaaaaagggctgcaattcccataaagaatcgcagcccttagcttgtgtcagactatctaacaagcattatccggagtgggaatgcctgcaaactgttattatattatacttattattgctcattttttcgtctatattatcaatgttatcgaatttacttccggttttcacttacaaagatacaacattaaaagtggtttgtcaactcctccatgcttctttcatacatccattcagatttattccgtctttataatctccgcaggattaattcgtgccgccttattcacttgccagaacaatgtacctgcggaaatagctacgacaaccaacaaagctatcacaaaaatagaaatgcttaccggagttttgaccacaaaatctgatgtatatatgtatatcagatagtatgataatggcatcgtgagtaatgttgcaccgcctataatccatatatatttgcggaacaggatggaataaagattcctgagccgggcaccattcactttccggatggctacttcccgatatcgctggcggatatcaaataacgaaagaccaaataatcccaaagcggaaacaaatatagagatagtggcaaaaagggtgaagacggttgcaatgcggcggtcgtcctgatacaacgcttttatatcatctttcagccaatgataatcgaattcattagagttatatatgtcttccctgcatttcttaagataatcaactaattgtttttcttttcccggcacacaggatatttgacactgggcattaattcctgcgctggatatcatatatataatcggctttttaccagcagtcaaatgtccagagtaataatctgcaataatagcctgtacaggcatcaatgacaatccaccttctactattttaccattagatatagaactccaaagtgaactttcacctttgacgaatgcatcttcccgacgggtataaccaaaagcttttaatgccgctttgttcatagctaccagataatcggcatgtccatttacttcatcgggcaatgaaccatcaactatatgtaatccatataacttaaagaaatccactgttacccacatcattgccatatttaactttcctcccttatcatttatcatacttgacatgctaccagccgataaaatgccttcgcgaccagtatctccggcaaaccagtgttcgatatatgggcattcattcagcttctgttccataacttctctgtcatgccaccgcttattttgtatttcctgactatcctcccaccattggttaggaagctttggcatcagatcagcatataaaattccttcggttctgaaacccggaggtgtattcagcaggaaatgaagatgattactaaaatacaacgataagatgatcagtaaaagagtgatactatattgcacaaataagaaaagggtgcgtgttttcactgactgacgtgaagtaccaatcgtacttatagacacgaccggaggcaaataattgtatttaagataaggataaatcgttgtcaacagtggcaacaatataaatattgccaaagagagctgccaatcgaaagctgtatacataacgttgctttccagcaaacgattggcatatcctgaaaacatctctataaagaaccatgcgaaaaataaagcgatgagtaccatcaagacattctctgtccataactgaagaaaaagtgtacgacctctcatgccaaatactttcctgatgccatactccttggaacgctttagcataaaaaccaaatagatattgacgaaattgagaatgccggccaaaagaagcaacaggcatacacaggacagtacccataaatgaaatcgactgctgtaatgccacatttccggagcatcggcttttgctgctaatatcttattccaataaagctcactgacaggaataaaatcataacgtatacggtaaccgccatcagcttgacggtagatattactaatagcgttaatagcatctacatccactcccggcataaaacggataagttcaaccagcatctttccccatcctctttctccattcttgagttcgaggtttaaaacgatgtcaaatgttaacgaggatttacatgccggttcatccaatacaccacagacagtgagaagatgaccaccggaataacttagtttttctccaattggattttcctttccaaatacacgctcggcaaactggcgggtaacaagtacatcattgggagctttcattggtgtaccactgaggggatacgtgaagaaatgaaagaaagcggtatctgccgctaataattgtacggtatacggctttccatttatggcaacattatcattgctgaaagttacaaaacgggccttttccttcacagcttccggagaatagaaaactgtatctgctccactatatccatctgatacactacctgcatatacattcccatcaatatcccgaagcggtatatatacattttcagcatctatgcaatgagtatttactcgtgtctcctgatgaatataacgtaccagtatgattgtacacgccagacttaatgacaagccgacaatattaatgactgtatatgatttggagcgcacaaggaaacgccatgcatactttagtgttttcattatattctgttgtttgcagaagaatacttcaaatcctgtgccaaaacataaagcgttatatactagtgatttggatttatcagcatatattctttttgtgcatatacgcacaaaaagagtgcgataatgcacagatagaaagacctccggcctattgccgctatagcaatacaaccggaggccttatttcaatctgaatctctgactacaaacgataggtaacaatcctttcttccggagaatcaatccaaaggcgccatacaccttccgaaaccttctccacagttcccatattggcttttggctgacggcgactctggatggtcagataaccttttccttccgtggccttcactttaatggttttattatccatgtagacatgaatgtctccgttcggagtaggtacggtaccttccatccatttcaaacctcccaataccggactgacagcaaactctttataaccctctttcgttggtttgactcccaaatagtatttacccagcagataaataggacttgctccccaagcgtggcacaagctctttccgtatgggcggccatacatggcaagatgctgtgttccgctttcctccggattatatttctcccaaaaagaggttgctcctgctttcaacattccaccccagtaagctttcatttctttcattacagtctcctgctcaccaagagcacaaagggcttccagttcgtaaaaacgcatataaggcgttgttattttcagaatctcatcattcaggagaacggactgtttaatggcctgctgcttatccgcattcagataatcaaagaaaacagagaacatattagcgtatcgggttacggcatcactctgacgtccatccacacaattgtgcacaaatgcctgtttctgattattccagaaagtcggctctaattttgcttttaacgcagaagctaacttctcatatttttgttgtccgtccttatctccgactaaatctgcacaaagtgccatcgtctccagactccggcaaaacaaaacctgttcgaaagaaagttctccctttttgtctaaatagccatccgcccagtccacaaatacccagtcgccggacattccttccaccataccattcttattcgtacgtcccaatacataatccatcattgtttgcatacgtggatatagctggttgacgaaatgccggtcaccgctatacatataataatcatatacgcttaagaaccagtagaaagtgtaatccataatggtgttactatggctggtcaccggatcttttccacgaagtaaccagatggtacgcttcacggactcactgtcaaagaacagataataattcatcagataactttggatggcatcgccactccatacccaacggtcgcgcttgataccgtctataaaaaactcgcgtgtagtaagatgcatcgtgtatgctcccacctcccagatacagttcagttcctcgtcgttacaacggaagttaccacgatattcttcgggaagatattcatattgcatagatacttcaccaatctgtacttccggttcgtgagtgatgtatacatagcggaatgctttgctgttctccagcgtatattcattatcagaatgatgcaaaggagatgtgctgcggatagcgagatcagtgatctgtcccggctccagcaggagtttatccaatgtttcgcaatatgctttgtctttcgcttcttccggactttcaccataatagaggtcaatctttcccttgcccgaaaggttctttaatgtgataaatccgaaagtttcttttccaaaatcatacagtatgcctccttccggttgttctgttttagcgacaggttgctgaggttcacgcatcaggctgaattgggaaggacgttgagtggcaccgtcaaagttccagcatccggcatccatatagatggtggcagatgtgtcactagccttaccgctttcatcgatccattccttatcttcataagttacccgccaggacgaatcagagtttaccgtctttcctttcacatagatagtgggaggcgttgcctgattccatactttaatatttaggctatgttttcctgccggaagcagcaaggtttcaggcattccgaactgaagtttcccgtccagcttcacattatatgttccctcggcagcaataaacacttcttctggttcggaaagattcaatactttgctgaactctacgactacataatgactgtctgttttccaaaaaggaggaaaaaaagcaccacgttccgtacgtcggttgttcatctggttgcccaaccagatttcatagtcccccggataccatatccaagtttgggcaaaggtgctgcttgccaatgacaaggcacccaaaagtatcatgcatttctttttcatttttcttatttcttcaagtccctatattcggcttccaaccctgcacgttcacgaatgactgtatctacctgcggaccattgttctcccatacatttccgggaccgttcgcattttgcagatacttctccccttccgtccagttatcgcgtacagtgataaaagaagagccttcgtccgtatagagataaaaccaatgattgggatcgtgtacataacctggcttataaatgctatgtacgcaattctcagttacataacttttcggctgcgagcccagtgtataaactccggctacgtcatacatatgctttgcatagtgatgaatcagattcgcgtgcactctgttgttacgcatacagttcactgtctgcgtccagccccagccaaggctgatgccgctataaggaacttcgcagatttcattgtgttctatattaatatctttcacatagcccgcaaggattgcaagacatccccaatcttcattacccacttcggtaaagtagcaattactgatttgttgatgcgcgcatacttcccgaaggtcggtagggtcataaggtaaatgtgtttcatgggcagccggagagaaactgccgaccaccagtccgttccccgcaatatcacggaaaagacagccacgaacgacaccgccctgcacggcttcttcataatccagcccggttgagcctaaatgatcgaaccgacagcgctcaaagtcgatctgattggcagcagccacgcttacagccgcggcaggacgtcccagccatccttgattatccaagggatgattcagatagtcccgttccattttcgggtcaatacgataaccgtctgtcagatacattcccgcctgaagaggaacatggcctttctcagacggacgcatccaagtcgtatgagagaacgtgattttctcaaaacggatatgtgaaacaggacggtcgaacgtcccttttacttgtatcaatgtctctatggcaggcactatcacttccgtgccggcatcctgcaacttctctccttcccgaggataataatagactttacgggcatctatgtcgtgataccattctcccgctacatccagtagttcacgggcattcgtcagataaaaagcagaattatgcccatctgtcgttaccatcggacgtggccagggatgctcaaactgaatccggctctccggctgatgaaaacgtattgcggcactgtctccagccagttcgacagaacgaatacgaagattggccacacaccacatctgatgcaataccatctctgcatatttggccttcaaagccccttttccgtctaccagtctgcgtatggcaaccgcaggaacataaagaatctcattcttctcgtccacactgcaaatgcggttcatcttctcaaaatcctctacgtcacgggcacggacagctttcttaccattcacccataactgacggaaatccagtggccgcccgttgaacatgggcacatccgctacccagagttttccctgcttcttccatccaccgatccggatgccgccactcaataccactttttcatcagctaccgggcggatcaccgtgggagaatcctccgtcccgctgtcttccggacgaataaacaccggttcatagagtgcatacgtaccgccttccatacagatcgtaattcctccccgcacccgttcatcatctgtccggcgccattcgcgtgcctgacgcaaagcagaagtcaacgtcgctttcggagatggacgtgtaccgtcattgagatcattcccctgcggcgaaatccagatttcacctgctgacagcagatgtgcacccagcaggcatatagttgttaccaataactttttcatttttcttttttacaatgggttatcttgctagcggcatccagactgtcatctctcctttacctctgtttccccatgcataataaggaatcagacgaatatccacagttttctctgcttggacaaccggacgataaagcacgccttcccaagactcagacgatgccagacgcgctttcccttccagggctactatcgaactgccttcaatcgtcgttttcttcggaatcagctttatgtcggcaggaatcaagatgttatcgatcttttctccatttgcaatgtccatactctccaagcagtaaaccaacggaccacgtttcactaccacctgattacggatttcttctgccaacggatgagcttcgagcagacaaacaggcatatccatgaccagttctaccacatctcctttcttccatgtacggttcacttccgcataggtatttgccttggcattcatggataccggttgaccgttcactgtcaacgcagctttcccgcaccattccggaatacggaagaagagggagaaagcacctgctttacggggcactttgttcaacgttacacgtacattgccttcccaaggatagtccgtttcctgcaccaaagcaagttcccccttgtccttccagtttgtagtcaatgtatttgcaccgtacaggttgcaataaatcccttccggactcaatgtataagcataattctgcgcctgacaaagcgtacgcaatgtattgggcggacaacagaaacaactgatatattccgtccgttctttcggccaacggagtgtataaggcagatcggcactgatacgaagaggattcgtatagaaatacttctttccatccagacttatgccactcaatacactattataaaggcaagtctccacaagctccgcatacttggcatctcccgtcacttccagcatacgccagttgaacagcatattacctatgttggcacaggtttcattatgtgccgtactgttcggtaactgatacggacgaccatagctctgatgcactttctgaatgctatccggttcatagcacgttccatccggtgaggtgccgtcatacaaagcaccgcaagctccggtcacgtacatctttcgggtgacaatatcgttccagatactagtcaggttcttcatcagttgttgttcacccgtctccgcatacacatctgccacacctgcatacaggtaattggcacgtacggcatgtcccattgcacgatattggtcacggaaagggatacggtcctgattatcatccgtaccactttctaccataccgcgaatgtcaatcaggttttttgaaagttccagataacggggatttcctgtagcacgatacatctccaccactcccatatagtgtgaagggcaaatagcattgcgtgccaactcggcagaagccgtctcatagaagtgacaaaggaaatctgtagctttcacggcagcatcaaaaagagtcgtttttccggtagcacggtggtgaacgatacctgccatcatcaggtgtcccaagttatacgtttcaaaattcaaccgattggcaaatgcacctttttcgtcctcggagcctactttcgtaccaatcactgtctgttgttgggaatcagccagcgtatggctgtctattcccttattcagttcttctataacaaccggcgtatgtatataaccatctgcacgttgggcttttacgacacaagcaataaagttgtccattaacttgtccaattccggatctttattgacagcatacacagaagcgactccttccatccacttgtacatatctccatcatggaacggaggcccccaatgttctcccttgcatacaccggcagcaatctcaaaattacggaaaccatgagaaacttccggcgtgttccatgtattccacatactctgcaaggaagttccgctaaatacattaaaacgctctccccagaatccattcgtccagtgtacggcatcaattccggtatttgccatctttgcataacggctctgactcatatccgtcagcccattgctctgcgcaaatgctcccgtgacggaggcggaagctaaaagaaataacagctttatctgtttcatttaatatggataattttaaaatttacacactatctctttaaggagagacgtgattatccatattttgtactcaataaagggatgtgaaagctgtccgacagcctttgcattcccttattcctgtttgttctttcgttatttttcgggagtataattcagttccgctttcctcgcctgtgagtgctggaactgtcgggcgactttatactcatgtccgtctttcaacagataacttcctgtctgcttgaaccagaaaccgacatgagcttccacacattgacggcgaatgtccaacacccagtcataattgcaaacgcgggcttccttaccggactctcctcctgccactacctgctctacccatccttccaattctcctctgaaatcaatctgactaagaaggggttcacagataataattttatgtttaataggactttctttataaataggtaagcgataatcgactctgtcctgattctccattgtacaacaaattgtcacattgtcgtatccatctccccaatccggtggcaggcactgttgcagtctgtctatccgcttcgtaataaacataaaatgaaggtcctgccgtatccgcatcatttcccatgcttcggcacgccattcatccacatcttcaatcagaaaatcagaggtaaaacaggtatataccagatttcccgagggtatcttatattctccattctttttcttctgcaaaggcaaaccgaacttttccgtctttgtcaccaccgaactgtcttttccgtatttgccatccgtacgatatacatagcagtggcggcagccttcactccatttgtgacagccgtgccataagttccacattgatgctttcccgcccattttctttttttcttcaaatgtatgctttatctgtttcataggcaaattttcattcaatatccgatagtcagggtagatagatataaatagtgcatcttctttctcgcttgaaaaaagatgcaccaaacacaaacaaaacaaacaatagagctaccttcacaggcggccggtccgaaaggaccaatacttttgatagtgaaatctcacttcacaaatatccgcatatttggggactagccaaactccatccatgtcggatacaaacaataaatgtttcgaaggtgactaatactatgacacaaaggatgaaatgttgcggaatataaaaaacaagaccagacaagaagattcttttgtactatttgtataatcaggaaaaaataaatttcatttattaaaaaacgattaaatcacgtcggtaagcatcattcatccctttactccggcggattatgtcaattaaaacggagatatgccaagcatatctccgcacatctgattatctaataggattcactttaatattaattgttatctggttaaagcaaccatcgtccaatattccttttctccgcactgaactccactcctactttcacgacttcacgtccggctgtctgataaggaatcagatagcctttttcatcaatctgctgcaaatcctgctcggcagtcccattcagtttgaattcgaatacatatatatttaggcgtttttactactgcgtccgtgccatcaaatcttacgataaacttcctcaaacggtaccctgcaccgttctccccaaattcctttatttccattccggattccacaagaaactaccatatttatttcagcaccatgaggcaacttaagcaaccttttgagccgtcggctatccaagccttccaagggacaggtatcatatccttcgttcgccatagcaatcataaatgtttgagcagcaagcgcacaggatttatgtactaccacacgcacatcaccttcagatacttcgagcatcatagggcggaaaatgctgataacattagcaagtagtactctgaaaagtcctaagataccgcagaaacgggcataaacaaacggcatcaatatcccatagtacagttttctgtctttaatacgtttctcctgcctgtctataggactattccgccgtatatttcctgtctcgaaatcaagaacgaatttcgcccgcttccgatacaagtcacgacgtgtgacgaaaacaacaatctgcgaagctgtggaagttgctttttgatcaagacaagctcttgatacctttgccatcaattcaggctgtgtgatgtgataaaactcccatagttgcatatcagaactattgggagccaaagttgccaattccaggcaatgctttactttttctatatctatttccttttctttatcatatacccgtacagagcgacgataatttaaaacttcatctaaattcatatactacttgac

SEQ ID NO: 117 - DNA, 24689 bp, Bacteroides thetaiotaomicron
aaataatattatgattaaagttgagaatttatcttttacttatcccaaatcaaagcacatggtattacacgacttttctttttctttagaggcaggtcgggtttatggactgttgggacgtaatggggcagggaaatcaaccctcctttatttgataactggattattgactccgaaaaaagggaaaataatgtaccatgatataaatgtccgttctcgtctgccaatgacattgcaggatatgttcttggttccggaagaatttgaattaccttctatatcgttgaaaaagtatattgacttgaatgctcctttttatccaaactttagcaaagaggatatgtataagtatcttcattgttttgaaatggatatggatgtgaatttaggggcactttctatggggcaaaaaaagaaagtatttatgagttttgctttagctaccaatacttctcttttattgatggatgaaccgacaaatggattggatattccgggaaagagccagtttcgcaaatttatggcatcggggatgacagataataaaacaattgtgatttcaactcatcagatacgtgatatagacaaaatgctggattctgttatgatcatggatgaaagccgggtattattgaatgaatcgacagtgcatatatgcgagaaattgtgctttaaggaaagtgatgaccgtagtctgattgataaagcgctttttgccgttccttctttgcatgggaatagtttgcttttactgaatgaacacaacgaagattcagatatcaacatagaactgctatttaatgcaatactggcacaaccacaaaagattgctaatttgtttcacgctcaagaagaatagattatgataaaggatacattttttagtttttctcgctttggaaaattatgccataaagagattttagagaattggaagttgtacactcttcgcacattgatgatgtatggagttttggcaattgcattgatatgggtaggctgttctgaatataaaagctataatcctctctattcgtttgatgaattgaatgtgcatgtaactactctggtcatttggatgtgggcttggtggggatttgtgtgccttggtacttcgttggcattcgaatcaatgaagtctaaaccaaggcgtattacaaatttgatgttacctgctagtacgtttgagaagttttttcttcactggctgatctatgtacttattcttccgttacttatctacttttttatgatattggcagattatacccgcgttttgatttgctcaatggtatattcggaaataccttctatagaaccgacacaatttaagtattttgttgaccagggagatggtgggtattcattatgtcataattggtctcaaggaattttattgatttcacttaatctatatgttcaatctttatttttgctagggagcattttctggtctaagaatacttttcttaaaacgcttataagtttggttgtaataggctttgtctattattggagcggagtagttgctattcatgtgtttgcagataatgatattgtaaatttgaattcatttatctttaaatggggacacatcttattcccaatattgactattataaattggacattgacttatttccgcttgaaagagtcggaagtaatccatcgaatatagaaaaggagggtatgtatgaattttaaagaaagcagagcaatatatttacagatagccgaccgtatttgtgatgacatcttgttgggacaatacgaggaagaaggacgtatcccttctgtcagggaatatgcgtctattgtagaagtgaatgcaaatacagtaatgcgttcgtatgagtatcttcagtctcaggaggtgatttacaataaaagagggattggcttttttgtagcgtccggggcaaagatgctgattcattcattgcgaaaagagcaattcttaaaagaagaagtcggtagctttttcaggcaactttatacacttggtatttctatcaaagaaatagagaagatgtattatgagtttatacaaagacaaaatcaataataaacagataagatatgaaacgcacaacatatataataataggactttttgtattgggcttattctttatacctatccttctgcatacacctggcggtgagaaaaccgataatcgtttatcaatggaaggtgagcggactgaaatagaaatgacgggaatccgtcatgtgaaggttgttgaaaagctagggaagatagataaagatcatataggcgtgttaggtcagttggatgtggaggcttctcactcttcaggtaagagtatatttgtgtatccgaaaagtcaatatttgcatgtgacacaagaaggggattgcttattgattgaaattaatctggataatgaagatatctatcaggtaattagacaggtagaaaatggatgcagattggttttagatggtttgaatctggaattgaaaacggattcaacattgttatctattgagaatcgtgcggctaggctggatattaatgtaaggaaattgtgtttggactctttatatctctttaatgacgaatggcagaatatctcattgacttcttgtcgctttcgttcgttggatataaaaggagagaagttgcaattgaaagctgagtgggtagaggctacaaactattatgaagagttagggacttttagaagtcgtgagactactcagtttatggttgagaatctgtatttatcaggaaaagattcgcataagtatcggccaggtataaattgtaatcgtatcttctggagtcctcaggtcagagatgcagaacttgagctgaccttgaatcagaagagtgagattatattgaatcgttgaacataaatgaaaaggaaatgaaagtcataaagtctattgcagttttaagtctgtcagcttgtttgtttgcttgtacttccaaacctgatttagacggatttcggaaggtagatattagtaataatatgctggatacgatgccggaaggcagattgagcaattataaagaaacgatagagaaaacttatttattggggtgtctggtattgagtacagccggtagctcgtcagaaagttctccggctcagttgaaagaatggaaggaggctctgagtatgcccgatacgataaagccgatatatagggagagactgtgggactttgttttttatccccagattacttatgaagttgaatctaagtatttaggtatttatcaacgaagaaaaacagtaattaaaggtatcgggcttgatatgataacaggagaagaagaaaaatatatcaaatcgagacaaaagtagtttttgagtattttattcattataatattttaaagcaggtgtcatttagtaatattactaggatataaccggaataaaattggtgtaaaagtgtgattttataagaagagaggcgttttctttgcgtctttctcttttttatcaaattgatttttgtaaatttggcgagaatcttacagagacacacagttaatatagtaataatactaaatactcctgttaatatggaaaacaaaattcaagagttgaccgataagatttatcgtgaaggcgtggaaaagggaaacgaggaagcgcagagacttatcgcgaatgctcaggaagaagcaaagaagattattgaagatgctcgtaaagaagctgactcaattgttgctgcctctcgtaaatctgctgatgaactggcagataatacaaaatcagagttaaaactattttccggtcaggctgtcaatgcactcaaatccgagattgcaacgatggtcactgacaagttgataaccgcttctgtgaaggatttcgctcaggataaggattatctgaatgcgtttatcgttgcgctggcatccaaatggagtgtagatgaacctattgtcatctcaacggctgacgctgaatcactgaaaaagtatttcgcagctcatgcaaaagctctgctggataaaggtgtgacgatcgaacaagtgaacggtatcaaaactttattcacggtttctccggcggacggttcatataaggtgaacttcggagaagaagaattcatgaattacttcaaagcgttcttgcgtcctcaattggtagaaatgctattttaaaagaagcgactatgagtagtaaatactattacttggtagccggtttgccggaactcactctggaggacagtaaactgagctatacagtagccgattttaaaaccgaaatctacagtggattgtctgcttcagaccagaagttgattgacctgttctatctgaagtttgataatgccaacgtgttgaaactcctcaaagacaaagaggcggaaatagacagacggggaaactattctgctgcggaactcaccgagtatatttctattctgaaagaaggcggtgagatcagtcctaaagaattcccttcctatttatctacttttatttccgactatctgaatactccggctgaaagcatagtgttgcaggaagaccatctggctgctctgtattatgaacatgctatgaaatgcggaaataagttcgtctcttcctggtttgaattcaatctgaacattaataatattcttgttgcatttacagcccgtaaattcaaatgggatattgcttcccatattgtaggaaatacggaagtgtgcgaagctttgcgtacatccagtgcccgcgattttggtttgtccggtgaagtggatgtttttgaatcgttggtgaagaccagtgagattacggaactggtggaacgtgaaaagaaattggatgctctgcggtggaactggatggaagatgctatcttcttcgattatttcactgtagaacgtattttcgctttcttactgaagctggaaatgattgagcgttggatttcattggataaggaaagaggaaatcaattgttccgaagcattattgaatcgctgaagaatgaggtacagattcccgcagaattcagataataaattaaaaaaaatatatggcaacaaaaggaactgttagtggcgttattgccaacatggtgaccctcgtcgttgacggcccggtagctcagaatgagatttgttatatctctaccggtggcgatagattgatggcggaggtgattaaggttgtaggttcgcatgtgtatgttcaggtgttcgaaagcacacgtggactgaaggtgggcgccgaagccgaatttacaggacacatgcttgaagtgaccttgggtccgggtatgttatcgaaaaactatgacggtctgcaaaacgaccttgacaagatggacggtgttttcctgaaaagaggacaatatacatatccgttggataaagaacgtatatggcattttgttccgatggtgagcgccggtgataaagtggtggcttccgcatggctgggacaagtggatgaaaacttccagccgctgaaaattatggctccgtttactatgaatggaacggctaccgtaaaaacgattatgcccgaaggggattataaaatagaagatacaattgctattctgacagacgaggaaggaaatgacattccggtgactatgattcagaaatggccggtgaaacgggctatgacgaattataaagaaaaaccgcgtcctttcaaattgttggagaccggtgtacgtgttattgatacgctgaacccgattgtagaaggtggtacaggatttatccccggtccgttcggtacaggcaagacagtgcttcagcatgctatttccaaacaggcagaagcggatatcgtaattatcgcggcttgtggtgaacgtgccaacgaggtagtggaaatctttacagaattcccggaattggtggacccgcatacaggacgcaaattgatggagcgtaccattattattgcaaatacttcaaacatgccggtagccgcccgtgaagcatctgtatatacagcaatgtctttggctgagtattaccgttcgatgggactgaaggtattgctgatggccgactctacttcccgttgggcacaggcattgcgtgaaatgtccaaccgtatggaagaattgcccggaccggatgcgttcccaatggatatttctgctattatttctaacttctatggccgtgcaggttatgtaaaactgaataacgacgagaccggctcaattacttttatcggtacggtgtcacctgccggaggtaacttgaaggagcctgtaacggaaaacacaaagaaggtagcccgttgtttctacgcactggaacaggaccgtgccgacaagaaacgttatccggctgtgaatccgattgactcatattccaaatatatcgaatatccggaatttgaagaatatatcaaagatcatatcaatgatgaatggatcggtaaagtgaatgagcttaaaacccgtttgcagcgtggtaaagaaattgccgaacaaatcaacattctgggtgatgacggtgtacctgtagaataccatgttatcttctggaaatctgaactgatcgacttcgtaatcctgcagcaggatgcctttgatgaggtggactcggtaactccgatggaacgtcaggaagctatcctgaatatgatcatagatatctgtcatacagaatttgaatttgaaaacttcaatgaagtaatggattacttcaagaaaatgatcaatgtctgtaagcagatgaactactcgaagttcaaatcagagcagtacgaagggttccagcagcaattaaaagaactgattgccgaaagaagcgttaaatagtaaattgtaaatagctaaatcgtaaatatatagatggcaacaaaagcttttcaaaagatatataccaagattactcagattaccaaggctacttgttcgctgaaagcgacaggagtagggtatgacgagcttgccactgtgaacggtaaactggcacaggtggttaagattgccggtgacgatgtcactctgcaggtatttgaaggtacggaaggtattcctaccaacgctgaagtagtgttcctcggcaaatcgcctacgttgaaggtgagtgagcagttggcaggacgtttcttcaatgctttcggtgatccgattgacggaggtccggaaattgaaggacaggaagtggaaatcggtggtccgtcagtgaatccggtgcgtcgtaaacaaccgtcggagctgattgcaacgggtattgccggcatcgacttgaataatacactggtatccggccagaagattccgttctttgccgaccctgaccagccttttaatcaggtgatggcaaacgtggcattgcgtgctgaaacagataagattattctgggcggtatggggatgactaacgatgactacctgtactttaagaacgtattctctaatgccggtgctctcgaccgtattgtgagtttcatgaatacaacggaaaatcctccggtagaacgtttgttgattccggatatggcattgaccgcggctgaatatttcgctgtaaacaataatgagaaagtactggtactgctaactgatatgaccagctacgctgatgcgttggcaatcgtatctaaccgtatggaccagattccgtctaaagactctatgccgggttcgctctattcggacttggcgaagatttacgaaaaggcggtacagttcccttccggtggttctattacgattattgcggtgacaacattgtccggtggcgatatcacgcacgctgtgcctgataatacgggttatattacggaaggacagttgttcttgcgtcgtgacagtgatatcggtaaggttattgttgacccgttccgttcattgtctcgtctgaaacagctggtaaccggtaaaaagacacgtaaagaccatccgcaggtgatgaatgccgctgtacgtctgtatgccgatgctgcaaatgcaaagactaagatggaaaacggttttgacctgaccaattacgacgaacgtacgttggcttttgcgaaggactattctaaccagttgctggccattgatgtcaaccttgatactactgaaatgctggatgtggcctggggcttgttcggtgaatatttccgtccggaagaagtgaatatcaagaaggaacttgttgaccaatactggccgaaaggtgaataattagcaactagtaatttataactaataattagcaaaaacaacgtggctataaagtttcaatataacaagacctctcttcagcagctcgaaaagcaactgaaagtgcgggtgcgtacgcttcctatcattaagaataaggaaagcgccctccgcatggaagtgaaacgctgtaaaacggaagctgccgatctggaggataggctcgaacaacaaattcaagcctatgaagccatgttcgccctttggaatgagtttgacgcttcattgataaaggtgaatgatgttcatcttggcgtgaaaaagattgcgggtgtacgtgtaccgctactcgaaaatatcgatttcgagatacgtccgtacagtatgtttaatgctcccaaatggtatgccgacggtatccatttgctggaggaacttgctcatacggcaattgaacgtgagtttatgctcgccaagctgaacctgctagaacatgcgaggaaaaagaccactcagaaggtgaatctttttgagaaggtacagataccgggctatcaggatgcattgcgaaagatcaagcggtttatggaagatgaagagaacctgtcgaaatcatcgcaaaagatcatgaagtcccatcaggaaaaaaggaaggaggtagaggcatgattacaaaaatgaagaaacttacattcctggtttatcataaggaatacgaagaattcctgaatagcctgcgcgaacttggcgtggtccacattgtggaaaaacaacaaggtgccgccgacaataccgaactgcaagaaaatatccgcctttcaaaccgcttgacagctactctgaaactgcttcaaaatcagaagcatgagaagaatgctgtaattgcagcggaaggaggaactgccgctcgtggtttgcaggtattggacgaagtggatgctttgcagacagagcatggcaaattgtctcagcaactgcaaggttatgccaaggaaaaggaggcattgcaggcatggggcaactttgatccggcaggtgtccggaagttgaaagatgccggctatgtgatcggtttctatagctgttcggaaggaaactataaagaagaatgggagacggaatacaatgcgatgatcattaaccgtatttcttccaaagtgttctttgtgaccgtcaccaaagctggtcaggaagtagatctggatgtagaacaggccaaacttcccgcttattcgctggcacatcttgaaacgttgtatgatacaacggaacaagctattgaagagaacgaaaagaaactggttgcactttctgaaacagatgtaccttccctgaaagcagctctgaaggaattgcagggacagattgaattctctaaagtagtattgagttcagaacaggcagccggtgataaactgatgctggttgaaggatgggctcctgcctacagtaaagtagagatagaggcttatctgaacgatgcacatgtatattatgagattaccgatccgatgccgggtgataatgttcctattcggctgaataacaagggattctttgcctggtttgaaccgatctgtaaactgtatatgcttccgaagtataacgaactggacttgacaccgttctttgccccgttctttatggttttcttcgggctctgtctgggagattccggatatggacttttcctgttcctcggagctacggcataccggttgatggcaaagaaggtgactccatccatgaagtccatcctgtcgctgatacaagtgctggctgtttcaaccttcttctgcggtttgctgacaggtacattcttcggagcgaacatttatgatctggactggcctatcgtgcaacgtctgaaacatgcggttctgatggacaacaacgatatgttccagttgtcactgatcttgggtgctattcagattctgttcggtatggtactcaaagcggtgaatcagacaattcaatttggtttcaagtatgcagtagcgacaatcggatggattatcctgttggtttcattggctgtttcggctttgttgccgaacgtgctgccgatgggaggtacggtgcatctggttattctgggtatctccggtgcgatgatattcctctataatagtccgggaaagaacatctttatgaatatcgggcttgggttatgggattcatataacatggctacaggtctgctgggggatgtcctgtcctatgttcgtctgtttgccctcggactttccggaggtattctggcgggagtgttcaacagtctggcagtaggtatgagtccggataacgtgatagcaggtcctattgtaatggtgctgatctttgtgatcggtcatgccatcaatatgtttatgaatgtgcttggtgcaatggttcacccgatgcgtctgacattcgtggagttcttcaagaactccggttatgaaggaggcggcaaggaatacaagccttttagaaatttagaatagaatattgagaaataacaagttaagaattaaacaataaaaatagaataagattatggaaatgaatttgtttattgcctacattggcatcgcggttatggttggtttgtcaggcattggtagtgcttacggagtaactattgcaggtaacgctgctatcggcgcattgaaaaagaatgatagtgcattcggtaacttccttgtattgactgcacttccgggtacgcagggtctgtacggttttgccggttactttatgtttcagactatcttcggtattctgactccggaaatcactgcgatccaggcatcagcagttctgggtgcaggtattgctttgggattggttgcattgttctcggctatccgtcagggacaagtttgtgcaaacggtatcgcagctatcggtcagggacacaacgtgtttagtaatacattgattcttgccgtattcccggaactttacgctatcgttgctttggctgctaccttcttgatcggtagtgcacttgcgtaaatttttcaaggaaaaaaatttttaataaagatctttcaatccccttgtgaatgcagctttgcgttcgcaaggggatattcttttttcatggcgggctaacctttctttcctcttattaactcatatttttcgcataaagtattatttttcaaagaataatgcgtacttttgcactcgcatactaaaaagagttttaatatattatatggtaaaagatttattaacccccgattatatcttcgagtccagctgggaagtatgtaataaagtgggagggatatacaccgtattgtcgacacgggcgaatacattgcaggaaaaattccgcgacagaatttttttcataggtcctgatgtgtggcaaggaaaagagaaccctctattcatcgagtcggataatctgtgcgctgactggaaaaagcacgcattcaaaaacgatcatctttccgtccgtgtaggacgatggaatatacccggtgaacccattgtcatccttgttgatttccaacctttttttgaacagaagaacgaaatttacacagaaatgtggaatcgttttcaagtagactcgttgcacgcttatggcgattacgacgaggcttcgatgttttcgtatgctgccggaaaagtagtagagagtttctaccgctacaacctgacagaaacggataaggtggtatatcaggcacatgaatggatgaccggaatgggagcactttatgtacaggaagctgtccccgaagtggctactatttttacaacccacgctacttccatcggacgttcgatagccggcaatcataagccgctgtatgactatctgtttgcttataacggtgaccagatggcgcaggaactgaatatgcagtcaaagcactctattgagaagcagacggcgcattatgtagactgttttacgacagtaagtgaaatcacgaataacgagtgcaaggaattgctcgacaaaccggcagacgtagtactgatgaacggtttcgaagacgatttcgtacctaaaggcagtacatttaccggaaaacgtaaacgtgcccgctcattgatgttgaacgtagccaataaattgttgggaacaaatctggatgacgatacgttaattatcggtaccagtggtcgatatgaattcaagaacaagggtattgacgtattcctggagtcattgaaccgtctgaacagggataaaaagctccataagaacgtattggcgtttatcaatgtccccggttgggtaggagatccccgtgaagacttgcaggaacgtctgaaaagcaaagaaaaatttgatacaccgcttgaagttcctttcatcactcattggctgcacaatatgacgcatgaccaagtgctggatatgctgaaatatctggggatgggcaaccgtcccgatgataaagtaaaggtgatttttgtgccttgctatctggacgggcgtgatggtatcctgaataaagagtattatgatatattgctgggacaggatttgagtgtatatgcttcctattacgaaccgtggggatatactccgctggaaagtgtagcgttccgtgtgcctaccattactactgatctggcaggttttggcctttgggtgaacagcctgaagaatcagcatggcatcaatgatggagtggaagtgctgcatcgttcggactataatgattcggaagtggcggatggcatcaaagatacgattacgctgtttgcagataagtcggaaaaagaagtgaaggagatccgtaagcatgcggcagatgttgcagagcaggcattgtggaaacacttcattcaatattattacgaggcttatgatattgccttgcgcaatgccatgaagcgtcagttaggctaaagaaatattttattatcaataagtaaacaaaaacattatgaaaattaaagttagtaatgtgaatactccgaactggaaagaggttacagtgaagtcacgtatcccggctgagttggagaaattgtccgagatttcacgcaacatttggtgggcatggaattttgaagcgacagaactatttagagatctagatccggaactttggaaagaatgtggccagaaccctgtgttgttgctggaacgtatgagctatgagaagctggaagcgttggcaaaagacaaggtgattctgaggagaatgaatgatgtttatacaaaattcagagattacatggatgtgaagccggatgaaacccgtccgtctgtagcttatttcagcatggaatatggtttgagcagcgtcctgaaaatatattccggtggtctgggtgtattggccggtgactacttgaaagaagcttctgacagcaatgtagatctttgtgcggtaggtttcctgtatcgttacggttactttactcagacgttgtctatggatggacagcagattgccaactacgaagcgcagaacttcggccagcttcctatcgaccgtgtgatggatgcgaatggtcagccgatggtggtggatgttccttatctggattattatgtacatgctaacgtatggcgtgtaaatgtaggacgtatttctttgtatctgctggatacagataatgaaatgaacagcgagttcgaccgtcctattactcatcagctttatggtggcgactgggaaaaccgtctgaaacaggaaatcctgttgggtatcggtggtatcctgaccctgaaagcattgggtatcaaaaaagatgtttatcattgtaacgaaggacatgctgcattgatcaatgtgcagcgtatctgcgactatgtagctaccggactgacattcgatcagtctatcgagctggttcgcgcttcttctctttatacagttcatactccggttcctgccggtcacgactacttcgacgaaggtttgttcggtaagtacatgggtggttatcctgctagaatgggtatcagctgggacgacctgatggatcttggacgtaacaatccgggtgacaagggcgaacgtttctgtatgtcggtatttgcctgcaacacttctcaggaagtaaacggtgtaagctggctgcacggaaaagtttctcaggagatgttctctactatctggaaaggttacttccccgaagaaatacatgtaggttatgtgactaatggtgttcacttccccacatggagtgctaccgaatggaaagaactgtactttaaatatttcaacgagaacttctggtacgaccagtcgaatcctaagatttgggaagccatctataatgtacccgatgaagagatctggaagactcgtatgacgatgaagaataagttggtggattatatccgcaaatcattccgtgatacatggttgaaaaatcagggagatccttcgcgcatcgtttcattgatggacaagattaacccgaatgcgttgctgattggtttcggtcgtcgtttcgctacttacaaacgtgcgcacttgttgtttactgacttggaacgtctttctaagattgtgaacaaccccgattatccggtacagttcctgtttacaggtaaggctcatccgcacgatggagcaggacagggtctgatcaaacgtattatcgaaatctcccgtcgtccggaattcctgggtaagattatcttcctcgaaaactacgatatgcagttggcgcgtcgtctggtttcaggcgttgatatctggttgaacactccgacacgtccgttggaagcatccggtacatcaggtgaaaaggctttgatgaacggtgttgtcaacttctctgtattggacggatggtggctggaaggctaccgtgaaggtgcaggatgggcgttgactgaaaaacgtacttatcagaatcaggaacatcaggatcagttggatgctgctactatctacagtattcttgaaacagaaatcctgccgttgtactatgctcgtaacaagaaaggctactcagaaggctggatcaaggtagtgaagaattctatcgctcagatcgctcctcactatacgatgaaacgccagttggacgactactacaataagttctacaataagttggcaaaacgtttccatatgctgtctgctaatgacaatgcaaaagcaaaagaaattgctgcatggaaagaagaagtcgttgccaagtgggattctatcgaaatcgtatcttgcgacaagctggaagatttgaaagccggtgatatcgaaagcggaaaagaatatactattacttacgtaatcgatgaaaaaggcttgaatgatgctatagggcttgaactggtaactacttatacaactgcggatggtaaacaacacgtttactctgtagaaccgttcagcgttatcaagaaagaaggcgacctttacacattccaggttaaacatagcctgtcaaatgccggtagcttcaaggtgtcttaccgtatgttcccgaagaatccggaacttccgcaccgtcaggacttctgctacgtgcgttggtttatctgatagcttgacgaagtagggaagtgacgcttccctgcttgacgtccctatataaaagaagcccctgcaattcgagcgatcgaaattgcaggggctatctttttatatctcaatgtaacggtgtggataagatcagtattttcggcaaaagtgcctgtacttggatcagatttacctactgcgttaacaggaataagataccttgtcggatgttgtgccatcctattggcacaactgtgccaacggcgtggcataactgtgccaatatggtggcacaagtgtgacaacggtatggcacaagtgttacttcattaggtgaagtctcttatcagcttcatttatttgactacttctgccaatttagcctgaagaccttctccatgaagaccacgggcaatgatagtaccgtcgccatcaatcagaacagtgtgaggaatgctgttcactgcataaagctgtgcgccttcactctgccagaacttcaggtcagacatttgcggccaggtcatattcagttttttaatagactctttccatgcagcagcatcctgatcaagagatacaccgacgatttcgaagtttttgcctttgtactgagcgtaagcttctaccaggttaggcatttcacgacggcaaggaccacaccagctagcccagaagtctaccagtaccactttacctttacctgcgtaatcagacagtttcacagtttttccttccggagtctgcatttcgaagtcaatgaacttagtacctacggcagtcttcttttgtttttcagtctgttccttaacttttacgattgtttcgtcattttggaaattagccgggatttgttccagcaaagctgcattctcttcagtagagttattgtagaaagtctgtttgaacaagaatacacctaccgggttggtgatgtttttctgtacaccttctttgattactttatcatattcttcttccagccgggcaccttctttttgcttggcttctttctgctcgtcactcaaagaagaatctcccatcgcttcgtagatagcgttcatcttttggctgatatcattgatttgagttctgatagcttggtaagcgtcattgttggaagtaccggttgcagaatcattgtcctttgtcagtgcaatgtttattttaccgttttcaaggaagaaatcaatcatcagaggttctccgttcacttcgcaagtgacataacggtttactgcagaatcctgtgtgccttcgaaggtgaaagtacctttagagatgactgcggtatctagttttgtaagatttctgcctgttgcttcctgaaggtaaacagtgtcgccgtcagcagcgccttctactgtacctgtgataacgtatccggctttgtttccggtacaagctaccatacccaacgctgccgtcgcaataactaaataagttaactttttcatgcttttgtaaaattagtgaataaatatttatgcaaagatagattttttttctgtctggcatcgaaaaacactgttatattagattaacacgtaggtggaaatcgtagaaatgtgtacctttgcagcccaaacttttagtatgaatatgcaagaagacaaatccatcattgaggttagccatgtatcgaagttttttggcgacaaaacagctttggatgatgtaactctgaacgtgaaaaagggcgagtttgttacgattctcggaccttccggctgcggaaaaacgacattgttgcgtctcattgccggttttcagacagcttcggaaggcgaaatccgaatatcgggtaaggaaatcacacagactccaccccataaacgtccggtgaacacggtatttcagaaatatgccctgttcccgcatttgaatgtatacgacaatattgctttcggcctgaagctgaaaaagacgccgaaacagacaatcggcaagaaggtgaaagccgcattgaagatggttggtatgacggattacgagtatcgggatgtagattctctttccggtggccagcaacagcgtgtagctattgcccgtgccattgtcaatgagccggaagttttgctgctcgacgaaccgttggctgcgctcgacctcaaaatgcgcaaggatatgcagatggaactgaaagaaatgcataaatctctgggcattacatttgtatacgtaactcatgatcaggaagaagccttgacattgagtgatacgattgtcgtgatgagcgaaggaaaaatccagcagatcggtacgccgattgatatctataatgagccgatcaattcatttgttgcggattttatcggagaaagtaatattctcaacggaacgatgattcatgataaactggtacgcttttgtggtacggagtttgaatgcgtggacgaaggtttcggtgaaaatactccggtggacgtagtcattcgtccggaagacctttatattttcccggtttcggagatggcgcaactgaccggtgtggtacagacttcgatcttcaaaggggtacactatgaaatgactgtgctttgtggcggatatgagttccttgttcaggattatcatcattttgaagtcggtgcggaagtggggctgctggtgaagccgtttgatattcatattatgaagaaagaacgtgtatgcaatacatttgaaggaaagttgcaggatgctactcatgtagagttcctgggctgtacgttcgaatgtgcttctgtggaagggctggaatccggtacggatgtcaaggtcgaagtagactttgataaagtgatcttgcaggataacgaagaagacggtacgctgacgggagaagtgaagttcatcctttataaaggtgatcattaccatctgactgtatggtctgactgggacgagaatgtgtttgtggatacgaacgatgtctgggatgacggagaccgtgtgggtattactatccctccggatgcgattcgtgtaattaaaataaccgattaacaggaaaggaagtgaataagaagtttatagtatttttgtcatcacgtaagagctggactcttccttacattattttctcggcgatctttgtggtcataccgttggttctaattgtcgtgtatgcgtttaccgatgataacggtcatctgacactcgccaattttcagaaattcttcgaacatcccgaagcgatcaataccttcgtctattccataggtattgccattattacgactcttatctgtatcctgctgggatatcccgcagcctggatattaagcaacagcaagctgaaccgttccaaaacaatggtggtgttgtttatcctgcccatgtgggtgaatattctggtacgtacccttgccactgtcgctttattcgactttttcagcgttccgctgggagagggagcactgatcttcggtatggtttacaactttatccccttcatgatctatcccatctataacacattgcagaagatggaccatagctacattgaggcggcgcaggacttgggggctaatcctgtacaggtctttttcaaagcagttctcccgctttccatgccgggagtcatgagcggtatcatgatggtgtttatgccgactatttcgacattcgccattgccgaactgctgacgatgaacaatatcaaactctttggtactaccattcaggagaatatcaataacagtatgtggaactatggggcagcactttcgctgatcatgctgctgctgatagccgcgacttcactgttcagtaccgatgataaggataatacgaacgaaggaggtgggctatggtaaagaagatattcgctcagacttacctgtgggtattactgctgttgctatattcccctattgtgatcattgtgatttactcttttaccgaggcgaaggtattgggtaactggaccgggttttcgaccaaactttattcatcgctatttaatacaggtgcccatcattctctgatgaatgccctgatcaataccattaccattgcgctgctggctgccacggcatctaccttgttgggcagcatcgctgccatcggcatcttcaacttaaaagcacgctcgcgcaaggcgattggttttgtgaatagtattcctattctgaacggtgatatcataaccggtatatcgcttttccttttattcgtatctctcggaatcacgcagggatataccacagtggtactggcgcacatcactttttgtactccttacgtcgtattaagcgttctgccgcgcctgaaacaaatgaatccgaacatttatgaagctgccctcgatttgggagctacacctatgcaggctttgcggaaggtaatcattccggagattcgtccgggaatgatcagcggctttatgcttgcactgacgctttcaatcgatgattttgccgtaactgtatttaccatcggtaatcaagggctggaaacgctttccacctatatctatgccgatgcccgcaagggaggtctgactcccgagctccgcccgttgtccgccattatttttgtggtggtactggctttactgatagtaattaattaccgtgccggaaaaacgaagaagaaagaatcatgaacatgtactgctacgtaaataaaatgaaaagaatagttgctgttaacttgtttttgctggtgctggctggttttctgagcggttgctacaattccggcgagccacgcgagagagttcttaagatctataactgggcagattatataggagaaggtgtactcgaagatttccaggcgtactataaagaacagacaggtgaagatatccgcatcgtctatcagacattcgacatcaacgagatcatgttgacgaaaatagaaaaaggacatgaggattttgatgtggtttgtccttcggaatatatcattgagagaatgctgaaaaagcatctgttgttgcctattgacaccactttcgcccattcccctaattacatgaataatgtgtcaccatttattcgcgaacagattaataaactgagtcagccgggtgaagaagcaagccgttacgctgtctgctatatgtgggggaccgcaggtattctttataaccgggcatacgttcccgattccgacgctttctcctgggaatgtctttgggataagaaatatgcaggaaagattctgatgaaagacagttaccgtgacgcttatggaacagctgttatctatgcccatgccaaagagctggaagaagggacggtgacggtggaagacctgatgaatgattactcgccacgtgctatggaggtagccgaaaagtatctgaaagctatgaaaccgaatattgccggttgggaagcggacttcggtaaggagatgatgacgaagaataaagcatggctgaatatgacctggagtggcgatgcgatatgggcgattgaagaggcgaatgcggtaggagtggaccttgactacgtggttccgaaagaaggaagtaatatctggtatgatggctgggtgattcctaaatatgcgaagaatccggtggctgccagctactttatcaactttatgtgccgtccggacattgcgttgcgtaatatggatttctgtggatatgtgagttctatcgctacaccggagattctggaagagaaagtggatacgactctggattattatgcggatttaagttatttcttcgatccggatgccgacagcatacagattgataagattcaatatcccgaccgtaaggtggtggaacgctgcgctatgattcgtgacttcggagataaaaccaaagaggtactggatatctggtcacgcatcaaaggtgacaacctgggggtaggtattactattctgatttttgttgtcgtagctttgatgagcggatggatgatttataagagatggcaacgctacagccgtcggaaacaacaaaatcgcagaagcagaagaaagagaaaaaagaatgtgaagcggtaagttaaaaacactcggtaataagcggtggatgataaacgaatgatacggttaaaaccgggcatcgtttgtcatccaccgttttttatcctactcttttcatagaacggatgatgcctttcgtctataaaaaaaagagtgcgtcttctttcgcagacacactctcttttacattttattctgtaaataattaaacagtcaccttatttcttagtcatatcaaaagaaaaggtcgttgccggaaatttatcaaaccgttcttcatttactgtaacttctgttgcctgaatagcaaacttcagtttctgaccttcataagcataactgcctttctcgtcagctttgattgtcacttttacggtgagtttaggagtttcttcttccccttcagtttttcttatgggttgtggttccattgcgatttccaataccaagggttcaggtgacatttgaagtaagatgttgtctttattatcattgaaagctgcctgataagggattttgtattctacatctcctaccgctttgatgatggcttcggctgcgtccggatcttcgataatgcttttgatcagatcctctaccgggaatttgctgattaatatatgattatcttttaattcggcatttacggtgactccgtcttcagcttcattctctgcattttccaaaggagcgatagaggttgtctgcattttgccggaataggtgccttctacatctttgagagaatataccggaatattttcatcatcatcactactacaagaggtaaagatactggtcatccccaatgccattaccaataaaacaaaacgacttaagcaacatacttttttcattttagttaaagttttcatacttgttaaacaaattaggttattaattctcaaaattaaggtgtacgtacatagagtaaataccggaaatgacgaaatactgcatcatggaaataaaaaagtactccagtcactttctccgtgaagaccgtgctggagtacattcggacatgcttttagttgtccgttctattccgactattttttcttgatcgattctttaggtgtaattccgaagtattctttatacctgttgcggaagttttttacatccttcaatccgatcatttccggtatggttccgacagggtatttcccgctttctaacaactcgtgtgccttttccattcgaaccgcttcaataaagacggtcggggcctcgccggtcactgacttccacttattgtagaatttcgttctgctcattttcaaatgtgaggcaatcgcatcgatagtcaaatcctctttctctatgcgttcaagaatatactcttttacttcattgatcaataggcttttgcttccttcagtagcttccttgatcatttcggttggttgtacttgcagaaaatgttctccgaatactttgtgcaggaatgcttttctaagaaggcggctgttcctgataagaacagcaatctctatctttaaatcctccacatgaaaaggagtatgcatgaatgtgtctgctaatgacgcttcccttttactgcgttggtcggcatctatatgcgatccgtaaaggatgaccggtataatagatgtttctttagacgtcttcagccttgaagaaagttcatcaccgcccattccgttgagcactgtatcgcatattaccagatccggatgttcatttttgatatatcccaatgcgtccgctccgttttcaaagcctctgactatgtattcctctgacaaacaggtttccagataggatctgaactcttcgttactgtcgaccataatcacgacaggtctggatgaatttcttttctgtgaacttttatggaataaggcatcgatcttttcttcttctatattcttctctatatgaaccaaactgcgttcggatacattttcataagagggttttacaggaaaacgcaatgtgatcgtatgacatgaattattgattaatatttctccattgcatatttctgtcagttttttgcataaagcactttttgcaaagtaatatttaggttctgttttttgtttaataagatgtttaccggagcatttatagcatttcattaggttttcatttcccgtataactcgcttttattatccaatatttgttgcataaagatgcgtgtataataactttttttgaatattctgtatgatctattatattctttatgaatttctctattacgggagatattttactttgatctatccacacgcttgcatatttgaattctgtttggatttctaatttaatatgtctgtttgctgcatgatctttcagagaagatattttatttttaaggaaatttcctaattcatgttccgtaatattcatttttagggaatgagcggctatttgcttcaggtccattaatctggttaaatgatcattaaggcaatctatattgcgaatcgccagtgacagctcctttttgatattgtctgggcaattcttgttataggttgacttcaaaggcgtatgaagcaatgtgattggggtgcgaatgtttcggaaggaatccatgaagtactgattttcttcttttaagaaagcaatttctttccgcatggcaaaagaatgagacaagaaccaatacaataaaagtattcctgctgttgaaaataaaattggaaataattcactttgggtggttgtaactgcgataatagaagtgtataatgacgttataattaaatatttcatattaatctgtttttttagtaacgtcacttggtgaaattgatctattcctcttgttcgggtttgaagcaaggaaaaatgcacagtattatggtctcatgattgtatatcaataagttcaaataacatgatctcaaaattatttgttctttgaaggctgatatcgggaatgcgtagtatatatgtagagttttaattctaatgtttgaacccttttgaaaggaatagagcaaatctcctccaagtaacaataattaatttgattattttttattaaacataaatgttaaatatattgtaagtaatgcgggctgctcaggaggtgcccgtgcttttggttgggtacttttggaataacttccatttagtaccaattcagattctctcatttttgggtttttggataatatatacgt

SEQ ID NO: 118 - DNA, 24484 bp, Bacteroides thetaiotaomicron
gttttctttctataatagtctaactttgttgcgaagaagatatgtatgacacccgggtctcgtgctgtacgacacccgggtgttgtgatgtctgacatccgggtgtcatacgtgctgacacccgggtgtggtacagaatgaaaatataaacgaaacaagaaaggagtataagacatggcaatcccttatgtagtaagaaagaaagcagacttgacgtccggagaaagaaaagagttatggtatggtgtaccaagtaaaatacaggatagaggcggagtacagaacaaagaacttgctcaagtggtggagctgcggggaggtttccaccgtggtcaggttgaaggcatattggtggaagtagcggatgccatccgctatttgctttctatgggacagtctgtgacgattgatgggctgggtacattccagactgctttgaccagtcctggttttgaacgtcccgaacaagtgacaccgggacaagtatcagtatctcgcgtttattttgtggcaaacagcgcacttcgtgaccgcatgaagaaaacaaagtgtatgcgcatcccttttaaatattatatgtccgaaagtatgttgactaaagagatgaagaaagcagaccaggagcaggaacaaacagaagaataagataaattaataccctccctgtcttatttatgagataaatgcctatctttgtggcactttttacgaaaaaaggtaattcaaattaatagatatagaaaagaaaatggcacaagaagacgtttttaagaaacttgtatcgcactgtaaagagtacggtttcgtatttccttcaagcgatatctacgacggactaggcgcagtatatgactacggtcagatgggcgttgaattgaaaaacaacattaaaaaatattggtgggacagcatggtgctgttgcacgaaaacattgtcggtatcgactctgccatctttatgcaccctaccatctggaaggcttccggacacgtggacgcattcaatgaccctttgattgacaataaggattctaaaaaacgttatcgtgctgacgtattgatcgaagatcagttggctaaatatgacgataaaatcaataaagaagtagcaaaagccgccaagaagtttggtgaatcattcgatgaggctcaattccgttctaccaacggacgtgtgttggaacatcaggctaagcgtgatgcacttcacactcgtttctcaaaagcactgaatgataataatctggatgaacttcgtcagatcattgttgatgaagagatcgtatgtcctatttccggtactaagaactggacggaagttcgtcagttcaacctgatgttctctacagaaatgggatcgacttcagacggtgccatgaagatttatcttcgtccggaaacggcacagggtatctttgtaaactatctgaatgtgcagaaaaccggtcgtatgaaagtacctttcggtattgcccagattggtaaggctttccgtaatgagattgttgcccgtcagttcatcttccgtatgcgtgagttcgaacagatggagatgcagttctttgtaaaaccgggaacggaactggattggttcaagaaatggaaggagattcgtctgaaatggcataaagcgctgggcttcggtgatgccagctaccgctatcacgaccacgataaattggctcactatgccaatgctgcaacagatatcgagttcctgatgccattcggtttcaaagaagtggaaggtattcactcccgtacgaacttcgacttgtctcagcatgagaaattctccggcaagagcatcaaatacttcgatccggaattgaatgaatcgtacactccgtatgtgattgaaacttctatcggtgtagaccgtatgttcctgagcatcatgagcgctgcttattgtgaagagcaactggaaaacggagaaagccgtgttgtgctgaaattgcctgctgcccttgctccggtgaaactggctgttatgccgttgatcaagaaagacggtctgcctgaaaaggcccgtgagatcatcgacgctctgaagttccatttccactgccaatatgacgaaaaagacagtatcggcaagcgttatcgtcgtcaggatgccatcggtactccgttctgcgtaacagtggatcatcagacattagaagataactgcgtgacattgcgtaatcgcgataccatgcagcaagagcgtgtagctatctctgaactgaacaatatcatcgcagacagagtgagcatcacttcattattgaaaactttacaataaaccattaacgaatgagtaaaaaaatctatttattctccttagtattactggctttggcttttgtttcttgtagcgaaaccgaagaagttggtaaatacgataattggcgtgcgcgcaatgaggcatttattgactctcttgcgaatgtttatgctacggcttctggtagaggaggcttggaacgcatagagatgttgactgctcctggtaattatatttattataaggaaatggagccaatgactgatcatgtagtaaaggcgggaaatcctaaatatactgactatgtgaaggtatattataaaggaacaaatattttaggagaatattttgatggtaactttaagggagataatccggttgtagatgggaaagatccaagtgaaggagattctcctaccaccattttccaggtcagcggggtaattaccggctggggtgaagtgcttcagagaatggaagttggtgatcgttggaaggtttatatcccttgggattatgcctatggaagtagcggtactacaggcattttggggtattcagctcttgtctttgatatcacattgcttgattttgctaatactgaagcggagttgaaataataagataaaactctctatatgtaaaaggtgctgtatctatattacgtagatacagcattttttttattattctccttaatgctactctcccttatctgcaaatgtgtcggaatcaccacttgcttgaccgtcctgtctcccttaatttgatcaatcagcagttgacacgctgtttcccccatcttataagtctgatgcgatacggcagataacttgggttccacataattggcgtgctgctcatccgtgtatccgatgatggcgatatcgtcgggaatacgaagtccgtgccttttgattacttccatggcggcaaaagccaatgtgtcattcatggcaaggatggcatcgggaggctgggggagagataataatgtttccgtagcaatctgtccttcctcataatcaattttccggcagacaactaattccttttcaatcggaatccgattatcgcgcaaggcttccagataaccgtgcttccttctttttacaatatccagatgattggcaccgccgataaaagccacccgtttacttccattgtccagcagatgctgggtagccatttgtgcggattgtgctccgtctgctattactgacgagaattgatcggtcaggcaaacacggtcgaacagaatcagcggcatattgatctctttcaatgcggcaaaatgagaaaagtcagttgtttcctgagacaggcaggcgataatcccctctacccgcatattgaccagattctctatattccttttttcatgctcgaaagactcgtgcgatgtcgtgataatgacgaaatatccgttatcgatcgccatgttctctatcccgttcagaatggaggcaaagaaatgagtgacaatatccggaacgatcactccgatgatgcgcggcgcattctttcgcagactcatagcgaaaggattgggacgataattcatctctttggccagcttcttggctttggcgcaaagttcacggctgatttccgggctgtctttcagcgctcgggatacagtagggatggatacgcctaatgcttgggcgaggtctttgagtgaagtatgtttccggttttccatctgaaggtctccaacttagatttatctgcaaagaaagcatattccctgataaatctccgcatttaaagaaatattttttacgtaaaccgttacgtagctttttcgcccctctcttgtccgttgagaagggttcaccccttacttttgtcgcatacaaaataatttaaaaccctatacgtatgcaataccatgaaatcggaaagacagggatgaaagtatcgtctctcagcttcggagcttcctctctgggaggagttttccatgatttaaaagaaaaagaaggcattcaggctgtgtttacagccatcgaagccggaatgaactttatcgatgtttccccttattacggacattataaggcagagactgttctaggcaaagcgctgaaggatattcctcgcgaccgttattatctttctacgaaagtcggacgctatggcaaagacggagtcaatacatgggactactcggcaaagcgtgcgacggagagtgtatatgaaagtatggaacgtctgaatattgacttcatcgatttgatcaatgtgcatgatattgagtttgccgacctgaatcaggtggttaatgagacattgcctgctttggtcgaactgcgtgagaaaggagtggtaggacatgtcggaatcactgacttgcagctcgaaaacttgaaatgggtgatagaccgttcgccaagcggaactattgaatctgttcttagcttctgtcactattgtctgtgcgatgataaattggctgacttccttgactatttcgaatcgaaagaaatcggtgtcatcaatgcttctcctctctcgatgggcttgctgagcgaacgtggtgttccggtctggcatccggctcccaagccattggtagatgcctgtcgcaaagcgatggagcattgtaaagcaaagaattatccgatagaaaagctcgctatgcaattctcggtgagtaatccaaagattgcgactaccctgttcagcaccactaatccggagaatgtgaagaaaaatatcggctttattgaagaaccggtcgattgggaactcgtgcgtgaagtgcgggaaattatcggagaacagcagcgtgtaagttgggcaaactcttaaaaaacgatcgattctatggattatacgattattgatgcgcatgcccatctgtggcttcgccaagatacggtggtcgatggttttcctatccgtactttagagaacggacgctccctgtttatgggggagattcggcagatggttcctccttttatgattgacggggtgaatagtgcggaagtttttctgtccaatatggattatgcccaagtctcggctgcggttattacacaagaatttatagacggcattcagaacgattatctgatggaggttgtttcacgctatccggaccgtttctttgtttgcggaatgtgtgagtttcgcaagccgggctatctggaacaggcgaaagaactgatcgggaagggatttaaagcgattaagattcctgcccagcgcttacttctgaaagagggacgggtaatgttgaactgtcctgaaatgatgcagatgttccggtggatggaagagcggggagtgatcttgtcagtcgacttggcagagggggcgatacaggttctggagatggaagagattattcaggaatgtcctcgattgaagattgctgtcggacatttcgggatggttactcttccggattggaaagagcagattaagttggcacgtcatccgaatgtgatgattgagtccggtggtatcacatggctgttcaatgacgagttttatccgtttaaaggtgccataaaggctattcgtgaagccgcagaactggttggtatggagaaactgatgtggggctcggattatccgcgcacgataacagccattacttataagatgtcttatgactttgtggtgaaatccccggaattgtcggaagcggagaaaacgttattcctgggcgggaatgcgcggaaattctacgggtttgcagaacttccggaactcccgtacattaaaaatatgtcggaatagaaaggaaacaattacaataccactaaacaatcactgtacacatgaaaaagaatacatataccattcctctcgcactggttttcagccttttcttcttgtgggcgatcagcagcaatctgcttcccacaatgatccggcagttgatgaaaacctgtgaactgaacaccttcgaggcctcttttacggagaccgcttattggctggcttactttattttccctatcccgatagctatgttcatgaagcgttatagctataaggcgggaatcatcttcgggctgttgctggcagctgtcggcggattgctgttctttcctgctgccatgctgaaagaatattgggcttatctctgcatcttcttcattatcgctaccggaatgtgttttctggagacagccgccaatccctatgtaaccgtgttgggagctcccgaaacggctccgcgccgattgaatctggcgcaatccttcaatggtctgggtgcttttatcgcagcgatgtttctgagcaagctgattctaagcggcacccattatacacgcgagacgcttcctgttgattatccgggaggctggcaggcttatatacaactggaaacggatgcgatgaaacttccttatctgatattggctctgttgcttcttgcgatagcggtcgtatttgttttctcaaaattgccgaagattggagatgaaggagcggaacctgcatccggaaagaaagaaaaactgattgatttcgatgtgctgaaacgctcgcatttacgttggggagtcatcgcgcagttcttttataatggtgggcaaacagctatcaacagtctgtttctcgtatactgctgcacttatgccggtttgccggaagatacggctaccactttctttggactgtatatgctggccttcttgctggggcgctggattggtacgggattgatggtcaagttccgtccgcagggtatgttgctggtgtatgctttgatgaatatccttttgtgtggtgtcgtgatgctatggggaggaatgatcggactgtatgcgatgctcgccatctctttctttatgtctatcatgtatcctacacagttctctttggcactgaaaggactcggaaatcagacaaagagcggttcggcctttctggtaatggcaattgtcggtaatgcctgtcttcctcagttgacagcgtacttcatgcacgttaatgaacatatttattatgtcgcttatggcataccgatgatttgttttgcgttttgtgcctattacggttggaagggctataaagtaattgattaataaatttatctcaaacaaataaaatgaaagcagttcaaattgtcaacccctccgaaatgaaggtggttgaactggaaaaaccgaccgtcggtgccggtgaagtattggtaagaatcaagtatgtcggattctgtggctccgatttaaacactttcctggggcgtaacccgatggtgaaactccctgtaataccggggcatgaagtaggagcagtgattgaagagatcggtccggatgttccggctggctttgagaaagggatgaatgtaacattgaacccatataccaattgtggtaaatgtgcttcgtgccgtaacgggcgtgtcaatgcctgcgagcataatgagacattaggcgtacaacggaatggagtgatgtgcgaatacgccgtgcttccttggacgaagattatcccggcaggtaatatctcatcccgtgactgtgctctgattgagccgatgagtgtaggatttcatgctgtttcccgtgctcaggtcatcgataatgagtatgtgatggtgattggctgtggtatgattgggattggcgctattgtacgtgctgccttgagaggagcgacggtgattgcggtcgatctggatgatgaaaaactggtactggccaaaagagtgggagcgtcttacgcagtaaactctaaaacagagaatgtacatgagcggatacaggaaatcaccgcagggtttggagctgatgtcgtgattgaagctgtcggcagtcctgtgacttatgtaatggctgtggatgaagttggctttaccggtcgtgtggtttgtattggctacgccaaaaaagaagtcgcttttcagaccaagtatttcgtccagaaagaactggatattcgtggttccagaaatgcattgcctgctgatttccgtgcggtaatcaactatatgaaagaaggtaagtgtccggtagaagaactgatctcaaagattgcaaaaccggaagatgctttggaggcaatgaaagaatgggcagctgatccgggaaaggtattccgtatcttggtagaaatgtagataatttattttacagaatcaaccgcttagcccattgtattgagaatatgaagaaagaatgatcccgttggttttaaaccaacgggtcgttcctttaaaaccaagacaccgttcctttaaaaccaacagatcttttcttttaaagaaattctagatgttttttatctgttgagaatcagtgttttacggactggccctaaacacgggtcaataaatggttatcattctttacataactgcgtggcattaaaagattgaagtataatttgtgcttttagtctttagaatgttcttctattattaaggatggaatgataattggctatgatattgaatcaatccttccatcggactttggagaatcttacctatctgaatacctgtttgtcgggcagcatcctgtagaatctctttgtaacagtaggctatcgatccgatgaagtgtaccggatattgcttgtaatcatactgcatcacattcctgcgaaagaaagctataaagctgttcataactaattggcggatagccggttcttccaaatgctgtgcgataaaaggagagagactggccaaaaaacgattgggaaagggctggcgataaacccggtcgatgatttcgggaggcgtcagatcgaactgcttcagaaactcttctttcaaggtggcaggaagttgatttttcagaatatctcctaccagcagttttccaagtacggcaccgctaccttcatctcccaaaataaatccgagaggagagatgttactgacgatctcttttccattgtaaaaacaagaattggaccccgtccccaaaatacaggcgataccagccttctggccacatagcccgtgggcggcagccagcatatccgaattagctttaatattcccgataacgggcagactgtctgcaatagcccgtcggaggacgggagctttctcgggtgtacaacctgctccgtagaagtaaactgcattgaatttcccttccggcagttgaggcagaagggaagctgccagcttctgttggatttcttcttccgactggaagaaagggttgatccctttcgttccaagtcgcttgataactgcgccgttcagtacgacacaccagtctgttttggtagaaccactgtctgcaatgagtatcatatcttaatgtatattttctttttatatagaatgtagcctattgcccagttgagaaggacaaaaagcagggcaaatacaagcgagcctcctttatctccgaagacaggttgtaggagtgcgctgtaaatatagccatgtaaagaagtcgcttcaccttggtaggtcataggaatgactgccagcgtaatcgccagaatatctgccaatacataaataaatagcggatttactccaaacgattcgaagaaacggctccagtttttataacctttaatgtcaatgatccatacgagtaatgccagaaaactggaacccagaccgcaggttacgagtacgaaggaaggagaccatactttcttgcagataggggaaccataactcagtaagaaacctgcgaaagtaaggatagtacctatcaggaacaaacgttccagcttctcatgaatatcttttacttccatcaatagctttccggcacagaagccgattaagacgtgggcgatggctgaaatagtactaagcagtccttccggatcaagtatctgaccgccatagatatgagcttgtcctaatactgcacggtcgacgatggaaagaatatttgtttcgtcgtagacatatccattgccgagggcaaggattgcaaaataactaatgagaagtacagcaattaaataaggtatatatttatgcttcatgagtaaagcgactatggcagtaactccatatcccaaagcaagccgttgcatgactccgagaatgcgaatctggtcgatagggaagggatcgtgctggaagcagagaatggaaagccagctgatgccaattccaatcaggaaaatgatcacggtccgtttgagaatttttaaacccgcgggaacactgaaggtgaaattgtactttctcaaagagatgtacgtggagattcccataatgaacataaagaatgggaataccagatcggtaggagttaatccaatccactcggcatgtttgaggggagcatacgcatgttgccaggaaccgggcgtatttactaagatcatacccgcgatggtgatgccccgcatcacatcgagtgccaataggcgtttgttacttgttgttacattcatgactgttactttttaatgtgttaagttataagtaattcaattttatctcttttttccgaaggaactgtccagtcgattgcggatcatccatgaagcaaggatgccgggaatggtgcatacgcatacccagataaagaagttggtgtatccaagatgttcctgtatccatcctgccggcattcccggaagcatcatgccaagtgccataaaacctgttccaatggcataatgagctgttttgtgttcaccatctgcaatataaatcagataaagcatataggcagtaaagccgaagccatatcccagctgttcgatggctacacaaatggagattagcaggaggttgtccggagtagctgctgccatccagacatataaaaggtcggggaggttgatagccagcgccatgggaatgatccatttcttaaaaccgtcacgggaaacgaggaaaccgctgatgatgccgcctatcagtagggcggctacgccgatggtgccataaatgactccgacggatgcggttgataatcccaatccgccttgttcggcaccatccaataagaatggagaggctattttagcaagttgggattctcccaaccgataggtgagcaggaagaaaaacataagtcccaggtttttcttctcaaagaaagtgacgaatgtcttaaagaaatcttccagtaacttacccggtgttaaccccggtcttttgacatctgaagcagggtgggggagaataaagcgatggtatagtgtcagtccgaggaataatcctgccatcagatagaaagtgatactccaggccattggaacattgccatgcgatgtttccaaccagcctgccaacataaccaggattccctgcccgaagatattggcgaaacgatagcaagtgtttctgatgcctacgaagaaggattgttctttgttgttgaggccaagcatataaaagccgtcagccgcaatgtcatgcgtggcagaactgaatgccatcagccaaaagaatgccagagtgagttgcacatagtgtggagtcgggataaaaaaggcaataccggcgaaaccggcagcaatcaaaccctgcatggcaataatccaggaacgctttgtcttgaccagatctacgaaaggactccataatggtttgatcgtccaaggcagatataaccaggaagtataaagcgctatttctgtattcgacaatcccaggcgcttgtacatgataacggcaattgtcatcacagccacataaggcagtccttccgcaaaataaagagtcggaatccagctccacggatttcgattgtttcttggtattatgttcttggcatttcttgttgatatcatggcattagtctcagatgttattcatattgtttttcaagtctgcttccgggataatagtgagctaaaatatctttgtaataataacctcgctctcccattactgccgcaccgatctgacaaagtcctactccgtgtccccaaccggctcccgtcagtgtaaagcgggttggaacatttccctcttctcctttttccttatccacaaggaatgctgaactataaagatgggaaggcgacaatgtacgtcggatctctaattcttttccgatggtcagtgtccgtaaagtacctactatctttaatcgtatcaggcgtccggaagttcctcgctctacagggattaagtctatgatttccccgaaatcaattcccgaacgttgatggattaactcagctagttcctgttggctataactgattttccaacggtagaaatcagtcgtttcctgatcgtagttattaagaacctgactcagaatctttttatcctgcgtattacagaaagcatccggagaagttcgtatccatcggtccgcttcttcttcctgcgtcagatcgggaagctgtattgccggacctgttatttgtttctccgaatcagaagcatgggattccggtatgtaatctcgtttaccggtcagataaggatgcctcacattctcccaacaattctgaaactcttccattgcaccgccacaacatttggagaatcgcgcatcgcaaatctttccttcatacatcagcacctctccacgggtagctgaaacagcttcgatagcttgtggagtagaagcacgggtaattccctgatagcgctggcaatgatcatccgcacaaacatcaaagtgcgtatgcgcttcatgatcataccatttgataagttgagagtggagagtggaatgtggagagttggctgcgctgtccggctgtatagtagctttccatttttcattctccactctcaatttattgatcagccagcttctggaaatgactgcatgcgctttcagtagttccaaagaggcggtggcactcatttctgatgagatgacacttgtcaggtaatcttctatagagattacattgatggcggtcagtgtctctccttcgacaatgattttcaaagctccctggaagcgttgtacttctttgcgttcccaatgaaaattgatgccgatggtgacatcctttagctcaaagaagatcccggcatttggctgagggtagaatatcaattcatcgtattctttccctgaccagtatatcttttctttttgataaacagccttttgtgcccctgaaacctttgtgccgtcaggagtagtgaagctttcgggaaaagaaaattcaatttcttttcccgaaaggataccgactgtaatctgaggttcttccatttcttctttactaggatgtttgatcggtgagtgcttttaactgttcctgtgacaaactgacctccttgtaaatctgagtgatttttttagctgttatcttatccaaatcttcttctcttacaatggggaatacgccacacatctccgcaatagccgggcttatcaataagccttttttcccttgggcataataacattccggccgatgtttagaacgtaggaaaataatacagttccactgttttatttcatcgcctccagtgcggtttactgtttcgagtccataccaggcaatcacattgattaaaggttctttgtcatgataaatagaaactatcttatcgtaaagatactcaaacatttcaatgatccctcttctgtttggagatgaaatgccaatgctcgtggtgaacccattttctagatgactatgtacgctatcttcagaactaagcatgtccgatatgaaagtcatcccaaaaggattggcaatcttttcctcttttcctgctgcctgaaagtgcatatggtcaggggcggaagctccgcattccggtccgttatataagatgaggaactcgttcatgttttcggcaaggaaaagcatatcctcaaaacggtttttgatggtttgcggggtatgttcctcttcaattatggtcagatgccggcggaaaatcggataaggattgaggcatacctcataatgtccaagtgacaaagacgtttgttctgccgggcgattgtcattgcacagaaaacaaggtctttcttgtatggactgagagtcggtctgggccattgtagagattgcccgttgtggatttgggaagaatctgactctcttggtgtcccctcctagtttgagttccagcgtcttttcttttttaagattctgttctaattccttataattcttttttgccagcttccagtcttttttctgtttttctatcatctcgttgacgagacgctgaaaactttcatcaatgctgtgcatccggattcttgcctgtaactcccaggttcggatactgtctttgtagaaattgttccggttaattttttcgatatctaatgctgcgtcagagttgccttcccaacggcggcaaagatagattacatcataaatacgaccgatcgtatattcacgagaaatactcagacctatggcataatcttctccataactggtattggggaatttgatcttgcgaaggatgggagtgtagaaggcccgtggggcacccaacccattgatacgtaaagcattgttgggaccgtcctctactgtccactctttatggtcaatgacaccgggagctatctcgttcatctgaaaatccgtcattaggtaagtccctatcaccattgcacagttctgctgatagaaggtatcgacgattttctgtaaggtatgctcatccttatacaggtcatcgctatccagttgcacggcaaatttaccgcatttctcatggtgtactcctacattccagcaacctcctataccgagatcattctcctggggaatgatatgtattagtctattgtccgcactaaattcctggagggcttcggtggtaccgtccgttgagtgattgtcgatcacaatcacattaaagggaaaagtcgtttgctggctcaaagcagaatttacggcgtcacgaatggtccggatacgattacggacaggtatgatgacagatgcttcaaactcaaaagcttctctgtccaagtttactgtccgggaagaaggtcttacataggcattgatttctttcagatgcttgatacaaactttctccatttcgatctgtacttcccgatttttaggatttacgtagtcgaattgtttttctccgcttttccgagtatctgtttctatttctgtgtaaaggaactcattgatatggatgatttgaaatagattacctagcatcagacgcatttcataaaatgcagcatattggaaaactgtttcctccagaatacttgaagcaagggtgaaaatttcggaattgaataaaagcaccgaaccgaaatcaaaatcatcccggaggcttccttgttgataatcaataacgggagcttgtttgagaactccgtcaaccagttggtaatgatctgcgtataccattgcattttctgaggaactctgtataatctgtgtcatgcgttccagtgcgtacaatcctagttttagcggggtctgtttcgtgtaaagcaaaagatagctggcatcatctgcgttgtcagcaattgttttaatcgtacttgtagagtagagaccgttaatgaggagacattcacaccccggtaagcactctttgttggtatcagcgcttagcaggtagattttgttcactaattctgaagcttgcaattcttttacagtttgtatcgtatctttcggattgccaaaaggtatgaagcaattgattttctttttcattttaatgtttttttattaaagagttgttgataggggctactgacgatttccttttgatgagcaggcaaagccccagaaaagtaaacgcagcattcaatatcagtaactcgtagctaatttgatatccatcgaaccaggcttccgaatttctttgcaatacgtagcaaagtgcaggagaaagaatggctactaacggaatatatggatcataaacttgttttttagtaaaaatgccgaaagcgaatagtccgagaattggaccatacgtataactggccagcgtataaatcgcatcaatcacactcgtattattcagtaaattgaatacgaagatgacgattcccatcacgaatgccatcccgatgtgcacgtgtttccgtattttgctgagtgccgcttcgtctttcttgtgcgcattcagaatatctacggtgaaagaagtcgtcagggctgtcaaggccgatccggcagcggagtacgccgaagctatcaatccgataatgaacaggataccgactattcccggaaagtaattgcctgtggcgatcattgggaacaattcatcgctcttaccgggattctcgattccctgtcgggcggtgaaagtatagagcaagacacccagcatcaggaagagcaggatcacaaagaactgtgaaatcccgcttgtaatcatattcttctgtgagtcacggaagttcttgcaactgagattccgttgcatcatatcctgatccagcccgttcatggcgataacggtaaagactcctgccaggaattgcttgaagaaatatcgcttgtcgttgacatcgtcaaaaaagaacattttggagagatcgttgtctgaaatcgttgagaccaatccgctgaaattcagatgcaggctggaagctatatagtagatacaaagtacgacggagactaccagacagaatgttttcagtacatcagtccatatcaatgatttcactcctccccggaaagtatagagccagacaatgagtactgtcagtatgacattgattataaagggaatatggaaaggctcgaagatgagtaattgcaaggtcagacatactaaaaagagccgcacggcagctccgagcattttggaaataaagaaaaaccaggctcctgtcttataggaagaagctccgaagcgattttcaagatattcatagatagaaaccagattcatccggtagaaaagcggaacgagtatgaatgcgataatgaactgtccgacgataaatcccagtaccatttgcaggtaggagaagccgctggcttgtaccatacccggtacggatacaaacgtaactccggagatagtggaaccaatcatggcaaaggcgacaatataccatgccgatttgcggttgccgacgaagaagccttcgttatccgctttatgtcctgctatataggagatagcgaaaaggatcataaagtatgctatgatagtaatagataagataattggactcatatctgttgcttaaaattcgttcgcgggtgaatatattcaaatatgcttttcctacaaattgtacaaatgtagggaatttatcaaataaatgcatccttcttatgagttttttattccgggtgtgccacctgtatcatttctcgatgagtgccagtttttgttgagagaaggaagttcaggagatatcttctctaatgaaatgcctgtagtgactgaagtgtcgtgcatccagtctatgaaacggcaggtatcaatcgtgcggggatgttcttcatcagttgccaaggcaaggtaacctccgtcgttgctcagttgcggaaatttggatatttcggttatacttttgccgtcaaccttatgctttctgatcagtgtagttgcggagtgagtaaaacaaatatatcctttgccgggaataacaaggtttgtattttcatcttcctgtttgagtattgtggtactgaatatttctcccgttgctctcattttaaacagacgcagagactttacagtgatatcctgatcagcaggattatagaattcgatgtattcggcaccgtctttggcattgtcatacatcacttcgttgaatagtaacatatttctcacattgtcaggatattccggcgattccggtgtgtcaggcttgtccggttcatccggaacgtccggtatgtcgtccggttcagtacttgttatcacatcatcagacaactgtatatgatggaaagtgaaaccgtcacagcggctttttgtataaacgcagtatatgccgcagcagattgactttgtgatacttgcgtcttttatttgtttctccttcgtatattcggtttccgtttccatgcgtgtccagaaagtccagtagccgttggcgtcgcattctactttgataaataatttcggagaattatttcctttcatgagttctcttcccgaagccagtaatttggattgattcccattttgccggtaaagtgctacattgtcttttgttcctcctatctgaatgtaatagccgttcagatctccggaaagtatttccgatgaagaggctaaatagaaacgggcgtaattattggcggaaggattaaaggtgagccgtaccccgaattcccatcgggtgcttcttacagaagaagaggggatcgtgatatatgctgttcctgcatcttcctgcggatcattcaagtgtacgccttctttggtattaatcgtgaatttctcggtttctcctgtccagggaagttctgatgttgaactgtccggttcaaggctctctttttcatcctcaggcggaagcgcacaactgtataataatataatgaggaaactcagaaatgtacatgccttgcaaattttcatacggctttaaattagtgttgttatctaccgtatttgtttgtgttcaacgcagaggcaattgcggatcggataatgttcatgcttgcaaaggtacagtttcttgttgaataaatgcgaaaggttctttattgttttctgtgaatgttagaaataaaagatacggattatacgaattaacacgatagctttatgctttcacaacgctaaaaccgtgttaatctgtgtaatccgtgcctaaaagttattattcctgttattactcaaagcgcggcatcacatacttgtccgtataagaagtgaaactgatgccgggcatataatgagtattcgaattattttccagcttctttatcagtgaataatcatccgcgttcaaagcatagtaattatcggaagacggactcgtcacccgtaccgtccagtcgaacatatttccaatgatggtcagcgcgtccgtttcgggattgaatgcaggaactcctgttttcaccacatcatacgtgcggcttttcagcacatataaagcattgttgatatctgtcaggaaagcaagcgtctttttatttctgaattccgtcagataaaggtgctctaatgttaatccttccggcaaagtgatagcacgaacgtagggacgccctttcacctgtttcagatggaacagacgacggtcggcatccaacagaaggtatccttcgtcatactccttcttcaccgtcgggtttcctgcgatctcaatggccggaaagcggaaattcttcttggtcatagcttctgtaaacaagaggcttttttctgcattcacgctattggaagccatatcgataaactcaatgccttgcgaagtaatgcggaaaacatcatccggcatcttcaggtctacacgcccggacatcgactccaacagaggataaagaccgatggaaggagcgttgatatccgtaggtacgctgcggaaattgaaattctccgtctgcacgatcttcggagtgacagctatcccgttaatcgtatccggaaaacgttcgtcggacatcaactggcggaaataaaacataggcagaatactgtcgaaagctgcttcggaataaatgtttccggcagcgtcgcgacgtacggttccttttccctcttcctgtcccatcaaggcgaaatcgccgatcacgaaactatatagagtgaaaggagtcttctccggctttacgacaaagaagttgtaacaccaaggcaactgccagagaagcaggaaggcgatggtgacatataatagtagggtactgaaacgtttcatctttatttaattcttcatttttagttcttcattcttcattatcctagtcctgctttcccgctttgaaccgtacgatggagagccaggagaaagacgcggtcagcaacgtatagaccagcagatacgggaggaatttgttataagcttccggcgtgggcgacaggaagaagattcgcagtaacaatacggcgataatgagattgatgattctgcgtttccatgccggttcgaggcagatccatgcgatgagcaggtagccggaaataccggcaagataccacgtgagggcggtcagcagtatatgattcttcagttcgtgagccagtactccgctcagatagacctccatcagaaggaagttggaagcgaagcagacaagcaacagtaccaaaccggagaacaacatattgccggtcattttcagttcgggatagggcaggtgcaaagtcagtttcagacatttgcgctgcatctcgggaacaaactgcacgatggccatcaacactccggcaatcagggggatgtattgtaacatatcgatgaatatggcatcccgctgcatcatgacttcccatacatgcgcggcgcctttcatttctatcacccggttgatgcgaagcatacagtagcctgtaaaaccgagtgtggtgactacggcaagcagaaaataccaccgtgtcttgatccattctttataaaatatagcgtacatgagacttctaatttactttttaatctttaattattttattgaatcagtatttgccggtcagaccgatgaaggcatcttccagattcacatgttcgctatgcaggtccgtatagggtactgacatggatttcagttttgcttccgcctctgtgggggggaggaaggagaatgtttccagtgtattccgcatcacggaaggatgatagaaatcatcggatgcgggcagttcgtaaccttcgggaacagtacaggtatagcggcgtccttctttcagtaattcgtcaattggcttctgaatcagtatctttccgtagtccatcatgatacagtcgtctaccagtcgttccatatcctgaatgatatgcgaagtcagaaagacagtcttgccttcggaacgtgcataatcgcggagatagtctacaaacaggcggcgataaccggggtcgagaccgagggagaagtcgtctaatacaagaagctcgggattctgtgccagaatcagtccgagtgctacttgtgaacgttgtccgcaagacatacgggagatgcgctgtccggtagctactttcagtttgttcatcagttcataataagcctcttttttccattgattggggtaaaaggctgcgtagaacttctcaatctgggtgatgctcatgaattgatactgtacgtgcccttctatcagcagcccgatgttgcggcgcaatgccggagccatcgtctgtatctcttgtccgaagatacggcattctccggaacgtggtttcagatatccgctcaggatgttgatggtcgtggtcttgcccgtaccattcttgcccagtagtccgaggatgcggcctttggggactgtgaaactaagattttcgtaaatcaaccgtttgccgtagtagtgcgtcaggttgttacattctatgatttgttccattttattttatcagttattctgttcaaaagaagagaagaaaaaggatgggaatcacgattccgacaatcatttctattcctcctctgccgataatacctttgttgcctttcagcatgatgactccggaaagggtgatgatgatgaggccgactgcgaaaatatccgcaaagtaagtccaccattgtccggggttgtagtgcaggcgtgccattgctccgatgagcgggcggcgggtgacagattcgtagactgcctctcccgtacggacgtttacctgcaagttggacccgcctttcaagaacactttcatgatgtccgctttcgggaaatagtgcttggtatagttaccttcctctcccaatggttgcagcagagtcagtacattttcccttttcattccctctttgcccggcagtttttcggcaatcttatattctttccgttcgatggagaagttcgggttgatggtgtcacggtgattcatcacaatgccggaaatggcataaatcaagaccattccggcaaagaaaaaggataaatcacggtgtatcagcctactccatttacggatgctgctactccacttcatacgaattagcttccatgaaatagaaagacagatactctttgccgctgcttgcttttcggtcggctatcttcgcgcggaagtcggcgatacgggcttcgggcgtgttggctgtctcgccgcgtgctttcttctctgtgtcacagccggcttcaccggttccgtgtttttcggcagcttgcgctttgagttgtgcttcccagttttggaggtaggcttcgtcaatgcgttgttctttcagtgttccggtgacgcggacgatggagttcacacatttcgggtcgaatgctcccagtgtgccggcttctacgcggatcacttgtgtgtcgtcactgcccatcaggaagattttcttggcgccatgcttgcaggtatgtgtgcaaacgccttcgatggttacttcttttcctgcaaggttttctgcatttgcaagaagagagtcaatttctaaagcagacgaagtggtctgttctgttgttgtgtccgaggaacttttctgctgtttgtttccacaagaggttccgataacggcaaccgccagtagagcgattgcgatgcttagcttttttgttttcattgttactttttgtttttatgtagtttatattcttttttatgaacttgcaaatggcttttagttctggttctttacacaacgaactgtttgaccactaagtacactgatataactcagagacaatctgccttccggatacttcgccattgagaatgtgctcattagtccgaagaactgaatattggtcaggtcgccggtgcttgtactataaataggcttatatgcagttgaagtcatgtaataactcatactgggttttccaaaccattcggttaccgtactgttgctgctggttattgccgttgcctgatatttggggacggctgaataaccggttgacatacgtactcccgagaattgataattaaatttagcctcgttgagtgtcgggattttaccaccgtcatatgctgtgtcatagaaaagagcgtcttttccgttttccaaactattgccgtccgcatctttggtcgaattacctacaaggctgaaatattcggcgcgagtcgggatgtgccatcccttcggacagatgccctgtgctccttcaaagtcgtagcagttttccggagtaactgctttgccgctaagtgcggcatggatgtcgtagagataaccgtactgcttgatagaagttgcgtcctgcaatgcttttgcagtaagtgtaccgtcaactgtaaccaattcgtacggataccagatgtgagaatctgcagccggatcacttgacggagtatatccatccggtacatagcgtaatggttccgccatccatgttgttccgttggagagagttaccgtattgtaggtaatgccgtcgtagatgaaatatccgtcatgctcttcaaaaggaacttccggctcatctcccttgatctctccctcgtctgtccagttctcgatctcaccactgagtgtaacgatgatattatcgggtaatacacgtatattgacactgtattgtccgccttgaactaaatctgtggatacgagcttttgcatcaatgtattgttatctgaagttgttactgcaagagtgaacgcagccgtctgtgggactacaatggcacgaaaagtcttattctttgtcacttgttgtgctgtgatgtctgtggcggcggcgctctcgtttacggttgtcttcatggttgccaaattgatattggcagtaggaacagagcctttgagcactatagatgaaatatccaaattcgtttcgtttgtcacattaataaccagtttggtcagcatgtgcttgaagatcatgctgatggagttcaccgaaggaagtacgtcggatttgcttgccgccataaagtcggagattccgtagttggtggtctggtcggcatgcacggtgaatgaagtcggtacaccggttgcgctgtaaggatagtaagccacgaatgaagacttgtctgctccttcgggataccatttcagacttccggcgaaagctccgtcattgaaagtcataagctcgttggtggcatatacagtgccgtcttctttagtgacactcaatccgatctgatcctgatcttcgaaattaacctctgtggcacgtgtgataataggagtgatggtcacccggtccacagatgctactccctcgttttcctcctgctggcaagatgccagaaatgctgctgtcagcacaaataatatcccctttttcatcatttgatagttttatat

SEQ ID NO: 119 - DNA, 24384 bp, Bacteroides thetaiotaomicron
tacttatacaattaagtaaaaaagtgtataataaattaattataaaagtatgcaattatttaatttattatttatatatttgcgcacatacttaaaaacgtacattatgggacaaatattaccaggagtagtcgtagcttttgagaatcccaagggcggggtagggaagtctacgctgacagctttgtttgcaggttatattcattcgcagtcaaacgaagaggggggcttatccattgccgtggtggatatcgacgacatgcagaacactatcggaaaattacgtgaggacgaagccgaggacggaatcatgaaaaaggaagaagaatatgaggttatcaatatctcttcctcagagttcatcaaccaactggatttccttcaggacaattacgacattatacttgtcgattttccgggtaacctgaaacaaaacggtgtagttgaaacgctgcacttcgttgacgtgatcatcattcccttcgaaccgaaccagaccgatttaagacctacattgaccttttactataacatctatgaagggattatcgaaagccgtcgaaagattggtaaaaagactaccgtgcgtggtgttatgaaccgtgttcttccgaatgtgctggagttcaaagaaattttgaaaaataaaaaaaccttgcctttcgagttgatgcaaaactacatcaaggattcaagggttgactatcaacgcaatttaagtacgctgagtaaagcgtaccatcatccctgtgatgctttctgtgaagaggtattggaattaatctgtaaccatataggagaataaagctatggcaaccaacaaagaaaggacatcatcagccgccatgagaaaactcttgctgcaaagcgccagtaagaaagagcaggaaatccagcagatcggaagtgttgcggaaagcactatcccccaacctgcgattgagcaccccatccatgaagaggtgaaagaatcggctccagtcaaagaaaccgtccaagaacctcagccggaacaaatggaaaagccggaatccaaaccttccgtgcagtcttctccaaaaacagaagaaagcaaagtctgcggaaaaaaattctcggaatatctggaagagcgaaaattaaagaacaccgaagtaatccggatatccagcgaaacccacagaaagctgaagcagattgctatggccactggattaggaatgcacaacatcgcaaacaacattcttgaagacatattgaccagccataacaaggagattcaagcgatactgaagaagtatatgagcatctgattctactttcggaaaaatatatacgcctgttcgactgcatccgtcgggcaggcgttatttttgcacaccgttttagtgaaggccggcattgaaccgggacacttttacacaactgcggaaaaatccctttgcctattatcctggacaatatgttaaagaattcaaacctctacttgtttccacctcaaaattttttccgaaagtaagaatacggtaacaaaatcatttcttcgttttatttaggtttttagggatttaagtatttgtgggacacttttacacaactaataagggaggttttccgtataatcaactatattattgcaagttagcacttactggcatcttctcgtaaccgggacacttctgcacaactaaccgactattcgggacacttctgcacaactgaacaggaaagtcgggatacttttacacaactagaatctgcattcgggacacttttacacaactaaatcaggaatccgggacacttctgcacaactaaaccggccattcgggacacttttacacaactgggggatcggaaacagccgtagtcgggacacttttacacaactaaatcaagaaacagcacgaaaaaaatgctttggaatcttcatttatagggagttagattcactatctccgtaaaaaaacgtatctttgcatcagtaaacaacaagtgtccgcctatgaaggaaagtaatacacaaaaagagttgagcagagtccccaggactctcagcgagtcttccaacacgaaagtattggaagttctatttgatgcaggcggcactgtcatgtctgacattatcatttacgtggcatcttcacaaatgaaagatctgttcggcgactgctggttctccatcaacgatttttgtgaggtcatggggtatgaacgaaccaagttgcaacgaaaactgaccgagaagcagcttgatttcctgttcagcaaccaacgtccggtatatatcaccgaacagaacggccaaaagatagagcatccgatagagaacacctttgaagcggcgttataccgtttagggacatccaacctcagtgtagcatacgccatgaacggcaagacgcaatataagttcattcaaatactggaccgctttgagataaaggataacttcggcacgaaaaagcgcaccaagcggaattacaacgtgcatctgagcaaagatctgatgaatactttgcttaccgaatacaatctgctggaactgaaagactaccgtaacctgcccaaccgcaaaggctaccgcaagttttatctgaacctggcgaaaatgatttacctgatcaagtataagattgaccaaggacaagcaccttatttcaccgttacggttgaccaacttgccaaggaatttgatgtaacggtaaaggacaaccatgaccggaagaagaaggtgaccagcatcttaaacggtatcaacaaaaagctggagagaaccaaattccaataccagtacatcaaaggaaaaggggagaagtggccctacaccgtacagtttttctttgaccaggaaacattggaatatttcgacgaaaagataaaggcgatactgacctcgcaatatcacgatgcgcttaaatcatgcttcttgttaaacaagaaaggcattcccgtgagcagacattatcaatataaggatttctttaaattgggaaccggcgaatattatcatgaatttaccgcatggctttattctgaagaggacaaggagattaaggagaacatctaccgggatatctatataaaggtagtaggcattcgtccagaagaccttgccgtcaacttaaatccctaaaagttggaacaaaaaccataaaatagtatctttgcagcggattgtcagaaaattggcagcccgctttttacatacgtccgtctgtctaacaaaagagtggcatctatcgttaaggaattaacaacaacaggcgcatgcctgtaccagtatgaaactggtacggggcgtgcctttgttgttggaacgccacgtccatgttagagggtacgtttccgtacccttatataaacataaaacaaattcaatggttcaaacaattgccaccctgatagatgagacgctcatggtaatgggcgcccatcttcacgtgcggatgacagacgaagaaaaggcgtatcttgatgctcatttcgagcttatccatatcaaaaagggagaacacctcgtcaccaggggcgaggaagtatgctacctctattatctggaatccggcatcgtccggttatggtttccggacaaagagaatagagagatttcagcacggtttatccaagccaaagagttcatcaattttttcctttcacatgaagaacaccatgcccactacaatatcaaggcattggagccatgcaagatctggagattgcccaaaaaagatcttcatcagctatatgagttatccatcaatttcaacaagctggccagaatacatttggtaagatccatcaaccgcaaaataataagggaagaggagttttacacactggatgccgaagcgcgttacaaagcgcttttggccaatgaaaaatggctgttacgttcaatacccttaaaagacatagcaagttatatcggcatcacgccacaagcattgagcaacatccgaaagcgcatataaaccaaaccctataagccgggcaggacagttttacacaactaatcctatccggcttttttctgtagaattattccacacctgccggtttacggcacatgtattttttaatgcacattaaataaacacgaaaggccctttaaaagcccttcataaaatttgtcctcccgtatataatctatatgtttggagcgaaaacaacgcgataagcaccttgattcggttctgccgacaggaatccgcgtaaattggaaacaccgtatgagacaaatagaaaaatatataacattaataacctaaagagtaattcccatggaacacatcagactgactgctatcagccttagcctgctgttatgcaccgtaagcgcttttgcgcaacgccattatgagaacatcccggcacttgaattgaactacggcactaacctgttcggcaatgcaggcaactattacaacctgtccttttccagatacatcaaccggacaagctattggaaagccgggtttagctattttgagaaaccttacgaatatacagccaacctaccgcaagtctctaccttgaacccggaagaaacgattcccgaaacgatacatgacaagggtaaggacttttttgtggacggcggttattacagaaccctggcctgcaacctgaaatccgtttactggggcatcggcctgggaggattcatcggtacagaatacgtccgccaccccgataaggaatacaacttcatcatcggcccgaaactggaaacggaactggaagtattcatcctgccccgaacggcattgcttgcccgcatacaacaacattggaatcccctatccattgacaagtggaacactgtctggaacgtaggaataaagatactgctctactaaccgacaaatcatatcaccatgcttattatcatattgttagccgatacaaatgtatccggcctgatctccttataccgtgaaataggcgccatgctgataggggtaggctttctatgtgccggactagcggtacttaaaaagctgataagcaaccacgagcgcaccaaagaggccatcatcacctatatcacggcattggtcacttggctcattatctggcaactcttatgaacgtagtggatttgatactggttgccatactcgcctgtgtcacgcttcacttttactttcggaaaaagaagaaagcactttcttccggaaaggagaaagagaagccgataagggaggcggtgcgcaaggaagggcaggagagagcctgtccggtcatctgcgtggtatttcagcctgagctggaagaagaggaattggctgccgagatagccgatatgtacctgcatggaagagcctactactactcaggcaaaccactgccggaacagccgaaagaagagcccatatccatcaagtataaggatgtgcaatgggagagactgaaaacgattcatgtttaattaaaaaataggaacaaaatgaaagcaatcgaaaatgtaagagaaaaagcgaaccaagtcattaaccgctatggaaaggttatcttcacctttctcatattcttcacgctgttgggaacggcacaagtggcggaggcacaaagcggcctgaagattaacagcctatccgaagtgacagacaaagccaaagagggtgcggacaccattctggacgtagccaaatacattttggcggcggtactcggcatcgctctggtctttgtcatctattcgcttgccacgaacaatccccatgccaaggaatacctgctcggctggatcatcgccgtggtagtcatcatggtagccttcctgattatctaaaaacgaagagccatgagaaccatgcgtaaaatcaacaagccgatcaagttcttcggtctgtcatcgggacagttcgccatcttcatgctgctgacggccatcatcatcatcgtgagcatattcaagcagctgcacccgatactcatcatcggaatcatttccgccattctgtttctatccggtctgctgttccaaaccttgaaaaaggaacacaaggccggtaacccggactacctgaccggcctccggatcaagaacgccaccccccggcagataacggacaaacggcagattttcaaattcatcctaaaacagcaaccatgataggaatcatcatactcatatccctgctaatctgtgcgctgtgcctgctgattgctctgctgtatatccggcagacagagatagaggtgaaggacaaatccgtggatctggaaagtgtcttgcctatccagaccatcacggagaacgccgtcatcaacgggaacggtgacatcaccgtcggctaccggctgcttctgcccgaagtgttcaccttgtcggaaagcgaggcgcaatacatccatgagcggttggaggctcttttgaagctgcttccggcaggcacggtcatccatcagcagaatttctactatacggggcgataccatcatgcagaatactcttccaatgccctgatagcggagaacaaccgtcatttcaacggcaaggagatactgaacagttacaccaacctgtatgtgacgttcacgaacggcagccgaaacggtaagatacgcaaaagcgcatcgggcacctcgctgatgcgaaagctgcactacccgttcaagcaaccttataaggaatatcagcaacggctgacagaaatggaagcctttctgatgaactttgagaacggtttgtcgtccatccagcagtttgagatacgcaagatggatgatacggaactgaacaacgccatctacgactacgtcaacctctcttacgagacaccggaaaacgatgccacgcagaagagcgtcaaccctatggctgtcagtgaaagcggaagcatgaaaatagggcagcagcacatttccatcctttcgctgaccaacgaaggcgagcatcttcaggaactggccgtgccgcacaccggcaagtcgaaggcatacgggggaaacatagagataccggacagcatacggagcaaatgctcgatgctgtaccccgtaggacttggcctgccgttcaaccacatcgtaaacatcgtgatagagataaccgatccagatgccaccgtaacggccatcggtgcggagaaagacgcgctgaactacatcaccaacttctaccctccggcggcagagaagcaacgcgagcaggcagccttctgcgatgagattacccagttcgactaccagaccgcctataccgccttcaatgtcgtgctgaacgatacagaccgcacctcgctcatgcggaaaaccgcactggtacagcaaggcttcagctttatgaaccaaagttcgtgctatgtggagaacgccgagctgtgcaacctgttcttctgcaacatacccggcaatgccagggccaattaccggggcttcgtcaacacgaccaagcaggccatctgctatctgcaaaaagaggggatgtacctttcggacgagaaagggcatatctaccatgaccgtttcggtactcccgccaagataaacctctgggattatccggcgctgaacaacaagaaccgcatcgttatcggcccgtccggttccggtaaatctttctggctgaacaattacatcctgcaaagctatgagctgggccgggatgtgatgatcattgacatcggcggctcttaccgctcgatgatagccttgaaccggggcaaatacttcgactctaccgagcagaagaaatttgcgttcaaccccttcttgtgtgaccgtgacaagaacggcaaatacctgtacatcgacaccacggatgccgagtctgccgatgaccagataaagaccatcgtcgccattatcagctacatttggaaggtacgtgaacccatgctgcctgccgaaaacgccattctcaggaaatccgtcatcggattttacgactatgtgaacaattcttcaataggagagaagcatgagcgtatcttcccgacgctgataacttaccgggcttatctgaaggaagtgttcagcaaacggatgaccgagtttgagaaacagaaattcgagatagaggagctgttgcttttactggaaccctatacggacggagagctgtcattcctgctgaacgctaccgagaacgtggatatcgtgcatgaccggctgatagccttcgatatggaagatgcctctaagaaagagtactttccactcgttgccatcatcaccctgcaaatgatcgtggataaaatcaagaaacgccaggggtttgccaaagagctaatcatcgacgaagcactcgacttcctgcaagacgagaaattcggagacttcatcgcctacctgtaccgaaccttccgtaaaaaggagggaagcatcacgctggccgcacagaacatcctgtttttgaaaaacatgccgtccagtatcaaggactccatcatcatcaactgcgcgaccaagattatcctcgaccattcagaacaccggcagaacctgccggaagtgaaagccgtgctttccatcacggacgaagaggcctatatgatcgagtcgttgcagcgcacggaacgctggagagagtttttcatcaagatgtcgaacgatgccttcatcttccgcaacgaggtgtccgacttcgccgccgtagccttcgattcgcgccaggcgacagtagtacgactgaagcagttgttcaacgaaagcggctcgacctatacggccatcaaccgctatctggaggaaaggaggaaaaagtatggatgacgccacccaagggctgaccgcccttctaggctggtcaaccgacttcaacggcagcgcatacaatcttgccggaagcattgccgccgcacttttgggcgttgcgctcattttcgtggtatgggcactcgccacgaaaaaggaaaatgccaagagctatctgacagcctggctggtatgtgtcatattcaccctattattcatcaccaacaaataaccgtcatgaaaagaatcattctcatactcggacttgccgcctcgatagggctgatgggaaccggcagtgttcatgcccagttcgtcgtgcatgatcccggccacaccctgctgaactcaacggaatggatcgccaatgtcaagaaatgggttacacaaatcaatgaaatgatcgatgcccaggaactgcggctcggcctgcaaaagatcgaccagttgaaggaactcaaatcattgaaagagcttgccgacctgctggacgacgtagcctgcctgagcagcgactacagcttttacctgaacgtaggatcgaattaccactgcctgaaatttctcaactttcagcgtgtgaccgtcaatctgagcctgagtaccgacctgctgttcaaggtggccaccgtgaccagttacttctcgatgaactcggaagggcgcatgtcctttatcgagcaggtgaaggaatcggtggaaaaagccgccgaagagatgcgtgagtttaacgaatccgtgcgttccacggtcatttacaaatccatgaaggggcataaccggaagacctattaccagggacggttggccgctttcacacgacacaccaattaaagcgttatgaatcaagataattttctctggggacttcagatcacggacggtctgacgatggaactcgtttcgcaaatgacagtcatcgccttcggtgttggtgtcatctgctttatctgcaacctagcatacaactatctctatcacggagccagccagctgttaagcccgaatgaggacaaatttcccgacatgatggaaatcgcccgttgcctggtactgttcttctgcctaagcatatacacccccatcgcccaaaccatcgtaggcacgatggaagtaatcaacgaagccacctcgctgacctccgagcgtgcgcaggaatttgcccagttcatggcacaatcagccatcgaacaaggagagatgattgccgaatacgacaaacacagcctccagtcggaggtagcagccggagaagacagcaccggcgccatgcagcacgaactggataaaaagatggaagaggacgaaatgaccggtgtacgctccagcgtggagaagattgtgcagctgctcaaccccgccaacctcgccacccttgtgcttcatggcatttccgccctattggtaggaatcatacaagtagtcatcttgggtatcggcgtggtcattgtcaagctactggtcattctcggcccgtttgtctttgccgtaagcatgttgccggtctttcagaaacagttgagtatctggttcggtacgctctgctccgcctgtatggtattcaccgtcatcaatattctgaaccaaatcatatggcagaccttcaaggccatctatacggaaagtgccgacatggtggacgcagctacgcagcagatacaatatttaggaatggatctcgccctgattggtgcttattgcagctgtttctggctatcctccaaaatcgtaggacacagcgatgccgggaaaatcatttcgaaaaccgtgtcaatcgtcaccacggcggccaccatcgccctgatgggaggcgcagcggcaggcggcaagctgaccaacgtaggcggtgccgcctctatcggggcaagtttcataaacgacaacaataaaaaatagaactatgaatctgatgaaattcaaaggagcagatgatgcggtcaagctgactatccggctttcagccgggtactgcatcattctgactatcgcttttgccagcagtatcatcttccttatcaacaaaatagaaaaagcatacggccaggctctcgtcatcgacaggcagggagaagtctatgaggcaagcagcctgtctgccagcgatatgcggcaatacgaatacatgaaccatgtaaagaccttcgtaacccactggtatgcctttgacgagagcagctacgagaagaacatttcgcttgcgctcaacctcataggcaacaaggggaaggagctgttgaacgagtacaacgatgtgaatatgctgaactcactcatacaaaagaatatccgttacggggtacgcatcaaggatgtagagattaacacacaaacgatacccgtttccggaaagataatcttcacgcagaccgggtaccgggcacggggaagcatctcacgtaatatcgaagcggagttcaccatctatgatatgctgtcccgcagcgaggaaaatgcgcacggagccaagatagaagattggattgtccgctattccgaacccgtggaaagcaacggcaccaacacatcgcaggcagcttctccgggcaagaatgaaaaccagtcagaaacctctaaaccaaccgaccatggaaccgaataaacttatcaaagacaagaacaagctgttgatggccatcccggtaatcctgggcatcctcttcctttatgtattcttcatccgtgaggacgggaacgtgccgtcagggagtgacagacaggccgcctcgcaagcctttttggaaccacagtcggaaatggccgacaaggtgaacgacaagatggaagcctataagcaggacaaactggaagagcaggagaaggcacgcatcctgaaagagtctcaggtcaaaggatctgatttttacttcgagctgcaaaaccagcaggagcggtatgaccgtgccacactggagcgcatccgccgtatgcagaacgatccgtacagcgaagtcatggcagaatacggaggtggccggaacggacgcttctctcatcagctggaaagccaactggacggactggaggacgagcaggcgctcaacgagattatccgggaagccaagaagaactcacgcatccgcaaggaactggaagaatccgacaaataccgcaagcgcatgtatgaacggattgtcaattatgaccaagagggaaaaacggagaaagccgctgccaacccttccggccatccatccgccgacagcctgatgcaaaaaggcccgatctaccatgccgaaaacggcaagcgggtacgccgccaaccgacctccgcaccgggaaacagcaacctcttcagggcttgcatccacggcgaccagaccgtagtcacgggcagtacggtacggatgcggttgcttcaggacgtaaccctatccggcatgaagataccggccaacacgctgttttacggtatcgccactttgggagccaaccgcctcgatgtggtagtcagcaacctgaaggtaggagacaacctcaatcccgtatcggtggttgtcttcgacaatgatgccatggaaggtttgaacctgcccaataacctgaaagccagtgcagccaagcgtatggaacaaggtcttgtacagaacattgacatgccgctctcttccatcggcacgatggccagcgaagtgaccagcgtagtcaacgccaccacccaggtagccaagcaaatcttgaacatgagcctctcacaagtgaaggtacatctcaagtccaactacgaaatgtatatccaagaagagagtcaggaatcgaagttgcgtaggcaagccgtgcaagcggagttacagaagctctatgagcaaatggaacaagagaaaacgaacaagaaaaatcatccccttcaaacattgatagacaaattatgatagacattctcaattacctgcttgcgctgtcagcggtctttttcggctatcggatctacgtatcacgccggaacggacgagcctttaaagaaatccgtccgctgaccgtttctttcggcattaccctgcttcttctatggggcattaccgtattcaccgcctttttttcaagaaccgtttaacatatcgacaacatgaagaaatatatttatctactgttttactgctttgtgtgcagtctgccgctcttcgctcaggaaaacggcactccccggaaacaagccatcagccaaaaagacatctttatctctttcgactgtgtgaaacacctggtatttcctgtgcaagtatctgatatcgccatcggcgaacaggagcttgtcatggccagccgggtagaagaggcgccccatatcgtcaggctctcggcgcaagcggaaggattcaccgaagagaccaacctgaccgtagtctgcatcgacggaagcgtttacacctatcacatccgctaccttcccgaaggcggcacggattcgtacccgaacatttacgaggacaacgggaaatggcagcaccatgactatcaggcagaagtcagcgacctccatctggccgagttcttctttccggaggacatcgcttacggaacgcccggcaacgaggtgtccttcactctggccgcctacaacaaccagttgaaagtatcaaccgccaaagatgccgtggcatattccaacctgtttgtggtggataaggccatgaacacttaccacatcaccatcaaacggggcaatacctccgtattcacctacaattttgatgaccagcgcaaatataccgcccatgtggatgtgaacagcgaggaaatggaaagatgcatccaagagctgcgcaccaagaagcgcaacatctacagcctgggggtcatcgagaacaagtttgagttgtcaatggccaatctgtatgtgcatgaggacttcatgtttttcatctttgacctgaaaaacaaatcatacatcgactacgacatcgagtttgtcaaatgtttccagcgtgaccaaaagaagagcaagaacgccatccagcaagaaacgaccatcgaacctatctatcagaaagattttgatacgaaaatcaagggcaagagccggaaccggctgatacttggtttcgacaaattcacgatacccgatgataaggtattcgagatcgagatttacgagcgaaacggcgggcggcacatcaagctggccgtgttgaacgaatacatcctttccgcagaacccttatacaagccacagccatgaaactgagagaagcattagacacctatatgttcgacaacgtgggacagttcggcggcatcgccgaatcactgggctatcagaccgaataccgggacggatatttccggttccgcaaagacggggaagagctgagcatgagcgtaagcgaaatcagggaaaaagccggagcaaagtacgatgaaagccttcgtgaccaatcaaaagaacgtgtatccgccctttttgacaaggaacgtgccaatgatcctaaatatgtcgccgagctggagaaggatggcatcagcatcaagcggtgggagaacctgaagggacatgacaaggacggctttaccgtcatcgaccatcgcctgaaggtatgctacaccggacagtcgctctatgaatacgcctacaagcaagggaacatcctcgacgggaaaggcaccaagctggaaaagggtgtcatgtctgatttgatggagatacacggcaaaccggggaagctccgtttcaacgatgacggaatctccgtattctaccgcaaagaggcgttggttatcccggacaaggtgctgggaaagaagttgggcaagaaagagaaagaacagctgcttgccggtgacatcgtacccatcaccgtaaataagaaggacatcctgctgcaagttgaccgggatctgaactccgtcatcctgcgcaccaaccaggaaatcaagattcccgacatcatcgggcagaccagcgaatatggcggctacaagttaaccaaagccgacaaatacctgctcgccaacggccatgcactggagaacaagctgctgcacagtccggaaggctacttcattgccgacatccaactgacggatgacaggaaaggagtcatgatacagaacatacagagtatcactcccggcaaggcacaagagctgatcaaggccatgacccccaaactggaagcccatgcggccaacatagaagctgcaaaagagcaaaaacacgaagaggggcgcaatatggaagccgagtttaaggaagcggtgggcaaacatgactttgaaaaaatcgggaagctcaaagaggaaggatataaacccagtgaagagtttatcaaaggaatcggtaaggaacacggtctggatgaaaggcaaacccatgaagtcatccagctgttcggcaccaagccggaagaacagggcgaacatgaaaggcaggccgcacgtctgttggatgccgcacagaccgacaactttcatgtcatccaagagatacagaaagaagggtaccggctcactcaagaagaccttacccggatgcgtgaaacgggtgtgcaagccaacacactgatagccgtacaaaagattttcgggatggaaggcagcacaaagacactgggagatgtcaaactggccagcacacccaaacccgacaacagcaaggaaatggcccgtccgatagccagcaccatcaaccgggctttcaatgacttataacctaaaaaatcaggaattatggattacgatgaattagtacagaaaaacattgcaggagaaatcagtgacttagagtttctacttgcacaggaagagcttgcacaagcctatcaagaagagatggctgccaagcagcaagagacaaacaaccaaacggccagagaatggctgcttgattacgagaacagaaatctataccaataaatcatggatacagcaagtgataaagcattacagcgtttcgccgaactgatgatcgaaaagataaagcaggtggaagacaactggcaaaagccttggttcgggataaagggtgggggacttccgcaaaatatcgagggaagaacctacaacggagtaaattccttcatgttgtttctactttcggaaaaagagcagtacagcctgccggtctatatgaccttcatgcaagccaaagacaacggccttaacatactgaaaggagaaaagtcattcccagtcatttactggaatttctcagtaagagacaagaacggaaagaaaatacctttcgacgtatataagaacctggataaaaacgagcagcaggaatataaggtcacgccgtttctgaagacatacaatgtgttcaacgtacagcagaccaatcttcaggaaacgaaaccggagaaatgggaagcattgaaggagcaattcaagataccggccatcaaggacgagcaagggatgctcaccgtgcctctgattgatgcgatggtacgggaacagcaatggatctgccccatttattccaaggaaggaaatagtgcttaccatgcaaggggagaagataaccatatcgtcgtacccctgaaggggcagtttaaggacggagagaatttctactccacactactgcatgagatggcgcactcgactggagaacctgagcatctgaaccgggaaaaaggcgtgattttcggagacaagcaatatgccaaagaggaactggttgccgaactcacctccgctaccgtcgggcaaagcctgggaatatccacccatatccgggaagaaaatgccatgtatctaaaaaactggctgggagccttgaaagaagatcccaaattcatctacaacatccttgccgatgtaggaaaagccagcaatatgattcaggaacataccgcacggatggaacagtacctcacaccggaggaacggttcacgcaggccgtcctgcaagacaaccgtccggtattggagcagatgaaaaacgaaggttttaccccttcatcacggttattggaaagtgttgcggcaaaccatcctacagccgacaaccttgaaacgctacacagcactttcggcatttcgctgccttccatggaagcggagccagccatgaaaaataggaatgagccacagctcggattataaacttttaaaaaccatcattatgtttacaggacaaattatcggttatgtcggtgcggatgcccggcagaacaagaacggaaaaggattcaacttccatgtatccaccaagtacaagaacgtgaacaacgaggaacagaccctatgggtatgctgtttcgtgaattacgagagtaaagtctttgagtatctgaaaaaagggacacaggtatatgtctgcggcgatgtgtatgccgatgtattccagaaggatgacggtagccacatcccatccgtcagcctgaccgtctcacgcattgagttactgggaaaggcagagaaaaaagagagcggtgacggaacggcatccggacaaccccaataacagcaacggccatggaaagagagaagaaagacctgtcattcatcctgatcctgctatccacgctcatcgggacagccgtactgtttcagtgggctatcgttacgggattatacgctccactacgtaatccggccatgtgggaaaggctgatggagaaggatatcctattccggtttctctacgttatcctgatcggaggcctcgcttttctctttccggttggcaaagtgaaagacgaaaacaagaaatgggtttacaccagtatgacactggttacggcatccatgctggttgtcggattcagccggttatcagcgtggtataacctatttgtatttcccattctattcgtagcgtacacgctgcttgtcatcaagactctgccttatttcatccggcgtcatgcccaatccgatgatagcattttcgggttaagccgggaagaatcggctttctacttccgctttgaaaccgcctccgggccgctggtcatccataagccgcagcagaatgtctatatcgacggcggtccgggaagcggtaaatcagagagctggatcaagggaatcatctaccagtgcgccgagcgcaactatgccggattcgtgtacgattgggagggtgatcccaccaaggacaagtcacccatcctctcacgtatcgcatacggaagcatcgaacatttccggaacaaggggatggaaacaccccgtttcgcctatatcaactttgtggatatgtcacgcacggtcagggtgaacgtactttctccgcaatacatgtcaaagggaaacgaatcgctattcatccgcaatatcatcatgacactgatgaagaatctggaagcaagctggaaggaaaagaccgacttttgggccaacaatgccatcaactacgtctattcaatcgcctataaatgtttcaaggaaaggaagcttggtatctgtacgctgccccatgtgatagcccttgccctttctgacagcaacctagtattccactggctgtcggaagatcctgaaatcgcattgaacatgtcctccatgctgaccgcctggaaactgggtgcacaacagcagacagccggagccgtatcatccgcacagactccgttggtactcctgaacaacaaatacatcttctgggtgttgtcgccacttcccgaagaagagttctctttggatataaccaacaaggaacacccaacgctgttatgcgtaggcaatgcgcccaccatcaaggaagccgtttcccctgctatttcctgcatcggcagcgtcttgatgtcacagatgaacaatcccggcaaagcgaccagcatattcatggtagatgaatttccgaccatcctgttgcaaggcattgacactttcatcggaaccgcccggaagcacaatgtcgctaccattctcgccgttcaggacttcaaccaagcggtcagggactatggagagaaaagtgccaacatcctgaaagcctcctgcggaacgcaggcttacggtatgaccggaaatgagaagaccgccaaagacatcgagaacttgcttggggagaagaaagaagcgcaagaatcttattcacaccaagccggtggcaataacagtgtcacggagagcctgcaaaaagaaaaagtcttaaaggcaagggacattgccggacaagcagccggacacttcattggcaagattgccggaggcaagccgccattcttcagcgtgcagatggatatgtgccgttttgaagagaaggagataccccgtttctccttaccggtcaaactgggcaacggcaaagaagagatggaactggaaatcctggaagagattatccagcagaactacatcaaaatcattgaagatgtcaacgccatcctcaaaaagatagaggacaaattaaaagaaaagtcagcagttccgccaaccgggacacacaagacagaacaaaaaatcatccgataacattcaacaaaagaatcctaccatgagaaaaattcattcattattagcggcagcctgcttattggccgcttcatgcaacaaagaggaaatccaatcggaaacagacaaagccggcatgtatcacatcaccgtagccgtaaccggttcctcacccaaaggcagtgtgcatatatataatcttgacggcgtgagattcaggaacgaacgcaccggtacctccgcagcttccgtagatgagagtttcaccgataaagcggaatacagcacggaaaagcctgtcagccaaattaccgtgcaaggcattctctattcaaaagagagtgctatcatcaccatgcagataaaaaaagacggggaaagcgtattcaaccagagcaaacagttggaggccgttcccggtatagacactactgttgatttggtttacagtaccttgaaataaaaatgcagacgaatcaaaaaacatatactttctcttccatatttagatgatatttcttatctttatgaaagataatctttctcatttataatctaagctcagataaaatgagattcaactaatccagtcaacgttatgaaagtcgatttcaatcagataaaaacaaccatttctctgcccgatttcctgctggaactaggatggaaaatcgtggaaggctcttccaactcctgtcccaaaatgagcaacggaacgcataccatcgtcatcaagcggaactcgcagaaccaatacacctattgggacgtgcatagtgacagcgtgcgtggccgcagtatcatggatctgatgcaggaacatctatttgaaacaaccggaaaaatgccgtccttgcgcgaggtgggggagatccttcagaactacatcaacaccaaccgcatcacgacacccgaaaaaagccggtatgaagtaggtaacacaagcatgagagcggacgaacttcaattctacttgagccagctacaaccctacaagggcaattatctccagaaaagaggtatcctgaaagaaagcattgaaagccggttcttcaaagacactttctttatccgtgaggtaaagaacaaagggagtgtttaccgcaacgtgtgcatcaagatgtacaatgaaaacggtgtgcaagccatttctcaacgaaatgaaacattcaaagggattatcggtggcaagttcgactgtctggcgaccagcaaccatgacaaaagccgcccgatagacattctctacattggggagtcatttatagactgtatctcccactatcaattacgccattccggaaacgacctcaatcttgtatatgtatctacggaagggacattcacggaaggacaaatgaggctattacgcctgattcttgacaagaaccaggtaaaggagctccggagcatctttgacaacgacaaacaagggcacaagtacactctatggctgcatcgttactttcatggcgatacgactgatgtcgagagcctgagtaacgatgaactccgcaacaaggtacggaaactgaagaacgtcgaactttcggaaaacaaggattggaacgatgatctgaaaatctcgtgtggcatctgttcctccacggaggacggccagtaacctcatagatttgctccatcacataatacgacaacctataaaatcagatcaatatgaatatcaagcatttatttttttgtatgctgctcattgccttttcctcatgcagcaaacccggctatgagaaggccattgcggaatgggttcagacagattctcacggcacctggacggatttaaagttcgaactactggaagtgttggaaacagaagacgtcaccgtatcggacagcctgtgctacctgaacaacaaaagcgcacaattatccgctgtcatacagaaagcggaaagtccccgtgccttattcaaaccgtccttttccgcctatatggaagccgaaaaaagcctgaaagcaacggatgccatgaaagccatgtacctgcaccgtgacagtacggaagttatcggcaagatattaaaatgcaggtatgccatcgtccagccacactcaggggtgcagcagaaaaagacggcttctttcctattgtcccccgacatggaaaaatgtatcggcaaactaaagccgacaagcaaataatccgagcgtaacgatgtgtagcgacaacgttttttggggttcttttttgggcgtcttccaaaaaagaactcccacacatttagatgtgtgggctattcattacactaccatcctttcccttatcaacggtatattatcccgtaccaaattcagaatccggtcatgataggctgataattggttagactttccacgacactggcacacctccatcctgctaagtgaaaactccaccgtttccatgcgccttccatccaccgttgccgacattatcaacgaatcttctctcttataataggcgttgctgaatacacaatgatgcagcaactttccctctttgtaaaagtccgaaaggctttccaatacccgaaccataatatttccatccgcaaacgaaagattaaagaaacgtgatttggcagcaatatagtctttttcatccttttcagaatattttttcttacatttccccatcacccaatcatgcgcttcttctacattcaacggacacaaataatgaggatttctcgcatccaatttattttctatcagcatatccacatagtccagccacaagtccgcatcatgtatcacatagtcatgtcttaaacagatttttacatacgtccaatacttatctataccgtattttctctctaaaaatctcaagaacaaattcatttgccctgccttatataatatctccatccgattatcagttaataatgtcataaagaaggaactcggacaaatatcataaaaggcacccttaaatccattcctcgtaagttcgggtatcactttcattctcggatagataactgccgggcaaatatcataaatacggtcatgatgcacattccgcttacgcaattccaaagaacttccatatatccatgcatcgtaataaaatatagacatgccccgcagcaaagacagcgtttctgtcttgccctctttattcatccaacactgtaccgcctcaattataaagtaattagccggagacccttttttcagccggcagtccaccataaaaaaacggataacttgatattgcttgtatgtagtaatcacacaaaaatattctttatatacagccgtccttttcctgctattctccaatttcaggttcataccgcaatgaggacatttacagtttttcttatcttccttatcccgccatgtatgcccacaatccaaacaaaagcaattcccctttgcatcacgcttgaaataatgcacaaagcaatgtttataggcataacgcttttgagcctctgaaacgggagctaacttcctgctcccattcacgatttccatttgtaattttgtcttgggtttcatatcaaaaaagagttaactgggtttgtacttcggtgttgttctcacgtttagcttgttgacgcttcttcaactttgccaattcttcctcctgcaattttttgatagcagcctcacgagccgctttcttttcttcctctgacaattcaacatgatgatttacgactacattacatttcaatgggctacccacctcaatattatcttcctgataatagtgcaacgccataccaaaaatttcatcatcactaaaaccacagcaaccgcttttcttcacttggtttaaaatataggtaatgcaattatctatattctttgtaggtttttgatagactggagcaaacagactatccaccgctgccatattatcaaggtatgccttgatggtacttttaaattgttctgacactttcatagtatatcatttttagatttcatttcacaataagccaatttcacgagaaacaaggagaataggcaaataagagccaacaacgtaaccgacacaacctttatcggacttggcgttattaccgctccgacaaacatagccactgcacaaagagcgatgatgaccgaaaaaacaaattgaatgatttgcatatacttctgctacttagtttgttaaacttctaattttatgcttcagctagatttaaagacctttttttaaaacccctttccgggatggccttttctttctgccgactttttttttgagctttcatgccccatctgagtttatgagccttttttttacggcacacaacaataaggaaggagggattaagaaaagttttggacgacaaaaaatgttggggacagcgaagccgtccggcgttatttttttcgggacaaaggggcgaagaccggaactctttcgtatccatccaccgaaataaatttgccgttcaaaaacaaaggatctcagatggagctatgaaaaaagcacattaggggaggcagaaaacaaggaaaagggcagtacggaaagtaaaacaaaccatacggttttgcttgcaaaaccgtattcctatctccctgccacaagtgacagggggggaacgggttagcaacggactgccgggacaaacggtaaaaggaaggaactgcaatacggaagaaggaggttgtttcggcaatgccgaagctccggatgatgaccattgcaatcccgcccacgtttggaacttctcttttctggtttgcccataatcagccgcatagcggatgactacgggcaaaccgggaatgagaacagtcattccgatgaaggggagggtggggaagaatactgcgtgaacgcaaaaacactctcggatatgtagcaaaaaaaagcggcactaggccgcttcaatcatttgcttgcttttttctttttagagacagccttctgtttaggctgatccggtttttcttcttctttttccggagccggataaaacttggtggctaccatcacaatgcggttacgcttctccccacttttagaatccgtccattcttccggcttaaagtagccttcaacggttatcagctcaccttttttcaatacatcgaaggaatccagtgcttcattctttctccaggcttcaatccccatgaaagcggaaacataagaggtttcttcacctgtcttgtctgcacggctgaccgcgatagaaaagcgtgctacgcttgctgtttcaaaactacggatttctgcatccttaccgataaaacctgttactgcgaatgaattttcaatctttttcatatctctgattttttagaagttaattaatcaattttacagtgcaataactgattgttggctttgggggacaccatgaaaaaagatataaatac

SEQ ID NO: 120 - DNA, 24318 bp, Bacteroides thetaiotaomicron
aaactaaatagaacatgaaacatttattacgtggattttttattgcagttctctatatatgctgcaacttccaactcgtgcttgcacaacctatgcaaacactgcccgtggacaaaaatgtccgcataggtaaacttgacaacgggcttacttattacatccgacacaacgcactcccagaaaaacgcgtcgaatttcacattgcacagaaagtgggttccatccttgaagagccgcaacagcgcggtttggctcacttccttgaacacatggctttcaacggaacaaaaaacttcccgggtgatgaaaccggactgggcatcgtgccttggtgtgagactaaaggtatcaagttcggaacaaacctgaatgcatacaccagtatcgacaaaacagtataccgaatcagcaatgtacctaccgacaacgtcagtgtagtagactcttgtctgctgatcctgcacgactggtcaagcgccatcaaccttgccgacaaggaaatcgacaaagaacgtggtgtgatccgtgaagaatggagaagccgtaacagtggtatgcagcgcatcatgaccaatgccctgcctgtcatgtatccggattccaaatatgcagactgtatgccaatcggaagcctcgatgtaatcaacaatttcccttatcaggacatccgtgactactatgcgaaatggtaccgtccggacctgcaaggtatcatgattgtcggcgacatcaatgtagatgaaatggaagcaaagctgaaaaaggtatttgcagacgtgaaagctccggtgaatccggctgaacgtatctactatccggtagcagacaatcaggaaccgcaaatctttatcggtacggacaaggaaatcgaaactccttccatcagcttcttcttcaagagcgaagccttcccggattcactgaagaatacaatcaactattacggcattcaatacatgattagcatgggagttacaatgctgaacagccgtttggcagaaatccgtcagcaagcgaatcctccttttacaggtgcaagtgcaggttatggcgacttcttcgtagccaagaccaaaaatgctttcggagtagacgccagcagcaaaatcgatggtatcgaactggccatgaaaacgattctcgaagaaactgaacgcgcacgccgcttcggattcaccgaaactgaatatgaccgtgcccgtgccaactatctgcaacgcgtagaatctgcttacaatgaacgcgaaaagatgaaaaacgacacttatgtcaacgaatacatcagtaacttccttgacaatgaaccgatgccgggcattgaatacgaatatgcaatgatgaatcagctggctccaaacattccggtagcggctatcaatcaagtgatgcaacagctgatcactgacaacaatcaggtagtactgttggcaggtccggagaaggaaggtgtaaaatacccgacgaaagaagaaatcgctgctttgctgaaacaaatgaaatctttcgatctgaagccttacgaagacaaagtttctaacgaaccattgctgaaagaagagccgaaaggcggaaagatcgtttctgaaaaagccggagatatttacggaacaacaaaacttgttctgtccaacggtgtgaaagtatatatcaaaacaaccgactacaaagctgaccagattctgatgaaaggtaccagtcttggtggtagcagccagttccccgacaaagagattctgaatatctctcaaatcaacagcgtagcaatggttggtggtatcggtaacttcagcaaagtagatttgagtaaagcacttgcaggcaaacgtgcttctgtaggagccggtgtgagcgcaacaacagaaacggtttccggcagttgttctccgaaggactttgaaacaatgatgcagctgacttatctgactttcactgctccccgcaaggacaacgaagcattcgaatcatacaagaaccgcatgaaagccgaattgcagaatgctgacgctaatccgatgaccgcattcagtgatacagtctcttatgcattgtacggcaatcacccacgttctttcagcatgaaagaaaacatggtggacaagatcgactatgaccgtgtaatggaaatgtacaaagaccgtttcaaagatgcgagcgactttacattctactttgtaggaaacattgatgttgagaaaatgaaaccgatgatcgccaaatatctgggtggtctgccatctatcaatcgcaaagagactttcaaagatacgaagatggaaatccgcaaaggtcaatacaagaacgagtttgccaagaaacaagaaacaccgatggcaaccatcatgttcctgttcaacggtacttgcaaatatgatttacgcaacaaccttactctcagcatcctcgatcaggcattggatatggtttacaccgcagaaatccgtgagaaagaaggcggtacttatggcgtaagctgcagcggaagcctcaccaaatatccgaaagaacaactcgtgcttcagattgtattccagaccgatccggccaagaaagacaaactatcgggcatcgtcatcgaacagttggaaaaaatggccaaagaaggtccgtctgccgaacacatgcagaagatcaaagagtatatgctgaaaaaatacaaagacgcccaaaaggaaaacggctactggctgggcaatctggatgagtatttctacacaggtatcgattatacaaaagactatgaaacgttggtcaacagcatcacagcaaaagatgtacaggaattccttgccaagctgatgaaacagaacaacgaaatccaagtcatcatgaccgtacctgaagaagaagctaaataaacttttatagcataccaacagtatgatgatatttaacgaattacgcaaacatggacggctcgcctccaaacggcatccgatgtatgaaaagaacaaagttgccaaaatattcggatatatcggggttgctttttgggcaggatacctgatattcttcggtacgacgtttgcattcggttttgcagatatggttcccaaccgggaaccatatcatgtaatgaatgccgttgccctgatatttattctggcacttgacttcctcttgcgtattccgttccaaaagacaccgacgcaggaggtaaaaccttacctcctgttgccggttaaacgaaatcggatcatcgatttcctgcttatccgttcgggacttagtctgttcaacctgttctggttgtttatgttcgtccccttttccttcattaccattaccaaatatttcggtatctcaggtgtactcacctatctcataggcatctggcttttgatcgttgccaacaattactggtacttgttatgtcgcacactaatcaatgaacgtatttggtgggtgctgctccccatcgctttctacggtggactgggctgccttgcctttattcccgaagacagtcccctgttctacttctttatggacctggacgacggatatatcaacgggaatattctctgtttcctcggtaccattcttgtcatagccatcttatggctgattaaccgcaaaatcatgtccggcctcatctacgccgaattggcaaaagtagatgatacccgcatcaagcatgtttcagaatacaaattcttcgagcgatacggagaagttggtgaatatatgcggttggaattaaaaatgcttttgcgcaaccggcgttgcaaaggtgcattgcgcaatgttctccttgtagtcatcgccttctcctgcctgttgagcttttcaagcctttatgacacgagcaccatgactacctttatctgtgtttacaactttgccgtattcggcatgatcatcctttcgcaactcatgtccttcgaaggcaattacatcgatggactaatgtcccgcaaagaatccatcatgagtctgctgaaagcaaaatattatatctatactatcggcgagatcgtcccatttgtcctgatgattcccgccattgtaatggataaagttcccttactgggtatctttgcctggttcttctataccaccggttttatctatttttgtttcttccaactggctgtttacaataagcagaccgtagcactgaacgagaaagtgacaagccgccagaccaacagcgccatacaaatggttgtcaacttcggagctttcggtatcccgttgatcctgtattctgtgttgaatgcgtttctgggtgaaacggccgcctactctatcctgttcgccatcgggcttggattcacactgacttctccgctttggatcagaaacgtctataagcgtttcatgaaacggagatacgagaatatggaaggcttcagagacagtcgccaataagagatttacgattgaaccgattaatcatttacgataaaaataccaagacaatgataagcatcaataatcttcaaaagaaattcggcgaaaagttagccgtgaacatagatcactatgaaatcaatcaaggcgatatgctcggattggtaggaaacaacggtgccggtaaaacaacacttttccggttgatgctcgacttactgaaagcggataatgggaatgtcgtcattaacgaaattgacgtcagtcaaagtgaagactggaaaaacttcacaggtgctttcattgacgatggatttctgatagactaccttaccccggaagagtatttctattttatcgggaaaatgtacggactgaaaaaagaagaggtggacgaacgccttctgccgttcgaacgtctgatgagcggagaagtgatcggacaaaagaaactgatccgtaactactcagccggtaataaacagaaaatcggcatcatctccgccatgcttcattatcctcagttgctgatactcgacgaaccgttcaacttcctcgatcccagttcgcaatccattatcaaacatatgctcaaaaagtacagcgaagagcataatgcaactgtaatcatttccagccacaatctgaatcatacgatagatgtatgtccgcgtattgccctgctggagaatggcgtcatcatccgggatattatgaatgagaataattcagctgaaaaagaactggaagactacttcaatgtagaagaataaagttacttataattttacgatatacgaaaagaaagatagccgatgggagtgaacttcaaactaatcttcatactgacaggactgatctttatccttagttcctgccgcacgtctgctccccgtctggattaccaggcactggcacgcgcctccatcctgctgggcgtggacatcaatatggaagataaccacaaactctatctggaatcggccgaatggattggtgttccttatcgtggaggcggtgattcaaaacgcggtaccgactgttcgggactcacctaccagatataccggaaagtataccgtactcaggttccgcgaaataccgaagacctgagaaaagaaagtaccaaagtcgccaaacggaatttgcgagaaggcgatctggtattcttcagcagtagccgttcccgaaaaaaggtagctcacgtaggtatctatctcaaaaatgggaaattcattcatgccagtaccagcaaaggagtgattgtcagtcgactgagcgaagactattacaccagacactggatatccggaggaagaatacgctgattatcaacttaaaaacatatagaatcatgaaatcgtttattggagcagtcatatttatctgcgtagcgttaagcgcaaacgcacagcttttatggaaagtatctggtaacggacttagcagcccttcatacattatggggactcaccatctcgctccgttgagtgtcaaagacggcattaccggactacagaaagcgatggatgaaacacaacaggtatatggagaactgaaaatgtcggatatccagtctccggccaccatccagaagatgcagaaaatgatgatgatagaaagcgatacgactctgactaccctcctctcaccggaagattacgaaaccgctaataaattctgcaaggagaacctgatgatggacctcaacatggcacccaaaatcaaaccggctttcttactgaacaacatagcagtagtggcgtacatcaagcacatcggaaactataatccgcaagaacagctcgatacttatttccagactcaggcaacacaaaaaggaaaaaaagtggatggactggaaactccggatttccagtttaacctgctatacaatggaatttccctgcaacgccaagcccaactgctcatgtgtaccctcaataacatcgacaaagaggtggaaagcctcaaaagactgacagatgcctacatgaaacaagatttggaaaccatgttgaaaatcaacgaagagcgtaaaggaaatcaatgtgatgcacttcccacagaagaagatgccctaatttacgaccgcaataaaacatgggcacagaaactaccggctatcatgaaagccgctcctaccttcgttgcagtcggcgctttgcacctgccgggtaataaaggcttattaagcttactgaaaaaacagggatatacagtagaagcagtaaaataatgaattataaaacttatttattcgatttcgactatacactagccgattcatcacggggtatcgttacttgtttcagaaatgtacttaatcgtcaccaatatacgaatgtcactgacgaagcgatcaaacgtaccattggtaaaacattggaagaatctttcagcatactgaccggagtcaccgactgggaacagctcaccgcttttcgacaagagtacagactggaagcggatgttcacatgaacgtgaatacccgcctttttcctgatacactctctactctgaaagaactaaaagagcgaggtgcccgcatcggcattatctctactaaataccgtttccgtatacttagttttctggatgagtatctgccggaaaactttctcgacatagtggtaggcggagaagatgtacaagctgccaagccttcaccggaaggaataaaattcgctctcgaacacttgggcaggactccgcaagaaaccttatacatcggagacagtactgtggatgccgaaacagcacaaaatgcgggagtagattttgcaggtgtccttaatggaatgactaccgctgacgaactcagagcatatccgcaccggtttattatggagaatttatccggtttgctatatatctgattatcttctgttacaacagcaaaaaaataaaggaaatatttgtctgaaacaaataaaagaagtacttttgtgcccgattattccgcaacgggttcgataaagagctctttaagtgattaaagaccacccgccggagctaacttatacattatatataagatgtacgcaattgtagaaattaacggtcagcaatttaaagcagaagctggtcagaaactgttcgttcaccacattgaaggtgcagaaaacggttcaactgtagaatttgaaaaagttcttttagtagacaaagacggaaacgtaactgtaggtgctccgactgtagaaggtgctaaagttgtttgccaggttatttcaaacttggttaaaggtgacaaagttcttgtattccacaagaaaagaagaaaaggttacagaaaactgaacggtcaccgtcagcagttcacagagttaacaatcacagaagtagtagcttaatcatttaaaaagtaagaagaaatggcacataaaaaaggtgtcggtagttctaagaacggccgcgaatcacatagcaaaagattaggcgttaagatatttggtggtgaagcttgcaaagcaggtaatattatcattcgtcaaagaggtactgaattccatccgggtgaaaacatcggaatgggtaaagaccacactcttttcgctttagtagatggtacagttaaatttaaagtaggtagagaagacagaagatatgtttctatcatccctgctgaagcaacagaagcataacctgtacaactgaaaatattcaagaaaaggagatgtaatccaaaggattgcttctcctttctttttttatgcagattttcattgctcgcttattcgttttttctttatctttgtagccttaataaagaaagttcataaaaagtatagatatgcttaccattaaacaaattacagaaaatacagaagcggtactccgcggactggaaaaaaagcatttcaagaatgcaaaagagacgattgacgaagtcatcgccctcaacgacaagagacgtactacgcaaaacctattagataagaacctggcagaggttaattcactttcccgcacgatcggtcagctgatgaaagaaggaaagaaagaagaagccgaagctgcacgtgcacgtgttgccgaactgaaagaaagcaacaaagcgctggacgctaccatgacacaggctgctacagacatgcagaatgtactttatacgatccccaacattccttatgacagcgtacccgaaggcgtaggtgccgaagacaatgtcgtagaaaagatgggaggcatggaaacagaacttcccaaagatgcactgcctcactgggaactggctaaaaaatacgatttaatcgatttcgacctaggtgtaaagattacaggtgcaggcttccccgtatacaaaggaaaaggtgcccaactgcaacgtgccctgatcaacttcttcctggacgaagcacgcaaatccggatatactgaaatcatgccgccgacagtagtcaatgccgcttcaggttatggtacaggccagcttcccgacaaagaaggacagatgtatcattgcgaagtagatgatctctatctgatcccgacagccgaagtacctgtcactaacatctaccgtgatgttatcctggaagaaaaacagttgccgattatgaactgtgcatacacacaatgtttccgtcgcgaagccggttcttacggtaaagacgtacgcgggctgaaccgtctgcacgaattctccaaagtagaattagtgcgtatcgacaagccggaacattctaaagaatcccaccagcaaatgcttgaccacgtagaaggcctgttgcagaaactggaacttccataccgtatactccgcctttgtggtggtgatatgagctttactgctgcgctttgtttcgacttcgaagtatactccgaagcacagaaacgctggctggaagtaagttccgtatctaacttcgacacttaccaggccaaccggctgaaatgccgctaccgtagtgcagaaaagaaaacagaactctgccatacgttaaatggatcagcactggcactaccacgtatcgtcgccgctttattggaaaacaatcaaacccccgaaggaattagaattcctaaagcattggttccatactgcggtttcgacatgatagactaagaaactttctactcctgtaaggatgagatatctctgccccttacaggagtttcctttattaacctttaacacatttacccccatgacaaaaaacacaaaaagtttcgtattgccattggcattcattggcgttatgttcttttcactgggcttcgcccttggtatcaactcagtattagtccccgtattgaagggatcactggaaatcagttcggccgaatcatatctgatcattgccgccactttcatcccgttccttatttttggttatccggcaggccttacaatcaaaaaaatcggatacaaacgaacaatggtcctttcattccttatgtttgccatagccttcggacttttcataccatcggcaagttatgaaagttttcctctgtttttattggcttcctttatcagcggaagtgccaacgcttatctgcaagctgctgtaaacccgtatatcacgattctgggaccgatagacagtgctgccaaacgtatcagcattatgggtatatgcaacaaactcgcatggccgattcctcctttattcctggctttcctaatcggaaaagaagtgaccgatattacagtagctgacctgtttctgccattctacgttattatcgccgcattcatcgcactaggtattatcgcatacatggctcccctaccggaagtcaaagccgtcggtgaagacgacagcgaagaggcagccgaagcctgtccgtacgccgcaaagaaaacctccatctggcaattcccgcatttattattaggatgtcttgctctcttcttatatgtaggtgtagaaaccgtatcactgggtacattagtagattatgccaccagccttcatttggaaaatgcagcaatgtatgcctggattgccccgataggcattgtgatcggttacatctgcggcatcatcttcatccctaaatatatgagccaggctacagcactgaagatttgttcagtgctggctatcatcggttccgtactagtagtacttacacctgccgatatatccatctatttcatctcatttatggcattgggatgttctttaatgtggcctgccctatggcctttggctatggcagatttaggaaagttcaccaaatccggttcatctcttctgatcatggcaatggcaggcggtgctgttattccgaccttatttggctatctgaaagacatttccgatattcagaaagcatattggatttgccttccctgcttcctgtttattctatattatggggtagccggatacaaaatcagaacgaaataaataaagatattcacatggatatggaaagtcactcatcaaaagagtgacttttctttttatatttcgtaaataagccgtatctttgccgaaatttataacattctgatagcagttacgtaataataccaacaaattaattagataatgaacaaaatcattagcaaagaacgcttttctgagaaagtgtttaaacttgaaattgaagctcctttaattgctaaatcccgcaaagccggccacttcgtcattgtacgtgtaggcgacaagggagaacgtatgcctctgacgattgccggttctgatttgaagaaaggcaccatcactctggtgatacaggaagtcgggctctcctctacccgtctttgtgaattgaacgaaggtgattatatcactgatgtagtaggtccgctcggacaagctactcatattgagaatttcggaacagttgtttgtgctggtggtggtgtaggtgttgctccgatgcttcctatcgtacaggctttgaaagctgccggaaacagagtgatcactgtattggcaggacgtaacaaagaccttatcattctggaaaaagaaatgcgcgaaagctccgatgaggtgattattatgacggacgatggctcttacgggcgtaaaggtctggtaaccgaaggcgtggaagaagtcatcaaacgtgaaaaggtagataaatgcttcgccatcggccctgctatcatgatgaagttcgtttgtctgctgacaaagaaatatgagattcctaccgacgtttcattaaataccatcatggtagacggaaccggcatgtgtggtgcttgccgtatcacggtaggaggaaaaacgaagttcgtttgtgttgacggtcccgaattcgacggtcatcaggtggactttgatgaaatgctgaaacgtatgggtgcgttcaaaaaaatagagcgtgaagagatgaacaaactccagcccgaatgtgaagcaacgaaagagatagatgagaaaagccgcaacgcagcctggagacaggaactgcgcaaatcgatgaaaccgaaagaacgtacagctattccacgtgtcgagatgaacgaactcgatgccgaataccgttcacatagccgcaaggaagaagtaaaccagggtctgaccgctgagcaagctgttacagaagccaagcgttgtctggactgcgctaaccctggatgtatggaagggtgtccggtaggcatcgacattccgcgcttcattaagaacattgagcgtggcgaattcctcgaagcagccaaaacactgaaagagacaagtgcgcttccggctgtatgcggtcgtgtctgcccacaggaaaagcaatgcgaatccaaatgtatacacttgaagatgaatgaaaaaccggtagctatcggttatctggaacgcttcgctgctgacttcgaacgtgaaagcggacaaatttcagtacctgtcattgccgaaaagaacggcatcaaagtggcggtgatcggttcgggtcctgccggattatcattcgcaggtgatatggcaaaatacggttatgatgtaacagtattcgaggcactccacgaaatcggcggtgtattaaaatatggtattccggaattccgtctgccaaacaagattgtagatgtagaaatagacaacctcgttaaaatgggcgttactttcatcaaagactgcattgtaggaaaaacaatcagtgtggaagatttgaaggaagaaggttttaaaggaatatttgtcgcttccggtgccggtttgcctaactttatgaatataccgggcgaaaactcgatcaatatcatgtcttccaacgaatacctcactcgtgtcaatctaatggatgctgcgagcgaagactctgacactccggtagctttcggcaaaaatgtggctgtcatcggtggtggtaatactgctatggactctgtccgtacagccaaacgcctgggtgctgaacgtgctatgatcatctaccgccgttcggaagaagaaatgcctgcacgtatcgaggaagtgaagcatgccaaagaagaaggagtcgaattcctgacattgcacaatccgattgaatatattgccgacgaacaaggttgcgtgaaacaggtcattctccagaagatggaattaggagagccggatgcttccggacgtcgcagtcctgtagccattccgggagctacggaaacaatcgatatcgatctggccatcgtcagtgtcggtgtatctccgaacccgattgttccgagttccattaaaggactggaattaggacgcaaaggaaccattgccgtagatgacaacatggaatcatctattccgatgatctatgccggcggagacattgtgcgcggaggagctaccgtaatccttgccatgggagatggccgtaaagccgccgctgccatgaatgaacaactgcaaagcaagtaaaaggacaagcttattataacagaaagccccgtctgctgaatgcaaacggggttttcttatcacaagatacttcttacttcactacgctattcgtcgcagggtccgggaaaatcacggtcggtttaaacgacttcgcttcctcaaaatccatcaatgcgtacgacatgataatcacaatatcatccggttgcaccttgcgggcggcagcaccgttcagacaaatcttaccggaaccgcgttcacctttgataatgtaggtttcaaagcgttcgccattgttgttatcagcgatgtacactttttctcccggaatcatgttggcagcatccagcaggtcttcgtcaatcgtgatactacccatgtagttcaaatttgcctctgtgacacgtgcacaatgaattttcgacttcaacacttcaatcatcataaggtttcgtctttttttaatttagatttctttatacttgatattatcaatcagtctgacctctccgcagaacactgtgatacagcctactacatacagagaatcctcccaactgcttaccttttgcagcgtgtttccgtcaacgatttcaaaatactccaaacgcaatcccggagcatcctctatcgcttcttctaccatcttctgcgtctcactcactgtatgagatgctgcaaaggtacgacttttaaataatgtctgagaaatatttaaagcattttcacgttctcgtgctgataaacgtttattccgactgctcagagccaatccgtcctcttcacgaacgataggacaacctacaatttccagtttataatccatctgacgaaccatctcccgaataatcgccagttgctggaaatctttctctccgaaataagcacgatccggttgcaccgcgtcaaacaacttgctgacaatctggcaaactccgttgaaatgtcccggacggaaagccccttccatcaccgtatccaacggagcatagctgaattcacgcgtatccggctgtggatacatctcttctaccgaaggagcaaaggcaaatgctgccccgcaatcttccaacaagcggcagtcagcatccaatgtacgcggatactttgctaaatcgtttttatcgttaaactgagtgggatttacaaaaacactcactactgttacaccattctcacttacgctgcgctttaccagtgatgcgtgtcctgcatgtaaagcacccattgtgggtaccagtcctaccttcttaccctgggctctcagtgccgtcaattcggcctgtaagtccttgatagtgtgtattactttcatttttgttaattggtttatgttttggtcgtttgcaaaaactctgcaaaataaactaatatttgccacataaagaaagaatatggtatttaaagttccttttttttgctatctttgcagaatattatagtgaactattgttattatgacaaaggcgaataaagttttatttattactcaagagattacaccttacgtttcagaatccgaaatggccaatataggtagaaaccttccacaggcaatacaagaaaaaggccgtgaaatcaggacatttatgcctaaatggggaaacattaacgaacgcagaaatcaactgcatgaagtaattcgcctctccggtatgaacctgatcatcgacgatactgatcacccccttattataaaagttgcttctattcaatccgcacgtatgcaggtatatttcatcgataatgatgattatttccagaatcgcttgcagacagcggacgaaaatggtgtggaatacgatgacaacgacagtcgtgctatcttttatgcacgcggtgtgctggaaacagtgaagaagcttcgctggtgtcccgacgttatccactgtcacggatggatgacggcattggctcctctttatattaagaaggcctacaaggacgaaccatcgttccgtgatgccaaagttgtattctcggtatatgaagatgatttcaagaatacgctcagtgaagattttgcaaccaaactgatgttgaaaggcatcaccaagaaggatttggctggtttgaaggaaccggtagactatgcggcactttgtaaacttgccgttgattattctgacggaatcatacaaaacagcgcaaaggtagacgaatcaatcattgagtacgcccgccaatcaggcaaactggtacttgattatcaggatccggaaaactacgcaaacgcttgcaacgaattctacgatcaggtatgggaaaccactacaaataaagaagaagaataaaaatctagatacgacaatcatgaaagcaaaatatgccttgatagctttactggcaatcacatttttcggatgcgatgataatacaggcggactgggattaggaatgttcccgggcaatgaccaaaatatcaaaggaaagttatccacgtttgatgtaactactgaatctgttaagacaggtgacatttatgcgaaaactaacatcggttatattggcaaattcactgatgaaacatttggcacttatcaggctggattcttggctcagctaaattgtccggatggactaacttttcctgaaccatacaaagaagttacagatgcaagtggtaatgttatttcagccacaggaagaatggttgtcgatgataaagatccagaaaataaagatgttacttttataaaagacggaaatcaaatcataggaaacatacgtgcagtcgaactctacctgtggtatgacagctactttggagactcattgacagcttgtagattaagtgtatatgaactgggaggcaatgggaaagagacattaaatcttgataatgcttactataccgatattaaccctgaggatttttacgatagtcagaatatattaggaaccaaagcatatacagccgtagatctttcagtaaaagattctattcgtaacctaagcacatatgttccaagtgtgcatattgctttcaaagaggatatagcaacaagagtaggtggaaatattttaactgcggcaagaaaagctaaaaatgctgataaggaattcaatagccaattattcagagaagcttttcaaggaatctacgttaagagcgactatggtgatggaactgtactctatatagatcagccacaaatgaatgtagtatacaaatgctatgcaacagattctattaccggaaaaaaattacagaagaaagacggaagtggtaaggactctacttattactcttatcgtgtgtttgctacaactcgtgaagtaatccaagccaatcaattaaagaatgatcccgaaaggatagatgcattaattaaggaagataaaaacacttatttaaagagtccggcaggtattttcaccgaagctacactacccatttcagatatacaaaatgaattgacaggcgataccttaaatgcagtaaaactgacattcactaattacaatcaaacaggtgataagaagtttggtatggctataccatctactgtaatgcttgtacgtaagaaattccaggatagcttctttaaagacaataagctgagcgatggtgtatcttcttatctaacttcacacacaagtagcacgaaccaatatgtattcagcaacatcaccaaattggtaaatgcttgtattgcagaaaaggaagaggctaaaaagaatgctggtagttcatgggatgaaactaaatggttacaagaaaaccctgattggaacaaagtagtccttatacctgtacttgtgacttatgactcttcaaatactacaactggtcaagctaatattattagaatacaacatgatttaaaaccaggttatgtacggctgaaaggtggaagtctaggcaaaacaaatcctgattacaagttgaaacttgaagttatttctacagacttcggattaacaactaagtcaaactaaaaagatatataaaataaacagcgcgggttacttcggtaattcgcgctgtttttttatatgtacctgtaccttccaatatataaaaaacaaccgtgaggtgattcccatctccccacggttacaaccagttaatttattattatcttattcttctttctttgcagtagctttcttacgagtagctttagctaccggttcttttttcgcagctactttcttgggagcttttacagctcctttttcagcttttgcctgccatttggttacttccttttgcagttcggctatctcctcaccctgattcttaatagtagtcagcagagagttgagctcttcattatctacgtcaacaggatacagtgaatctactcgtttgataaagtcgcccaagatattcatgtagttagtgaaggcatcgtaaggagagtcataaataccacggttcagccagatacctgtattcttggtagtcatgaaacggaaattgttgctggcttgcagataatcccagtcctgcttgatacgacggtcgtcacacagatgaacacgttctgctacgctatacaacttgttgaaagcctcacgttgcaggatattacccagccaactgcttgtatctctttcttcgtccacccatgacattgggtaaggaacatccagctgagatacagatttcaatttagatacaatctctgtcggagtagagaacgtgataccctttgatttagcacattcgggcaatgctttcaggaattccaggatattggaagaaagcggctgagccatacccaatgcacttaattccataaagatattaatcacttgctcttcttgtggcaacgcatcaatccagttaatatacttatcagcaaataatggatattccggccattccgaattggagaaacgcaatcctatatcatcagaaagtttaaagtctctcaatagcaatttgaggctcggagcctgattacagtgatatacatagtgtgggctcttccatcccaatacatgttttgcaccttccgtcagcattcccttaaagcccatagaagctaccagtccaccgatttcatccgaataaatcaagctggagttgcggaacaccttcggttctttgccaaacatctgtttcattttatcacgctggcgaagcacttcttcacggaagcagtcttcgttagccaaagatgacaagccgtgtgaataaggttcgcaaaggaactcacaacagccggtatcattcaactggtgcagcaagtcaatcaccgccggagcatgaatttcaagttgctccaatgccacaccggaaatagaaagcgccactttgaaagctcctcccgagtttttcaccatctcaatcaacgtactgagagcaggtatataagatcgttcggcaacctcattcataccggtttcatttgcatagtcatcatagtaataatgatcggtgccgatatcgaaaaaacggtagcgtttcaagtgtataatctgatgtatttcgaaataaagacagatcgttctcatagtctatatcattttattgtttaccataatttttaataacctcatcatagataccgcgaactttatatcccacgttctcccatttaatctcatccacttctttcttaccctcttctttcaggtactcgtacatagccgggtaagtacagatagaataaatggcatccgccatagcgtgaatatcccagtagtccgttttaatacatttatccaaaatttcggcacagccggattgcttggatataatggaaggtacactacattgcatagcctccaacggagagataccgaatggctcagatacagaaggcataatgtatacatcactggctttcagcacttcgtacacctgctttcccttcataaaaccggggaaatggaaacggtccgcaataccgcgttcggctaccagacgaatcatctgatccatcatatcaccactaccggccattacgaaacggacattgcgcgtacggtgcaataccattgctgcagcctctacaaagtattccggtcctttctgcatggtaatacgtcccaggaaagtaacgaccttttcgctcggattcttttgaggaacaatatcctgtatctcttgtgacaaaggagaaacggcattatgcacagtagacaccttcttcgggtcctgaaaatacttatggatcacagtctgacgggtcagttcgctcacacacatgatgtggtcggcattgtccataccattcttctcaatggcatacactgtcggattgacattgccgcgactacggtcgaaatcagtagcatgcacatggatcaccaatggcttaccagatacttgcttggcatgtatccctgccggataagtcagccagtcatgagaatgaatgatatcaaactcctgctgacgtgctaccaccccggcaacgatcgaatagttattgatctcttcgtgcaggttgtccggataacgtccggagaactcgatgcatcccagatcattcgtattgagatagttgaagtcggcatagatatgatcgcgcaagtcatagaacaattgcggatccatataactgcctacgcgtcctttcacatagtcccaaccgacatttttccacactaccggcgtgctgttcatgccgataattcttaaaaagctctgatcttcgtctccccatggtttgggaatacagaatgtaatctccagatcatcctgctgagacattccttttgtcagaccataactggcagtccctaaccctcctaagatatgcggggggaactcccatccaaacattaaaactttcattttcgttcctcctctttttaataatacttagacagtagcttcagaatacgcagtacttcggcgacattcatggcaaacgatacagctccgcgtcctttaaaaggcggattaccatcgaaaagttcaggcagcgaactgatacaatgaattgtcagttcatcttcgagaccaataagctggcgttcaatgaacgacaggccactcatcttataaattcgcagataggcttccatatagaatcccatcagccaaggccaggctgtgccttggtggtaagcgtagtcacgctgtatctgaggaccaacatagttagggttatagcccccgctcttcggactcaaggtacggagtcccttgggggtgagcaactctttggttgcgatgtcgagcacttgcttcttttgtgcccggtccaacggagaataatcgaatgctacggcgaatatcatgttggggcgtacgctccagtccatcatatttccgtctacatagtcaagtaaatatccatattcgttgcggaacacttcgataaatgattttcccgtcacttccgcctgtgcgtcaagcgcatcggccaaaagaacgtttccatcttcacgaaccagatcggcaacgaaacgaagcgcattataccacaaagcattaaattctacgatatatcccgtacggggaatcaccggatgtccgtttacggtggagttcatccacgtaatcgccttatcggtgccattggcataaagcagaccgttttcatgcaggaagaggttctcatgtttccgctgacggataaattcgatgatatctttcagcagttcgccatatttctgacggcattgttcgcgagaggtctccttggcatactgttgcaaagcccatacggcccaaagcagtacatccggatgctccatctcgtaaatcttgtatcctgccggctcatcattgatgaagcttcgaatcgctttttccgctgtcttcatcacatcttcaaactgatccacctcctccagcgcaagtgtcagtcccggcaaggatataaacatatcgcgggcacggcacttgaaccacgggtaaccggcaaggatataatgttctccttcctgctggttgtggaactgatgggctgagtttttcagacagtgatagaagctatcgcgaggcgtacggtcagccacttcggcttcgaacgtctgcttcagtctgcgcggagtaacttcggaagtacccgcagagaaaacgatgctttctcctttctttatatccacttcaaaatatcccggaacatagaggtcttcattgaagtcgtagcctcgctcttgttctttcggatattcgaatccacgataccagtcgggctggaaatggaactcacaagccttgttcaactgcatgaacagttccggataaccgggatacatacaagtcttgataccattttccacaagctgataatcgcggcttgcctgcgcattctcgtgagtgtactctcgcacgctccggaaagcgaggaacggtcggaagcgcaaagtcgtcgccgaatgtgcgtccaacaaagtataacgaatcaggattctgttttcatgatgtacaaagattttttctttgcgtaacactactcctccaacacggtaagttgtcgccgggatatgctcacaatcgaattcacggatatacttatgtccattcggactaaagttgtttccctgatatttatgcaaccccaagttaaactcagcaccatgttgaattaccgtttcatcaagagaagatagcagcacatgattttcatcgtcgatattgggaacaggaattaccaacagtccgtgatatttgcgtgtgttacaatcaacaatcgttgtacaatgataagctcctgctttgttcgtccggagaatctccctttggagactttcttccagattcgtcatgagggtcttgtcaaatcgtaaataactcatagttgtgcattatttaaaggttaattattggtcactatattccttatatatatctattgctgttctgtatatataccagcctgagcattgtatatataggtataatgcccaaatgtacaaattctagataaaaacaaaaataaaaaggctttttattttcagtttttgtgcaaatattcgtagtattgcgtaaaatatctaaagaatagaaagtaatgaagcgagatattcagcgtatcatgctggctacagcggtgccgttgttcctaatttttatcctatttctgctaaagatcgttgaagtcggcatggactgggacttctctcacatgggaatataccctctggaaaagcgaggaataacgggtattctgactcatccgctgatacacagcgggttcagccatttgctggccaatacgttgccgctattttttttatcatggtgcttgttctatttctacagggggatagccggacgtatttttatgatcatctggatcggagccggactgctgaccttcattatcggcaaaccgggatggcacatcggtgccagcggactgatttacggacttgccttctttctttttttcagtggtatcctgcggaaatatgttcctctgattgccatctcactgcttgtcacctttttgtatggaggaatcatctggcatatgttcccctacttctctcccgccaacatgtcatgggaaggacatctcagcggaggaatcatgggaacactctgtgcattcggtttcttgaatcacgggcctcaacgaccagaaccttttgcggacgaaacggatgaagaagaagaggaatctccggaagaagatatcaacaatacaaccgactctacggatattacctcataaatcccggttacgacttatgcaatgcctcaatcagcaaggtgatattagcagtaaacaaccttactgagatagcgagcaggatgataccgaaaaacttacggatgatatagatcccccctttcccgaggaaacgttccacacgtccggtcatgcttactacaaagtagacccatagcatattcagtatcaaggcaataataatgttaacactggcatattcggcacgaagcgaaagaagcgtagtaaaagctccggcccctgccagcagcgggaagacaagcggaacgagtgtcgcttcctttatcggcccctgatttttgaagatttctatatccagaatcatttccagagacatgaggaaaataacgaatgcgcccgccacggcgaatgattcgatatctacatgaaaaagtttcagcatcatatcacccgcgtagaagaagcctatcagtaaggcaaaggagatgacagtagcctttgttgcattcacatctttccccttttccttcaggttaataataataggtatagaaccgataatatctattactgcaaaaagtacgataaacgcactgatcatttgctgccaattaaaacccgtgaacataattcctccttttttttgcaaatatactctatttttatgcattcaaacaataaaaaaaacaaaaagaaaggggatatgtggatagcagtgttgtattatgagtaaatttgtacgattaataagagattacaacgtatggaaacaatgttcgatactttgctccaattacctttatttcaggggctttgtcatgaagatttcactagtattctggataaagtcaagctgcactttatcaaacataaagctggggaaaccatcataaagagtggtaatccctgtacccagctttgttttctgttgaaaggtgagatttctattgtcaccaatgcaaaagaaaacatttatacggtcatcgaacaaatcgaagctccctatctgatagaacctcagtctttattcggtatgaataccaactatgcttcttcttatgtggcacatacggaagtgcatactgtttgtatcagcaaagcattcgtactcagtgatctgttcagatatgatattttccgcctcaactatatgaatatcgtcagcaaccgggcgcaaaatctctattcccgtttatgggatgaacccacgctggatttaaaaagcaaaattatccgtttctttctgtcacattgcgaaaaaccgcaaggggaaaagactttcaaagtaaagatggacgatttggcgcgttgtttggatgatactcgattaaatatttctaaaacactgaatgaactacaggataatggtttaatcgagttgcacagaaaagagattctgattccggatgctcaaaaactactttaagagattgacagtttgggtagaacaatctaatatatataaggtagaaaaaagtcaaaagaacagtcttctaattattttcaaaggaaaaatcgacctaattatttaaattaattgcattacttttcatcctggagagcaatagagaccttatgccaaattgaataattttgaagaagtcgtaat

SEQ ID NO: 121 - DNA, 24201 bp, Bacteroides thetaiotaomicron
gtgggctcggagatgtgtataagaaaaaagaacacggcctggtctttaatttttgcaaaagatttccctcccccctgccaacgtctaagagcaggggttaaaaatattctttacttatttaatgaatgtagctcgcagacgcctctgtcggggtggaaaagtatgctttcccgttacctacaaagtaacggaatactaaataataagaacagtattagaaagggattcaaaatgcgagattatttacttttttatttttttaaatttataaatttaaagtttttcaattatgaacaaaaagtttttaagtgtgatcctgtttggagccttgatgacggtttctacgggcacttttgtctcttgtaaggattatgatgatgacattaataatctacaggagcaaattgatggtcagaagaatgatctgaacagcaaaattactgctgtagaaagctcaatcagcagtttgcagactgctcagagtagcttgcagagcgagattgctgctgctaaggatgaggcttcaaaagctgcacttgccgcacaagaagctgcaattgcaacagcaaaagctgaattggaaaaggtaaaagcagaattgcaagcggccgataaggctgatatggcaacagtagacgggaagctggctgaaatatccggtcgtatccaaacactggaacaattcaaaactaccactgaaacaactttggcagctttaagcgcagcagatactaacttgcaaaaaagcatcactactctgcaagctgatgttcttgcaaatgcagaacaaattggtaggaataaagctgccatcgaagctcaaatcgcagctttggaagcatacaagggaacaaatgatgatgccattgcaggtttgaaggctgacttggaaaagttgcaggctggtgaactgacagaagcaatggttgcaaaaattgcagcacaagtaactgaagtcgtaggtgctaaattggaattgatttctgctgcattcagtaaagcagtcactcatgtagagttgtgcgactacacctttggtggtggaaacgaggaccatattatagcaggtgcatcttcaagaatggatttgcgtactactctggctgtagaagaccgcgtgttcggtaagggtagcactgatgaagtagaagctaaagcttacaccattgctaaccaaaaggagtttaagaaaggcgaaagagcattcttgactgattctgtattgatccgtgtatctccgaccaatgcaaccttaaccgaaggacagatttcattcgtaaattcggctcttggcaatttggacaaacttgttactgtagagaaagtagaacaattcaaagggacagttacacgtggtatctctgctaatggattgtggaaagttgtcttcaaactgaacaaggaaaactataccgaagaaaactacctgaaagcagctaagtttgactataagaacggtactgctgaagacagacttgtaaaggaattgaagaacatcagatatgcagtagccgttactgacaaaccgggtgatgtagaacgtaatgtaaccagtggatatgatttgttcttaggctctgattacgaacctcaatatcaattgaccttcaaggttaatgataagaatgtcagtgctctccgtaaccgtttccaacaagcagaagatcaaacatatgttgctgacgccaacaaaaaattgctttacgactacaaatggaacgttgacaatggtgagcgtgtagaaaaggatggttcttatgagtctattattgatgctacctacagttctggtacgtggagagatcaagatctttggtggaacggtgacaatcgtaacactaagtctttcttctctacaaaagtaggtgaaaaatttacagtagaattggatgggtatgatgacgaccagatcagtggtatctacggtttctatgtagtacttgatgagcagcgtgctgtagaaagtgctccatctgaaatcagagcatggaactcttatgaatcagatatcaagggcttgaatactattactactaacagtaagattgagatgtctatcgatacagaaaaagcagatggtgacatcatcggtttccgtgtgtatgctgtaaatcatgacggttcattggttgacccggatggtaaagcattctatgtagcagtaggtgacattgatgcaatgactactacgttgaaggctgattatattcctgtatgggatgctacggctggcgactacaaacgcgtcgttgagttcgctttggatgaggaaattcagcaaatgcttgtagataaatataatgagggttatagttactctagcttggtggttgataaagataataacccgactgcaactaccgcattcattcgtcgtttcaattttgacaatgacaaggtgatgaatataacattaagtaattctttatctcaatacaaggataatggtacttacaagatgtactttaacatcctcaacaagaagaaggtagttgtcaagaaagttgccatcgaaatcaccaagaagctgcctgaattcccagctgcattctctgctaaagctaaccaatttgatgctgaaggtgcaaaagttgttgaagtaacagatgctacttggaactctaacccagttcacaatttaggtacagcattcaatggcatctctgatcctgacaatagtatcattgaccacaactacacatttacttgttcggaaaagaagattgtattcaactcaactctgaatgataacagatatggattcaaacttgatgtaaatgataaggatgcagcagcagatctctttgctgataagtctgcaggaaagatctacgacatcaacgtatcttatatttataataatgtatcttccgagtcagttgacaattcttatactgtaaaagctccggcagctaagaatttcaaattgagattagtatgtggtgaaggatttacttctgaatggaaaaacttcgatgataagaagaatccaattaaacaggtattgaaatatacggatcgagaaacgaaagttaagcttgctgacatcttgaagtttaagaaaggtggtgtagattatacatccacattctctgctgacaacatcaaagaatgccacttagcttctaacagtgtagacgatgaatacttcacagtaacatttgatgctgtaaatcaggaatttgtattcacatcaaaacagagcgctaacccgccgactagtgatgtaactgcaactctgaagtttactatggtagatagctttggacatgaaaatgcagaagaatatccgtatttcactattaaagaaaaataagagaaaacagttgaatggtggtatttgtgaaagtaggccattcctttataatcttaacagatcccttatatttcccttagttactacttttatgtaacattccccactaattaaggagatggttaagaatacagaagtctggacttgtgaaagtatagcttcttataataatgaaggacgttccattgtattcccatggaacgtcctttttaatttttgaaataatagcgaatatgatgaataaaaatataattctattggtattcctctttataagttcttccactctctttgctcaacaaactggtagtacgaatgaacgatctcgtgtgaaagaggaaggaaaaactgtattcaacccgcattggtttttgtcagtgcagggtggggctgcttataccttggatgaggctgattttggagacttgctctcaccatcagttgcagtagctcttggttataagtttactcctttgtttggtctccgtgctgcagcgagtggctggcaggctaaaggaagctgggtaaatccgaccaccacttactcatataagtatttgcaaggtagtatagatgccatgctcgatctgagtaatttgtgttgtggctttcatcccaaacgatttttcaatgcttatctttttcttggagtaggcttgaatggtgcttttgataatgacgaagctgtagacttggatgcaaatggctataaactgcatcacctgtggacaggtaagaaactttttgttgcgggccgtggaggtctaggcgcagacttccggctgaataatcatatagccattaacctggaagtaaatgccaatatgctatctgataagttcaactccaaacaaggtcgtaatgctgactggcagttcaatgctttggctggtcttgcctttacatttggaaagagctctaaaaagacagctccggtttattatgagcaggaacaaccgactgtaacaaccgtagtggagcaacctgcttcagcgcccatagtggaacagccgcagcctaaagaagaaaagatcgctaaagaacctttgaaacaaaacgtcttctttgcgttgaactcggcacgtattcagacagatcaacaatctaagattgctgctctagtcgaatatatggagaagaatcccgctgccaaagtgaatgtgacaggttatgcagacaaggaaaccggtaatccggtaattaatctgaaactgtccgaagctcgtgcaaagaatgttgccgaagcattgaaggcaaaaggtatttcatctgatcggattgcaattgattttaaaggcgatacagtacaaccttattccactccaaaggaaaatcgtgtcagtatctgtattgcagaataatatttccccgttcttatgtgagatgcagtttttccctgttagcctcttcataagaggaaatctcacagtaagaatatatggaagctgatgcttgtgaaagtgtggacttctatattccctttttcacttgaatgtgaataaatagttgaaagtgtggcaaatgaaagtcctgtgcttgtgaaagtataccttttaatatttgccaccaagaggatgcctcctttattccccacaggcatcctcttttttattcattcctttggatcttcaaaagctatctttatgattgctaaagcatagctttaagtggccatgcgggagatgttacgaacattctttatgatatacagaacaataatatcgttatatttgtatgtcattatttcgggcaatggaaagcgaaaggctctgtttcaagaggaattttgggaaaagggaataacttcttgggaaccaccttttaaagtattatttaaatcaatagacgatggggaatttaatttcatttatgaagggagtagccgatgggctacgggaaagtgggaattatgggaccgcccatatttacaggagtagcttgaatgcctggcttgcattccatgggagtgataatcttccttttcggaggatgcaggattttcttctggctatagatgcatattctgctgcttgtacggataagccagtggaacagataaaatccggattctcggaattactaaagagatatatcgagatgaataatgacaatgtaattggtacttatattcagacagtttaccggtcatcactataatacgaaaaatattctttttcatttctataacaaataagatatacgaatacagagataattaaataaacaagagctcaatcataataatccttctcctgatatcttccggattaatgcactacttctttatgaaggggatatccataagacgagaaacaaagatgcgcccttgcgaaagtccggatttttgtattattatgtttctaaggacgttcctgttcccacatttcccctttttccccaggaacgtccttttatttttcaactaggtttgtatttttattgtaaagcacggatacgtacttctatttctttttcgttttttaatccgtccttcacttcattgatattcgtatctccgtaatggtacggatacaaaatatgtggttgaatggtttttgcagattgtatagcttgttccggtgtcatcgtatacggttggttgacaggcaggaaggctatatcgatattctttatttgtttcatttccgggatatcttccgtgtctccggcaatgtaaatccgggtgccgcccacagtgaggatatatccgttgtcacgtcccttgggatggaatttatctctaccgggagttgtattataagcaggtactgcttccagtttgatttcgggtgtaatttgcagtatatcaccatttttcatggcttgtcctttgtccagcatcttctggcaattcggattggcaataatttttgtatccggggtttcgatcgcagcaattgctttggtatcgaaatggtcatggtgttcatgtgttatcaggatatagtcagctttcggttgttgtgtaaagtctgcgtaatcagagactggatcaacaaaaaacttttttccagcatattctattaacaagctggcatgcttaaagaaagtgattttcaggcttttcccgttcttggtggtaaacgaatccgtttcgaagttctgcatctttgtggtcagattaattgaatgattgaataaacaggaataagcaaatccgtaagaaaggcacagcgcgagtgctactaataaaatctttttcatatctatacagagtttggttccttacaaagataaacatctatagcgatttatcagttcatgattaaacatattctgttagaaattaactttcttattgagaagtaggatgataggcagtaaataagaaagggatgaagcattggtgaaaagagaaaggcacagaatcaaaatgtcctgtgcctttgctgtttgttatctgatagtaatcagcttttacgcattcaacgcttgctcaatatccgcaatgatatcatccgcattctcgatacctacggacaaacggattaagtcgggacgtacacctgcttccatcagctgctcatccgacaactggcggtgagtatggctggcggggtgaagcacacaactacgggcatcagctacgtgagtcacaatagcgataaattctaatgaatccataaacttgatagagacatcacgtccgcctttcagtccgaaggagatcactccgcaggaaccgttcggcatatatttctgtgccagtgcatagtatttgttatccggcaggccgcaatagttaacccaggccactttctcgttcttagaaagatattctgctactttctgagcgttacggcaatgctgaggcatacgcaggtgcagtgtttcgagtccaagattcagtaagaaagaattttgcgggctttggatactgccgaggtcacgcatcagttgtgcagttgctttggtgatgtaagcacctttgccgaatgcttttgtataggtcagaccatgataagattcgtccggtgtacagagtccggggaatttgtctgcatgggcatcccagtcgaagttgccgctgtcgacgatacagccacctacgcttgttgcgtgtccatccatgtacttggtagtagaatgaacgatgatgtctgctccccattcgaaaggacggcagttgataggagtcgggaatgtattgtctacaatcaaaggtactccgtgactgtgtgcgatacgggcaaacttttcgatatccagcacttcgagagaaggattggagattgtttctccgaacagtgcttttgtattaggctggaaagctgccgagatttcttcttcgctggcatccggattaacgaatgtaacgtcgatgccgagtttcttcatggtgacaccgaacaagttgaatgttcctccgtagatggcggatgaacaaacgaaatgatctcctgcctggcagatattgaaaatggcataaaagttggctgcctggccgctggatgtaagcatagcagctacaccaccttcaagggcggcaatcttggcggcaaccgcgtcattagtcgggttttgcaggcgggtataaaaataaccactgtcttccaaatcgaaaaggcgtgccatttgttcgctggtatcgtatttgaaagttgtactctgatagatgggcagcacacgcggctcaccctttttaggcgtccatccggcctgtacgcacagggtttcgggtttgaattgttttgccataatgatatagggttttaagttttattgccaaaaaaagttttaacggggcaaaagtagggaaaataattgtatttttgtcctgtttataagtgaaatgatactgataaggtagtagtcgaatatgaaaaaaagattctatattcttttattaattagttttcttctttcgttggctgatgtgcaggcgcaacaaaaagctactccgaaagcaggtgaggggatttctacttttttgctgcggcacaaccgtgctccaaagaaatattatgatgattttgtggaactgaataaggcaaagctggggaaagggaatgtgttgaagctgggggtaacgtatactattcctcctgtcaagagatcggcggcggctgataaagagacaccggcaagaaaacaatcctcaaaggcttcgaaaataggaaccactcttcatgaacctcttttcggtaagcaactggcgaatgtaaaggtcacttccaaccgactggcaggtgcctgcttctatgtagtcagcgggcatggcggtcctgatccgggagccatcggacgggtagggaagcacgaacttcacgaagacgaatatgcctatgacattgcacttcgtctcgcccggaatctgatgcaggaaggggcggaagtgcatatcattattcaggatgccaaagatggtatccgtaatgacgcttacctctctaacagcaagcgtgagacttgtatgggcgacccgattccattgaatcaggtacagcgtcttcagcagcgttgcaataaaatcaatgctctttatcggaaagaccgtcagaactatacttactgccgcgctatcttcattcatgtagacagccgcagcaaaaaaaagcagacggatgtctttttctatcattccaataagaaagccgaaagcaaacggctggcaaacaatatgaaagatacgttcgaatccaaatatggaaagcatcagccgaaccgcggcttttccggaacggtgagcggacgcaatttatatgtactttcacacactacccccgcttctgtttttgtcgaactggggaatatacagaatacatttgaccagcggagactggtgatggattccaaccgtcaggcccttgccaaatggttgatggaaggctttctgaaagattttaaagggagaaaataaacttcaatctctttttttcgtgaacaaaacgaaaatcgggatgttatatatgtgcaaatcgcctgatgactgcttgtaggtatgcgaatatatatgagtcagtgaatatgcctccccggcataacaggaagattgcatagtagttttgtcgtgttttattttgtgtttgtgttgtgacggtgctgcgatgtgaatcggggtaccgttttttttgttaaaaagtcgtcttaacttcatttttttcagaactcttgtgaacaaaatccgaattggtgcgttatttattatgcaaatcgcctgataaagcttcttatgggtatgcgaatatagataagtcaagcaaggtatgcctccccggcattacaggtaagattgcatagtagttttgtcgtgttttattttgtgtttgtgttgtgacggtgctgcgatgtgaatcgaggtgccgtttttttgttataaccgctttgggggtataaccagggattatccgacataataaaattctgtgattcagtctgccggaaaatgtcttcctttgcaaaaaagaaataatttagtatcacttaaatcaaatcatttatgttcaatgaaaagagaagcagcatgctgcacggtgtcctgttgatagcattattttcttgtgctgcgttttatattggcgagatgtcttttgtaagaagtatttctttcagtccgatgattgtcggtatcattttgggtatgctttatgccaatagtctgcgaaatcaccttccggaaacgtgggtgccgggtatccagttttgctcgaagaagattctgcgtatcggtatcattttatatggcttcagattgacttttcaggatgtgatggctatcgggttgccggctatgctgatcgatgtgattattgtggcggtgactatttgtggcggtatctatcttggtaaattgctgaagatggaccgtggaatcgcattacttacttccatcggaagtggaatttgtggagccgccgccattctgggggctgaatcgaccatcaaggcaaagccatataaaacggctgtatccgtgtctactgtcgtgattttcggtactatttccatgtttctgtatcctttcttgtaccggaacggattttgtgcactgactcccgatcagatgggaatttatacgggggctaccctgcatgaggttgcccatgtagtaggtgccggagacgcgatgggaaacggtatttcggattctgccatcatagtgaaaatgattcgtgtgatgatgttggttcctgtgcttctgattactacctatctggtggcgagagcgcggaaaagacaagtgcagaaagggcagaagtttcagaagattgcagtgccctggtttgcaataggttttatgggtgtcatcgctttcaattcttttgatttgcttcctgcgcagttggtggcaggtattaacacactggatacctttctgctgacaatggctatgacggcactcggaacagaaacaagcatcgataaattcagaaaggccggagccaaacctttcgtactggctcttttactttatgtgtggctggtggtcggaggatatttccttgtgaagtatctcactccttatctgatgtaagggaaaaacgtcttcttgcaaaatacttattatcactttcaccgcaaattgtacaatcttagacggataaattaagtgtcagtcattgagaacttcccattttatctgtatgatagatacaatttgtggcgaaagtgatgcgtttcatccgggcaggctatatttatcgcttttctttcggatagttaggaccgtaaagcatcgtttttttgcggacaaccaattgaccgtctttcacaaattcctctccccgttcactgaggtggcggatcatttctgcacgcattcctgtcagcagctttttatatttcttgtcgttcacagcattgtgcagttctttaggatctttggcaaggtcaaacaattgctcttcacctgtatagaagtaccagatatatttaatctttccgtcggtcaaggcacaccaatagttgtcatcactgtagcaagtggcatgttccaggtcgatgtatttgcgccattccgtttctgtgcctttagccagagatagcagagagcgtccgtctatgtcggtgggaacggaggttcccgctatttcgaagaaagttggtagcaggtcacggagttctacgggattatccaccttgccgggaacgacttgcgctttggctggccatttaataatataaggtatgtgcgtagatccttcatacgggtaagtctttcgccagtggtagtgatctcccatcatatctccatgatcggaaacgaaaatgataagggaattatcatacattcccttgtcttttaaggtctggaggacacgccctatctgttcgtctatgaaagtgatgttggcataataatagcgtttggagtgacgtgcatattcatttccgaagttgccgtagggagcatctttggctgctttttcggggtccagttctttggcatatttcccacaccactcaccaatgacgggatcgggaacctgcgcatccttatacatgtcgagaaagcgttgaggcgggtcgtacgggctgtggggacgggcaaaggaaactttcaagaataagggctgattgccgttatcataattctgtatcatctgacaagccatttcaccggtccaataagtagggtgcagactttctttcagtttataggtagctgctccgtgatcgttccatccgattccggtttcatccgggttctttcccggtgcctgtatttgaaaccataagcgatagtcactgatgaaattcggatcttcccggcgtccgctttcatccagcagcgttccttcgaaaccgtgtttgattcgttgcggatgccagtgcatttttccgataccgaaggtataatatccggcatctttcagcatctgaggcatttcgtggttgtacttgggggcaactttaccgtatcctaacaagccatgatgccagggagactgtccggtcaacagtccggcacgggcaggggtactgctgggacacgaagaatatccgttcataaacaacgttccttcgcttgccaaagcgtccagatggggggagataagagattcattacccatgcatcccatggcgtcgccacgttgctgatcggtcataattaagataatgtgcggttgtttttgtgcataggccaaagatgagcacaatccggccgtgacggcaaatgtacatttcaggttaatcatattttctggtttttcataatgtaatactgcaaaggtataaagttttatctattttgcgtgaaagcatttctgctttttatatgaaaaaaagaaactgtttcagaaacaggtgggggcacctgtactgaaacagtctcttttattataggtaatcgcctataacttataaaggcatatttccatgttttttaggcggattcgtctgcatcttgttctctgtcatttccagtgcctggatcagacgtttgcgggtttgtctcggatagatgatttcgtcgatgaatcccagttcggcagcctggtagggagtggcaaacttttccttgtaggcttccagttctttaccttttgtctctgcatccgctttgcggaacaggatgtttaccgcaccttccgcacccatgactgcgatttccgcactcggataagcgaagttcacatctgcacctgtctgtttggagttcatcacaatatatgcgccgccgtatgccttgcgggtaatgactgtcagtttgggaacggtagcttcggcaaacgcataaacgattttagcaccgtggcggatgataccgttgttctcctgcgtatatccgggaagaaatcccggcacatcttcgaaagtaatcaacggaatgttgaaacagtcgcagaaacggatgaaacggcttgccttgtcgctggcgtcaatgtcgagaacaccggcaaggtaggccggctgattggcgacaataccaaccgaacggcctgccagacgtgcaaaaccgatgatgatattctttgcgaagttagtcattacttcgaagaaatagccgttatctactacccgttcgatgatatccttcatgtcatatggtacattcgggtctgcggggacgatggtgtcgagtacggcatcttcacggttggtttcgtcagtacagttctgctttttcgtttcgtccatattattctgaggcaagaaggaaagcagttcgcgaatgctcatcaacagttcttcttcggtattgcacataaagtgagtgacaccgcttttgctgctgtgtgtcatggcaccgcccagttcttctttgcttacctcttcgtgaatcacagtctttaccacatccggacctgtcacaaacatgtgactcttttctttcaccataaagatgaagtcggtaagggcaggagagtagcaggcgcctccggcacacggaccaagaatagctgaaatctgaggaatcactccgcttgccattgtgttctgatagaaaatatccgcatagccggaaaggctttcaattccttcctgaatacgtgcgccaccggaatcattcagcgcaattatcggagcaccgttcttcaatgccagttgctgcactttcacaatctttttcgcgttcgaagcggacagtgaacctccgtagacagtaaagtcgtaggcataaacaaatacctggcgcccgtcaatctttccgtaaccggatacgatgccgtctcccggaatcttgtttttgtccatgccatagttggtgcagcggtgaaccatcaacttgtccagttcaacaaaagtacctttgtcgagcagcatttcgatgcgttcgcgggcagtcatctttccgctttcgtgttgcttttcaatcttttccacgcccccaccgagggaagcgatgcggtcacgttcctgaaacatggcgtatgctttatttatttcttccatgatgcaatccgtttttagtattatataatcggctctaatgttattaatgtctggtcaccggtgatgttgtcgccttcctgaaccagaatttccttgatgcggcaatcggaagtcactttgtagttgctctgcattttcatggcttcgatgacgatgacggtatctccggtcctcatttcctgccctgccgtaacagggattttcaccacctttcccggcattggggaagtgatacggtcgttctgttcgtcttcacctttcttgcgcatacgcagatactttgcctggctgtccacgatttcaacattgaaactgctataatgcgtatttaccttatagcttttaccgttttcgcggcgaatcagttgtgcgtttgcgctgcgaccgtccatcagaatattgcaggtgccattttcggccatcacaacatctgcttcaaacggttttccgtcaatggtaagtaccactttgttgtcttccttgctgacgagttctatttccgctacgcggtctcctatatgaatttccataattgaatgctgtttttagtttagatacgaagtacacctttgtgcaaaccgaattctttccatttgctgatgggacggttgtccgttgcgtcacctctgttttcttcaagattcatcagataatccatgtaggcagcaatcatggcaatgttttcggcacgttcgctggtgcgcatgatacattgttgcagatgctcgccgttcttggtgataaagcctgtgtcgtaatggccttccacaaagtccggagtgtccatgatggcacgcaggtagctgatgttgttctttacccctgtcagtttatactcatggagtacgcggcgcatccgttcgatggcatattcgcggttagtagcccatacgatcagtttgccgatcatcgggtcataatagatcgggatttcatatccttcgtaaacgtaactgtcgatacgaacaccgattccgttcggttctgtaatctgcttgatgattcccgggctcggcatgaagttcatttccgtgtcttcggcacaaatacggcattcgatggcatggccgcgctgttggatatctttctgtttcagctggagcacttggccgtcggcaactttgatctgctctttcaccaagtccactccgaccacttcttccgtaatcggatgttctacttgcagacgggtgttcatttcgaggaagtaataattgcgatgcttatcaaccaagaactcaatcgtgcctgcaccgatatagttgaccgctttggcggcggctaccgccttttcacccatgtctttacgtagttcgggagtcacgaaaaccgatggcgtctcttctacaatcttctggttgcggcgctgtacggaacattcgcgttcgcacaggtgaatcacgtttccgtgtttgtcgcccagaatctgaaattcaatgtgatgaggttcttccacgaacttctccagataaacggtatcgtcgccaaacgaagaaagtgactcgcttttggcagtcgtataagcctcttccacctcttccgcactgtggataaggcgcataccttttccgccgccgcccatagatgctttcagcatcaccgggtaaccgatcttgttgcagagttctacggcttcttccacacttttcagattctcctgtgtgccgggaacgacagggactcctgcctcgatcattttaatacgggcggatatcttgtcgcccattgcctccatcgtttcggggtccggtccgataaaaataatattttcttcctgacagcgtcgggcgaaagtcgcgttttcggacaggaaaccatatcccggatgaatagcgtctgcatggcattcctttgccacttcgatgattttttctatattcagataactctctttggatgctgccggtcctacgcaataagcttcgtctgcatagagcacgtgcttcgcggtccggtctgcttcggagaaaatagcgatactcgttatctccatctcccggcaggagcgcatcacccttatggcaatttcaccgcgattggctactaagattttttttatcatactttactcaattaagtacatacttatttaatgccttcccatcttcacagacatagtccatccgacagaaacacagtattttcttgatttggggcttaacaaatgatgttctttctcctaacccacgaggcagaagaacgctttacgcgaagtggcaggtcttctgactgactcttgtcttatagtgccttcccgaaataacatcagtggcgataaattagttcattaataagacattgtatagagcttcacagcagcgggactgtacgggatttacacccgattcccttttaatcgttgtccgttggacacggactccgaaccatttcggggggcaaagataaataaatattgaatactgtgttctgtttttgcacgaaagtttcagttttgtgcaatgaatgctccggcagatttcctctcctttacttttccaatagaactaaatctctgtgtattaatgtttatgtgttaaaccttcccctttttgtattgttaagactcccactaattaattaaaaggagaatcgatatgaaagaaaagaaaatagctcgtgatacgagaaacagagagaaactggcgggtgatgactgggtaatggcagaattttatgcaacgtggtgtcctcactgccagcgtatgcagcctttgataaaagagttcaagaaagagatggaagggatagtcgaggtagtacaggtagacgtagacgaggaaagtgatctcgctaatttctataccattgaatccactcccacattcattcttttcagaaaaggtgaacagctctggagacaatccggcgaactgacgctggaaagattgggaagagcagtcaaggagtttaaatcttgaaaaagtattaataaaaagggatgtttttctatgaaagttttaaatcgtgttataaaacatacttttttatttggataatttgctaataacacagaagtacgtatctttgcactgtgtttttcatagtattagatttaaggttaacaaaggttggagcaaggcgttgctcctttttttatgcccgtatcccggctttctgttcagagtggtctttatttcgccagcctcagttcgtatagacaagcctgtacttcctccggactgcctgtatgttttccctcgtcatccgatagtttgatgcattctctccattcctgattgacattcattttgcattgcgtgagtttcatgacaatgttggaaggggcaaatcctgtatcattcgtaagattggtaccgattccgaaggaacagcgaatcttgtccttgcagtattcctgaatttccagtgccttcgtgaagtcgagagcgttgctgaagacgattgttttggtagtggcatcaatgcccagttctttatagcgggctaccagcttatcgataaaatcaaactcattgccggaatcgcagcgcactccgtcgaatagcttggcctgcttgcggctgagattgctcaggaatattcctgaagtataagtgtcggacagcgcaatgcccaaatctccgtcatatacattcacccagttttcgagcgccatatagttggcgtgcttatatccgaactgtgccccatgaaacatgaaccactcatgcggatgagttcccatcattttcatgccgtacttcatggcaaaatagcagttggaagttccggtacagtatttggccgtatcattcagccgtttgatcaccgtctcctgcacgtcgattgagaatcttctccgcgtgccgaactccgagaagcggagctggtgctgattggacaattccactttctccgacaatttgcagagtatctcgctcatatcgggtacattgccgaaaaacttgtttttgatttcggatacgatggcgagcagcggtacttcatacagtgtgactttataaagaaaatcgctgacttcaatatgcagccggcccgttgtgtccagatgaatatcgatcttgtccggatcaaaacggaaagaagacagccattcccaatagactctaggaagaaaccggcaattgcgtgtcatgtattccagttcctcttccgtaagtctcaaccggctgagtttgttgaattcgcttttgagcgcttccagaaactcttcggtatattcagtttcgtttctgtcgttgaaactgaaagtgcccattgcgtaagggaataatttgatataagcgtacgaggtggtaaacttatagaggtctgtatccagtagtgttcttacaatcatgccgtttattctttatatgtaaaacgtcgtaaagttagcatttgttgaacaatcctactgattaattggcaataattccttcttttagtaagttaatcccacttttagggtgttttcgctttctatagcggtgatgcttcaacaaaataggcgaaaaaatactttttttatgaataagcttctttataaccaatcaattattgctgtaaaccgtaagacgcaaaatacgtatatgattattatacagtatgatacggattactatattctcaatcattctcatggtgatgagaaaaaattctcaccactatgagaaaagtttctcatcgcattgagaaaaagttctcactgcaatgagaattttttctcgaaggcatgagaattttttctcgttaaagagagaacggatgcttatagtaataacctgctcatagttgcagccttttatttactttgtttattggatatgaatggttatactcttgacgatatgcagtgctgtggtaagtgaagaggtattggtcacgatctttccgttgctgccatcggggctgctgtgtccgattagcggggaaaaagggactttttatttgttaattagaaaaaacggctttggagtatgctgagggagacgagaaagagaataaatggacagtacatctggctttatgaaggtgtgtcaaaagtaactaaactcccctcttcaggaaggaagagtggctgaaagccggagtggtaggtatgctgtatggttgaatatcaatagcttgtgtgctcacctaccacctcctcctacgggtactcctcttcccgaaggaggagagtgtggatacaactgactttttagtcagcctcagtttagttacttttgatttttgacacaccttcatcgttcttatgataaaaagcaggatgtactgtccggggtatatttatgataattcaacggtaggattgtgaatggttaagccaccgtctaccacaatcgtctgtccggtgatgtatcgtgcatcgttggaggccaggaatgcaatagtggcggcaacgtcttcgggttctcccaaataaggcgtggcgcattgtcccagaaatatattgcgtacttcttcgttcagattgtccagtgcggcaggggtaagaaccagtcccggtgctacggcattgcagcggatatttttctttcccatttgggtggcgatatatttggtcagattgatgacacctgctttgctggctccgtagagagtgccgttggcgtcggctgtcagtccgcttatagatgctacgtttacgatatttccgcctccgtgagtggtcatgatgggaatgacctgctgagaaagatacatcgtgcagcaaaggttcagatggaatacttcgtcgaagtaatcgatatccagcttttcaatattcagatcacgtttggggtcggttccgcctacgttgtttataagtacgtctatctgaccgtattccttcatggcgaaatcaaccagttctttacagctttggagttcggtggcggagaaatagatgggacgcacgtcggcccctgcttgagtgagttcggcggcaagcttgtcggccctttcctgcgaaagatcggcgatgactacttttcctccttcggagacgatgcggcgtgtggttgcttcgccaatgccaccggcagcaccggtgatgacgactactttgttttcaaatcttttcatatatgttgagaatttgatgattaccttcctctaattaacagctaatgaatggatttgttgttgcctgtaaactcttattaataggaatcggcaacagattcgaaaacttttgcatctcattcagttttatgggctaaatatttaagaagactgctaaatgttaacatgaagttgcttatttgttaatgcggttctgattctattaaaccatgttataagatgtcccgttttagccggaaaatttggagatgaggcaaaagtccgtatctttgtactgtgtttttcatagtattagatttaaggttaacaaagattggctgtctgggatagatagccttttttttgctcttatgcgaaggaattatttggagtccgggcgtgattcagaataatgaatattgattgtttcgcagacttttcatttcccgttccttcactacatcatcttctgccggatgcccgatcagcaaaggcgaattcctgtcatgtttcttagtgttatattccacactgttgtaattgcctttgatggcgtaacaatagatgcatccgttgaggcaactttcataagtgcctatgtcgatactttcaatgcaattgcagacattccgctgatttttgtcttttttggcaaggagggggtagccggtgattctttcgatcagttctttgtcgatacacagtccggcagggattcccaaatgtctcagatcaactttggaggtgcaggtatctagttggatggcaggatattcgttgatggtattcctgaaagagacggctatttcttcaatctcctcttttcgcaacggctgtatgttgaactggccgactgcggtgcggatatgctggtaatggtcaataaatcccagcatacacttttcggtatggtctttaagtccataggcaatttgggcaaacgcctccttatggaaagaaacgtcgtactcttcattggtcagtatcgggtcatagcgccagatcactttttcttttcctattttatccgaaaggcgtttgaatatgtctattcgtttgttgactgacggcagattattctctaatttctctccgtaaggattgagggtgaactgaaagtagtatttgtagtcttgcagatgatccagtttatcaatcatcggggcgggattcttggtccagaacacgatgcaatctatcacagcaggatgtaagctgaccttgctgatcattttaggattaaaaggattgggaactaacacatatccttctttaatccggttgaagaaccattgcgaatagaatgccggaatatctgtccggcggctggcgctaattatcatatttcaaagttacggtaaaattggttgtattgcaataattccgtgatgaaaaataatcaatagtacggataggagggagaatagagtatactgaaaaaggattaatgcgaaattcttgaaaaagcggacttagttgctttttcaagaatttctttaagcaggaactgtgaatgaatatgttaaatgttaacacgaaaagtctgaaatgttaatgcgcttccgagagtcttaaaccgtgttatattatcgtccgattcggctctgaaatttgctatttacttgaaaggtggtatatttgtactgtgtttttttcataagtattagatttaaggttaacaaaagattggttgctcgtgatgagtagccattttttgtttttatacgtcgataattgtttattctttaatcatcgttaatagcatcttgaatttttccaccgttgtaagtgtatgtgatacctattgtttgtacataacaaaaatcgttttttattgttatagtacggaaagtaactaataaggagaacattatgaaaaagaaatttttattgtttggagcactggtcggtgctttgctgttgtcttcctgttcggggggaagtaaaaagcagactgtatcctcggaaagtacggaggaattggatgatgccagtaaggtgatcaattattatcatatgtcgctcgctgtattgaggcatgtggctaatgcgaaagatataaatgctgtgttgggatacatggaacagacagggaaagtgcctgaagttgacccgattgcacctccggaaatagctgcccgtgatacagcggaattgttggacccgggagactattttaatcctgaagtccgtcagaatctaaagcagaattatgccggattgtttaatgtgcggacacagttctatgataacttcaataaatttctagcttataagaagtcgaaagatacagcaaaaacggctcagcttttggatgaaaactataagttgagcgtagaactgtccgagtataagcaagtgatttttgatatcctaagtcctttgaccgaacaagcggagagtgaacttttggctgatgagccgttgaaagatcagataatggcgatgcgcaagatgtcaggcacggtgcagagcataatgaatttgtattcccgcaaacatgcaatggacggagtacggattgatttgaaaatggcggagttggagaaggaactgaaggctgcggaaaaaattccggctgttacaggttatgatgaagaactgaagaattttcagagcttcctttctaccgttaagtcctttatgaatgatatgcagaaggcaagaagtaaaggtgcatattcggacaaagaatatcaggcgatgtcagaagcctatgaatacgggctttctgttatttgaaaaataagaccccttgcctggctattatattatacccaggcgaggcatattttatgttttgtcgttattgataatatctgtcgatccttttaataacatcttattttcaggacttaaaagtaaatcacatataatgggctttttagttttccaaataaatgtcggcatggagttataggataaattattttttataatgcattgtagcagatgtatagtcgttacttgatatttattttttaattcgtttactttaccataagtaagtttcttaaattctttcaaagattgcaagatgctttcttcgaaagcgagatttggaatagtttcgaatatatgattgatatctgtacgcccatctgttaaagtagctccaagacctgtttcttcacaaaaatcaagtaatgccttgaattttttttgtacagattggttggccatttcggtcaaaggcttaatttctacaacgaaacctttcccatcatcaaggaagactatagcatcaggggtatattttcctctatcgtatgtgattgtaatgccttgttcgacataataaataacctcatgtgatttttctaaacgtttatagaattttttctcaagcatcgattcgtaaaaaacatttctttgaagtttattactatagaactctccagcttctgattctaaatattttttgtttgggtcatagtttctatgaggagttatttggtggatttcttcaagagtccatgacttcacatgatcaaaccatataattttgtttgtaatatctgtcaattgtgaattttgctttttgggaaagattgtgcttgtttctttgatttctcttttccaggttttgataatggaataatcctgtttaaagtaaagttgagctagatcaaaaagagtttctatgggatattcagacagatggctttcttgaaatttttttaagtagcaagcaaaattgtgtacttcatcaagattgatctggtgattattagtcaatagattatcaatgtcaatgatggctgggatatttctttttcttaaaattccgaatttcttgaatacttttacttttaattgacggattctttcacgactaagtcctaatttatctcccaaacttatcatattttgtatttcgtttccttccaaaccatataattcggagaagatgtattgctctctgtcactatataaaggtgtaccatcttttttagtggctagtatgcacagtttaagagcagttatgagacgaagtccttgagcatccatatggttttatgtattgtgtgtattaatagagaacaatattagac

SEQ ID NO: 122 - DNA, 24138 bp, Bacteroides thetaiotaomicron
tttgaaaagagggcaggcttgtgcctgccctcataaccattaaacaaatcacattcgaatcttaaagacctactagcgattctggttttagaaactctgctcaaggcagaaagcgtacacacctatacaatagaacactgcataatagcagcattagctggtcacataccgccaaacagatagtttagaactaaaggtatgcgaatggtgtgagtccgaataccgctttatatcagacattttgaaaagccggacatttttccttgggaatattcagatgtctgcaaaatcttctgatatttataatatcattatcactataataactaaaattccaaatctgatcatccacatttcttacattttcaactttttcaataagattcgagcatttcagttctacgctgcaggcaataatcttccatcccactgaccaaatctttcgttgaaaagccaaatgggcacattgcatcaaacaatcacacaaagataactaaccactttcacaccgttaaacctattgctatgcagctatgaataaaataaaactttgtcagcaaatcatattttcatctatcattcaactgctcagcctgttacaacgcatcttcttattcttttaatgcaaacagacacatagtctgctgatttgaaattgttattctataaaaaaatttacgtctttatgctagctcacacaatgtgcaacagctaattcatattatgtgcagcagctattgcacattatgtgaattatttgtcgcaccatatgtgccaatcaatatcatagatagaaaagcatgattgctacattcaaatatacagagagaaaacataatatcaaaaaaagaagatgcattgtattcatttgtgtaatagagtattatgaaaaaaagtgactatgatgaagttttgtttgcaattactattcatactttaaatcgattcaatatcatttttgaagtagtcttttccttctcaacaaaactccctgattcacatcttttacttatcaacttatttttctgtcatgttcataaatctacatataggaaaactcttgaaagcttttttcttttttatttatttatagcatgttcttgccttttcaatattccctaagagcaaatatattgcagtgttaacctctgcattattttttgtctgctcaaagcatcaagttctgctaatccatccatgtttaagattctttatccacttcatttataaaaggagataaataatcagtcttggagatatatccggtaacagctgatgtaaccaatttttcaatatccatctgttatctacttttattaatcaaattcacctatcaaatttcaagtgtcattatcaccaaagttcacaattatcagatccttattcacagattacagcatctattgttctaggctaagctatatcattacataagacaacaaagatataaatttcaaagttcactagtctaataacatagtcaatcattatacaagatagcaatttaagataacggttgaaattatatcctccctatatttgcagcatatactttaaaccacatatcatgaaagaattaccggaaaatcagacattaagcaaacaaataaatgagactctaaaagatagagtcatcacagaggtattcaatgcgacaaaattccacaagaatacgttctattttggtgatccccttacatatagcgaactactcattggaaggagaatcaattcatcaatgagcttcggaatgtatgtcgatattattttagataaagaaactaagattagtttcggagatgggacaaatctgaaatatggcaccatttcaaataaaatgccaaacaattaccagctattactcgcacttgacaacaatacttatctgacatttacggtagggatgtttggcgtaatagcagcatatactggaatatataatgatatatattacaagaaaaacttagataacttatcaccactaagcgatgatttcaacgaacaatattttgaaaagctatgtgttggggtgaagccaaaatcatctgtaaaagtattattggcaacagaacaacgtattcctggcttaggaaacggagttttgcaggatatactattcaatgccaaaattaatcctaaaagagaaataaattcattgacagatatagacaaatcggctttattgcaatcgattaaaatgactctaaaaaacatgattctacaaggaggcagagatacagaaatggatatattcggcaatcatggaaattataaaaccattttatccaaaaatacactgagtaagccatgtccccaatgcggtaatccgattataaaagagacatcaagtggtggagttgtctattactgtccttactgtcagaaataatattaagatacgttgagtctgtttttttaagcaaacgaatattacaagccattttttcgttttatcatcaaccacttgcatggcatattgcttggatcatttatgtactctaatgagataaattatttagttcatgcagtagagtgattgagttacttactctattgatgtttcttgaatctactttcgagttactgcaatcattacagacgaacacaataaacattttctctataaaaaataatatccgcgggtgcataaattaattcgtccgcctataggcaactttgcgtccgactataggcaaacgtaacgtcggctataggcaaacttgcgtccggctatagtcggacgaattaatttatgtactgaaagagattatttattgcacaagccggagctaaatttagtataggaattctttatccaataaacgacttttagatttatatgatttgaattcatatttggacgatttagttcttttgcgtatcggttagcccattattgaatcattcaacccattttaaatgataggcaagaagcaataattcaattgctgacttctatcaattatttgattagaacacatttataggatatctatcaatttaaagctccatttagttattcttcaatgtccgaacaactaaatggagctttatcatatatttctaagaatcctaaataaggaaaaggataaacctattattatttagcactttcctcttttcccttatcatatttatctctttcgattttaagtaactcctcaaatagtttcacagcttggtccattgaaaaatgattgagattttccacatgagtaataggccctatattagatgcgcttacatggcagttctcatagaaattgcttgtatagtataatacagtttcttctgtaaatttctttaagccttcttctgtaacccccaatgcagtagccacttgttttaacttctcatcatctatcttttccgcttgttccattttggaaatagcctgttttgtcacccctagcaactcccccaaatccgtttgagtcataccacgaagacggcgtattctttctattttacgccccaaatgtgaactgtttgtataagtttctgtttccataatatttatttcttagttaaattagttaatcaactaataataatcaccttttctttaataattcaattttctctctctcactttgcagcagacgttcatacaattccacgattttatccaatggattgaactgctgggctattgatgtagctccttgttcaaaggtgttatctctaatgttattgatattatatattgccttctcaacatcaaaatccttaatcacctcagcagatatccccaatacagaagctatttgatttagaagcccttcttcgatttcctcctgtttttcaatctttgaaatgacctgttgatttacaccaagatcagccgctaaagcctcctgcttcataccaaaataaacacggatcttttgcaggttatgtccgacgtgcctcctgtttgctttattttttacttcgacatccatattattgttctttatgtgattacattgagacaaagatagtaaaaatcaacccattccgattcaaagtcaactttattttttttcaatccacaacgctctatgcctatttttgtccaatcagtctaaataaactgatattgatagtggcgccacatcaaatacatacactcagagattgaccgtcaattcacggtacaatcgcagttttaaccaataaaatctaatagcctatggagtaaatcaaatcggtataatcggaacatagatttaaatcattcagagatttaactattcaaaaaccaattagtgaacatacaattaaacaaaaaacatgaaatcattttctgataaaacaaacatagggacatacgttaccctaaagacagtttatatgataaggttctacctgctactccttttaacagggggaatattggtaatcggagccacacaagtctacgcccaacagagcagaaccatctccagcgtagtgaaaaactctcagggagagacgataatcggagctaatattgtagaaaaaggcacaaacaacggaaccattacaaatgtagacggactcttcacactgcgtgtgtcgcccaacgcagtactcaaagtatcttatatgggatacatagaacaggaagtcagcacacgtaataaaagcaaactggaaatcacaatggtggaagatgcccgactgattgacgaagtggtagtagtaggatacggctccgtcaaaaagcgggatctgacaggagcggtaacctctgtcaaaagtgccgaggtactggctgctcctaccagtaatgtgatggaagcccttcaaggaaagatacccggcatggacatcaccaaaacatcgggacaggtaggcggtgaagtcagcatcctgctgcgtggttcgcgttccatatatggcaataacgagccactgtttattatcgacggaatccccggaagctatagtcaggtcaacccttccgacattgaaagtgtcgatgttctgaaggatgcttcatccaccgccatttacggttcggcaggagcaaatggtgttgtgattatcaccaccaaaagaggaaaagaaggcaaagccacaatcaactttgacgcgtattacggcttcagcggatcgcccaactacaaacacggaatgactcaggatgaatgggtgacttaccagaaagaggcataccgatataagaacggtgatttcccttccgatatgtctgccctactgggcaagcaggcttttacagatgcgtataatgccggaaaatggattgactgggtagacgaagtttccggcaatacagctaccacacaaaagtacagcctttcggtaagcagcggaacggaaaagacaaggatattcgcttcgacctcctacaaccgggaagaaggcctgctcagcaatgaaaatctgaaccggtactctttgcggctcaacatcgaccagcaactcttttcgtgggcgaaagtcggtttcacctccaatctggtgtaccgtgatttgaattccggcgtgaaaaacacgtttacccgctccctctccgctttcccgttgggggatgcctatgatgaggaaggcaagatcaatcacgaatatatcacagggcagtattcgccgatgggagatttcatagagaatcaatatgcgaacaacacccgttccacttacctgaatatgagcgggtatgtcgagctgactcctctcaaagatttcacattcaccagccggatcaacgggacattgaaccattcccgacgaggacaatactggggaaaccaatgcaacgccaaccgtccgagttatgcaggttcgcctcacgcttccatcaccaatgacaacgcatggaattacacgtgggaaaacattctggcatacagcacaacccttgccaaagcgcatacggtaggaggttctttaatcacttcgtggaacaagaaccagtcggaaagcaacatggctgccgcaagcggacaaatggtagaccaatggtcgttctggcggttgacttcgggttcctccccacatgtggaatcggacttcgcacagacacagaaaatgtcttttgctttccgcctcaactattcatacaagagcaagtacttattcaacttctccacccgttgggacggtgtctcacaattctccgccggacacaaatgggatgctttcccggcaggcgccatagcctggagaatttccgacgaggcttttatggaaaagacacgaagctggctggacaacctgaaactgagagtcagctacggcatcacaggcaactctggcggaacagacgcttacagcaccactacacaagcctacgtatattctgccagcggagtctccgtcaatggaaaaatcgttcctttcacacaatactcggagacttacggcagtgccgacctcggttgggaaaaatcgtacaactggaacatcggtctggacttcggcatactgaacagccgcatcgacggttccattgaatggttcagaacaaccaccaaaggattattattcaagcgtatattgcccatcaccagcggactgaccggatggggttctcctctgtctatctggcagaatatcgcccaaaccagcaatcagggcgtggaagtgatattgaactcccacaatatacagcacaaggactttacatggaacacgaccttgtccgctacctggagtaaggagaagatagacaagctgcccgacggtgacctgatctccgagaacctgtttaccggcgaaccgattcacgccatttacggctataaatatgcaggtatctggggaagtgacactccgaaggagacgctggatgcatatggcgtaaatccgggatttatcaagatagagacagtggataaaaacggagacggcggagtacataaatacagcaccgacgacagacaaattctgggacatacgaatccggattggatcatcggactgaacaactccttcacctacaagaacttcgatttatccgtctttgcaatggcacgctacgggcagacaatcaacagtgacctgctcggctactataccgcagagcaaagtgtgaccaagaatcagctggcaggcgtggattactggacagaggacaatcagggcgcatacttcccgcgtcccggaacgggagacgaacaaaaaacggtatatccttcgctgagagtacacgacggctccttcatcaagatcaagaatatcactttgggatataccctccccgccaacatttcccgcaaggtattgatggagaaatgccgcatctacgctacggcctacaatccgttcatctttgtgaaagacaagcaactgaaggacacagaccccgaaacgaacggttcggacgcgtttcccacctatcggcaatttgtatttggagttaatctcacattctaattaaagaagaaaatgacaatgaaaagtatacatttaaaaacagttttttgctctgtcctgctgtctgcactattcctgcattcctgctcgctggaagagtacaacccgggcgcatttaccaatgaaacattggctacctcgaccgagggatacgaaacactgatcaaccagtgctacttcgcaatggaaaggttttactacggtgccgcagactggatgtcgctgaccgaaggggatacggacctctggacgtacaaggctaaccaatcgacaagctacaccgaatggttctggtttttcgccggaacatcgcccaacacgacctacatcaataactggtggaacgggacatacgacggaataggttcctgcaacgaagccatcgccttaggcgacaagcctccctacgccacagaagaggaacggaatgcgaaagttgccgaagcccgcttcatgagagctgtctattacttcaacgcagtggaacaattcggaggggtaaccatgcttacggaaccggaaaccagccttaactactctcctgtccgcaccgacccgatgactatctacaaagaagtcatcctgcccgacctgagattcgcatccgaatggctgtcaatcgggaatcatgccacgactaccactccgaccaagaaagccgctctcggctttttggcaaaagcctgtctgcaaacctacgagtatggaagcacggaatacctgcaggaagctctcgacgcagctttacagctgatctccgactgcgaatcgggtggcgggaaatacaacacttatatgtatcctacatacagtgaagtattcgaagaaagcaataactgggaaaacaaggaagcgctctggaaacatcgctggtatgcaggcacggacggacacggttcgagcaacggtaactacaagctaaaccgcaatgacgagtatttcctgtgtgacatcaataagttcggtgcccgtgaagacaatcaggaaacacgactgacatgggaaggctccatcagcggcatcttcatgcctacgcaacacttgctgaatctgtatgtacagaatgacggcacgttagaccccagattccaccagtcattcactacccaatggaaggccaataaaagttatacttgggacgaaagtgccgtacacatgtacgataaagacgaaacagtcatcggcaaagctctgaagaaaggtgatccggccattaaatttatcatgccgcaggatgcggattattctacggaaaaacagaatgagcacaagaccgactatttgttgattgattacaatcatgtctacagtgatgaaaacaacaatgtgaacatgaactactcgtatacaaatgtaacagggaattacaagaacgacggtaccagcgagaatctgttccgttactattatccgtcactaaacaagcacaacagcagtaactattacgttgcaaacgcctccaaacaaagaaacggaaacttaaacgctacgtttatcatgcgtatggcggaagtctatctgattgccgcagaggctgacatttatctgaacggaggaacgaatgccgccaaatacctgaataaggttcgcgggcgtgccggagcaaatccgttaacgggcggcatgacggttcgtaacgtattagacgaaagaggacgcgaactatgcggtgaatattgccgtttctacgatttgaaacggacagggatgttcaagagttccgattatctgaaagatactcacccggatctcgcacggttctttaatccgaattatgctttacgtcccatttctacgacctttaccgctaccattatcaacggcagtgagtatcagaatccgggatattaaattgtaagacctatatacccaatcattatcggtacgataatccatatagccacgctatttatcgtaccaatgattggggatattttccacacctttccacatttttccacacctccccaataatatcgtttttttcaactctgctgttaatctgtatcttatcctttcagcatttctttatatcctattggtatatcctttgtatcgactttatagcaaatgtatttttaaatataaaagtatgaagattaatcaaaggttaacattatgttttagcttattgttttgtttgttgagtatttcgtatgcgtccgctcagcaactgaacatatccggtgttgttatatcatcagaggataatgaaccacttatcggtgccaccgtcagtgtaaaggggaatcccaccaaaggagtgattaccgatatcaacggtcagtttcaattgtccgtggaaaccggaaccaagctgctggtcgtatcctatgtgggaatgaagacacaggaaatacgcgtcccccgcaaagagaaagaactcaaaatagtactgatccccgaaacgatggatattgacgaggtagtagtaacagggtatggtaatttctccaaatcctcgttcacaggatcggccaatacgctgcgtacagatatgctgaaagaagtgcccgtgatgagcgttgagcaaaagttgcaaggtatgactaccggtgtacaaataaccagcagttccggtcaaccgggcgccaaccaaagtattcgcatcagaggaatgggatcgttcaacgcttcacaagaacctttgtttgtcatagatggagtaccggttacttccgggagtatgagttccggtggtcctgatgcagcatatatgaacaattccaagaccaatataatgagtacgctgaatccgtcggatattgaaaacgtaactgtaatcaaagatgcggcagcggcttccctgtatggttcccgcgccgccaatggcgtcatattgattacgactaaaaaaggaaataccggaaaggtacgcgtggatttgaacgtatcaggcggcttctctcatgcggccgtcgacttccgccctaccctcaacggtgaccaacgggaagagctgctctatgaaggattgctgaactacgcaacagacaatggcatggagtctccgactgaatatgccagttccaatatcggcacatatgcgtataagccggccatgggatacacggactggcgaaaagagctgctccgcaccgctatgcatcagagttatgaagcttccgtctccggcggtaacgaccgttctacattctatgcctcgctcggctacaacaatcaggaaggattggccaaaaactccagtctggaccgttactcagcacgcttgaacgttacgcagaaagtcggcaaatacggggaagtaggagcaaatatgatgttctcgcaaatgaatcaggaaatgaatgaggaacgcggatcatctatcaaccctttcctgtgcgtagccatgaccatgacaccttccatggtggtgcgtgatgaagaaggaaactacgtaggagcttatgacggcaccagcctgaacccgttgcgcgacatactcaccgattacaaccgcgtgcgtatgacacgtatgttttcaaccggttacgcagcgatagagccaatcaaaggtctcaaactgaaagagacattaagctatgattatactatccagaaggattcacgctactataaccctttgagctcggcaggtcctaaaagcggaagcgatgcccagacagccaaaggcttcattgaatacggcaaactgatctcatcgacctcactgaactatgtgcgtactttcgcccgcaaacatcatctcgatgtattggcggcttatgaaatagaaagctaccagacagaccacgcttcgggtgaaaagtccaaactccccagtgataaactgacagaaccggataatgccgccgtactgaacagtttcaagtctgccacccaagcctatcggatgatttcttatctatcacgactgaattatgactatgacgaccgttactacatcgccggaagttaccgtcgcgacggaagttcacgcctttcacccaacaaccgctggggaaatttctggtctgtgtcgggtatgtggcatttaggcaacgagaatttcatgaaagccgtaaagccggttttgagtgatgtcaagatacgtgcctcgtatggtgtaaacggaaatcagcccggttcatactacggctacaaaggattgtacagttatggagaaaactatatggaggcagccggatcgtatgaatcggcacaacccaatgatctgttgacatgggaaaagaattacagcctgaatctgggcatcgacctttcatttatcaatcgtatttttgcgagtctggaatattacaatcgggataccaaagacttgctttacagtctccccatcagcgccactaccggatttaccagttatttaagcaacatcggacgcctgaacaacaagggagtagagtttgaattgcgtacgctgaacgttgtttccaacgactttaactggaccagtgttttcaacctgagccataaccggaataagatcgtttcactcaacggactattagaccagacgattgagggaacatggttcatccataaagtgggactcccctatcatacgttttatgtaaaagagtttgccggagtagacccgctgaccggttctgcccaatattatctgaatacaaaaaatgaggacggaagctacaatcgggaactcaccaccgatgctgccaaagcagaatccattccgtacaaaaccgctactcccaaagtatcgggaggattcaccaatattctgaattacaaatggatagacctgacctttacactgacttattcactgggcggttactcgttcgacaaactgggaacttatattgaaaacggcagcagttccatctacagttcacgatacaacttgcccgcatacatgatgaaccgttggcaaaagcccggagatcagacggatatcccacgtttcgtatatggtgaaccggctacttccaccaactcgtcccgctatatccacagcaccgatcatttacgcctgaaaaactttaccctcggcttcacactgcccaaccagtggactcaaaagctgatgattgacaaagtacgggtatatttctcgggaaacaatctgcttacctgggccaaatggaaacagtatgaccccgaaacacccgttaacggtgaagtcttttgcgaggctcccgccatgcgtactttcagtttcggagctcaattatcattctaacatccctatcattctaactaaataaacaacataatgaaacgaattcatatatacctacttacagcaatggctctactgaacagctcctgctcggcagactggctagaccttaacaccaccagctcggtagaaacaggacaggccatcgtaacattggacgatgcccagatcgctctgaacggaatttatcgtctggcatccggccatagctattacggagacaactattggtattacggcgattgccgtgccgccgatgtacaggcacgtatcaccaaaggagacggaaaacgcgtatctccctattatgaatacaatgtgctcgcttccgataatctgaatattgtactgccgtggaatactgtttataaagtaatacgacagacgaataatctgatacagaaaatagagtcgggcagtattcaaagcagtgatactaaagaattgaaccgcatcaagtccgaagcgctggtgatgcggggactttccctcttcaacctgacccggttgttcggaatgccttatacgaatgacaagggggcttcattgggagtacccatcgagacctccccttccgatcccacgcataaaccgtcacgcagcactgtagcgcaatgctacgaacaggtagtcagcgacatgagcaatgcactgtccgggttgagacaagagacatccaatggctatataaactactgggcagctcaggcattactgtcaagagtctatctgaatatgggtgaatatcagaaggcttatgatgccgctacggatgtgatcaagaacaacggcggacgttatcagctttacagctatgaggaatatcccaatgtatgggggcaggatttccagtcggaatcattattcgaactttacatcactttatccgaaccttcaggaggtacgggcggtgagggcgctccgatggtttatgccaacgaagcaacggtcgactggaataatctgatcttgtcggaagatttcctgaacctgctgaatgaagaccccaaggatgtacgccactgcctgacaaaggaatctgtcatcgaaaacaacaccggacttccggctgccgccatgcacgagaaagtctatcttgccaagttccccggcaagaccggagatgatcccaaaactaataacatttgcatcatccgcctttccgaagtctatctgaacgcggctgaagcgggactgaaaaaaggaacggatattgaagaagcacaaggttatctgaatgacatcatcagccgccgtaccacggataccagtcagcaagtatcaacggagacttttactctggacagaattcttaaggagcgccgcaaggaactggttggcgaaggggaagtcttctatgactacttgcgcaatggtctggctattgaacgcaagggcagctggcatcttgagaccttgaaagcgtctaacgcacaaaagatagaagctaccgatctgagaatagccctgcctattccgcaaagcgaaatagatgccaatccgaatatacagcagaatccaaggtaagcaacgtcaattgatgtataccatttccggaataagctggctatactcacgtgtttagcctcttcccgatatcaaagaaggtacatttcaccaaagaatgaagtgtaccttctttgtctttcagcagcagttcccactctcctgtttctctcctccttagtgaacgaatcgataaaacaccccctttttcaccggcatctattgtgggcagaattgtttttcctatttttgtacttgacagaaaattattaaggactactttatgagaaacattatagataagatgaactctttgtatcccatttcggatgaaacgatacaaatactaaaagaaaatacagtattatgtcattttccaaagaggcatcaactgatagaggctgacaaattttgcaaatcggcttattttattgaagaaggaatgacccgctctttctggctggtaaacggagaggaaataacgacttcctttgcgtgtgagggagcgattgtcttcagcatggatgaattgtattataataagatgagtgaagaatttgtggaaacgcttgaggacgttgtcgcatacaaaatatcactgaccgatctgctccggctgtttcagaccaatatcgaactggcaaactggggaagagtgattcatcaaaacgaatacagacgcctgcaccgttcgcacaaagaccgcctcaccctgtctgcaaaagaaagatatgaagcattcaaacttcagtttcctcaaatgtgccaacggatacaattgggatatatcgcctcttatctgggcatcacactatcaacactcagccgcctcagagcatacaaataattcccatacacggcaagattttgatgcaggacaaatttttaaacttataaattccgtatttttgcggcttcttcaatgactaatactaatttgaacaataatttaaaacatgcaaaaaatctcttcctctgcatttgcagactctaaaccccattacgtactccttgacggactgcgaggggttgcggctcttctggtgatatggtatcatgtattcgaaggctttgctacaagtcccatagaccaaaaattcaatcatgggtatctggctgtcgatttcttctttattctgtcgggcttcgttatcggctatgcttatgacgaccgctggaaaacaacgatgacccaaaaagagtttttcaaacgcagattaatccgtctgcatccgatggttgttatgggagccgttttgggtgctattacattttgcatacaaggctgcgagcaatgggacggtacccgtgtttccatatcgatggtaatggtggctatgcttctcaatcttttcctgattccggctgttccgggcacgggtcccgaagtccgtggaaacggtgagatgtatcctttgaatggtcccagctggtctttgttcttcgagtatatcggtaatattttgtatgccctatttattcgccggatgtctaccaaggcacttacgatacttgttgtgatagcaggaatcggattggcttctttctcgatatgcaatctctccggtagtcatcatttaggagtaggctggtcgatgatcgactataacctgatcggaggttttctacgtatgttgttcgcattctctatcggattattgatgtcgcgcatctttaaaccggtccatatcaaaggggccttctggatatgcagtctgtcgattctcattttacttaccatgccgtatgtaggcggtgagacatctccgtggatgaatggtatttatgatgctgtatgcaccattcttattttcccactacttgtctatctgggtgcttcgggaaaaacgacagataaaggtacagccaaaatctgtaaattcctgggagatatatcttatccggtatatatcatacattatcctttcatgtatctgttctatgcctggttatggagcaaagagccacatatcactttctcccagtcatggccggtagccttatgtgtcttcttcggaagcattgtgttggcttacctttgcctgaaactgtatgacgagcctgtaagaaagtggttgagcaagaagtttctgacaaagaaataaggtaattatcataacagagaagggcgaacactccattatagttactcttcaataaggcattttgacacaaggtatataataaaaagaagctttcaatatcactgaattcagttttttatcgagagcttctttcattatataacctaaccagcattatattcattaaacttatccgaaagaaaagtcaaaatgaccttcattataaatttcaattaatccattcttgcgttcaatcactaccttgttttcacgagccagccaaccgactgccagagctgtgctttccacactcagatttactttccgggcaagttcgggaatcgatattccatcagcttcattaagggcgtgccatactttgcctgcgttggcacctacgattttcttatccatagtagtcttttttttaattaataaaaaggaaaactaactcgttaaaaaagcaacgcacttttacgataaaacccaaaatgaagatcttttcatatgttttgaatgttatgtcaagaatagatataaaaaaacgtgagccttttcttcccaaatgtagcaacaggaactaccaatccctacaacacaaatgagaagaacgcccacgcaaagtatatgtataacaagcgtaggcgttcagtcatttttacgtgttgtaatatttaccctgagggtaaaagaaattggtagtttcgttactacgtaaaaaagctgaacgcttttcgatatttagtctcaatgaacgcacctttcaacggctatacaaatataataaaaatcagaattaaaagttacagtatccctccttttttattccattactattagattatcacattttttagcactacagtcgtaaaaagacattgttgagcacgattcggctatacttttatctgataaaagtaataaataaacagctataaaagccggaattattctccggctttcgtctttttctcacgataaataaccttatctctctgactgattgtccacaatccgtctataaaccgtacatttttcgtatcatcatcctccacgttccatgcataacctcccgaaggtaagccacgtctttccagaatctcattcggttgttcatcagagaagaaaagttccagacgtgtggaatcggggctgaacactataaaagcagaggcagtgcctccatccacagcttctgtccggatacctttttcaaacaaccggatgcagtcttgctgcacttcacaccatacatatccggcagagccgatacaaccgtgttcatcccgatcgcctccaagtttgagagattgcggatactggactaattttgaggcctgcatccccggtgtatatttaccggtatagaatacttccagagtatcattcagaagcaagccatcgacttcttctttattcgcgttcatcgtactgaatgaaagagtatcattcttgtctgtaacaatcgccactgtattcatggtcgcatcacaaacaatgccttttgaacttgtcatacctgacgaacaacttcccatgaaacacaaaactcctaatgctgccaatactgttctcatatcttttttatataattgttggttctaatatcatgcaaatataaaggatatatggaaaagatgttatcctaacaagcagaataacaaacaagtttgcttttatagaatgcaattccgcatatatttcattcatttgtctatatttgcattattgcgcagttgcgcaaaagaaactttaaaacagaaagagaggaattatgccagagtttgatttttccccaataacagaagggatttataatgttatagagacagaagaaaaagtattaaccagcctgccggaagagacaatcacacaaaaacgtaacaggcagaatcgtactatcaaacaaattctcggacatttgattgattccgcctcaaacaatcatcaacggatgatcaggttgcaatacagtaaggatctgcttttctttcctgattatcgacaggataatgatctgtggatagccttgcaggattatcagcatacggactggaataatctgattcagttatggaaattctttaatttgcatatcattcaggtaataaagtcggtagatcaaacgaaactagatagttactggtgtgacttcgaagggacaaaagtcactttaaaagaaatgatagaaggatatttagatcatctgaatctccatattcaggaaattcacgaactgatttagcagcctgtttgctatatgatatagtagaggacagagataagaagattaatattttcttatctctgttattgcagcagattgagtcattgtatcataagtcaataatccttccgtactaattttgatgcttctccggttttatttttagaatcccatagcctcttttaccaaagacatttcacgatgggaagtcagtttctccaataaaagaagggctactcccgaagcggtttgaggaccataggacgtgattatattgtcgtccaccactatcggttcatggacgattattgctccgaaactttgaagaaccttttgcttgactgcccctccgagatgataagtagtcgcctttctatctttcagcacaccacttttaccgacaggcaaagcacctacacaaactgttgcaatccatttcttccgggcatcaaactgacgaatcagatttaaaagcttctcttcataagcctcttcataaaagccgaaaacttcaaaacctccggggatggcaagagcatcatattcatcaacggatatctcatcaatcgtcttatccaccaaaacgggaatattaaaagaactgatgactttctcgttaaaaccacctgttaccacctcaacatcacagccaaaatcagttttcgcccatcccatcacatcaatgaaaccactaaattcaatcgtctcaaagcctttagcaagaaaaaccagtaacttcataatcgtcagtgttataaattaaacaaaccgtttatactgcaaagataggcagatacctcatgaaacaagaataatccgccaaaaactgctatatttacttcatctttcacacataaaaagacttctgcaaatacagtgtaaggataaaattcacaagatagttagcaagaatagacaagcagatctgacagacggcagctatctttgcgattaaaaaccgtctgacatgaatatacaagaaaaaagtaaaatagaatatcgttccaggatcaatcgggtgatggactacattgacatacatctcgaccagcctctggaactgaaaagtatagcagaaatagctaacttttcgccttttcatttccacaggatattcacgttcctgataggtgaaacaccgattgattacatccaacgcctccggattgagaaggcagcctgccggttacgggaaaatatggatatttctatcagtgagattgctgatagttgcggtttttgcacagtatccctttttagccgtgtattcaaaaagttttttggtttgacgccaagccagttccgtaaaacggagagacccgtttatgcccaggacggaatcttatttagcaagaacggacaaatggttagcaagaatttgacacccaagcatgtattatctccccaactttgcagcgtcaaatttaaaatatcatattttatggaaacaaaaatcgaagtaaaagagatgccggacatgaaagctgtttattgccggcatatgggagcattcaaagagattgtaaaagcgtatgagaaacttatcaaatgggcagaacctcgtggcctgtatattccgaatgttacgaaatcggcaaccgtcacacatgatgatccttcggtaacggaattgagtaaagtgcgccagagtgcctgtatcatcgtggaaggagacgtaaaaggagaaggtgaaatcggtaatctcgtcattcccggtgggcaatatgctgtcggacactttgaattgggtactgaagatttcgagaaggcatggaacacaatgtgcaagtggtttacggaaagtgggtatcagcaaggagatggatgtacttatgagttataccataacagtcaccggacacatccggagaataaacacattgtggatatttgtattccgataaaacctctttagaggatcatctgtcttaccggataaaaaacgaagaggatgtgtcaagactccccttttaacgaaatcatcttcgccacagatagttgtagcgaagatgattctttatttatgaagggtttcgacacatcctctttgatttgttctgaatggcagccccatcggaacgatatgcccgtcagatttacttcgcagtttgaaataacagactattgccattggtatccatccattccgccatcaagcgataatacgccggatattcagtcggagttatcaattgttttttcagtttcaaggtacggaatatctctattttatcctccgcctttttcactgtaacttctatgatgccgacagcattttcaatctttttgttagtcggcacaaccactggttttattcttgcatcaatctttacgatataggtataagcctcatcgggcaaataccgcaaaagcaggttaacgggacgagttgtattcagagccgtcacacgtccatcataacttgcccatccaccacgagcctgcggtaagtcgaatttccgataaccatcagccaatgcccttccggttttatcgctcacccgcaaggtgtcagttcgtgaaacaacatgagaaaccttctctaaaattatcggctgagcattcagatcaactacagaaacaaaatcctgtatatcggcaattcctttatcaaagagaaacaatctgctgacagcggcaagtccggctgcatctttatcttctgttttaggaaaagccgcttttatctccgcacggatgcctatcgcttgttgcaaggcagccaacaaagcagccttctccgcttcagttccgtatgccgaacggatcacttcggaagccggacgcaaaaggtatccggtttgcgacagggtcagacggcaatttcctaatccttctacataagcagtgagtaactcctttttttgttctgtggtttgtgcaccggcagtcagcttctgtgccaattcggtaacatcctttccattactttccagttgttgttttatcactttcagtgcatcagcctttgaagcataagtggacgccacaacagcctgtacattacctgccggcaaagagacgtcaagtgaataaggacgcggttgcacatttttcagtgtccaggtcactgttttcatgccatccgcagttttcaccaccggagcagcttttccattcaaccattcataatgcagaggtttgctttcgggcactgacagcgaaaacacatattccctgattggggaaagctcttccacctgctcgcacacatccagttcgggcagatatcccggacgggtaacgacggagtagtccagataaatggtagctcccaattccagtcccgtatgaacgactaccatctctttcagaccattataagccggagcatctgccgctacggaaggaagtacctcaaggagcgcattttcgggagtcttcacaatagtaccgtctttctgacgagtataagaatcgtgtatcttcagtgtctgaaactccggattgtaaatgataaaactctctccatacacacggttcatcgctgcatgagtaaacaaagtcagctctttttgcacacgcatttcctgactgccgtcagcgtgtaacgtataagccttgctcaatttcccaaattcagcttcggatgccgctttcaccggaaatgccagaatcaacatcgccagcgtaactatataataatatgtatttttcattctgctctactttttaatcaccaaatattcaccatacgccttgtgggcattcacagcattgcggaaactttcccaatcagaagcctcataaacacgcttcttcaaagccaatcgattgtggagcaacactttatttcctttctgtaccaacgaaccttcaaaatcggctcccactccttgcatggtttcatccttgaccgcactcaccagcttgtatcctgccggaagctgaaccgtttcatccagttcgaccaaacgggaacaagcatctttgaaaccatacttgcggttttctaccgaagtatcgatccacatataagaacgtacctgattataaaggttattcatcaccatcggacggaaaaacatctcgccctctcctttcaaggcataatcgggtatttcataacgaaaagtgattttaataggtgcagcctgatagtctttgggattttttccatagtctacgctcaacaatctggctttgggagagatggccaacagctgacgttccatcgtgcttttccattcgctctgaaagccggtggtaaagatgcgacggatattgctgtcactctgtccttcggctgtaagggtaaaagtaccgcgtagtgtaccatctgcttccaagcggttgtcggctttgatacgtacataatggttttcgggagccgaaaccggagtgatacacaaatcagaaccttcgggtacacccggcagatagttctgctgctgttcggcactgctccataactcgcggcagaaaggaacccatgtcggatcaagaggcatatatgttccattgctcagtttcaccactgccacacaatgattaaaatggtcggcaggaatactttctacccgactgcctgccatcgtcatggcaggataggcttcgaaaccagccatgcgcaagaacgaaatcagtgtacctgctatatctttgcagactccgcaacgatcagtataattcattttagtattatgaagtgtaaatccttctccttttcccatcgagatgccggaatagcggatgttatctgccacccaatgagtcaacacagctattttttccatttcggtcttcttgccttttatcagttcatccacttttttctgcgcttcgggcaatggatcaaaactaccataatcttcattcactttattgaaccacaacgacttgtctttccactggggagtggaagacatcatcagtttgggagctgcatcgaaaaggtctaccatgtttgtctctttaacgaaaggcatcatatcatccatcgcaaagctatatttcttgcgaccgtcttcataacgcatggatgatgcgcactcaccctgatagaacagaaactgaagttccttctccatcggaatgcttactacataaactttacgtacagtaggagtgctgctccaaaaaggaacaatatcataaaactgtccgcgcataggcggaataaagcgtgattcatcttcattaccggctgcaagcaacgcataggtaaagcctttcttggctatttcgtaatccacaatatcacccggctgcaaggcgcccacttcaatcatgatttgtcttgcgccccaataaatagcacgcgcaggagcagcataatcacaggttttcctgacatcaagttcatctacttttccattggcacgatggatggttacacgtttaaattcggcataagcagtcaaagggtcataatcgtatttaatcacccgattatccactgctcccctcggagtctgtacctttatcactttgcatacaacaaacgacccttgtcctgtaggctgaacagataccgatgtactatccaacagtgtcacacaatcggatgcttcgtaagtcttccccttcgcagcctgttcataaggtttccagctttgagccaatgacgcagccgaaacaagaaggcagcagaggagtgatactaatagttgttttctcatgtttttcacttacattttatttatagaaacaaatgtaagtaaaatctttggaatttatttacttcatgctaaagcaattatcttttttcctgcctcaatacaacaaattactacatcaccttacttacaaaaacaaatgacctatttgaaatatttaaatatttatcc

SEQ ID NO: 123 - DNA, 24012 bp, Bacteroides thetaiotaomicron
gttttgttttataatttataattattttgaggtatgtacttaataaaaatattgcatatatttctcagataatgtcttggccaacaatatcgggttctctccagaaattataggatggtgctctttggataatgtccactcatattcgaagtcagtaattgattgataaaattgtttttcatcaaacttctggccggataatgaagcggttattacttctgttgtaaagcgcttccaacgttcacgataataactgtaagttaatccaccccagcccctgtttgcatagtcatttaactgggttgccttttgtccccatactgtcaggatacaacgtgcattttcctcataatattctttttcagcttctgtttttccaaaagaacgtgcatcgtcaatccacttaccgattgagaaattggtttcacaggataacagacggtctgtatctatcaatagtgcatccatttgatcggcccatttcttcattccatctatgtctttttctgaataacattgagtgaaatgatctctaaacgaggaaaagagatttcctaatacttgccgtcctacatttattacatcaaatcgatatccagtattgtttatatgactggctttcaacatttctgtccaaatatcccataagtcacgattgttgtaagtgatgtccggataggtattccaactatctgtgcccactaacattggacgtgcattcattaaaacggcttgccctgctgttgcatactttttatatatttttttatgtaatgaatcccatgctttcagaatatgtctatcttgatttccccctctgcattttgcccagttttgaatccattgatcagttgttaacggataatcccatgcctggtcaaatacaaattcatacataaaaggattcacatcgaagccttccaaggtagctcctaggccatatacattctcaccaccttctacaaagagtttttcaattttgacatcaacatcatccagatttccgaccatcatggagtttccaccaaaattgcctaagtagcaccacatatatggttttccgtagtacatttccgtattcctccatatttctgtactgtcacaatagtaatccaacagtatgagtttgtcatctggcacagcctccaggaaagaacggattctgggttgtgtccatttcttttgatcatggtaaaacatccatgtcatttgcaaccacttagcctcagcatctacttgataaatggactcatatatcttcttagaaacctttgccaggaaatcttcattccaatttggagaatcaacctcattaaaaggatcaattccataaatatgatctgtgccatatattgccgtctgctcttccaaatacattttttgaatgatgttgaacagagagtccattggttctataaaatgactgcgatattttgaatcatatcctccccattgactcatttcgtgaattttggcatctggatagattgctttaagttctttaggtacgtgcccagaaaatgcaggtaaaacaggggtcatattaaagtcgcgttccctctttaatatttgtttctgtaatacttcttgttgctccaaccatgatttcggcaggggactttgccaataatcgacattagacatacgatgccagggcaagtgcgcaggtcctgtgaaatatgaacgtatttgttcatcgtttaatcctaatttgctccagaccttataccatactgtctcttgtccactgatagctaatggcatcgtaattccatttaatgccatccagtcaatcaacctttcccaatcagaccatttccaataaggcattgtatatccaaatgtacagtagttcaagaagaaacgattgtcacacttagaacggatagatattggttgaggaattactggtaactcttcgggcatatcaatgctatcagaggcataccaagatacattcgtatggcagtaatatttcagataatggttaagacctacggccaaagaattattattatttccttttatgcaaattttcttgtgtgccgattctagtataaaacgatccatctggtttgagtcatttagtaattcaaattcaaaagaatctgcatgttgaggaaataatctctggcacatctgttctaatactgggttacttgatccagtatcctttctacaacttgtaaaaagaaaaattgtaagtattatatagaagtattgtctgttcatatcagggtaataaaaataagaatgtattatatgttagatatttgattttcatggatgtataatttcatttgtttctcgtaactcttccagtactttccagcattgaaataatccccttggtacatgaaagcagcctttccatttcccacctttgagtggcagcaatacttctccctgccgattcagataaccgaaccattccggatattccggatctttgaaatgtgtccatgtgtagtcatgtaccttctcaaaccattccaaacatcttttatctccggtcagctgataacctttcaataatgaaatcaaagattcaatgtgtacccaccaaagtttctgatcccactccagttgttggggaggacaaccgttacggtccataaagtaatagatgccgccacattgcttgtcccaaccgtaatcaagcattgttaaggtggttaacattgcttgttgtatgagctccggtcggtccagccttttgcccagatccatgataaaccacatcgcttcgatagcatgaccgggggtcacctgacgaccttcgaagcaatccaccagattaccgtccatatcgacattctcaacaatgataccacccagctccggacgataaaagacattcatcacttcatggatgcaggtttccattgttagttttaagtagtcagggtccagcagatgttctatctccaaagccagattgcaaaggatcatcgggagagcgaagttcttcaagtttcgtgtatctggatgaagcttattccatttacctttcggattatcaactttagagagtatgatttcaaaagttttttttgctatgtctgcatattcctgacttccggtagcaagactcaactgcccgaaggccatggtggcaaaagtatatgagaaaatattgtatggttctactaatggtctacccgaacgattgagtgaaaaataccagttgtaatctccattatgtccatattttttcaagaactcaccacccagaacggcacaatccagccattcctgtcgtttttccactttgttgtaaagcatggagaacatccatacctcacgtccctgcaaccagatgaatttatctgtatcaaaaactcctcctttgcggtctaagcaggtgaaataaccgccaaactcaagatcttgagagtgttcgagccagaatggaaggacattatccaataattcattccgatattgattggctagtgttttaaaatccatatatctttaagtgttaagttattaaggtttctttcttctactgttccgaccgggtccagtatctttcaatctcttccagtgactttcctgtggtctccggcacgagtttccatacgatgagcatatacggcacgcacatgactgcgaacaggaagaatgttccggcgggggtgagattctggagcatccagggggttaactgtccgatcaggtacgttcctatccacagggcgaatcctgcaatggacatcgccagcccgcgcaccttggtggggtacatctccgagaggagcacgaacaccacggcacagatggagacggcacagcagaatacatagaacaggaagaaaacaagcaggaagaggctggagactccccaggaatcaccgaagaggaagtaaatgccgatcagcaggagggagacaaccatccccgaaactccgtaatagaccagttgcttgcggccgaccctgtcgatgatcacaagagcaagaacggtggtcagagtgttgactagtcctacgagaacttggtaaaaaacgcaagtttgtcgctttgactgttaaatatatgcagagaaaatcttatctttgccttcgttaaattaactaatacccccatttatgaaaagaaatcattatttatttacccttattctcttgttagggtgctctatctttgtgaaagcttcagacaccgtttttgtacatcagacgcaaattcctattttaattgagcggcaggataacgtattgttctactttcgtttagatgcaaaagaaagccggatgatggatgagatcgttttggattttggaaagagtgtcaatctgtcggatgtacaggcagtcaaactctattatggcggtacggaagctttacaagataaaggaaagaagaggtttgcacctgttgactatatatccagtcaccgtccggggaatacattggcagcaataccgtcttattcgataaaatgtgcggaagccttgcagccttctgcaaaagtagttttgaagagtcattataagttgttcccggggattaatttcttttggatcagcttgcagatgaagccggagacttctctattcacgaaaataagttctgaacttcaatcagtgaagatcgatggtaaagaagccatttgtgaagaacggtcgccgaaagacatcattcatcgaatggcagtgggcgtccgccatgccggtgatgacggttcggcttctttccgtattcccggattggtaacttcaaataaaggaacgctgcttggcgtatatgatgtccgttataatagcagtgtcgatctgcaggaatatgtagatgtcggtttgagccggagcacggatggtggcaaaacatgggaaaagatgcgccttcctctttcgttcggtgaatacgatggtttgcctgctgcacagaatggagtaggggacccttctattttggtagatacccaaacgaatacaatttgggttgttgccgcatggacacacggaatgggtaatcaacgtgcctggtggagttctcatcccggaatggatctatatcaaacggcacaactggtgatggcaaaaagtacggatgacggtaaaacctggtcgaaaccgattaatataaccgaacaagtaaaagacccttcctggtatttcttgcttcagggaccgggacggggaataacaatgagtgatggaactttagtattccctactcagtttatcgactctacccgtgtacctaatgccggtatcatgtatagtaaagaccgcggaaaaacatggaagatgcacaacatggcacgcaccaatacaaccgaagcgcaagtagtagaaacagagcccggagtgctgatgctgaatatgcgggataaccgtggaggaagccgtgctgtggcaattacaaaagatctgggcaagacatggacagaacatccttcctctcggaaggccttgcaggaacctgtatgtatggctagtttgatccatgtggaagctgaagataatgtacttgataaagatattcttttgttctcgaatccgaatacgaccagaggacgcaatcatataactattaaagctagcctggacgatgggctgacctggcttcccgaacatcagttaatgctggatgaaggagaaggctggggatatagctgtctgacaatgattgatcgggaaacgattggtatcttgtatgagagtagtgcagcccacatgacatttcaagctgtaaaactgaaagatttgattcgatgaaaagtcttcgaatctttttggggattgcatttttattccataccttatatatattgggggcagatcatttgcgtctgcttccccaacctcagcaatgtgtgcttgcaaaaggatattttatcgtgggtaaaatgcagctttccactcctgtgctttcgcaggaatggaaacagtttgtgacggagatgggaggtactctgactgatcagtcggcatcctctatcaatataaaattggttgacgcgattgacaatgtatctgtcaataaggaagaggcttatcgtctgactattactccaaaggcaattactgtggaggctgtagcagagcgcggagtatattgggcgatgcagacgctatatcaactaaaagaagaaaagggaaagaagatccgcctgcaatgtgctactatcactgattggccggctttccggattcggggtttcatgcaggatgtagggcgtagctacttgtctttggaagaattgaaacgtgagatagccatattatcccgatttaaaatcaatacctttcattggcacttgacggaaaatcaggcatggcgtctggagagtaaaatctttccgatgctgaatgacagtacgaatatgactcgtatggcgggtaagtattacacgttggaggaagccagagagttgaccgagttctgtaaagctcatcaggtactgttgattccggagattgatatgcccgggcatagtgcggcatttatccgtactttccgtcatgatatgcaaagtccggaaggaatgaaaatcctgaaactcctgctggatgagatttgtgaaacgtttgatgttccatatctccatattggaacagacgaagtgcattttactaatccgcagtttgtgcccgaaatggtggcttatgtccgtgacaaagggaaaaaagtgatttcctggaatcccggatggaagtataaggcgggtgagatcgacatgatgcaactttggagttatcgtggcaaagcccaacagggtattcccgctattgactcccgtttccattatttgaatcattttgatacgttcggcgatataattgctctatataatagtcggatttataatgcagatatgggaagtgatgatcttgccggagtcattatgggtatctggaacgatcgtttaatcgacaaagagtggaatatggttctggaaaataacttttacccgaatatgctggctatcgcagagcgttcatggcggggaggaggaactgaatatttcgataagcagggaacaattcttcctgtagatgaaaactctgaggtctttcgtaattttgaggacttcgaaagtcgtatgttatggtataaagagcatctgtttaaagggtatccatttgcctatgtcaaacagactcatgtaaaatggaacattacagatgcttttccaaatgagggggatctgactaaagtttttccaccggaagaagagctgaaagattcatatacctatgaagggaagcaatatggagtgcgtcctgccataggagccggtatctatcttcggcacgtatggggtaagattgtgccggctttttacaaagatccacaggagaatcatactgcttatgcttacacgtatgtctattcttctaaaacacaggaagtaggcttatgggctgaatttcagaattatggacgttcagagaatgacctgccgccattgccgggaaagtgggattataaagaaagccgtatttggattaatgatcaggaaatactgcccccggtatggtctgctactcatctcgtgaaaagctcggaaacagccttaggtaatgagaattgtgtggcacgtccgccactacgggttcatttgcataaaggctggaataaggtattgctgaaactgcctgtcggcaaattctcaacgaatgaagtacgattggttaaatggatgtttactgcagtatttgtgactcctgacggcgataaggccgtagaagggctgatctattctccggaaaagaaaatgtaattgacttttatatgatgaaaaatgtattattgattgttgtttccatcttgtttattacagcagcgagtgcacaggaaaatcgtattaaagttgcctgcatcgggaatagtatcacctatggttatggattgcccgaccggactacacaatcgtatccggtgcaattacagaagatgttgggagagtcttatcaagtcgaaaacttcggcaaatcgggtgctaccttgttgaataaagggcaccggccttatatgcagcaagatgagtatcgcagagcgatcgactttggcggagatattgtggttattcatttgggcatcaatgatacagatccccgtgattggtccgattatcgtgatttctttgtgaaagattacattgaattgatcgattcttttcgggcggctaattctaaagtccggattatgattgccagacttacgcctattgccgatcggcatcctcgtttcctgtcagggacacgtgactggcatggagaaatacaattggctattgagaatgtggcacgctataccggagtacagttgatcgactttcatgagccgttgtatccataccctttcatattgacggacgccgtacaccctgatcccgaaggagcgtttattatggctcagaccgtatattccgccattaccggagattatggcggactgaaaatgtcgttgctttatacagacaatatggtattgcaacgggatgttccgctgacggttcaaggaattgccaatgccggggaccgggttactgtaagcatagccgaccggcaaatgaaaacaaaagcaggtctgaatggaaaatggtcggtaacgctgcctcctttaaaggcgggtggtccttataccttaaagatctcaacggatgagacgggttttcaatatcaaaatgtgttagcgggtgaagtctggctttgttccggtcagtcaaatatggagtttatgctgaaacaggcttcgactgcccgagccgatattccacgtgccgtagatcagcaacttcgtttgtatgatatgaaagcacgttggcgcacaaatgccgtcgaatgggaggcgaacgtacttgattcgttgaatcatctccaatattataaggatacggaatggaaaaattgtactccggcgacagcttctgatttctcggcaattgcatactattttggtaagatgctaagagatagtctgaatgttccggttggattgatttgcaatgccgttggaggatcacctacagaagcctgggtagatagagctagtttggaatatcagtttcccgccattttaaaagactggactaaaaatgattttattcaggaatgggtgcgcggacgggctgctttgaatataaaaaagtcagcaaatagccagcagaggcatccgtatgagccttgttatttatatgagtcggggattcggcctttggaacagtatccgatacgaggagtaatctggtatcagggagaatcgaatgcacataattgggaagctcatgaaaaattatttaaactgctcgtgaatagttggcggaagaattggaatgatgcctgcctgcctttttattatgtacaattatccagtttgaatcgcccttcctggccttggttccgtgatagtcagcgtagaatgttgaatgaaatttctcatatcggaatggctgtatccagcgatcatggtgattctctggatgtgcatcctatctgtaagaaacctgtgggagagcgtttggcgcgaggggctttgaataaaacgtatcagaaaaatgtcattccttccggtcctttatttcgtggtgcaaacgttcgcggtgggaaagtctttttatcttttgattatggaaaagggatgcggagttcagacggaaagcctttacaatgctttgaagtagcggaatatgatggtatctattatccggcaacggctgaggttgtaggagaccaggtgaaggtgtatagtaaagaagtgccaaatccccgctatgtacgttatggctggcaaccttttacgcgggctaatctgatcaatcgggaaggactgcctgcttcgacatttcgtgccgaattttcgatgaaatgagatattttgtagcttcaataggaaatatttaacaaaaaagcaatatctttactccgttaatatctaatgcccccactatgatcttaaatttgacaggaaagatagccccgatagcatgtggattgctatgttgctgtagtatggtttatgctcaaggtaatgacacttcggaagtcatgctactggataccggttgggaattttctcaatcagggactgaaaagtggatgccagccacggttcctggtacggttcatcaggacctgatcagtcatgaattactgccgaatcctttttatgggatgaatgaaaagaaaattcaatgggtggagaatgaggactgggaatatagaacctcctttatagtctccgaagagcaattgaatcgtgacggaatccaacttatttttgaaggtcttgatacctatgcagacgtatatctcaacggctcattactgctgaaggctgataatatgtttgtgggttatacacttcctgtaaaatctgtgttgcggaagggcgagaatcacttatatatttatttccattcacctattcggcaaacgttgccacaatatgcttccaatggcttcaattatccggcggataacgatcatcacgagaaacatcttagtgtgttcagccgtaaggctccgtatagttacggttgggactggggcatccgaatggtgacaagtggtgtctggcgcccggttactcttcgtttttacgacatagctaccatatccgactactatgtcagacaattatcgctgacagatgaaaacgctcgtctgtctaatgagctgattgtaaaccagatcgttcctcagaaaattccggctgaagtaagggtcaatgtatcgttgaatggaactaccgttacagaagtaaaacagcaggtgacactgcaacccgggataaatcatatcactcttcctgctgaagtgacgaaccctgtacgatggatgccaaatggttggggaactccgactctgtatgatttctcggctcagatagcttgtggagatcggattgttgcggaacaatctcatcggattggtttacgaacgattcgtgtggtaaatgaaaaagataaggacggagaatctttttattttgaagtcaatggcataccgatgtttgccaaaggagctaattatattcctcaggatgcactgctgcctaatgttactacggaacgctatcagactttgttccgtgacatgaaggaggccaatatgaatatggttcgtatatggggtggtgggacatatgagaataatcttttctatgaccttgccgatgagaacgggatacttgtctggcaggattttatgtttgcgtgtaccccttatccatccgatcctactttcctgaaacgggtagaggcggaggctgtttacaatattcgtcgtcttcggaatcatgcctctttggcgatgtggtgtggtaataatgaaatactggaagctctgaaatattggggttttgagaagaagtttactccggaggtttatcaaggattaatgcatggttatgataaactgttccgtgagctgttgccttcaacggttaaagaatttgattcggatcgtttttatgtgcacagttcgccttatctcgctaactgggggcgtccggagtcatgggggacaggagacagtcataattggggagtctggtacggaaagaagccatttgagtctttagataccgatttgccgcgttttatgagtgaatttggtttccagtcatttccggagatgaaaactattgctgcttttgctgctcctgaagattatcagattgagtctgaagtgatgaatgcgcatcagaagagtagtattggtaattcgttgatccgtacttatatggaacgtgattatatcattcccgaaagtttcgaggattttgtgtatgtcggattagtcttgcaaggacaggggatgcggcatggactggaagctcacagacgcaatcgtccttattgtatggggacattgtattggcagttgaacgacagttggccggtagtatcctggtcaagtattgattattatggtaattggaaggcattacattatcaggcaaagcgtgcttttgcaccggtcttgatcaatcctatacagcagaatgacagtttgagtgtctatctgatctcagaccggcttgatacaatggagcaaatgacattggaaatgaaagtcgtggattttgatggaaaaacgctgggtaagaagatacaagtacattcgttggaagttccggcaaatacttcaaaatgtgtttatcgtgcaaaactggatggctggctgactcccgaagactgccgacgtagcttcttgaaattgatactcaaagataaatcgggacatcaggtggctgagagcgtccattttttcagaaagacgaaagatttgcaacttcctccgacatcagtatcctatcaaatgaagcagacggatggtaaatgtgaattgactctcttttcatcaatgttggcaaaagatatttttattgagactccattgcaaggagcccgttacagtgacaacttctttgatctcttacccggagaacgtaagaaagtaattatcacttctccccggataaagaagggagaagaattacctgtcaatatcaagcatattcgagaaacctataaataaaactaatttattaactactaacacctaatttttattttatgaaacaactcctaaaattaacaggatgtgtggcactggcaggactgatgagctcttgtggctcggtacaagaagaagccaattatcagattatcccattgccacaagaaattgtaacatcgcaagtaaacccctttattttgaaaagcggtgtgaaaatcctttatccggaaggaaatgagaagatgcagcgtaatgcgcaatttttggctgattatctgaagactgcaaccggaaaagacttttcgattgaagccggaactgaaggtaaaaatgctatagtgctggcgttaggctcagaagtagaaaaccctgaatcttatcagttgaaagtcaccgatcaaggtgtcacgataactgcccctacagaagccggagttttctatggtattcagactttgcgtaaatcattgcctattgctttgggtgctgatgtagcattgcctgctgttgaaattaaggatgctcctcgtttcggttatcgtggtgcacatttcgatgttagtcgtcatttcttcacaattgatgaagtgaagacttatattgatatgctggctttgcacaacatgaaccgtttgcactggcatatcactgacgatcagggatggcgtctggaaatcaagaaatatccgaagttgacggaaataggttctcaaagatcgggaacggtcatcggacgtaactccggtgaatatgacaatacaccctatggtggattctatacacaggaacaggctaaggaaattgtagattatgccgcagaacgttatatcactgttgttcctgagattgaccttccgggacacatgctggctgcccttgccgcttatccggaattgggttgtaccggtggaccgtatgaagtttggagacaatggggagtagccgatgatgtactttgtgccggcaacgatcaggttctgaaattcctggaagatgtatatggcgaattgattgaaatcttcccttcagagtatatccatgtaggtggtgacgaatgtccgaaggtaagatgggagaaatgtccgaaatgtcaggcacgtatcaaagcgttgggcttgaaatcggataagaatcatagtaaggaagaacgtttgcagagtttcgttatcaatcatatagagaagttcctgaacgatcacggacgtcagattatcggttgggatgagattctcgaaggcggacttgctcctaatgcaacagttatgtcatggcgtggcgaaagtggaggtattgaagctgccaagcagaaacatgatgtgatcatgaccccgaacacttatctgtattttgattattatcaggctaaagatactgagaatgaacctttcggtatcggaggttatttgccgatggaaagggtgtacagctatgagccgatgccggcttcccttactccggatgaacagcagtatataaaaggtgtacaggctaatctctggacagaatatattgctactttctctcatgctcaatatatggtcttgcctcgttgggctgctttgtgtgaagtccagtggtcaacacctgataagaagaactacgaagatttcttatctcgtcttccacgactgattaagtggtatgatgcagaaggatataattatgcaaagcacgtatttgacgtaaaagcagaatttactccgaatccggctgatggtactttagacattacacttactacaattgacaatgcgccaatccactacacgctagatggtacagagccgactagtacttctcccgtttatgatggcgctttgaagattaaggaaaatgcagacttctcggctatagctattcgccctactggaaatagtcgtgtcgtttctgagaaaatcgatttcagtaaatcaagcatgaagccgattgttgctaatcagccggtgaataaacaatatgagttcaaaggtgtctctacgttggtagatggcttgaaaggaaatggtaactataaaaccggacgctggattgcatttagaggaaatgatatggatgtgactattgatctcaaacaaccaacagagatttcaagcgttgccatttctacttgcgtagagaagggagattgggtttttgatacaaggggactctctgtagaagtttcagaagacggcacaaacttcacgaaagtggcatctgaagcttatcctgcaatgaaggaaactgataaaaatggtgtttatgaccataaactaacatttacacctgtaactgcacaatatgtgaaagttatagcttcacccgagaaaagtattccggaatggcatggtggtaagagttatccaggctttttatttgtagacgaaatcacaattaattaatgaatataagaaagagatacactaaagtttgtcttttcttatgggtaatcgggatgtgtctttgtgcacatcccattaatgcacagtccgtaattcctgttcccttaaagatggaacagggtacgggctcttttttactctctgaaaaaacaaagctttatacaaacttacaaggagaagaagctattcttctgggcgactatctgaaaactgcattacctgtacaatttaaggaagggaaaaagaaagataaacagaatgtcttgtctttattgataacagaaaagaatcctcagttggtgtcaccggaaagttatatattatccgttactcctaaacatattctgattcaggcttcttccggtgctgggttgttttatggaattcagacactgttgcaattatctcagctttcgggcacgggttattctatagtttctgttgaagtacaggatacccctcgttttgcttatcgtgggatgatgctggatgtctcccgccacttcttctctaaagaatttgtgaagaaacagatagacgcattggcattttataaactaaaccgtttgcatttgcatttgacggatgcggcaggatggagacttgaaataaagaaatatcctttattgacggaatttgccgcctggcgtactgatgccaactggaagaagtggtggaatggcggacggaaatatctccgttttgatgagcccggtgcttccggtggttattatactcaggatgacatgaaggagattattgcatatgcgcagcagcattatatcacaatcattcctgaaatcgagatgcctgctcattcagaagaagtattggctgcttatccgcaactctcctgttcgggtgaaccttataaaaacgcagatttttgtgttggaaatgaagaaacattcactttcttagaaaatgtgcttactgaagtaatggagctttttccatcggaatatattcatgtaggaggcgatgaggctggtaaggcggcttggaagacttgtccgaaatgtcagaaaaggatgcaggatgaacatctttctaatgtagacgagctacaaagctatctgattcatcgtattgaactgtttctgaatgcacatggacgtaagttgctgggttgggatgaaattcttcaaggtggtctggctcctaatgctactgtaatgtcatggcgtggcgaagagggaggtattgctgctgtccgttccggtcatcaggcaattatgactcccggtcaatattgttatttggatagttatcaggatgctccgtattctcagccggaagccatcggaggatatttgccattggagaaggtttattcatataatccggtttcagattctttaactgtagaacaggcaaaacttgtttatggtgtgcaggcaaatctatgggcagaatatatccccactccggagcatatggaatatatgatatatcctcgtatccttgctttggcagaagtggcttggtcggcttccgaacgtaaatcatggacagactttcataatcgtgcattgaaagcagttgatgatttgcaagcgaaaggatatcatacttttgatcttaaaaatgagataggaagtcgtccggagtctttgaagccgataagtcatttggctgtggggaaaaaggtgatttataatgctccgtatagtcctcactatcctgcgcagggaaatacagctcttactgatggtattcgtggcgactggacttatggagatggatcctggcaaggttttatcgataaaaagcgattggatgttaccattgatatgggtacggaaactgctgtccattctgtctctgctgattttatgcaagtggtaggggcagaggtctttttgcctgaatctgtcactatttccatttctgatgatggagcaaacttcacagaattgaaacaatatacttttgaagtaaatagaaaagaagctattaaatttattagtatttcatgggaaggcagtgctgaaggacggtatatacgttatcaggctcgtgccggagaagagtttggcggatggatatttacagatgaaatagtagtgaaataatcagatgtataatttatgactataaatattagatacttattaggaatagccctccttttttctttctctgtgatcagtgcacaagtacgaacctcgtatacttttgagaaagggtggaagtttacacgtgaagataatgctgattttattcagcctgactataatgatatcaagtggcaatctgtggtagtaccccatgactgggctatttatggaccttttggtatagataatgacaggcaattgacagccattgcgcaagacggacaaaaagaagcgatggaacatgccggacgtacaggtggtcttcctttcgtcggagtgggttggtatcggctgaattttgatgctccctcttttgtcaaagggaaaaaggctacattaatttttgacggagctatgagccatgctcgtgtgtatattaacggtcaggaggctggttattggccttatggatacaataccttttatctggatgtaactccctatctgaaagaggggacaaagaatactttagctgttcgtttggagaatgagacagaatcttcccgttggtatccgggagccggactttacagaaatgtacatctggtagtaacggaagatgctcatattccgacatggggtacacagttaactactccggtagtgaaggatgattatgcgaaagtgaatataaaaacgactttggtcgtaccttccggaaaacagtttgatgcataccgtatagtgactgaacttaaagataaggatggaaaagtagtaactactgatgaaaaacaaggttcccgttttgatgataatatcttcagccaggaacttgttgtcagtcgtccggctttatggagcccggaaactcctgttctttatcaggctgtctctaaagtctatgaaggcaatatactgaaggatgaatatacaacatctttcggtattcgtactattgaggtcattcccaataagggctttttcttaaatggaaagagaacttcattcaaaggcgtatgcaatcatcatgatctcggccccttgggaggcgctgtgaatgatgctgctattcgtcgtcagattcgtattttgaaagatatgggttgtaatgcgattcgtacttctcataatatgcctgctcctgagttaatcagagcttgtgatgagatgggaatgatggtgatggcggaatcgtttgatgaatggaaggctatgaaggttaagaacggctatcgtcatgtttttgacgaatgggcagtaaaggatttgacgaacttgctacgtcattatcgtaataatccgagtgtggtgatgtggtgcatcggaaatgaggttcccgaacaatgggatggaaataaaggacctaaaatgtcttattttctacaggaactttgtcatcgtgaagatccgacacgtcctgtcacacaggggatggatgcgccggatgctgtagtcaataataatatggcggcagtaatggatattgcgggatttaattataggccacataaatatcaggagaattataaaaaacttcctcaacagatagtcttgggtagtgagactgcttctacggttagttcgcgtggagtatataaattccctgttacccggcaatggatgaagaaatatgatgatcaccagtcttcttcttatgatgtggagtcttgttcatggtccaatctgcctgaggatgattttattcagcatgaggacttaccttattgcataggagagtttgtttggacaggattcgattatctgggtgaaccgactccctattatacagattggcccagtcattcttcactatttggaattatcgatttagcagggctgcccaaagaccgttattatctctatcgtagtcactggaataaagaacaggaaacacttcacattcttcctcactggaattgggaaggacgagagggagagataactcctgtctttgtatataccaactatccttcagccgaattattcatcaacggaaagagccaagggaaacgtaccaaagacctttccgtaaccattgataacagtgctgactctgtttccatcatgaacctgaagcgtcagagccgttaccgcctgatgtggatggatacaaaatatgagccgggtacggtgaaagtcgtggcttatgatgctgacgggaaagctgtagctgaaaaagaactccatacagccggtaaaccggatcatattgaattggtagccgatcgtaatgtaatcaaagcggatggaaaagatttatcttttgtgacagtgcgagtggtagatagagacggtaatctgtgtccggatgcctcacatgaaatcagtttcaaagtgaagggagagggtagttaccgtgcaggagctaatggtaatgcagcttccttggaatctttccagcatccgaagatgaaagtcttcagcggtatgatgactgctattgtatcttcgacagagcaaccgggcaaaataacccttgaagctacgggcaaaggcttgaaaaaaggagccttgatcattgaaagctgtcaggaagctaagaagtaagaaatatcgttgtaatatgtgtaattcctctaagtgtttcattgcgatacacttagaggagtttttgtttaagcaggcaggagtttaacatctttgcaggcaaaataaaagctgtaaaagtatgttcttttattaaattgtattacttttgcatcgttttagtactgtatccgtttctctatgaaccttggttcttatatggagataagataaaaaggctaaatccttaagagatgcgctactgcttcataaatggatttcatttatgaaagtcagggcgcttttgtcttttaagtaagtgatgaaataaaaaacaaggggtaatgggtgataatgaatgatttggacaaagaacgacaaacagagggaaggaaggcatggtatgctgtacaaaccttctattgtaaagaagaacatttggggaaatatttggaaaaaaaaggggtaaattattttattccgatgcgatatatcgagcatgagacgcttgatggtaaaaagcatcggaaactgactccagctgtacacaatctgctgtttatcgagaaagaatttacggaaaaagaacttttagaaagggtaaaagattgtactataccttttttgcttgttcgtgaccggagtacacggcggtgttatgagattccagactgtgagatgttggaattccgtgccgtatgcgatcctaattataaaggaactctttatgtcgatacagtaacagcagaagcccgtcccggacaagcagttcgggtgatccgtggcccgtttgccggacttgaaggcaaactcacgcaatacaagaagagctattacgtagttgttacgttagctactatcggcgtcatgctacatattcccaagtggtattgcgaaaaaatcaactaatcataacattacgatcatctgctcaacaccttgttgtcggacacttcatgtttgacctttagaactgtttttttaatctcggaaggtaatctatttatttaataaaatattcatttttttgagtggaaggatatataccctgccactcaaatcttgagtactaataacaaatcaatgaaaggaattgttttagccggtggttcaggtactcgtttgtatccgatcacaaaaggagtgagcaaacaactgctccctatctttgataagccaatgatttattatcctatttcggtattgatgttggctggtatacgtgagattctgataatttctactccttatgatcttccgggctttaaacgtcttttaggagatggctcagattatggtgtacattttgaatatgcagagcaaccttctccggatggattagcccaagcatttattatcggagaagaatttatcggtaacgattccgtttgtctggtactaggtgataatattttctatggtcagggtttcacccatatgctgaaagaagctgtgcatactgcagaagaagagaataaagctactgttttcggatactgggttgccgatcctgaacgttatggtgttgctgaatttgataaaatagggaatgttctgagtatagaagaaaaacctattcagccaaaatctaattatgcagtagtcggtctttatttctatcctaataaagtggtggaagtagctaaaaatatcacaccatcttcgcgtggtgaattagagattacggcggtgaatcagcaatttctgaatgatcaggaacttaaagtgcagctgctaggtcgtggattcgcttggctggatacaggaactcatgattctttatccgaagccagtacttttattgaagttattgagaaacgtcaagggttgaaggtagcatgcttggaaggtattgccttacgtcatggatggattactactgataaaatgcgcgaactggcccagcctatgctaaagaatcagtatggacaatatttgttaaaggtaattgatgagttaacacagaaataaacttaatacttaattttcaaaataatcacagtggaagttattaaaacagctatagaaggtgtgttcattattgaacctcgtttgtttaaggatgatcgtggctatttcttcgaatctttctcgcaacggaaatttaacgagaaagttcgtaaagtgaattttgtacaagataatgagagtaagtctagttatggggtgctacgaggtttacattttcagaagcctccttatgcacaaagtaaattagttcgtgttattaaaggtgctgttttggatgttgcggtagatattcgcaaaggctcaccaacgtttggaaagtatgtatctgtagaactgacagaagataatcatcgtcaattttttattcctcgtggttttgctcatggattcagtgtgctgacggatgaagttatttttcaatataaatgtgataatttctatgctccgcaaagtgaaggggctttggcatgggatgatcctgatttgggtattgattggagagttccggcaaatgagattgttttgtctgagaaggataatcatcatgaattattgaaagatgcttcttggttgtttaactataatgaaagtctatattaaataatgaatattctagtaactggagctaatgggcagcttggtaatgaaatgcgatgcatagcagctacaagtttgaataattatatatttactgatgttgcagagttggatattacagatttagatgctattcgtaatatgatacatttggataatataaaggtaattgttaactgtgctgcttatacgaatgtagataaagcagaagatgattatgatatggcagacttattgaataataaagctgtagagaatttggctattgctgcaaaagaagttaatgctactttaattcatatttcgactgattatgtatttcaaggtgataagaatatgccatgtggagaagactgtgaaactaatcctttaggtatttatggtaaaacaaaaagagcaggagaacaaagcatccaacgtgtgggctgtaattatttgatttttcgtacagcttggctgtattctcaatttggtaagaattttgttaagactatgcgacagttaaccgctgataaagataaattgagagttgtttttgatcagattggtacacctacatatgcaaaagatttggctgatattatttatagagtgattgagggggatcaatatcacaaacaaggtatctatcatttcagtaatgagggtgtttgttcatggtatgattttgctaaagaaatctgtgaattgagtggaaatagttgtgatattcaaccttgccatagtgatgaatttcctagtaaagtaaaacgtcctcatttctcagtattagataaaacaaaattgaagctggcttttggtgtagagattccttattggaaagattctcttgtgaaatgtattaataaagaaaataattaatcatgaaattctcaagaaatataatgatcactggtggtgctggtttcattggtagtcatgttgtccgtctgtttgtgaataaatatcccagctatcgtattatcaatttggataaattgacttatgctggaaacttagctaatctgaaagatattgaagataagcctaattatgtttttgtaaaggctgatatctgtgattttgaaaaaatgatagagttgtttagtgagtataagatagatggggttattcacttggcagctgaaagtcatgtagatcgtagtattaatgatccttttacttttgctcgtacgaatgtaatgggaaccctttctctgcttcaagcggctaaattaacttgggagtctctttctgaaggttatgaaggcaagcgtttttatcatatatctacagatgaagtttatggtgcattggatttaacgaatcctagtggcaataaggacggtaggggaccttatggtcatgatttttttaaggaaaccacgaggtatagtccacacagtccgtattctgcttctaaagcaagtagtgatcattttgtacgtgcttttcacgacacttataatatgcctacaattgtaacgaattgttccaataattatggcccttaccaatttcctgaaaaacttataccattattcatcaataatattcgctgtcgtaaaccattgcccgtgtatggcaaaggagaaaatgttcgtgattggttgtatgtaatcgaccatgttcggggcattgatcttatttttcacaaaggtaaaatagcagagacatataatattggtgggttcaatgaatggaagaacatagatattattaaggttcttattaaaactgttgataggttactaggttatcccgaaggttattccttagatttaattacatatgtttctgatcgaaaggggcacgatctacgctatgcaattgactccgctaagctgaaacaagagttaggctgggagccgagtttgcagtttgaagaaggtctcgaaaggactgtgagatggtatttagataatgaggtatggatggacaatgtgacaagtggtgattatcaggagtattacgattccatatataggaatgaatgaatattctcttttatat

SEQ ID NO: 124 - DNA, 23628 bp, Bacteroides thetaiotaomicron
gcatattaatatatagtacgtgtacctataatagcaaagaagatgaagagaacgtctgctggattcagcaggaattcggtgcggagctcttgcctctggaggtgcggaacgagtggaatataacagggaatttactcgatggagaggatgagtctcagggaagtttgtctgtttgtcattttcttcctcataagacaaaaggcgaaggattctttctggcggcacttcgcaaaccggattcggaagatgaaccggcagcctattcattctcaaaagcaaagtcgtccaagaaaaaagataagaaaggtggagcggctgcttctcccgtttccaaagaacacatggggatggcactgaactggctgaagcaggaaaatgtcgaaaaatacaccctgtctgcggaaggcgcgggcatcgtcgcatttccgcaacgatataccgatgaactggctgccatgaaacagcatctgaaagtgatacaggcaggcgttctgactggtgaagtgaaagggagagatttgattcccgctcatgcgttggcaatgagcgctacgctcttgcggcaggatgcttttgatacggaagaggtgagttatgaacaggctatcgcttatttacgaaaagaggctattaccttgtcggaaacagcccctcgtggttatatcttgcttacttaccggaatattcctctcggatttgtgaagaatatagggaatcgtgccaataatctttatccgcaggagtggcgtatccgcagcgggtatttgccggaggagatacgtacgctgtaaagattatttccgaaagaaacggacaacggatagaatgcttatcttgatagctcggctaatttatcatccataatttagggaagtattccagtgggtatttccttataattcagaatgaaaccgacctgtctgcctgttcccggttctgctccttccgttatttcttccagtgtgtaggccggaggcggggcaggtgatgtccgtgtttctccaatgggcggcgtgccccagttcagatgtaagttcttgtccagccggtgaagcaggtacgtgtttccccatacggtgaaatggtgttccgtagccggtgaggcatccaatgagaaagtaagggtcagtgtggctttgttctcgtcctcttgcttcagtgcataagttcctttggtgatcagttcgagtcccgatgaaaaagcggttcgttgtccttgtttgaagaaataagcgtcacgggcagcgttgctgacaaggaaaatgtcgtcaacacccggcagtaggttctcgtccccattgggacgcagggaggacgagccgtgtatcagattgagatcttcgtagtagtccaccactttaatgggcagagtgagcgtttcctgtgtggcgttgtctgtcactttcagatacgtgcttccggtgagaatgccggatatgtaaatcattcgtccggcgggaactccgctccagccgctttcgattccggcacttgcgatgcggggatttccgatttccaaagagtagtctccgtttccgctttcgattccgaggtagcgtcttcctcccatgggcacttcgtatttgctgtcgtaaaaccgcaggggggcatcggcatcgtctttacaggcactccataaaataagaatgcaaaacaagatgggggtgtaagagagggttttagttttcataatagtttagtgttttttacagtccccaaatgtaatgcattctttttatttattcaataatcgggcgaaataaagcgggaatttatagcttgctcttataaattcgtgccattgccttctgatattgattctccagttggaggtaattctgatgactttgataaatgacggatacctcgacaaaatactcgatcatgctgatctgtccgcctgtcagagcctgtttcagcagtgcgaggtcttgttgcgcctgaaaagttttcctgtattcctccatagaggtgtgcagcgttttggcctcccggtagagctgtgccagttcggattccacttgcagggtggcgttgtctttctgcaagtcgatgttcagcgcttgcgctttggctattttcaccttgttgcggttctcgaaaagcgggaaggagaatcccactactactccgttgaaaggcgttcccgtttcggtgttccggcggtagccgagttccagtttcggcagccattgcgacttgttgacggcgatctgcttgcgggcaacgaggctttcgttgttgaacgccattaacgtgcggtcggcggagagcacttccgatttcagtatctgatagtcggcagggaaaggcgtcgcgggatacgtgctttcttcgaacactacggggatattgccgtttaacgtgttcagttcctgcaacttattacgcagtgccgtctcgttcagcgaagtttccgtcttgacattcagcagttccagattgattttattcgtttcgagggcgttcgcgtctccggtttggaggcgcttggcgtacattttggcaagttcttccgcgttgcgcagccgttcctccaagatgtgtttttgctggcgcagcatgataatgtccagacacacttctttggcgagcaacaatttctcttggcggaagacgtccgcctgactgtcaaaagcacctgctttcagacgattcagcttgttgcgggtggcatacaggctcggaaagtcgaaactttgtgacaccacaagttcgccgatcgtttcgtttttatctttcgctccccagaggtgggcgtatgataaagtcgggtccggcaggttattgtccgttttggcttccagcttttgcgaggtgatgagttgggcgtttgcttgcaactccttattgttggcttcgatattcttcaaaacctgttcgatgccgctttgggcctgcacttcgcccgtgagggtgagaagtgcgcagcttaccaaagagcctatgatgatgattcgtttcatactttttttatttgtttctatatacatagtagctacatttaactgataattatgcctgttccgccggtacgccgcacggagaatttgctccggcgctacgctggcggtgcatcatcagataaacaatcggaacgatgaaaccgttcaggaaagtagatgttaaaagtccgcctaaaatcactttggccatcgggctttgaatctcgttgcccggcagatcaccgcccagagccagcggtatcagtgccagcgcagaggagagagctgtcatcaggatcggattcagacggtcgagagagccttgtaccacgctgtcgtatacgttcagtccctccacttgctgcaagtggttgtagtggctgatgagcagcataccgttgcgggtcgcgataccgaacagcgagatgaaaccgataattgccggaatgcttacttcgccggtcgtgatgacaagcgcaaaaacgccgccgatcaatgccagaggcaggttcagcaagatcacgccggactccttgacgctgcggaactcgtggtaaagcaacaggaaaataatgacaatactcatgaaagatgtcagcgccaatacacggctggcagcctgttcgctttcgaactgtccgccatactcgatgtggtagccttcgggcaactggatagtggcgtctacctgcttctgaatatcattgacaacactgcgcaggtcacggtcggcaacgttggcggagataacgattttccgttttacattttcgcggttgatcgtgttcggtcccatggaggaaaccacttccgccacgtagttcagaggaactttgcgtccgtcgttggtgtcgaccatgaggttgcggattttctccatttcgtcgcgtgcgtcgtccttcactttgacgatgaggtcgaaactcttgccctgctcgtacacttgcgaaatcacttttcctgccagcgccacattcacgtattcagaaaactccggcagggtgatgccgaatttcgccagcatttcccgtttgggctgtatcttcagctgcgggcgttcgatttgttgttccacgttgaggtcggcaattcccggaatgtcgctgatagctcccttgatctggttgcccagcgagaacatcttgttcaggtcgtctccgaagagtttgatggcgatatttgccttcgtaccggacaacatcgcgtcgatacggtggctgatgggctggccgatttcgatgtttgctccggtgatcgttccgagtttctcgcgcacttcggcgacgagttcgctgcgcgggcggtctttcagttcaaacggtgcctcgatttccgaaacgtttacgccgagcgcgtgttcatccagttcggcacgtcccgttttgcgggctacggtttgtatttcggggattgtcagcagcaattcttcggcacggtgtcccatcttgttgctttcttccagagatatgcccggcagcgaactgatattgatggtgaacgagccttcattgaacgaaggaaggaagctgcgcccgagcgtaaagaatacccctaaggcgatcaggaaaaggacgatggtgctgccgagtgtcacccgtttgtgagccagcacccatgtcagcgccttttcgtaaatgcctttcatccagcgggctacgaaagattctttcagttccttgttcgtcttgttgctgcccagcaggtaagagcagagcaccggagtcagcgtgagggcaacgaccgtggaagcgaacagcgccacgatgaaagcgatacccagcggtaccagcatacgtccttccattccactcaggaagaacagcggcacaaagctgacgacaatgatcagcgttgaattaagaatcggcattcgcacttccttcgaagcgttgaataccacttcgagcgtgctgaagcgttcggcttccgccttctgacggttctcccgcagtcgcttgtatacattttccacgtcgacgatggcatcgtcgaccagcgaaccgatggcaatcgccatacctcccagactcatcgtgttgatagtcagccccatgtagtgaagcgtgaggatggagacgagtagtgaaagcggcagcgtgacaagggaaatcagcgtagtgcgtacattggccaaaaacaggaaaagtacgatgacgacaaagattcctccttcaaaaagagactttttcacgttgccgatagagctttcgataaagcggctctggcggaaaatatccgtggagactttgacgtccgcaggcaaatttttctgtaagtcttgcagagaggcctccaatttgtccgttagttccagcgtgctggtggcgggctgtttggtgacggtcatgagtacggccggtttgccacgctccgaggctgtacccagtttcggggctttgggacctattttcacgtcggcgatgtcttccagcgtcaccggaaagttgttcaccgttttcactaccgctttgccgagttcttccactttgggggtagagagtactccgcgcacgatatattcattgccaaattcgtaaagtacgccgccattggcgttcaggttcatgtcttgggtgacggccatcacttctcccatcgatacgccgtagtggcgcatccgttcggggtccaactgaatctgatattccttgatgtctcctccgagcactgccacctgtgccacgcctccggtggagagcaggcgcgggcggatcgtccagtcggcaatcgtccgcagatcgagcatggaggtggagtcggcggtcagaccgacgatgagcatttcgcccaagatggacgattgggggccgagagtcggcttgcccacgttgacgggaagtgactcgctgactacggcgagcttttcgctgacgatctgacgggcgaggtatatatctgtgccccagtcgaattctacccagacaacggagaaaccgttggtcgaagaagaacggacacggcgcacgccggtagccccgtttacagctgtttcgacggggaaggtgacgagctgttccacttcctcggctgccataccgttggcttcggtcatgatgaccactgtcggggcgttcaggtcgggaaacacgtctacttccgtgtgcatggcggtgtaagtccccgcaataagcaggaggatggccgcgcagagcacaaccagtcggttgtgcagggagtaatgtatgattttatttagcatgatatttcattgattaagtttggttcctcccggtttacttttgagcagtgccgggcaggggataaacttgcgtgactataaatgagttctgtgtgtgccgcaagagaacttggatgcggcaccttgccgctagtgctcatgactgtgggcagggatggcgttgcttgcgcttgccaggcgaacttggtatgcgccttcggtcactacacggtctccgggtttgattccggtcaggatttgtacacttttgccattgtcggcgccgagggtcacttcctgtttcttgtagccttcttcatcgagttgcaggtagacgaagaagatgccttgctcttccgtcagggcggtgcggggcacggatatcacgttttccagttgggaggaaagcagataaacttcgacgaatgatcccggaatcacttctcctttattgtcaaattcgaaggtgacgggcacgtagaaagagttgtctccggaagttttcccgaaggaaagcagtctgccgctcagttcattcagttcgtagacctcattattataaggtgtccggaaattggcggaactgattgtgcggagatacgggtagtatttttccgatacttcggcacggaggaaaagccggcggttctgtgtcacgctgaccagtggctgaccgatggttacgtagtctccctcattgaccagaatacttttcacgtatccggcaatgggcgcggtgatattctgaccgatggccgagtggtttttggcgagcgcttcgtagctgatacgggcgttttcgtagttctgctccgcctgtgcgaaatccttatcggacacaatcttgtttttgacgagcgacttcattcgttcgtattcctttttggatacttcgtaagcgattcgggcacgttgtacggggtcaccgtcggcgatgttgtgcgaagaaatagtcaccagcggagtgccgcgaccgacgctcattccttccgtcaccttgccgcggaaagaaacgactccggccaccgtggctacagccaccgattcgtcgccttgggcagcgagtacctgtccgcttgtcttgatgacttgctggaagggggccggtgtgatagcatttacctttacaccggcagcgttagctttcgctttcgggaggatgatttcatcgctgtgctcgtcggcgggttcgctggtggcagctttgccgtgatcgtgtcctccgctgcattcaccttcgtgtgaatggtcggctccttcggcttcgtggtcatgaccttccgcttcgtggtcatgtccttcgtgttcatcatgattgtgtgtgacggtctcgtggtcatgcccttcatgaccagtatttttactattgcaagagcccaggacgaataatcccatgactcctataaagataagtttcttcataaatgttgttttcctactaagttttactgtttttgtacgctacaaagatagagtaacgcagatgcaacttgcttgcatttacgtcattatgcaaaaacagagtagggaggggcccgaagtgaggaggtacgaggtattttcgtaccgtgcagggattcacgatagatgtagtaatttttgactcgtctttcctgcggtcgtaataaatgttcgatgatcgtatccgtaaacagggtggcgacgaatacgtaattcggtccgctgtccgtgtgcacggaggggatgggagagtggaagcgggtcatgcattcgctgctgcaacatgaatcgcttgcggggtgatgatggtggttggggcattgctgctctaccggttggtcctgcttcatgcagatcatcccgttggggtggtggtgatggggaataacggcggctaccaacataatgatgttgataaagaatagcatcgttactatgaatcgtttcttccctttcatcctttatttatatagagctttctaattttgtaaaacttccaatatctttttactttattatagagctccggttgttgctttattataaaacttcaattattctttttccgactctttacttttctctttttcttgcttctgcaagcgttcgagcaattctgtggcggagacgtaaatcacttttccatcgggcgtcccttgactgaggagttttccgtgacgggcatttctttccagtagccgttgttcggccagttggagcccgcgccgcagtttatcactcaattcttgcatttcattatttgacataactcttgatgcgattaaaaagttcaagttcgtatatccggtcctcaccttgctggcagccttcggctacaatcactcggggagaaacactgttatctgctaatagccaatagtctacacgtggcgcatatattcggaacaggttgtttatgcctgcctgatagcggcggtagattgtatcaatgggcacgttatgcccgccttcgttgacccgttgcaatacacggttgacagcaagttccggagagtttagccaaaaatagatcaggcttactttgtatccggcactctgtgctcttgtgatgagccgtgtgtacgagcgagtcgctaatgtcgtttcgatggagaaactggttcttgtagccaatagttcgtcaatacgtttcaacatcagacgtccggcttcgatagccatgctttccggattgaaaggcgatagtcctttggctatttcgtctgcattgacaaattctttgcacaataatatttcgggcagtacagtataagaagctgttgttttaccagctccgttgcatccgcttataatgtataactgcctcgtttcatccattttaaattatctgtttcagatattatgtgacaaatatacaaatactttttctttcacctaaagcagataatgtctttttattgtttattatttcttttccagttcctgcaacgaatccattttcttcttttcgaggaattcgtagatgccgcaaagatgctccgtcaccttcttattgccgaactcgtagaccttggtcaccagtccgtcaaggaagtcacggtcgtgcgaaacgacgatcagggtgccgtcgaaatccatcagcgcttgcttgaggatatctttggttttcatgtcgaggtggttggtcggctcgtccagaatcaggaggttgaccggttccagcaggagcttgatcattgccagacgggtacgttcgccacccgagagcactttcactttcttcatagactcttccggcccgccgaacatgaaggcgcccagcaagtcgcgtatcttgttgcggatttctccttttgccacgtcgtcaatcgtctggaaaaccgtgaggttttcgtccatcagcgaggcttgattctgcgcgaaatatccgatttgcacgttatgtcccagcgtcagcgtgccgtcatggtcgatttcgttcatgatacatttcaccagcgtcgatttaccttcaccgttcttgcctacgaaagccaccttgtcgccacgttcaattgtcaggttggcgttgcggaacacgacatgatcgccgtacgtctttccgacaccttccatcgtgacgggataactgcccgaacggggcgaaggcgggaatttcagccgcagtgccgaagtatcttcctcgtctacttccagcaattccagcttttccagcatcttgacacggctctgcacctgcaaagtcttcgagtacgtccccttgaagcgttcgatgaaggcttccgtttcggcgatgaacttctgttgctcgtcataagccttctgttgctgttcgcggcgttccttgcgcagttgcaggtattgggagtagtttactttatagtcgtagatgcgccccatcgttacttcaatggtgcgggtggtgatgttgtccacgaatttgcggtcgtggctgatcacgatgaccgctttgccgttattgatcagaaaatcttccagccattggatcgattcgatgtcgaggtggttggtcggttcgtcaagcaggagtacgtccggtttttgcagcagcagtttggcgagctcgatgcgcatgcgccagcctccgctgaagtcgctcgtctgacgttgaaaatcttcgcgtgtgaatccgagtccgagtaatgatttctctacatcctcttcgtaattggttgcgtcgatggagtaaaatttttcgctgagggcggacacttcctcgatcagtgccatgtaactgtcactttcgtaatccgtccgtgtttccagctccttgttcagtgcgtcgatccgtgcttccatctcgtgcagatgcgcgaaagcctgtgccgtttcggcaaacacggttctgccgtcttccgtcatcaaatgctgtgggagataggctactacgcaatccttgggggccgaaaccttgccacgggtaggctgtctgactcctgccagaatcttgagtaaggtactttttcccgctccgttttttcccatcagggcgatgcggtctttttcattaataacgaaagaaatatcactaaatagggtagtgccgctaaactctacggctagtccgtctatcgaaatcatacaattctttataatttgaggcgcaaagatagcgaaatatatcaatcttttttataacttgcgggctgaaaagcattattaactgaaatatgttgactaaaaagtaattttagagaataattttaaaaataatatagaaacgatatggaaggcggacaaacaaatgaattcagacctcttatcttagtggctgaggacgacgacagcaacttcaaactgatcaaagcaatcatcggaaagaaatgtgatatacagtgggccaagaatggcgaagaaatcgtggcactgttcaaggaatacggcaacgaggccaaagcgatcctgatggacatcaaaatgcctgtgatgaacggactggatgctacgaaaatcatccgcggagaaaacaaggaaatccctattatcatgcagaccgcctacgctttcagctctgacaaggagaatgcgatgaacgcgggagcgagcgaagtgctggtgaaaccgatcacactgtcgattctgcgcaatacgctgacgaagtatttccccgaactggtctggtaaaccgatctctttttttgtccggtagactgatcttttttgtttgttaaaccggtccttgctccggcaaacatgatctttatccggcaaaacggtatcgctgagtagaaaaacggtataacaattcgggtgttttttcctgttttgtatttgtgatattaacaaatagctgacggggataatatggatttttactatatgaaaatccacattatccccgtcagctgtgtccggacgtttctatgtcaatccggatattactgtatcaatccgggtgtattgtctggaatgcctctgcccgacactttcggcagaaggctgtaaaagtaaaataggcggacctcacggtcggcctatttctgttcgtttccgttaatttgttagagttcagaaacgactctatgtaaagtctctcctttgagagattttaagagcgatttttatcggcttccgcctgcccaccaaacgggttcggagtatacgtagtcaccgttgccgtaagcggctttcacttccgggttggcagctgtgtcgctgtttccgtatgggtagcgcagcgggaatttgctggaattgttcgggttggtcagcgtgatgaagttttcgttcagtcccttcatacgacggaaatcgttgtacgtctccgtggcttcaccggaggcaccccacatggcaaggtacttctgaatcattgtttcctgcaatgggttggctgcatatttcgctttcactacgtcgtcgaaatactttccggcagacgtttccgtgattacttcgctggaattggtgttcaaaccgcttcccaactccttgatggcaatgcttatgctgttttccgcattcagcaagccggctactaccgcttctttcagcgcgtcttccgcatcacggttcagacggcacagagcttctgctttcaggaacatcagttcgtgatagctcatcagcagggtcggtgcggttttggcgtaaacgaatgcagagataccgtatttggacgtactctgatccggactaccgttgggagccggaacgaggctgggatcgttggctgctacctgcgaacgttttttgtcgacgatcggagtgaagaaagcacggttggcacgcggatcattgtaggccaacagcttggtgccgaggcttgtactggctccgaatccggcacgagagttgtagaaaccgtagaacgggttgatgttgttagagtcgtagatgtcgaatgcagcctggtcgtcagccgaagtgaacgatttgcttacatagtccagcaccttttcataatcggccgatttgttgcttgagcggttgatcagtctcatggtgtagcgggctttcaggccgtaagcgaatttcagccatttgtccgcgtcgccggcataaaggaaatcctgctcggtcacgtctgccaagtcttctttctgaagattggcgatggcgtcgtcgagataactgatgatttgagtatagatttcctgttgcgtatccattttcggggtcatatagaccggagagcctttttcgtccaccagcgcagcctgactgcacggggcatcaccgaagaaatcggcaatcagtgcgcagttgtaagcggccatcacttcggccattccccgggtgacgtcgttgccgtgatctctgcctccttcgccacattggtcgatgatgatgcgggcgttcttcaatgaagaatagatgccgttccatgagttattgaaggtagacgaggacgacggttcgttttcgcggacttcggcgtagtaaagctggttgtcgacacctacttcgtattcgatatacgaagaggcgtatgtattgatgtcaccgctggcgttggagaaagcggtagaggtgattacatctgccaagataaatcttgaggcaacactggtggtgtggtcgtggtccttgttgattctgtccatcgtgtcctccgagcaagcagagaacaaagacagagcggcaacagccagtacaccggttattttatcatatcttttcataatcttctttcgtttagctaattagaattttacatttacaccaaaaccgtagcttgcagttcccggcagagagaaacgctcgaaggcacctcccatgttgtcgttaccctgagatgcttccgggtcgaatcccttcagctcggaccatacgatgaggttgcgggcaaatacgtttacatctacgtttagccatttgctggcgtataccgggtagcttacagaaagctcacgcagtttgatgaacgatgaatcgtagatataagattcgttgatagaacgcaggcgggtgtaataagcctgtgcgttagtcacttcgatgtcgttggcggcatacgtcgggttgccctgcgcgtctgttccggtttctttcacggtgttgggaacgacgaagttgctcttgcgtttttcgcccgattctttggtgacaccgtagaagttcatttcaccggcagtaccgcagtacatttgtccgccttgtttccagtcgaacacggcagcgatacggaatttgtaaagctcgatattcgtgttgaagcccagacggaagtcgggagaaacccggccgatcacgtcgtcttcgcccacctgcggaagtccgttcgcgtctaccacgatctgtccggccttgttgcgcttgtacgtgctgccgtatactacggggaatttctcgccgataccggcacgcacctgcggagtgacgaatccgccgagatagatgctttcaacacccggtgcaagttcgtctacgtagttgtcgatctttgagaagttgaaagcgaagtcgagcttgaagttgcggttgttgaccggcgacactcccagtgtaagttcgtgcgagttggtatgaatcttaccgccgttcatgatcatgctgtcgtagccggtagagccggacaaaggcacttcgaagatctggtcttttacgttctgacgcgagtaggtatagttcaaagtgaacagtccgttgaagaatgtcaggtcggcaccgatttcgtatgacttcgtgttctgcggtttcaggttcgggtcatacaccttataataagggatatatgccatcgttccgttgatcgggtaggcgatgggcgtgccgttgaagaatccgccgccgtagctcggggtgtagtaatagctttgcatatagtcgcctgccatacctacttcggcgtacgatgcgcgcagcttaccgaatgtgaggatgttgtttttcagcggttcgagttcggtgaacacaaatccgagcgatacggaaggataagtgaacgaacgattgtcgcgcggcatatttgaaacgacgtcgttacggattgttccgttgaggtataccatgtttttccatgccagagacaggttggcaaagttacctaccgtacgtttcttgttgtacgacttggaactctggtagatagaagcattgttgatgtggttccatcccgggaagttgaagttcatcccttcggagaaggcatattgcgttcttttctctacaagttcgttaccgatcagggcgtcgaatacccagtccttgttgatgtcccagcggtaagaagctgtcagcagcgagttcagctcgttgatgctgtagtggtattcgatggcgtcgccggtgtctgccattgtactgccgtatccgtagatttcgctgtagttggtggtgtaggcgtcgtcaccgagttggtatttcacgtccagtttgtggttgtccgtgccgaatttggtcgtgaatttcacgaatgcgtttccgaagaaacgttgcgagcgttcggtgaacagattgttgtccacagcccagtaggcgtcgtcgatccatgcctggcggtacgtgttctgctcgtacgggtcgccttcgacgtgcgaggggattcctttcatgttgtagctcaccggagcgttgtagatggtagccgtcacgccggagttggcggtagactgcttttttatcttggaagtcacgaagttaccgttgaagccagtcgaccagttggggctgagctgaacttcggcagacattttggcgttgtatctgtccataccggtagtcgggatgatgccttcctggtggctgttacccagcgagaaagagtagtttcctttgtccagattttgggaaacgttgacgttgttgctccaggtaatgccggtgtcgaagaaatccttcatgttgttgtatgctttcggcgttgcccacgggtcaagaccggcttcggcacgttggggcacgtagtattgtccctgacgttttcccattttctgggtgaaagcgttgtcggtgttgccgccgtatgtaggatcgttggcgaggtcggctattttcggtccccagctgtggccggaataagggtcgtatgagccgccgctgccttgtccgaattcgttttgcagttcgggcagtgtagacacgacatcgaacgaaagattgctgcggaatgtgatcgtcggtttgcctttggccactcctttaccgcttttggtggtgatgacgatgacaccgtttgacgcacgcataccgtagagggcagaagctgcctgacctttgaggatgttgatgctttcgatgtcgttggggtcgatgtccaccgaacggttggcgtagtcggtaccgtaggcggcgccgttagcgttgtcggtagtcgttacgtcggcagcggaagagatcggcatgccgtcgatgacatacagaggtgtattgtcgcccgtgaacgaacgggaaccgcggatcgtgatcttggaagatgcacccggcataccggaagagggagcgatgtccacacccgaaacttttccttgtagtgctcctgcaaggtcggtgttggccgcgcgtgtcagctggtctgacttcacgtcctgaacggcgtatcccagcgctttcttttcgcgggagatacccatggccgttactacgacttcgtctagtgacttggcgtcactttttaatactactttgataacgccttgtgtgatcgtaacagtttgcggagtcattcctacataggaaacgcgcaaagttttagaagaacttggtacggtggggagttgccctttcgggaagcgttaagtgtttttggggctatttaaggcataaaatgataaaaagataccatttcgaacgaatatctgatgttttttttatgaaaatagcggttttaacactttctttctgttaggtaataatgtttaaatgctgctaaatacgtctttagatttacttatttgatttattctctgattaaattctttcaatatgatactttatagttaaaaacgtaacacttttttaattttgatataaatagtgttatctttgcaccctgttagagactagaagtctatttataggttaaatttaagagagaatttatgaaaagaaaattgatgttctttatgaccttcctttttgtgggtataggtctggtgacagcgcagacgtcccgagttaccggtgtggtaaccgccgaggaagatggcctgcctgttgtaggtgcttcggtattggtgaatggcactactcttggtactatcacggatattgatggtaagtttacaatcacgaatgtaccaagttcttctaagacttattgatattttatagcctctctttttcctcctttttcgtcctatcttattgtaaatcagaatataagtgctgctttctgcaacttggcttcccggctcacttactataatcgcaaccttttccctttctttttcgatctcagtcatctttttcgggcaggtactcggcttgttttcaggggggcggatgcttaggttctacctttatttgaggctttctatgagcgataggggcagaccggtcttttcggcaatgagttgattgtcaattccttgctttttcatgtcgatggctgtctgaaagatgttcaaggcttcttcgcgacctttcttcaggccttcctcaagtccttcttcaagtcctttcttcagtccttctttcattccttctttcatccctttttttattccttccttttccgctgcatccattgtcaccaaataatcccggtacactttgacgctattatcgtatagctccctctcttttggggacatagaagccacatcagcgatctcttcgagtttttcgaagacggcttttcgtgccttgaatggcaggcgttttaaagtttccatattatttaatatataaatccaacgttcaaaattcgtttcacattcctcttcgctttttttgaagagggggagggcgatgaatatttgccggaatttctccgagaagagttcaccagtctccttgtctgcaagaataacgtctgtccggagttttatgttcttgtccatgatgaaattcatcagaaagactccgtaaacagcttttatttcaaatttccagtcgtgccccgtccggccctggttgacgatggcacgggagagatagaaaatggagcgttctttaaagttgctctgcatgcggttttgcatttcgacaattatcttttcgcccgtgtccgtggtgcagtagacatcgtagatgatgcctcgtccttccgggtagtccggcagctgctcgttgttcaaaaacgttaagtcggttatcactcgttcaccttcgagaaggtcgttcagaaattcgattagtaaatccttggagacttctctgccgaatattaatttgaatccgtagtcggtgaacggattgataaatttgctcattgttttggttgttgctcttttaggttgtaaagagaggtttctctttgcatacggtaaagaggctttttctttgtcccacaaagataggataaattattgttttatgatgcgtttggcgggagaaataaatgacgtgggcgctcaaaaatgctcatcttcctcttaaaaatgttcatcttcccctaactcgctttttgaggataccggtgtaggtgtcctcaaattctgccgggtgattgagcgcccagaggatgtagtcgcccggctcgttctttttgagcagggtggagcggtattcggagctgaggactttccataaggtgccgcacggaccacccagctttctgcgtcgggcgagggcgaggatgcctttcacggtttgttcgttccggatgccgatggcgtccatgttgaggcgcagcagggattcggagaatcctccggaagcaatgctttcgttcggggcttcttcctgctggtttctttcgtactgggttccgttgtgcttgggttcttcctgctggtttctttcgtactgggttccgttgtgcttgggttcttcctgctggtttctttcgtactgggttccgttgtgcttgggttcttcctgctggtttctttcgtactgggttccgttgtgcttgggttcttcctgctggtttctttcgtactgggttccgtttgggttcttcctgctggtttctttcgtactgggttccgttgtgcttgggttcttcctgctggtttctttcgtactgggttccgttgtgcttgggttcttcctgctggtttctttcgtactgggttccgttatgcttgggttcttctagctggtttctttcgtattgggttccgttatatctagcttctcccttctgatctattcctccatttcttctttcttccttattttcctcctccctttttccggacgagatttctaaagacaaacctttgacagcaacaggcgcagcctgagaaacgccgtttgacggaacgggcggctgctctctatctttctcccattcattttcggttttgctttgtctttctctctctttgtctttttctctttccggtttgatatcattttccatctctcttttcggtttgctttgaatctcagtatccgtttccgatttactttcgatttctgtatccgtttcctgttttgtttgtgggattgttgctgcaatttctcggttttttgcagcattaattttcatagctgctccgtcggtcactgtttttgtagcattgattcctgtgcctgctgcatggatgtctgtgcctgctgcatggatgtttgtgcctgtcgtgccgattcctggctttgttttagtaacttctgtagctgtgatattgactcctgtttttgttgtgttgactcctgcatctactatcttgttttccgcttcatccacttctgtaccttttgaatttatattgcttcttatgtctgcggaattatttcccgttccatccttttcttccttgatgagccaaaaccgttccagcggaagtttgtatttccttcggctgtcggtaatgattttgtggtattgctcttggatggcttgcgaagtcagaatcccgtactccttatatatataggtgtcgaacagtccgacggacaggcagtcgtcgatgatggcctgcatctcctcctcctcgcaacacacttcctgcgaaatgtcgaacaaggtatcttgattccatgcgacgtaaaatcccttttctttgtagatgaggcagagcagggaagtgagtgcggcaattcctgccgcatgatgacggttggaaatgcggcgtaccttcctgtcttggaagaagttgacatcgagcgggaaataatctaatccgggtttggaaatacgggccatctttttgaatatttagagtgatattgactgataaataatgaataaggcgaatcggtaattttaatttagctcatttcagtatggtgataagctacttgatagtcagttctgtatctcaactgagggtgactaaaaagtcgattctatctctattctcctccttcgggaaggaggagtggtcgcagaccgaggtggtaggagaaataatgtttatacctatttttttgtaaatgataggattatgcattcacctaccacctccccctacgggtactcctccttcccgaaggaggagaatagagttactattgcgtacaactactccctagaactcctttttcacatcgaagcagggacaggctttcatgtattcattgggtgagatgatgccgtctccgttgaggtcggggcttgtgtcccggtgtccgatgacctgtttcacgttggggaaggccagttgcagagatttcaccagtcggatgagggcggtgcgttgtgcatctgtccgtgtgtcggcggggcggccttccttgtccagtccgccgacgtagcagatgccgatggaacgctggttccagcccatacaatgcgccccgtcgagggtgacgtcccgtcccggttcgatggtgccgtcgaggcggatgacgtaatgatagccgatggaccagaagccacgggcacggtgccgcagtcgatgtcggcagcggtgatgtcctgtcccgcacgggtggcggaacagtggatgatgatggtgtctttcattgcagaaactcctttctttgtcctctttctctgggcaatatataagtgttgaaaccaaaaatggcggattcttcgggggacaggcggcggtaatagtgctgcgtcactgaatgatgtataggggcaaagagagaaataagaggaaaaggcgatgaaacaaaggaaaaagaaactggctgcacacatacattgcctgccttgaactccccgactgaattgctcgatttgcctatcccaagcggattacctgcttcgaactcctcgactgaattactcgatttgcctatcccaagcggattgcctgcttcgaactccccgactgaattgctcgatttgcctatcccaagtggattgcctgcttcgaactccccgattgaatcagctttgacggtcagcacaggtatttcgggtgctatcagaaagcattcttccgaaccgcttctttcggctcttgactttttcttcatggccgattgcttcagtctttcggggtgtaataaatgcagcaccagccaattacgttgtttagggttcatttgttccccttttaccagtgcgttcatggatggataggcttgcaggatatttcctgcctcgtccgttgtggcacaggggacgggggagagggcgggtgacgacggacgcagaccggtccggatggcgtgcatgacattgtcgtaggcatcgcaccattcgaggttggcgacgtggttgttgagcttgtttccgtcgaggtggttcacttgggggagacgcttcgggttggggataaaagctgttgccactaagcggtgtacagagtagccgacgtatatccccttttggcggatggccacgtactcataaccttttgcggtaatgctgctgctgattatcaacttcgatttgcctttgaaactcaatatccgcccgtggtctgaaaccatataatcggaatttgcttcgataaatctccaattttccatactttattctttatattgttaataaaattatacttcgttaaaaagaaatcccttttccgaaaccaccggggataaacggcgcagcctgcatggtagaaacggcgtagcctgcaaggtagaaacggcataaacaaggactgttaaacggcgtagcctcctcgctgacatgaggcggttccgcccgcttactccggtctttgacctttctcattcctcctctgcacggggttcgagccgttcggcacagcgaacgagaaactccagttcctcccgacacccttgaatggcttcgtacaaagagtccacatgatacattctgcaaagcgtttcccattcttttcgttcttctgaagtcatttgttctccgaaattcatttgctgtccaaaacttatctgctgtccgaaactcatttcaaaatttatctgctgcccgaaactcatttgctctccgaatctcatctgctcttcgaaactcattcgacgcaaaggaaattttcggcatgaaacgtgcgccaccctttggcttcgaggtcgtagtagactacaaacgtattttccggtcgtggcatataggggcggtgaaaactgtgttgatatccggtgagcgtgccgacagcgtggcgcacggttccgtcctgcttggtgtagcagaatttcacgttctccctgtgcatcttccttatcagtccaccgattcggtgggcgatgatgagcgcatcacgccggttcatgtcattgttgcgacggatgacggcggcccgcctcatgagccgtacccgtgggagggaatgttgttttttcatttcagtcatatgattcaattgttttttattgatttcggggcaaaagtagactgtgggtagaataaaaaccgttcacgcttgactaaaatgaaaaaatatgtagaaagagtcacgcgtgacccaaaatgttaaaggtaaatcccgaattttgtcggattaatttaaatataattagtaatgaacaaaaaagaaaactgccagaacagtagtgaaagagaacaacacattgaagtaaaaaggactgtaaatcagaaaagtacaagtcagaaaaaagtaaatcagaaaagcatgagtcaggaaaaagcaaatcagaaaagcatgagtcagaaaaaagcaaatcagagtggcgaaaagtccgtgtatgacgagaacagggatgcccttcaggaaagagtcgaagagaagcaatggaagaaaaagcaatgtaatggcttgcagcacagtgatgacgaagaaaaacagaaagtcatcgattcgattatgaaagtcagccgggataacggctttgacgacgcttatcttcagcagcattcggactgttcggcatcgtcgatcaagcgcttccactcggcctggatgggaaagagaatgtccaattggacgacgatttttaatttagcgcactgcgtgtccgtcaattgtgtctttgccgaaaatctggtcgggatgctggttgtcattattatgttcttgattagagatgccggaattgtgagttaccatatcgactcgcccaagaaagtggtgatagaaataaatttcggtaaagataaattattgcgcatgaaagacgaggaaaagaacgaaaaaggaaaagaaggtaaagacgacgaacacctttgagcgacgacaatgatcgggacaaaggaaagaacaactgacggaatgaggtaagtcctgtaagaacttggtagtctgtattcgtaaaaaaacgattcgatatcagcgatggacttccattttattcccttgttataatgtcaccacaaatgtaatcatattattgagaaaaccatgcagaaacgcttttattctgaaaaataagttttattgttcactcagatttcatattcgatgttgacatcctacgttttctcttttagatatttatttgttttcctttgtcggtttctaccgtattgcacgttcgtcattatttacaaattctaattattgcattctcagttcgggtaaaacgaatccgttttccgagctgagaatgcagatgacggcttttaataagtctgtttgtttttatttctttagtaatatattataaactggcagataagtcgctctaccaagttcttacagaacttacatttttgtatag

SEQ ID NO: 125 - DNA, 23554 bp, Bacteroides thetaiotaomicron
ctatattaatgtctttaataattatgaccatgacttacgaaatgcctaaacttccttacgcaaacaatgcgctggaacctgtaatcagtcagcaaacgatagatttccattacggaaaacatctgcaaacatatgtaaataatctgaatagccttgtgcccggaacagaatatgaaggcaaaacggtagaagaaatcgttgccaccgctcccgatggagctatcttcaacaacgccggccaagtgctgaatcacaatttatatttcctccaattcgctccgaaaccttcgaaaaaggaaccggcaggcaaactgggagaagccatcaaacgtgatttcggcagctttgaaaacttcaagaaagaattcaatgcagcagcagtcggattgttcggttcaggatgggcctggctgtcagtagacaagaacggtaaactgcatatcaccaaagaaggaaacggcagtaaccctgtacgcgccggactgaaaccacttctgggttttgatgtgtgggaacactcctactacctggactaccagaaccgccgcgccgaccacgtaaacgccctgtggaacatcatcgactgggatgtggtagaaaaacgaatgtaaccggactcattaaaattaagctaaactatactattgaaaaggtcgttgtgaatttcacagcggccttttttctagcataaaaaactaaactatctattgtatttcaaaggcataatttgtatttttgcaatagccgaaaatcaaaacagacaattatgacacttcagctaaaaaataaaaaatggcgcattgtctacgttatttcctttcttttattctcctttacaggcaatgcggctattccggaagaaccggaagaggagattcttttcgtgacgtcctataattccgatactaaatatacctacgataatatcaacacgttcgtagaaacgtaccgccaactgggtggcaagtattccaccatcgtagaaaacatgaatgttaccgacctcaatcaatccagaaaatggaaaaaaagacttaccaacattctggacaaacatccgaacgccaagctggttatcctgctgggtggcgaagcgtggagcagtttcctgcacctcgaagacgagaagtacagacaactgcccgtattttgcgctatggcatcgcgcaacggcatccgtattccggaagactctattgatatacggacttatgaacctcagagtatcgacttaacggaaagaatgaacaaatacaatataatatactgtaacacatatgaatatgatatcgataaggacatagaaatgatgcgaagcttttatccggatatggagcatttagtgttcatctcggacaacacctacaacggacttgccgaacaagcgtgggtaaaaaagaatatgaaacgctatccggaaatatcgacgacctatattgacggccgtatccacacccttgatgctgccgccaaacaactacgcgatgtccccaaaaattcggttgcactactgggtatctggagaattgacaatcggggcataacgtatatgaacaactctgtatatgctttctccaaagcgaatccagagttgcctgttttcagcctgactgctaccgccatcggttattgggcaatcggaggatatatcccccaatacgacggaatagggagaagcatgggagaacaggcttatcaatttctggacaaggggaaaaacaatgtcggccacattcatttgttgcccaacagatacaaatttgatgccaacaaactgcatgaatggggatttcaggacaagaaactacctttcaattcacttatcatcaaccaacaggtgcctttctttcaggcatatcggacggaagtgcaattcatcctgtttaccttccttgtactgataggcggactgtttatctcactgtattattattaccggacaaaaatcttaaagaatcaccttgagaagactacagcccaactaagggaagataaaaagaaactggaattatcggaaattgcactacgtcatgccaaagagcgtgccgaagaagccaatcaactgaaaagtgccttcgtatcaaatatgagccacgaaatacggacaccgctgaacgccattgtcggcttttccagcctgctgatcgataccgtggaaacaacggacgagcagaaggaatatgcggatatcatccagactaattccgaattgttattgcaactgatcagtgatgtactggatgtatcacgtctggaatcaggcaaactgctgttcaagtatgaatggtgcgaactggtaaatcattgccagaacatgatcacactgaccagaaagaaccggacaagagatatagatgtcaggcttcagatgccgaaagagccttatatgctctataccgatccgctacgtttgcagcaggtgatcatcaacttactgaacaatgccctgaagtttactcccgacggcggaagtatcacgctggattatgaaatagacgaagaagaccagtgtatgctgttctctgtgaccgatacaggcgcgggcatccccgaagacaagcaggaactggtattccagcgttttgagaagctcaacgaatttgtgcagggaacaggcttgggactggcgatttgcaaactgaccatacaacgcatgggaggcgatatctggattgacaagaattataagaacggagcacggtttgtcttttctcatcccatcaaaaagcgggaatcggaagaaaaatgaaaaaaaaacggataatttgatgaatctttgtttctttttcgcttactttgctcccgtaaagacaaaggggtgcccccaaagaggggctgagattataccctaggaacctgaggcagttagcactgacgtagggattgtgtttctttcttatcgcctttctatataagcacgctctttgtatttactttcaacttattaatactgataggacaatgaaagtacaagttaacaacaaagaggtggaaatgactcctgcttctacccttacacaactggctgcccaactggaacttccggtacaaggcatcgctattgccgtaaacaacaaaatgattccacgttccgaatgggagaaattcgcgttacaggagaatgataacctcgtggtcatcaaagcggcttgtggagggtaaaagtatggtcagtctacaatttatcacccaccagaccgatcggtatacttatttcgaatcggcactcatggcacttgaaggaggatgtaagtggattcagctacgcatgaaggaagctccgtgtgaagaggtggaagctgttgccctccaactaaagccgctctgcaaagaaaaagaagcgatcttacttctggatgaccacgtcgaacttgccaaaaagctggaagtggacggagtgcatctgggcaaaaaagacatgccgatagatcaggcacgacaattacttggagaagcatttattatcggaggtacggcaaatacattcgaagatgtcgtacagcactaccgtgccggagcggattacctcggcatcggtcctttccggtttaccactacaaagaaaaacctgagtcctgtactgggactggaaggttataccgctattttatctcagatgaaggaagcgaatatcgaacttccggtagtagccatcggaggaatcacccgtgaggatatacccgccatactcgaaaccggagtgaacggaatcgcgctttcaggaacgattcttcgggcggaggatccggcagcggaaacacgaaagattttgaacatgaaacgtataatcaaataaacttattgaaaagtggaaaagttagtaattgcaggccgtgagttcgactcccgcctttttctgggtacaggaaaattcaattccaatgaagtaatggaacaagccattctggcatcgggcactgaaatggtaaccgtagccatgaagcgcatcgacatggatgacaaagaagacgacatgctgaaacatattattcatccgaatatccagttgctacccaacacatcgggagtacgcgatgcggaagaagctgttttcgccgcacagatggcacgtgaagcttttggtaccaactggctgaaactggaaatccatccggatccgcgctatctgctccccgactctatcgaaaccctaaaggctacagaacagcttgttaaactgggctttatcgtattaccctattgccaggccgaccctgtgctctgcaaacgactggaagaagccggtgccgctaccgtaatgccgctgggtgctcccatcggaactaacaaaggactgcaaaccaaagaattcctgcagattattatcgaacaggccggtatccccgttgtcgtagatgccggaatcggtgcaccgagccacgctgccgaagcaatggaactgggtgcttctgccgtactggtaaataccgctatcgccgtagcaggcaatccggtagaaatggcgttggccttcaaagccgccaccgaagccggaagacgggcatacgaagcaggactgggtctgcaggctgataactttatagcagaagcaagttcacctttaactgcatttttggaataagtaataggtgataagtaataggtaataagtagggagtagtgtttgtttcactattcttaatgatatgataataaaattctatggaacaaaaaataaaattcccccgttctcagaaagtgtatctgccgggtaaactctatccgaacatccgtgtagccatgcggaaagttgaacaagtgcccagtgtcagcttcgaaggagaagaaaagatagctactccgaatccggaagtatatgtatatgacaccagcggtccgttcagtgacccgtcaatgagcattgatcttaagaaaggacttccccgcttacgtgaagaatggattgtgggacgcggtgacgtagagcaactccccgaaatcacttcggaatacggacaaatgagacgtgatgacaaaagtctggatcatctccgctttgaacacattgcccttccctatcgtgccaaaaagggagaagccatcactcagatggcatacgccaaacgaggaatcatcactccggaaatggaatatgtggcgatccgcgaaaatatgaactgtgaggaactgggaatcgagactcacattactcccgaatttgtccgtaaagaaatagcagaaggacatgcagtgctgcctgccaacatcaatcatccggaagccgaaccgatgattatcggccgtaacttcctagtgaaaatcaatacgaatatcggaaactctgccaccacttccagcattgacgaggaagtggaaaaagctttatggagctgcaaatggggaggtgatacgctgatggacctttcaacaggagaaaatattcatgagacacgtgaatggatcatccgcaactgccctgtaccggtaggcactgtgcctatctatcaggcacttgagaaagtgaatggcgtagtggaagaccttaactgggaaatctatcgggacacactgatcgaacaatgcgaacagggagtagattattttacgattcatgcaggtatccgccgtcataatgttcatcttgccgataaacgtctgtgcggcattgtcagccgtggaggaagcatcatgagtaaatggtgtctggtgcacgatcaggaaagtttcctgtatgaacactttgacgatatctgtgatattctggctcaatacgacgttgccgtatcattgggagacggactgcgtccgggctctatccatgatgccaacgacgaagcacagtttgcagaactggacacgatgggagaactggtacttcgtgcatgggaaaagaacgtgcaggcatttatcgaaggtccgggacacgtaccgatgcataaaatcaaggagaacatggaacgtcagatcgagaaatgccatgatgcgccattttatacactcggccctttagtgacggatatcgctcctggctacgatcacattacctctgccatcggagctgctcaaatcggctggttaggtacagctatgctttgttatgtcactccgaaagagcatcttgccctgccggataaagaagacgtacgtgtaggggttatcacttataagattgccgctcatgctgccgaccttgccaaagggcatccgggagcacaggtacgcgacaatgccttgagcaaagcccgttacgagttccgctggaaagatcagttcgacttgtctctcgatccggaacgggcacagggatatttccgcgcgggacatcacattgacggagaatactgcacgatgtgcggaccaaatttctgcgccatgagattatcccgtgatctgaagaaaaatgccaagagtgataaataatgagttgtgaatatccccaaaccaagtcacaacctcatttctttttaattttcaactttcaattaattaaaatgttctcagacgaattagaaaaaatatcctgggaagagacgacaaaagccatctattccaaaacagatgccgatgtgcgccgtgcattaggcaaaaaagagcatctggatgtcaacgattttatggcattgatctcacctgccgccactccctatctggaagtgatggcccgcctcagccagaaatatacgatggagcggttcggcaaaacaatctctatgtttgtgccgctctatatcaccaattcatgcaccaactcctgcgtctattgcggtttccatatcagtaatccgatgaaaagaacgattctgacggaggaggaaatcgtcaacgaatacaaagcaatcaaacggctggctccttttgagaatcttttactcgtgacgggtgaaaatccggcagcagcaggtgtaccttacattgcccgtgctctcgacctggcaaaaccttatttcagcaaccttcagattgaagtgatgcccctcaaagcggaagaatacaaagaactcacccatcacgggctgaacggagtcatctgctttcaggaaacttaccataaggcgaactataaaaagtatcacccgcgaggcatgaagtccaaattcgaatggcgtgtcaatggtttcgaccgtatgggacaggccggtgtccataagatcggcatgggtgtcctgatcggtctggaggaatggcggacggatgtgacaatgatggcttaccacctccgctacctacagaagcactactggaagaccaaatacagcgtcaatttcccccgtatgcgtccatccgaaaacgatggcttccaacccaacgttatcatgaacgaccgggaacttgcacagcttactttcgccatgcgaatcttcgaccacgatgtagacatctcctattctacccgtgaaagcgccaagatacgaaatcacatggcaacactgggcgtgacaaccatgagtgccgaaagcaaaacagaaccgggcggatattacagctacccgcaaacgctggagcagttccacgtgagtgacgaacggaaagcggtagaagtggaacgcgacctgaggaaattaggacgtgaaccggtctggaaggattgggaccagtcttttgactttaaaagataaaacgatgcggtacgacaggcaaatgctccttcccgaaatcggagaagacggtcagcagaaactgaagcaagcaaaggttcttattgtaggcgtgggagggctaggctctcccatagccctctatctgaccggagcaggagtaggctgcattggattggtagacgacgatgtagtcagtatcagtaatctgcaacggcaagtgctctattcggagaaagaattaggtaaacccaaggcaatatgtgccgccgaacgactttccgcacttaacagcgagataactatccggacttatccaacccgtttgacagaggaaaacgcacaggaaattatcagtcagtatgatatagtagtagatggctgcgacaatttctctacccgttatcttatcaatgacatctgtgcggaaatggggaaagtgtatgtctatggagcaatctgcggctttgaaggtcaggtatccgttttccattacggagaagagaaaaaaagttatcgggacttatatccggatgaagaagaaatgagacgaatgcccccgcctcccaaaggtgtaatgggcattactcctgcggtaacaggaagcatcgaagcaacggaagtgctgaaaattatctgtggttttggcgaagtattatcgggtaaactatggactattgacttgcgtacattgcaatctaacaaattttcactataaacgttggtttctgaaatagttaattagtaactttgctaaactttacaactttacaaaggaaatgaaactaattgtagttaccacgcccacgttcttcgttgaagaagataagattattaccgctcttttcgaggagggactggatattctacatctcagaaaacctgagacaccggccatgtattccgaacgattactgacgctgattccggaaaaatatcatcgccgcattgtgacacacgaacatttttatctgaaagaagagttcaatctgatgggtatccacctgaatgcacgcaacccgagcgagccgcatgattatgccggacacgtcagttgttcctgccattccgtagaagaggtgaagaacagaaagcatttctatgattacgttttcatgagtcccatttacgatagtatttcgaaggttaattactattctacttatacggcagaagaacttcgtgaggcacagaaagctaagatcattgactcaaaagtaatggcacttggaggtattaatgaagataatctactagaaataaaagatttcggatttggaggggctgttgtactgggggatctctggaataaatttgatgcctgtctggatcagaattatctggctgtgatcgagcatttcaaaaagttaaagaaattggcggactaagaaatatcgattcgaatattatatacaatcataaataaagaaaccgctgtaagtaatcttttacagcggtttactttttagtaattttcttatcagaatttatatcctaatacaatagaaaagtttgtatttttaggattacctattttttctacatctactaaaccaaattgaccatccaatcctacaataaccttacctaattccaaagctactccaacaccaagaccggcatcaaaacgttttaaagcatcatcaccaaatgtatcatacttacgttccgtatcattccccaaatcaattttggttttaccagcaataccacatgccaaataaggaccagcattaaccacaatatttgtattatccgcaacattaaaacgagcagcagccataactggtaattccaaatacattgcatttatgctattaccatccttttttgctcctttagtcgacaaaaacaatgatggctgtaatgaccaagtattatcaaaagcatattcaaaaccacctccaagtttaaagccaatctttgcattcaaatcagcatcacctgtataattactaatgttcattcctaccttagcattccaacctgtaatctgtgaaaagccagcaactgaaatcagcgcaaataaaataaataaagcactctttttcataattctaaagttttaattaatactatagttaaatcatctgtttaattaacaatgcaaatatatgattgatatatatatcaaacaactttttcgttaacaaacgtgtaaaatatagagattacacacaaagaaagggaattccctatttcagagaatcccctttcctattttttattatctactacccgattagaaattgtagtggaaaccaatagacaaatcttcgctagtcaacatcagaccgaaagaatctccggaagtgttcacattcttacgatatcccaagaaaccatacttggcgataaaagagaaatgatcgttcagtttaacagcgatacccggtctcaaaccgatctgacctgctttagtggtatcaccatctttgattttcacgaaaccaatagcagcagttccgtccaggaacagacgtacagcatcattctgatagtaagaccaacggatgtacggagcaacagtaactgaatttgcagtcacttgtttcacatattcgtgtgaatagttcagttcagcacccaatgcccatgtttcattaaaattgtagccgatttccggagcaactttaaaagaagtagtgttgcctgtgctgttacgccatacgttcaatgatccgcctacgtaaatgtcctgtgcttttacagcgatagttgctaacattacaactaccaataataaaccctttttcatcttctttctttttaagttataaaataaaaacatgttttgttttcgggggcaaaattaagctacttcttcatcttaaacaaatatttagttagttttttataataatcaccaaacaaatcattattaatggctgattatcagggctgaacaaatacaattaaaaataacatcatccaacaaaaaaggctgtaatcattctctcacgagacgattacagcccaattatcagaaagttaactttctaaccagtttatctttctatccttcaattgctgcctgcgccgctgctaatcttgcgataggtacccggaacggagagcaactaacgtaattcaaacctactctatggcagaacttcactgaagacggttcaccaccatgttcgccacagataccgcatttcaaatccggacggatagcacggcccttttctgtagccatacgtaccaactgacctacaccattctgatcgagcacctggaacgggtctactttcagaatcttcttttccagataaaccggaaggaaggaagcgatatcgtcacgagaatatccgaaggtcatctgagtcaagtcattcgttccgaatgagaagaattcagcagatgaagcaatacggtcagcagtcagagctgcacgaggaatttcaatcatagtacctactttgaaatcaatgctgtcgcccacttcttcaaacaacttggcagcctcttcacgaatcaccttctcttgttccttgaattcatataaaataccggtcaacggaaccatgatttcaggatgtgtctctactccttctttcttcagttcaagagcagcacccaagatagcacgtgtctgcatctgagttatttcaggatatgtatttcccaaacggcaaccgcggtgacccaacatcggattgtgttcacacagcgattctacacgttgctggatatattgcaggcttacacccatcgtatcagccatttcctgctgtcccttcgtatcatgaggaacaaactcatgcaaaggaggatcgagcagacgaacagtcaccggacaaccgaccattgctttaaagatacccttaaagtcggcttgctgatacggaagaatcttagcgagtgctttacgacgtccttctgcattttctgccagaatcatttcacgcatcgccttgatcttttcaccttcgaagaacatatgttccgtacggcaaagaccgatacctactgcaccaaagttgcgtgctacttctgcatcgtgaggagtatccgcattggtacgtacttgcagacgggtatatttatccgagagtttcatcaaatcggcaaagtctccggaaagttcggcagcctgagtttctaccttaccattatatacttcgcctgtactaccgttcaaagaaatataatcgccttctttcaaaacaatgccgtcaatttctactgtacgagtcttatagtcgatattcaatgctcctgcaccggatacacaacatttacccataccacgagctaccacagcagcatgagaagtcataccaccacgagctgtcaggataccttcggcaactgccataccggccaagtcttccggagaagtctcgatacgtaccattaccactttctttccggcagcatgccattcggcggcatcatcagcgaagaatacaatctgaccggttgcagcacccggagaagccggaagaccgcgagtcagcactttcgcctgtttcaaagcagatttatcgaataccgggtgaagaagttcatccagtttgttaggttctacacgcatcaaagcagtcttttcatcaatcatgccctgacggagcaagtccattgcgattttcaccatagccgcaccggtacgtttaccgttacgagtctgcaggaaccataacttaccttcctgcacggtgaattccatgtcttgcatatctttatagtggttctccaatttagtctgcaatgcatccagttccttatagatttccggcatagcttcttccattgaagggaattttgcagcacgaatgtcttcagtcacacctgccagtacagcccagcgctgagaaccaaccttcgtaatctgttgtggagtacggataccggctaccacatcttcaccttgtgcgttgatcaggtattcaccgttgaaaaggtcttcacctgtaccggcatcacgagagaagcaaactcctgttgcagaagtgtcacccatattaccgaataccatagcctgtacgtttacagctgttccccattcatcaggtataccttccatcttacgataaaggatagcacgttcgttcatccatgaatcaaatacggcacagatagctccccaaagttgttcgtaagcacaagtcgggaaatcttttccggtctgttctttcacagcggccttgaacttcttcacaagctcttgcaggtctgctacttccagttcgttatcaagctttactccttttgattcttttacttcttcaatgattgcttcgaacggatcgatatcttccttgttcgtcggcttcatgcccagaacaacgtcaccgtacatctgtacaaaacgacgataagagtcccatgcaaaacgggcattaccagtcttgcggatgataccttccaccacctcgtcattcagacccagattcagaatagtatccatcatacccggcatagacgcacgggcacctgaacgtacagaaaccaacaatggattttcgatatcaccgaatttagatttcatcaattcttctacacgggcaatggcctttactacttcatctttcagcaactcaaccactttatcacgtcccaacgtattatactccgtgcaaacttctgtagttattgtaaatccgggaggaacgggaattccaattaaattcatctcggcaagattggcacctttaccacctaacaaattcttcatgtcggcctttccttctgcctgaccatttccaaaggtataaactctttttttatccataatattgtgtttaaagttacattatgatttttttctgttcgcaaatctaagtatatttcgcaaaccagaaaactttttgagaaaaaactttctattaaaatgcaatttcgacattacaatctggaatattttcatagacacgaaagttttccaaaaaaaatacctacttttgcatcataattattagattggtgtaaaagtggcaagaaagagaaaagaacttcccctgctggagaaggtaacaataacggatgtggctgccgaaggaaaagccatcgcaaaagtaaacgacctggtgatttttgttccttatgtagtgccaggtgatgttgtagacctgcagatcaagcgcaaaaagaacaaatacgccgaagccgaagctgtgaaattccacgagctgtcgcccgtacgtgccgttcctttctgccaacactacggcgtatgcggcggttgtaaatggcaggtactcccctattcggaacaaatcaggtataagcagaaacaagtagaagacaatctgagacgcatcggaaagatcgaacttccggaaatttcaccgattctgggttctgccaaaacagagttctaccggaataaactggagttcactttttcgaacaaacgctggctcacgaacgatgaagttcggcaggatgtgaagtatgatcagatgaatgctgtaggttttcatattcccggagctttcgacaaagtgctggctattgaaaaatgctggttacaggacgacatctccaatcgtattcgtaatgctgtacgcgattatgcttacgagcatgattactccttcatcaatctgcgtactcaggaaggtatgttacggaatctgattatccgcacttcatcaacaggagagctgatggtcattgtcatctgcaagattacagaagaccatgaaatggaactattcaagcaactgctgcagttcattgccgattcattccccgaaatcacttctctcctatacattattaataataagtgcaacgatacgatcaatgatctggatgtacatgtattcaagggaaaagaccatatgtttgaagaaatggaaggactgcgtttcaaagtcggtccgaaatcattctatcagaccaattccgaacaggcatacaatttatataagatagcccgcgaatttgccgggctgaccggaaaggaactggtatacgacctatataccggaacgggaaccattgccaattttgtatcccgccaggctcgtcaggtgattggtatcgagtatgtaccggaagctatcgaagacgcaaaggtaaatgccgagattaatgagattaagaatgccttgttctatgccggagatatgaaagatatgctgactcaggaatttatcaatcagcatggacgtccggatgtgattatcaccgaccctccacgtgcaggtatgcatcaggatgtggttgatgttattctgtttgccgaaccgaagcggattgtgtatgtaagctgcaacccggctacgcaggcacgcgacttacaactgcttgacggcaaatataaagtgaaagctgtgcaacctgtagatatgttcccgcatacgcatcatgtggaaaatgtagtgttgctggagcttcgataatacgttagttgaattgttcgcaaaagaaaaaagaaatggaaaaaagaccgagaagaactcctgcagaaaaagcacgtgcccaatatacgaactatgcagtcaaagagcccatggaactaatggagtttctggctgccaaaatgccggacgcaagccgcacgaaactgaagtcattactgagcaaacgggtggtattggtagataacgtaatcaccactcagttcaacttcccgctgcaacccggaatgaaagtacaaatcagcaaggaaaaaggaaagaaggaatttcataacagactgctgaaaattgtatatgaggacgcttatatcattgtagtggaaaaaatgcaaggactcttatctgtcaataccgagcgacaaaaagagcgcaccgcttatacgattctgaatgaatatgtacagcgctcgggcagacagcaccgtgtgtttatcgtacatcgtctggacagggatacatcaggattaatgatgttcgcaaaagacgaaaaaacacaacggacattacgtgacaactggcatgaaatagtgactgaccgccgttatgtagctgttgttgagggaacaatggagaaggattatgacactgtggtttcctggctgacggataaaactctttatgtaagttccagcgattacgatgatggtggttcaaaatccatcacacactacaagacaatcaaacgtgctaacggttattcactgttagaacttgatctggaaacaggacgtaagaatcagattcgtgtacatatgcaggatttaggacatcctattataggtgacggaagatatggaggcgaagaatcgcttaacccgatcggaagactggcactccacgccttcaaactttgtttctatcatccggtgacgggagatttaatggagtttgagacaccttatccgggagagtttaagaagttgttcctgaagaaataaaataataaaaattccccttatttgctgacaactctgtacatagattagccttcaataaggggaacttttataaaaaatcgatattttttccaattccacaattcttttttagatcttcactaattactcatttctaaagtaacggttccttgatctatattatttgaatacaaacgccctgtaagatatcggccttcaacataaacatctgctaatattaataaaggatagccattaccataatccaagaataaatctccatcttcaatccaccagcggacatctaaaacagcagctactctatcccaatcataataccattgttcatctacaccaaaaccattactcttaaaggttattccactttccaccggactattatctacccaaaatcctaaatcaccaacccatgtacgccctactatgtgatcaaatatagtttcatcatcttcgcacgaagtaaagccgaccaataaagtcagcaacatgagaacacctacgtattttttcaaattcttcataattttctagtttattgcgtttattattgcaaaattagcgtttttattttactatatgccttaagatgcaagttttttgtacctttgtcccactaatagtaaaatttacacatgaaacttctttggcttgatttaaatagctcctatgcgcactcatcgctggcattgcctgcattacatgctcaaatagcagatgacactaccattgagtggtgtacagtatcggcaaccatcaacgaaaataccggaatggtagtcaaccaaatctatcaccatcaaccggatattattgctgctaccaactggctatttaatcacgagcaactgttgcatatcgtttcacgtgctaaagctttgctacctcattgctgcatcgtactcggcggtccggagtttttaggaaataacgaagccttcttaagaaagaacaaatttgtcaacggagtgtttcggggagaaggagaagaagtattcccaatttggttaaaagtatggaatcaccctgtaaatgagtggaatcagatatccggattatgttatctggacgaatcagaccaatatcaagacaacggtattgcccgtgtcatgaacttctctcagctcgtctcaccggagaaaagtcgtttttttaattggagcaagcctttcgtacaactggaaactacccgaggatgcttcaacacatgcgctttctgcgtcagcggaggtgagaaaccggttcgcaccatttcattggaggcaatccgcgaacgactgaatgttatccatcagcatggcatcaaaaatgtgcgtgtactcgaccgcactttcaactataataataagcgagccaaagaacttcttcacctcttccgtgaatatgccccggacatctgtttccatttggaaattcacccggcacttctctccgaagaattgaaagaagaactcgctattttacctaatggtttgctacacctcgaagcaggtattcaaagccttcgtgaacccgtattagagaaaagccgacgtatcggaaaattatctgatgcccttcaaggtctgaaatatctttgttcccttaagaacatggagacacatgctgacttaatagccggtcttcctctctatcacctatccgaaatatttgaagacgttcgtacacttgccgaatatggtgcaggggaaatacaactggaatcattaaaattacttcccggcacggaaatgcgaagaagggcggaagagttaggcatccaatactctcctctccctccctacgaagttttgcagactaaagaaatttccgtagaagaattgcaaaccgcccactatctgtcccgtcttttagacggattctataatacacctacatggcgaagtctgactcgtaccctcattttggataatccgcatttcctgcatgagttacttgaccatctaatacagacagatgtcatcgacactcctttgagtctagaaaaaaggggacttatcctctataatttctgcaagaatcattatcccgattacgtgacacaagtcagtattgcatggatagaagccggtatgtcgttaaaaaaatccccgctgaaaaagtaaagacaaaacgccaagttcctcccgataattgggaaattatatatggttcatatcgtgagaacctccggttatgttttcttcctattgacgaagcaggacatggctattggttcggatttgaatcggagattcagaagatagaaccggtatttaaagcaaaaagattatcttaaatacaaaacattaaagaatgataataagaactatgagtcctgcaatgctcagaaaaaaagtggttgtaattataacatctatatttttccacctcattttttctctcaatatcattcaagatttatgaaagatgaaccaatcaagaaactagaacttatcactcaatacataaaaaaacagctatataggttttgtttccataggtgcgactggacacgataaatgtgcttaatacacctatacaaaaaaagaaaagtattctcatattatgtaaaatagctattatttattcattacataaagcagcattttcactttttcaccgtccatagaataaactatactagcacactatatggacgcttataaatatcagttaggtactctttgtctattattactccccttatccgtagcaggacaagagtggagcaaacaagattcattgaggctacagcaaacattaaattctgagcaagaaatcagaatcaataaggtattcgtaaagaagacagaacaaaacatgttatatcatacaaaaccctttgttgactttgatccaacattaccgattcttaaatcaacaatcatatctccgaaattaccttttcatactcataacatctttcgacagaccaattctactttcttacccacttattcacggctcaaaataaacaaaaatatcactctgcatagtaaaagtaactttagtgaaagttcaaaccactttcatatccaaactcaaatggattataagctctctaaaaaatggtttcttagcatatatggtaaacaaaatctggacacccgaagatatcgtggactttcctctgaagcaataccaaccacactaggcagcgacattgttttaaaagtaggtaaaggctggaaattgaaaaccggcgtacaatatcaatacaacaccatacaaaaaagatgggaatgggtgcctcagatctgtatttcttatgaatggtaaaaaaggaatcacatgataaacgatttcattttccatttattctcgtacctttgtagtacgattaaaaaacatcctataataatgaagaactttatcaagggattccggtttactccctccaattacccggctgaagtagaagcgaaaatacagaaatacagaaaacaaggttacaaactcccaccgcgcaaagtactgcgtactcccgaacaactggaaggaatccgtgagagtgccaaaatcaatactgccctgttggattatatttcggagaatatccgtgaaggaatgtcgactgaagaaatcgatgtcatggtatatgacttcaccacaaagcacggtgccatccctgctcctctcaactacgaaggatttcctaaaagcgtctgcaccagtatcaatgatgtggtatgccacggtattcccagcaaaacagaaatactgcaaagcggagatatcatcaatgtagatgtttctaccatttacaaaggatatttctccgacgcatcccgtatgtttatgatcggtgacgtaagtcccgaaatgcgcaaactggttcaagtgactaaagagtgtatggaaataggtatagccgccgcacagccttggaaacaattaggagatgtaggcgccgctattcaggaacacgcagaaaagaacggattcaacgtggtacgcgatctttgcgggcatggtgtaggaatgcagtttcatgaagcaccggatgtggaacatttcggacgccggggaacaggaatgatgatcgttccgggcatgaccttcaccattgaaccgatgataaatatgggtacttatgaagtatttgttgacgaagctgacggatggacggtatgcacggatgacggactgccttctgcccaatgggagaatatgattctgattactgaaaccggaaacgaaattctgacttattgatggaactgattctacttattgttattgccgcattagcagtaatctcgattgtactatcactggcaaaaggaaataatcatgcgcaagcggaacaattacaggcagccttgcgccagcaaatgcaagagaaccgcgaagaactaaaccgcagtatccgggaacttcgcatggaaatgacccaaacgctgaatcagaatatgcaacaattgcaagacgtactgcataagaacatgatgacaaacggggaactgcaacgccaaaagttcgacacaatggcacgccagcaagaggtcttgataaaatcgactgaaaagcggctggatgatatgcgactgatggtggaagaaaaattgcagaagacattgaatgaacgcattggacagtcctttgaaatcgtccgctcacaactggaaaatgtacagaagggactgggagaaatgaaatctctcgcacaagacgtcggtggactgaaaaaagtattgagtaacgtaaaaatgcgcggtacattcggtgaagttcagttaggagcattgctggaacagatgatgagtccggaacaatatgacgccaatgtgaaaaccaagaaaagcggaactgaatttgtggaatttgccattaagttaccgggtaaggatgatgcgaacagcactgtatacctgcctatcgatgcaaaattcccgaaagatgtatatgagcaatactacgacgctttcgaggcaggagatactgcattgatggaatcatccggcaagcagctggaaacaaccatcaagaaaatggcgaaagatattcacgataaatatgtagacccgcctttcaccacagactttgccatcatgttcctgccttttgaaagcatctatgcagaggtgatccgaagaacaagcttggtagagacgctacaaaaagaatataaaattgtagtgacgggaccaactacccttggtgctatattgaacagtcttcagatggggttccgcacgctggctattcaaaagcgtaccggagaagtgtggacagttttgggagcagttaaaactgaattcagcaaattcggaggcctactcgaaaaggtacagaagaacctgcaaagtgccggtgaccaactggaagaagtgatgggaaaaagaacccgcgctattgaacggaaactacgccaagtagaacaattgccccatgaggaaagtcagagaattctgccgatagcggatgacggggatgatgaataaaacaaaaattatagaccttttaagatggtgtcgctatccggttgggatagtgtcactatgctgattggatagtgtcactatgctggctatatagtgacactatttataaactaattagttatcagttgaataattaatcttcaatgcactacattccctcagcacctgcttggtatccgtcacgtatcccatcttacaccctttctctatcttgaggccaataaccaaactttccggatcagcagcttgctttgcacgtgcagcagtgactttctgtttcaattccgttaaagtataatctttcattacttccttcccttccgaagtgtgaattgttaccacaatcccactgattttctcctccattgacagctctttcaatccataatttctcgtagcaccttccgacagtagaacgggaaacaatcggtccaacgcttcttcacttttatctgtcaatgtaatagacaaatcagcacgaatttgctcaaatgctccttttacttctttgagtatagtagtgagtgcagcaatttcacttccgcgatcaacctgaaaagaaataacttggtattctttcctcttactttcttcccaggacttcgtcaaattcttcacaatagtagacttcaactcatccactgaacatacatcattatcgaacatcaccctattttgtttattaacaaaaagggagtgaacctgtcttgctttaatcttagagggtggatacgctccattaaccagcttgctgtatctctctcccccttctttgaaaaaaaacatcaaagatgaataatcatccgcttctttctgctgaagttcagactgaatctgtcgcggaacttctttcacttccggctgtgcaaacacataaagcgctccagccatcacaggcacggcaagcaacagctttaatcgtgcccaacgattggttctttcttttaacatcatagtgatacgttttttaagtttagagtgattaaagccattagccatagagtagagccttgtaccaacagcttttttcaccagtaataattgatatttagttgcatcgatgcctgtattaattacaccattatcggcttcaaattcatgtacttcctgcaactcccgttttagtagccaaacgacaggattaaaccaataaacaagcaggaatatctgcataaacaataagtccaaagtatgatgatttcgtaaatgcatcatttcgtggaggagtatttcttcggactgttgagagtagtcagctgctgaaataacaatatatttaccccagctaaatgaagcagttggctgctgaggaatcactaatacatagtttccaaactgttttttctctgacgtacgaatcaactgaatcaaacgacaagtggacaaagacaaccagatcagtgtcaccaaagcccccactccatatataaaagctaaagtcacaggaatccaattcaaagagtttatttccggattcttttcagatataagaataggatcttccatctgttccggatttagaatgacagattccgtactttgcaatatctcgtgaatggcatacaacggagtatgcaaaaaagtctcctcggtagttgtcagctctataagtggaagcaaagtacatcctaacaacccaaccaacaaagtgatgcggttgaaatggaaaaaagtactccggctcatcagcagcttaaagaaaatataaaagaccactaagcaacatccggatttcagcagatagaataaaaaagctcccattgtgttttcagattaaaagttgtttgtccatagaataaaaatcgtatctgtccgatagaccagagagagattacttcttctttttactttgctctatatactctataagcgattttagttcatcaacagacatcccttcttcttcaataaaagaagacactacattgatataggaattattataatactgggaaaccacttctttgagtgccgaactcttatactccttttccgaaacaagagcataatattgataagtatttccgtaggctttataccccacaaaacctttctcctccagccctcgaacaagggtagaaactgtgttataatgcggttttggttcatcatagaatgatagaagttcacgaacaaacataggtccatgttcccaaaatatacgcataatttcttcctctttgacggtcaatcgtttcatctgtttcatagtctacatatttattgttcttccaatggcacaaatataatactatttttcaaacaaacaactaacactattagtt

SEQ ID NO: 126 - DNA, 23251 bp, Bacteroides thetaiotaomicron
atataatatacaatgaagaaacacttcttttttatatttatgtttctcttgatgacgagaatctgtgcttttgcctaccctaacatgattgttgaacattatacggccgaacgaggcttacccaataatatcgtcaattgtacacttaaagggcaggacggatttgtatggttcggcacctggtacggactatgcagtttcgacggtaccaaattccgttcctatgataatcatgatggattttactccgcagatattcctccccgtaagattcagcgtattgtagaagacaggaacggatacctttggatcaagactatcgaccgcaaactctatctgtttgataagaaacatgaaagtttccacgcagtgtatgacgatgtaaaagagtactctgaaaatattcagattatcaagatacagacgacagatgacggagacgtactgctgctgaccaaagataaaagcctgctgcgtgcaaatacagaccagaacggtaaaatcaccatgaagcagttgcacgattcgcgtcccaatgtcaacgtctacgacttacgcctcaagcataatgtgttttgtgaaactgccgagtttatcaattggatcggtatggactatcagattctttcattgagaaaaggagaggctctgaaagataagcctgtcgactttattcaaaagaaagtttctgccaatccggaccagttcacttgtgcttcctacagttccaaattcttatggctgggagataagaacggacatatttatagcgtcgatccgcaaaatggagtagtcaaccgctacgaaataccggagattgatcaaccgatttccaatatactggtcactgaatcaggattaatgtatatcaccaccgttgatggtgcgtatgaatataacatcggctacaaacaactgaccaaactaccgttctccatcgcagggaaaaaagtaggaatgatattcaatgacaagtatgacaaaatttggtttcaggaaggtaatgaggcattgacgtactatgatcctctgaacaaaagcaatcatcgctttcctttccccaaacaaaatgccatcggtaactttgaaaagcaggatgccggtgaacagggtatgtttttcctcacccccggtggagaaattctgctcttcgatagggaaaaactggaaatgacccgtatcaatcaactgaaacctttttccgacgaccttcccgatcagctcttctttcatctgttgctggataaagacggtattctttggctggcatctacaggcagcggagtatacaaggttaactttcccaagaagcaatttcaactgctgacagaagtttctcctgtccctgtagacacagaaagagcgacctcttggaatcaggggatacgtgcactgtatcaggctaagaatggagacatctgggtcggtacccgttggcaggcactttatcgtctggatagcaacgggcagataaaacaggtttttacggatcagaattatctgataggcgccgtatatcatatcatggaagataaagaaggaaacttgtggttttccactaagggaaacggacttgtcaaagccgaaccggatatgaactcaccacatggtctgcgttttacccgctataagaatgatcccaagaatccgaattctatcagtaacaatgatgtgtatttcacttatcaggatagtcaggagcgtatctgggtcggtctgctaggcggagggctgaacttgatttccgaagaaaacgggacacttgtattcaagcataaatacaacggactgaaacaatatcccgcttatggtctgtatatggaagtccgtacaatgacagaagatgaagacgggcgtatctgggtaggtacgatggatggtctgatgtcttttgacggacattttacgactcccgaacagattcagtttgagacgtaccgacagatcagcgatcgttccaatgtggcagacaatgacatttatgtactatataaagacagtgattcgcaaatttgggtgagtgtattcggcggaggtctgaataagctggtccgctatgacaaagaaaaacgtgaaccgatattcaagtcatatggcatacgtgaaggaatgaataacgatgtggtcaagtccatcgtggaagataaaaacggaaatttgtggtttactaccgaaattggtctgtcctgctttaataaggcgacagagcagttccgtaactacgacaaatacgatggtttcctgaatgttgaactggaagaaggcagtgcgttgcgtgcattgaacggagacttatggcttggttcgcgacaggggattctgacattctctcctgataaactggagacacaacataccaactatgacacccgtatcgtagactttaaagtatccaatcgtaatctgcgaagtttgaacgactgtccgattcaggagtctatcacatacaccgatgcacttcaattgaagtataatcagtctatgttcacaatcgaatttgccgcattaaatttctacaatcagaatcgcgtatcttatcgttacatactcgaagggtatgagaaagaatggcactataacggcaaaaaccgtattgcttcttataccaatgttcctcccggagactacgtattccgtgtagaaacgatggatgaagccaatccggaacttgtatccacatgcacattggctgtcaccattctcccgccgtggtggctgagttggtgggcaactcttatctatgtaatccttggcatcgcggccctctatttcggtctgcgcctggccttcttcatgattaagatgaagaacgacatttatatcgagcagaaagtctcggaaatgaaaatcaagttcttcaccaatatttctcatgagcttcgtactcctctgacactgataaaagggccgatacaagaactgaaggagcgggaagaactgtctccgaaaggactgcaatacgtggacctgatggaaaagaatacgaaccaaatgttacaactggtcaatcagattcttgatttccgaaagattcagaatggcaagatgcgtctgcacgtatcattgattgatttcaatgaaatgatagcttccttccaaaaagaattccgtgtactttcggaggaaaatgaaatcagtttcacattccaactgccggacgaaccgattatggtatgggcagataaggacaaactgagtattgttatccgcaacgtcatatcgaacgcgttcaaatttactccttctggtggaagtatttatgtaactaccggattgacagatgatggaaaatcctgctatgtacgggtagaagacaacggtgtcggcattccgcaaaataagctgagtgaaattttcgagcgtttctcacaaggagagaatgcgaataatccacattatcagggtacgggcatcggtctggcactttccaaagaaatagtaaacctgcatcacggtatcatccgtgccgaaagtccggaagggcagggggccgtgtttattgtagagctattgctggacaaggaccattatcgtccgtcggaagtagacttctatgtcagtgatacggaaactgctcccgccgctacagacaagaagatggttatcgattcagaaaaggaaccggaggaggaactggaaattgatgcttcattaccgactcttctgctggtagaggataataaagacctgtgccagctgataaaactgcaattggaagataaattcaatatccatatagccaataacggcgtagaaggactgaagaaagtgcatctgtatcatccggacatcgtagtgaccgatcagatgatgccggaaatggacggactggaaatgctgcaatctatccggaaggattttcagatcagccatatccctgtcattattctgacagccaagaacgatgaaggtgccaagaccaaagcgatcactctgggtgcgaacgcatatataaccaagccattcagcaaagagtatctgttggcacggatcgatcagttgctcggcgaacggaaactgttccgcgaacgtatccgccagcaaatggagaaccagacgacaacggaagaagacagctacgaacaatatctggtgaagaaagatgtgcagttccttgaaaagatacaccaagtgatcgaggaaaacatggacgacagtgatttcaatattgatacgatcgcttccggcatcggactgagccgttcggcattcttcaaaaagctgaaaagccttaccggactggcacctgtcgacctggtaaaggagattcgcctgaataaatcgatcgaactgattaaaaatacggatttgagtgtttcggaagtggcgtttgctgtcggattcaaagattcgggctactatagcaagtgtttccgcaaaaaatataatcagactccccgtgaatatatgaatgaatggcggaaaggatagaaagaccgattacaaaatactttcttaatcgtcttttttaaaaacctattaagattcggaagaatgaacaagattaagaaagtattatcagcatggatgttggttgcctgtgtactacctgtgacagcccaatatccggtgatccccgactcggtaaaagaaagaggagcaaaacaagaagcagagttcgaacagaaatcaaatgcggcatgggaaaaagccttgccaacagttttggaagaagcaaggttaggaagaccttacaaaccttgggcctccaaaccggaggatttgataaaaagtaatattccggccttccccggtgcggaaggtggtggtatgtacactcccggcggtcgtggaggcaaagtgattgtggtaacttccctggaagattccggtcccggcacattccgcgaagcctgtgaaaccggtggtgcacgtgttatcgtatttaatgtgtcaggtattattcgcctgaaaagcccgatcagtgtacgtgccccttatgtaacgattgccggacagacagcaccgggagacggtatctgcgtgaccggtcattctttcctgatcgatacacatgatgtagtgattcgtcatatgcgtttccgtcggggggcacaggatgttgctttccgtgatgatgcagtaggaggaaatgcagtcggcaatattataatagaccactgttcggcaagctggggactggatgaaaatatgtctatctatcgccacgtctacaacagggatgaaaccgggcacggactgaagttacctactgtaaacattaccattcagaattcgatgttctcggaagcattggatacttataatcatgcgtttggcgccactatcggaggacataatagtatgttctgccgtaatcttttcgcttccaatatcagtcgtaacagttcggtgggtatggacggagactttaacttcgtaaacaatgtggtcttcaactggtggaaccgttctgtcgacggaggagataacaagagtttttataatataatcaataactattttaagcccggtcctatcaccccgctggataagcctatctcttatcgtatattgaaaccggaagccggacgcgataaaagcaaaccgatgtccttcggaaaagcttatgtaaacggtaacatcgttcacggaaatgctaaagtgacaaaagataactgggatggcggagttcagcttgccagtgaagtggatgaaggaaagttcttaccgcaaatcagagtggacgaagcattcaaaatgtctcctgtaacgattatggataccaaaaaagcttataactttgtattggataatgtaggtgctactctcccgaaacgggatgcggtagacgcgcgcgtcatcaagactgtacagacaggaaaagcgatttatgcgaaagacgctccggaatttgtctctccttatgtgaaaagacgcttgccggcagactcttacaaacaaggcatcatcaccgatatccgtcaggtgggcggacttcctgaatataaaggagaagcatatcttgattcggatggtgacggtatgccggacgcatgggaaatagccaacggactgaatccaaacgatccgactgatgcaaaggaggactgtaatggagatggctataccaatatcgagaaatatatcaatgggctggatacaaagaagaaagtagactggacagatctgaagaacaactgcgataccttatccaaacggaaaagtctgttttaatcgtatgatttgcttatggtcaaatgatctttcaggattgaataattagaaaacaacgtttattgtaatgaatatacaattaagaactatccttttaggattattgagcatagggtttgcgcagggatatgcgcaaacctttgctttacaggttaaggatgaccggatcacttacttgaatgacgaacagggaaaccggattcttgatttctcgtactgtggctacaagggctccgaacaagatattccttctgtccgcaatgccgtgtttgtaccttggacagcaggagataatacatcacgtattcaacgcgccattgactatgtcgcttcattagtacctgatgcttccggtttcaggggagccgtgttattggatcagggagaattttctttatccggaagccttcgtataaatgcctccggcatcgtactgcgcggagtggataaagagaaaacgatacttctaaaaaaaggagtggacagaggtgcccttatctacatggaagggacagacgatatgaaggtgcaggatacattgcaggttctctcgaagtatgttccggtaaatgcgaggacattggaagttgcttcaggtacttcattgagaaagggagatcggatactggtggaccgtccgtccggcaaagaatggattgcttcgttaggatgtgatatctttggaggaggaattagtgcactgggttggaaagaaggagatatggatctcacctgggatagaaccgtgacagaagtaaacggtaatcagataacgctggacgctccgctgacagtggcgctggatgctaaatacggtacttcttccgtgattacttatcagtggaacgggcgcatccgggagtgcggagtagaaaacatgactctgatttccgactatgacaaacggtaccctaaagatgaagatcattgctggacaggtatttcgatcgaagatgcggaaaattgctgggtacgcagggtgaactttaagcactttgcaggaagtgcaatccttgttcagcgtaccggttcccaaatcacggttgaggactgtatctcacgggaacctgtttctgaaatcggaggaatgcgccgctgtactttctatactttaggacaactgacacttttccagcgctgctattcggaacagggtattcatgactttgcagccggatattgtgctgccggaccgaatgctttcgtacaatgtgattcgtatgagtcttttggtttcagcggatctattgacgcatgggcgtgcggtttattgtttgacgtggttaatatagacgggcataatctgagtttcaagaatctgggacaggacaagaacggagcgggatggaatacagcaaatagtctgttctggcaatgtaccgctgccgaaatagagtgttatgctccggcaaaagatgccatgaaccgtgcgtacggatgttgggcacaattctccggtgacggcgaatgggcacaatcaaacaatcatgtgcagccccgaagcattttctatgctcaattggaggatcgtttgcagaagaaatgtgcagaacgtgcccgtatcctgccaaggaatacaagcgccaccagcagtccgaccgttgaagttgctatggaactggccaaagaggcttacaatccccgcctgacattggaacactggattgaacaaggagcctttgctccttcaatagctatgtccggagtaaaatcaatcgatgatatgaaagaaaagaagataactccgaacaagacatcagcacaaccggaagtaactattgcaaacagacgtatccaaatggacggtactttgttggtaggaggtagccataccaccccttggtggaatggaaaacttaaaaccagctttctgaaaaaagcaagtcctgccatcacccgttttgtccccggacgtgaaggcttgggactgacagatcgcatcgattccgtaatcggctatatgaaacaaaagaatatattggtatttgatcaaaactacggactttggtatgaccgtcgccgagatgatcatgaacgagtgcgccgtcgtgacggagatgtatggggacctttctacgaacaacctttcggacgcagcggtcagggtactgcctgggaaggactgagcaaatatgatctgaaccgccctaatgcatggtattggtcacgattgaaagagtttgccgaaaaaggaagtaaagacggactattgctattccatgagaactatttccagcacaatattctggaagcaggtgcacactgggtagattgtccgtggagaagcaccaataatatcaaccagaccggatttccggaacctgctccgtttgccggagacaaacgaatctttgttgcagatatgttttatgatatcactcatccggttcgccgtgagttacacaaacaatatatccgccagtgtctgaacaactttgctgataacccgaatgtcattcagttgacaagtgcagaatttacaggtccactacattttgtacagttttggctggatgtgattgccgaatgggaaacagaaaccggaaagaaagccaaagtagcattaagtaccacaaaagatgtacaggacgctatccttgccgatccgaagcgtgcggctgtggtggatattattgatatccgctactggcactataaaacggatggagtctttgcaccggaaggagggaagaacatggctccccgccaacatatgcgtaagatgaaagtcggaaaggtcactttcaccgaagcctacaaggctgtccacgaatatcgtcagaagttcccggagaaagccgtaaccttctacgcacagaattatccggctatgggatgggctgtattcatggccggcggttcatgtcctgtaatcccgtgcacagataaagcattcctgaaggatgcagcggctatggaagtggaagaaaccgataccgacaactataagaaaatggtaaaatctgatatcggcagtatcatttattccaagtccggaacagaaattcctgttcaattatcgtccggaaagtatatcttaaagtacatacatcccggttcagggaagatgattgttatagataaatcattgaaaattaatggagtatacaaattaaaggtaccggataagaaagaaggtatttattggttccataaactctgaaacaaaaaatcccgctgatgactgatcagcgggatttttccattttataggtaatttctaacaaaagagtgttataaaacatgatacttattttttcaacctacaaaccagattttaccggtggttgaggtcagttctgcttagctttgcaacatcaaatcaatcgaattaatgctatgatggaacagactaataattcaaccgacactttactcgcttcttttcaagcgggaaatatggcagctttttcgcagctatatgatttgcacatcaacattctttttaattacggattgaagttgaccattgataaagagttactgaaagattgcatccacgatattttcgttaagctctacactaaaaaggatgaattaggaactattgataatttgaagtcttatttgttcatctccttaaagaacaaactctgcgatgaactccgcaaacgtatgtatatgtctgatacagccatagaagatgtaaatgcagtagctcccacagacgtagaagatgactatatggaagaagagcaacgcaaaaatgagttctcgctggtgaagcgtttactggaccagctttctccccggcagcgtgaagcacttacattatattatatagaagaaaagaaatacgaggatatttgtgagattatgaatatgaactatcagtctgtacgcaacctgatgcaccgtggattgacaaaattgcgtagtctggcaagttaattttagtaaaaaggatatttggttgagtacatacacagagtaacagcgtcctatctatgtaaacgcttaaaaaggatgcgatatgtgctctaaggtaaaggattttttgacggatgatgatttcatcaattatgcactgggtgtaactccggaagcagcctcccaatgggaaacttatttcagggaacacccggaacagatagcagatgcagaagaagctaaggccgtattattggctccggcagatgttgcctgcgacttttcactggttgaaaaccaagatttaaaggatagaattgttagtagtataaaagatttttcgaacattttgtagttagattagatagaagttaggttagttaaggttagtaaaaagattgacgcagtctttcacagatgcttgagtgatcaagtactgtgagagactgtgttttatatatttacagtttattttcttcccgaatatcgaatgcgttgcagaaactgacgataagtacgatacaacctcccaatatacctataatcatgtaagcaatacgaatatctaatgcctgtgtaatagcgcctataagcaaaggagcgaccagcgaaccaataaaactgatactcgacaggatagtgagcgcaatgctgacgggcgtctttgacttggcccctacaaagctatataaagtaggtacgatacatgagatacctagtccgaccagcataaagcctaaggaattgatgatcactttcattcccagtgagtcaaacgcattgcccaacaatgcggaaatgaagaagccgatacaaataaggctgcctgccagttgcagtacttttttctttccccaaagctggtatgcataattcgtcaggaatcgtcccgtagccatcatgaccataaatacaaggaagccgatttgcaatgatttaggcacatggacaaccgattcaaaataaacagcactccagtcgaacatagcactctctacgatgagcgcgaataatccgactaaacctaattgtaaaaggagtatttccggcttttgaaataacagacggaatccattcggagctttatcagccgctttgtctgttgtctcaaagcccggcttcggatgttcgcatataggaagcgttgtttcttgcagatattttcgtcctgccaatactatgataaggataatagcggctattagcatataatgccagacaggagaggtgcccgtcagaatcatcacgaagccgataagtgctccggtacaggctcccaagctccatcctccatgaaaagttgccatgattgtcttaccatacaagcgctccacttcgatcccttgcgtattgaacgatatatcgcacaagttccagaacactccgaaacaaaaaagcaggaatcccagcaaatagacttcatgagccaatccgacacaaagtaaggacatggcatatcccaaaatgctgacttgtaccattgtgcgactccctaatttagatacaagataacccgccaaaggaattgctacaaacttgccgaccggtatcataaataaaatcagaccccaataaaatgcgtaattggctgcaaatacatctttgaaatccgggatacggcttgcccagcttgccatacagagtccttgggcaaagaagaaagtcaggatggcaaaacgtattttctcttttggatatgtaaattggttgttcatgagtcattctttttatgcaggcaaaggtatttattttttgtgttttacctttcctgctattactcttttttgtacttttgcagccgatttaaaaatatcacatacatgaagacaagcgaatctttattatctataggtaaattcatagccgaatattcagcccatctaatgggagcgggggtacatacctcccgtgttgtacgcaattccaaacgtatcggagaagcttttggcttagatgtcaaactgggcgtatttcataaaaatatcattcttactatcatcgataaggagacaagcgaagcctgcaacgaggttatagatattcctgcacatcccatcagctttgagcataactccgaactaagcgctttgagttgggaagcagtagacaaacagttatcgttggaagaactgaaagagaaatacaaaaagatagtctctgctccgatgatacatcctctgttcgttttgatattggtaggctttgccaatgcgtcattctgcaaactgtttggcggcgacttaatctcaatgggaatcgttttctccgccactattacaggattatacctgaaacagcagatgcaaaagaagaaaatgaatcattatattatattcattgtttcggccttcgtcgcgtccctctgtgcttctaccgccttgattttcgacacaacttccgagatcgcactggcaaccagcgtcctatatcttgtacccggtgttcctttgattaatggagtgattgatgttgtcgaaggatacgttttgacaggatttgcccgtttgacggaagcctctttgttgattgtcagcattgccatcggcctttcctttacattattaatggtaaaaaacagtttaatttgatatggtagcacttgatattctttctgatggtttctttgcagcgatagcaggtatcggatttggcgcaatttccgatcctccgttgcgtgcgtttaaaatgattgcaatattggcggcattgggacatgcgtgccgtttctgtctgatgacttacttgggtgtagatattgctacggcttctttattcggtggattagtaatcgggttcggcagcttatggcttggaaagcgggtatattgcccgatgacggtgctgtatattcccgcattgctcccgatgattccgggaaaatttgcgtacaacatggtattctctcttattatgtgcttgcagacagcgaataaaccggaactgcatgataagtatataaagatgcaggagatgttcttctccaacactttggtggcaagtacagtaattttcatgcttgcggtcggagctacattcccgatgttcctgttcccgcacagagccttttctttaacaagacattaattaaactacttttatggagattttttggagaacaattgcgtattataattcagccacttggcttttgcagattattgtcattctgatcggcattgtgctgaccgcattgctgatcagcaaaccacgtccgtgggtgaagatgggaatgaagatttatatgataggtctttattcgtggatttccattgtctattactttatctactgcgaagaacgcagctataacggagtaatggcgatgttctggggagtgatggctattatctggatatgggatacaatcaccggatatacgactttcgaacgtacacacaaatatgatctgctatcttatgtattgctggccatgcctttcatatatcctatggtatcgttggcacgcgggctatctttcccggaaatgacttctccggtgatgccttgctctgtagtggtatttaccatcggactgctgttgctgtttgcacacaaggtaaatatgtttttggtattgttcctttgccactggtcattgatcggattatccaagacttacttcttccagataccggaagacttccttttggcaagtgcgactattccgggactctatctcttcttcagagaatacttcctgaataatctgcacgcagataccaagcccaaagctaaatatatcaactggttattaataacagtctgcatcgggctggctatattattgacgactactatgtttttggaattagttccgaagaactgattgccgtactattacacgctattagtttcacgccttgaaacgattagtttcattgcttgaaacaaaaagtttcaaccgttgaaaccaacagtttcaaggcatgaaacttttttttatctgatagcataaaatattcggagagcatattgcatcatattatccggcagccagctcttgcttttagcaaacagaacttgcaccaacggacctactttagtccggaaaggaggatttttacgcgctactattttacagattgcagcacccagcttgcggggatggcatccgttacgctcttctttttcaataatctttaatgatctcagaaaactgtcagcataatcttcattttgtccggtcagttcagagatattccggttgtcggtaaacccggtattaaaatctcccggctgcaccaggcagactttaatatgaaacggatgaacttccagcgccaaggcctcgctgtatccttctactgcaaacttggatgctgaataaaatccctgataggggatgcccatcactccaccaatagagctgatattgataatctttccccgacgtgccttgcgcatataagggagcaccgctttgcacatattgaccacgccaaagaaatttgtattcatctgcatgctcacttcttcttcggtagccaactccaatgctccgccaattcccataccggcattattaatcagtacatccatccgtccctgctcggatattatttgttctacagcctgacgaacagaaatactattcgttacatcaacgacaagcattcggaccttacctatattctctgaaggtttccggctcgtaccgtaaacgatatgaccttgttctgataacatttgcgcagtgatctttccaaatccggaagaagctccggtaatgagtatgatttgtggttgcatattcttttatttgcagcaaagataaagagaatatccgaaaattctgtttttgccgaatagtattctgattagacggtttcagaagcttcctcctgcaaaacttggttttctgcaaaagatatcctatcttcgggaaaaataacgatatgaaaagaatacttatattcagcatagtatgtctgacttcaattatagtgtcgctgggacagtcagtggaaagcaccattcttcctcctacgggctacactcgtgaagtatgcgatgaacattcatttgccgcctatctgcgtcaactcccattattgcccaaagggagtaaggttttactttacaacggacaggagaaaaggaatcaggcagccgcattcgccgtagtagatatggaaataggcaatcgcgatttacagcaatgtgcggatgcagtcatgcgcttgcgggcagaatacctatgggcacagaaaagatacggagaaatcaaatttaactttaccaatggctttccggcagaatataaaaaatgggcggaaggaaaccgtatcaaagtaactggaaataaggtagaatggtatgctgcaggaggcaaagactattcatataagacttttcgtaaatacttgaatatggtatttatgtatgccggcactgcttctctttcaaaagagcttcgtacggttccttatacttcactgcaagcaggagatgtgtttatcaaaggaggttcaccgggccatgtcgtgatagtagtagatgtggcaattcacccgaaaacaaaaaagaaagtttttttattggcgcaaagttatatgcccgcccagcaaatacatatcctcgtcaatcctgccaaccgaaatctgtcaccttggtatgaactgacagatacagacagtggcagattgtatacaccggagtggacatttgaaaagaaagagctgaaaaggttttagaaattgcttacctggcacctttccttccggggtcccctcctgtaggtgggaggagcataaagatacctcttctcaactatttagtataacggtcaactcttgccgccaatcagcaccgttttctggttggaaggtttcgaagccaagttctttgcctatgtggatattcgaacttccatcgtcaacgaagagcgtttcggaaggtatgacatgactgtcttttatcataaagtcgaatatttcgggagccggtttggtatgtcccaactggtaagataaatatagtttgtcgcaataatcgttcagcggtttcccttcggatgaaaactccggactgcatgcccatgacataacaaaaggattggtattactcaagagatacacatgatatgatttacgaagtcccaatatataatcgagctttcgcaagtccacttcattgaaaaagcctaaccacgcctgtttggtttcttccatcgtcagttcgcgaccgcacagatctcccaattgcttccgaaattcatcggcactcaactttccttcttccagttcttggaagattccggtctgatggtatttgtccaaacgagtatcggcatccgccaatcccagtttgataaacgcctgaacagctttatcgcgatcaatgtctacaatcactccgccaaaatcaaatacaatgtttttaatcatgatatatacaatttttatttgttacaaagatacggctaatcttcttaataaacagcccgtcatcgcttgatctttgtcaaaaaaaacatgagggcaatctgcgatatgcataataataggagcataaataatatagttacactatcctgccgtgatggtgtaactatgatcacagtatagtgtcactatgagaggaggatagtgacaccattttttgtatggtttatagaggtgtatgtatcatattattttttatatttgcaaatccaatcgtttgtatacaaagataaaagcagagttatgaataatcttcgaatcttattatacgtggttgtcctttcactggctgcatgccatccggaagggactaatgtaaaacagggattagacaaagccgcacagctaatggggcaggacccggatacagcatctattattctcgaaaatatccagatcaaccagatgaacgaagcacagctggcagaatataatctgttgtgtacccagctgaatgaagataaaaatatcgcccatacgtctgataagcaaatccgtcaggcagtttcatactttgaccaacacggcaatgaacttcagaaatcaaaggcttatttttatctggcatgcgtagagagtgatcttgaccagaaaaaggaagcggagacccacttcaaggaagcaataaagcttgctgctcttacagagaagtacgattatgtagccaaggtgtgcagacgttgcagcctttattatcagaaatatggtcatttcgacgaagcattggaaatggaaagaaaagcctatgccagccagctaatgctgaacgatcagacaggcgatacgaagattattctttcttctgcattgggagtctttggtgtgatgtccttgttactcgggctgctctggaagaagaataagtttgtatattctcaactgactacttttaaagatgaaatgttgcgaaaagaggcagagtcggataaactgatgttgcaatgtaactatctggaagaaaaatatcagtcgcttcaacagcatatttatgaaagttctccggtagtatcgaaagtccggcaaataaaagaacggtctgtttccccttccaaggttgtttctttttcagagaaagactggagtgaattattaagactacaggaaggagtatatggacttgtttccaaattgaaagagataagtcctaaacttacagaagaagatttgagagtatgtgctttcctgcgcgaaggtatccagcctgcttgctttgcagatctaatgaaactgactgtagaaactcttacccgaagaatatccagaataaaaacggagaaacttatgcttgtaagttccaaagaatcactggaagactacatcaaatcattgtagtccacatttgtccggaattacctgacaaaaagctttgtttttcaacaccttatagaaatgggatgtccgtatccgtccggctaaaaatgcctgttttatatcactgttctataactttgcaaacaaaaaagttacagaactatgaactacttattatttaaaagatggaatgatttcagtggttggcttgtcttcctgatagcagctttcgtatacggaatgacaatcgaacctactgccagtttttgggattgtcctgagtttatttcatgcgccgaaaagttacaggtcggacatccgcctggtgcacctttttatatgctggtaggtaatctgtttacacagtttgcctccgatccctcccaggtctcacgtacagtcaactttctgaatgcactgctaagtgcaggatgtatcctctttcttttttggagtatcactcgcctggtcagatctcttctgaaagaagaaaaagagaatctgtcagtaaccgacgtgattatcattctcggttccgggttggtaggagctttggcatatacttttagtgatactttctggttcagcgcagtagagggagaagtatatgctttctcttcttttcttactgccttggttttttggatgattctgcgctggcaggatgagtcggacaccgtttatggtgaccgatggattattctgattgcctatataatcggactctccatcggagtacatctgctcaatctgctttgcattccagcgattgtactggttttctattatcagaaatatcgaacgatttcgcttaaaggagcaattgcggcgattgctttatccggtctgcttattgtattgatactttttgtctacattcccggaatggcggatattggaggatggttcgaactactctttgtcaatgccttgggatttcctttccaaacaggactgattggctttctggctatcacatttttcctgctcatagctggtatctatcgtttcaaaaaacgattaatcaatacagctttatggtgcatacttatgcttaccgtaggttataccacctatgcagtgatattgattcgtgccaatgccaatacaccgctcaatgaaaatgctccggataatattttcgcactcaaaagctatttgaaccgggagcaatacgaaagcgcccctttactttatggcaaaacgtatgcctccgaaccggagtatgtgcccgaaggagattattacaaggtaaaaatgaaaacgggtggtgctgtctacagaccgaatagggaagaagggaaatataaagtgattcgaaataaagaggaagtatgctatactcaaaatatgctgttttcacgaatgtggaatgatcgcatggcttcctcctacaaaagctggtcggaaggaacggacggagctcccacgcaaaaagagaatcttacctacttcttcgcttatcagctcaattatatgtattggcgctattttctctggaattttgtcgggcgtcaaaatgatatccagggacatggcgaaccggagcatggaaactggatcacgggtattcctctgttagataatctaaggcttggtgatcaggaacttttacccgaatctctgcgtcagaataaagggcataacgtattttacgctttgccgctattattgggattaatcgggatttactggcaatggatgcggggaaagaaggggatgcaacagtttagcgtcgtgtttttccttttcttcatgacaggtctggctattgtgctatatttgaaccagactcccggtcagccccgtgaacgggattatgcatacgcaggttcattctatgcttttgctatttggataggaatgggagctgccggattgtgtgacgcacttcgaaaaaagaagtcgtcagtacttcaagtcggcctgttaatgtttctctgcctgctgattccggttcagatggctagtcagacgtgggatgatcatgaccggagcaatcgtttcacctgccgtgattttggagccaattatctgatgacactccccgacaaaggaaatcctatcattttcagtaacggagataatgatacttttcccttgtggtataatcaggacacggaaggagtacgcagagatgcccgcatctgcaatttgagttatgcgcaaacagattggtatatttatcagcagcaatgcccgttgtatgatgcacccggattacccattacctggagtaaagatcaatatcaggaaggaaaaaacgaatacgtagccatccgaccggaactgaaaaaacagatagaagagctttatcagaaacatccggaagaagcccgtgatagtttcggcaatgatccgtttgaggtaaaaaacatcttgaagtactgggcattatcggagaaacaggacttccacgtaatccctaccgatacgatcagtatcagcattgataaagatgcagtgcttcgatcaggcataatgcttcccgactccatccgtcatctgaaaggtaaagaactaaaaaatgcgataccggataagatctatatttctctgaaagatatgcgtattctaaccaaggtagatatgctgatgctggaaatgcttgccaactgcaattgggaacgcccattgtacatggcaatatccgtcggtgaggtcagcaagctgaagtttgatcattatttcgttcaggaaggattagctttccgtttcacgccttttgattataaaaaatggggaaatgtcaaaggagataataactatgcgatagatgtagagagattgtatgaaaatgtaatgaacagatataagtatggcggactggacactcccggactctatctggatgaaaccaccctgcgaacctgctattatcatcgaaggcttttcgcccaactggcaaaggaactgatcaggcagggcgacaatacccgagcaaggaaagtacttgcctatgcagaacaagctgttccggcgtacaatgtccccgagatctatgaaagcgggtcattcgacatagccaaagcctatgctgccctaggagaaaagacgaaagcaatgcctctgttaaagaacctgacagccgaatcggaagattacatcaactgggcattctcattaggagacaacaggatcaatatggttcagagagattgcctgtataagttctggcaatggaatcagtataatgaacttgtaaaagagattgatgaagaggaatacaggctaagtaatcagcgctttgaggagaaatatgctttattctctcaaatcgtgggacttagaaactaaaatccggaaatataaacttgaaaacaataaaactatcagaagtatgagaaatgcattgagtaaaataaattatattattctatcgattggttcgatattgattatcacaggatatgtattaatgagcggcgaggggagtacccctgccgcatataatcctgatatcttcagcagacttcgtatatgttttgcacccattatttgtttactcggttatttgctgaatgtggttggcattatttatattacaaaaaagaataattagcagggatacatcttaaatattttcaaaagaatgcgtttttaagccaaataattacttcttttgtcctcactaataaaaatgaaagtcggacaacatgagtaataacattgacataaaaacgcttgaagccttccaggatggaaatcacaaggcttttgaaacagtttttatagcctattacaataaaacaaaggctttcatcgacggatatataaaatcggaatcggatgccgaagaattgacagaagacctttttgtcaacctttggatcaatcatgattcaattgatgcatccaagtcttttagttcttatctgcatacaattgcccgtaattcggccataaatttcttgaaacataagtatgtacatgacacttatctaaatagtagtcaggagatcgaatatagttctacctccgaagaagatcttattgctaaagagttaggcttattaatagatgacattgtcggaaaaatgtcggaacagcggaaaatgatctatacattaagccgtcaggaagggttgagcaatgctgagatagcaatacagctcaacaccactaaaagaaatgtcgaaagtcagttaagcctcgcattaaaggagatacggaaagctatctcgtgctttttattatcttttttataaaaacatccactttttcattgagctttttgtcatcagactgtatatatagtaaatacagcaaaaatggaaaagagtaatattatcaccagaatcatcaaaaagttcctttccggacgtttttctgttgaaacggaggaaaaggtacagcgatggattatgaaggaagaaaacgcggaggagaaagaaaaagcctcattagagtattggaacgaactggatacggaagccgattcaaaaacatacagtgctttagagcgggtcaatttaagaaccggatacaacaaagaacatcttgaaaatattgttttatatcataagtttgtccgcattgtagccgtcgttattcccatatgcttattggcaggaggattgctttattatatcccttccgaaaacgagcagatagaaatatccacagcctatggcgaacaaaagcgcttggttctgccggatagttccgaagtatggctgaacgctggaagtacaattacctatccgaaaacttttaccaaagagaatcgtgtcgtaacccttgatggtgaagcctatttctcagtcagaaaagatgatgcaaaacctttcatagtagaaacatcgcaactatccgtcaaggtacttggaacgaagttcaatgtaaaggcatatgctaatgatgcgaatattaccacaacgttgactagtggaaaagtggaagtgagtacgcaatcccgtcctcctcaaactctcaagcccaacgaacaactcacctatgataaatcgacatcagatattgagatatcgacagtagacactgttgacacgaacagttgggtaaaagggaaaataatcttcaccaatgctactgccgaagaaatattcagaacgctggaacgacgttatgatactgttatcgatcattctaccgatttttctgcctctagacggtacactgtcaaattcctgaaagatgagaatctggatgaaatgctgaatatattaggagatataatcggctttagctatcggcagagtggaaacaaaataataataaccaaataaaaaaaatagcctatgaacaaaaagaaccgggaagcagcttgagaccctcttcccagttctgaaatgtctatcctcatttaaaccgcgaagtaaaaacgaagtatcaacgtacaaatataaaataatgaatcgaattaatgcgaataaaaaaccagataagatgatcattcttttgtttttttctattctgtcattgacggcaat

SEQ ID NO: 127 - DNA, 22540 bp, Bacteroides thetaiotaomicron
gtgcttgtccgggtctgcatattctcgtttttatctttatctttgtaggaaaatataaaaatatggcacaacatacttatgatgaagaatcggtccaggagctgttgggctgggcgaaaaagatgcttgaaacaaagaattacccgacagaaaagtatcaggttaatgcgtgtacttcaatcattgatggtaaactttatctggagtctttaatttcgatgatttccaaaaactgggaaaatccgacttttcatcctaccattgagcaactgtgggaatatagagaaaagtgggaaggtcaaaaggagtaatgtaagtttcagatctcctcagaaaatgcataatgcactctgaagcgatgtgcccggagtgcattatgcatttttattaatggatgtaagtctgatctttcgcgtcggagattaaaacggcaaccattttctttttttcttctgactggtattttcttctctttgctggctgtatatatcggcaaatgtctttttctcttttatcatttcatagataattccccagtcgggaataccgccgacattccggtcgtctataaacagatcggctttcagttttcgggaaaagccctgatgatctctttcttcttccggatagtctttattggctgcataaaactccagtcctctggctctgcaccattctatggcttcgtccagaagttctccctcgcgtacactccacaagattaaacggtgcttttcttgttgtaacaatttcagcgtttcaactgcaaatggaatttcttcaccaatacgtggataacgatgctctacaatcgttccgtcaaaatcaacagctatagtcattatgatatatttagaatacgtaatttaggacaaagatacggactgtaagctaaaaaaacgtatatttgcgctgaattaacattttaataaaaaaacagagattacatgaacaattcccctcagcgtgccgccaaaggttttacaagagccttttgggtgagtaacacagtcgaactgtttgaacgtatggcatattatgctgtttttatcgttctcactatttatttatccagtattttaggttttaatgatttcgaagcaagtatgatttccggccttttctccggaggattatatctgcttcctatattttcgggtgcttatgcagataagataggtttccggaagtcgatgattattgccttttctttattatctatcggttatttggggctgggcgtattccctacattgctcgaagcggcagggttggtgagttacggtgcgactacccggtttaatggtttgccggacagttcttcccggtggattatcgttcctatcctgtttatccttatgataggaggttcttttatcaagtctattatttccgcatctgtggctaaggagacaacggaagcgacccgcgcccgtggttattctattttttatatgatggtcaatgtcggtgcttttacgggtaagacaattatcgaccctttgagaaatgtgatcggcgaacaagcttatatttacattaactatttctccggggcgatgacggtgattgccttgctggcagtgatcctgctatataaatcgactcatacggcaggtgaaggaaaaagtctgcgtgagatagggcagggctttatgcggattatgactaactggcgtttattgattctcattttaatcgtaacaggcttctggatggtacaacagcaactttatgccactatgcctaagtacgtcatccgtctcgcaggcgaaacggccaaaccgggatggatcgcgaacgttaatccttttgtggtggtatgttgtgtcagctttatcactcgtttgatggcaaagcgcagtgcgattacttcgatgaatgtgggtatgttcctaattcctgtttctgcattgctgatggcttgtggaaacatattgggaaatgatattatctcaggaatgagcaatattactctgatgatggtggctggtattgttgtacaggcgcttgccgaatgtttcatttcgccgcggtatctggagtatttctctctgcaggctcctaagggagaggaaggtatgtatttaggattcagtcatctgcactcattcctttcttctatattcggtttcgggctggctggtattctgttgacaaaatattgtccggaccctgccttgtttgaaactcgtgcggcatgggaggccgccagtgcgaatgcgcattatatctggtattatttcgctgctatcgggctgattgccgctatagctttgctattattcgcaaaaatcaccgaatccatcgacaaaaagaagaaatcttctcggtaattatcttcttttttatgtatatttgccgtcactttgctgtaaaagttgacggcattttgcattttaataaagaaagataaaacatgaaagtaagatttataagcctggcgagtggcagcagtgggaactgctattatctgggtactgatacctatggaatactgatagatgccggtatcggcatccgtaccatcaagaaaacactgaaagatttcaatattctgatggaaagtatacgtgccgtatttgtaacgcacgatcatgcggatcacatcaaggctgtagggcatttgggggaaaagatgaatatacctgtttacaccacggctcgtattcatgaggggattaatcgtagttattgtatgacggaaaagctcagcacatcggttcgttatcttgaaaagcaagtgcctatgatgctcgaagatttccgtatcgaatcttttgaagttcctcatgacgggacggataatgtaggatattgtatagaaatagacggcaaagtcttttctttcttaaccgacttaggggaaatcactccgacggcggcagattatatcagcaaggcaaactatctgattctggaagcgaactatgacgaagaaatgcttaaaatgggaccttatccccaatatctgaaggaacggatcatgagcaggaccggacacatgagcaattctgctactgctgaattcctggcagaaaatatcaccgagcacctgcgttatatctggttgtgtcatctgagcaaagacaataatcatccggagctggcatataaaacggtagaatggaaattaaagaacaaaggtgtaattgtaggtaaagatgtgcaactacttgctttaaagcgaaatacgccttctgagctttatgtgttcgaataataacgaaaaaaagatagtaaaaaagctgcattattgtttggtcaaatgaaataaaagacctacttttgcaaccgcaaacgaggaaataagcactcttagctcagttggtagagcaactgactcttaatcagtgggtccagggttcgaatccctgagggtgtacaaatccaaagttgcaatataaaaaaatgttgcactcttagctcagttggtagagcaactgactcttaatcagtgggtccagggttcgaatccctgagggtgtacaaagaatgaagaagtaacttagttacttctttttttgtttatatgaactgccttgtaagggatcagttgtaaatcttgtgaggactactcttcaactcaatttgagcctactcttcgggacttgttgctccttagcccgaaagatgcttgccgatttaatcagacctgcctggtttaatagtctatgcttcgttgattaatcccttttgtatgctaagttaatgtcttttgaaagcaataagaacaagtttcaggtacgtgatcccatcggttcatgtacgtgggctgatgggatcacgtgcgtagtctgaatgtttcacgtacgtaaaacgagagcatatatcctgcaaaatgtattaatcaaggcttgttgatgtattaggtataccggctttaactattatacatgccatctaaaatctcttaggaggccaaagaagcatcgtttaatgctttagcaaataaaattttgttgttgactggagggagaaataatggattaataggaattatagaaggcaaaaagggggtgaaaatacaattctcgggtcgaaaatacagttctctgtgataaagagaaaaagatgttagtttctgtttaaatgttggtaatcagtgtagtaggaaatatgggtgataatagaaggtgataaatgaattcatataaattctattatcaccttattatcaccgcttattgtcaccactattttattgattactaactctttaactataaaaggtgacaagtgacaatagaatcgtatatgaaactacaaggagaggaacgttagttttaaaaaaaaataccgctgtggagcatcgtgccccgacagcggtattactatttagtaattcttgttttagaatttgaagaagttcttggcattgttgtagctgatgtcttcgatcatctgatttacgcgatccatttcagataccggaatttctccgttctccacatcacgtcctaccaaattacataatgtacggcggaagtattcgtggcgtggataggaaaggaatgaacgggagtctgtcagcatacctacgaaacggctcaaaagtccaagtactgacaacgcgttcatttgtttttccataccatctttctggtcgaggaaccaccatccggaaccgaactgaatcttgccggctatcgagccatcctggaagttgcccagcatagtggcaatcacttcattggcgcaaggattcaggttataaaggattgtcttggtcaacttgccgttaacgttcaggcggtcgaggaatttagacattgccttggctgttgtaaattcgccgatagagtcgaagcctgtatcgggtcctaacaatttgaacatcttcgtattgttgttacggatagcaccgtagtggaactgctgagtccatcctttttcccagtccatttctccgaagattaccaacatagcagacttgaatttcagaatttcttctttagtcaattcagctccgccatataccttattaaatatagctttgatttctgcgtcggtgtaatcttctgcatagaactcttcgataccgtggtcggacaagcggcagccctgttcggcgaagaagtcatgacgtttgcggagagccgcaatcatatcgtcgaaattggagattgtcacgccgcttactgcagacagtttttctacataagcgcggaagtcggcaggaacttctactgccattgccttgtccgggcgccaggtaggcaacattttgatttcaaaaccgctttcgcgtgtctggatatgatattccagagaatcaatcggatcgtccgtagtacatactacttccacgtggtaacgacgcatcattccgcgagctgagtattctggctgagccaacttctcgttacactcgtcgtaaatctcgcgtgcagtcttggggcttaaaatcttgtcgatgccgaaagcagtcttcaattccaggtgtgtccaatgatacaacgggttgcggaaggtataaggaacggtttcagcccatttttcgaacttttcccagtctgtggtatcttttcctgtacaatagcgttcgtctacgccatttgtacgcattgcacgccatttgtaatggtcgccacccaaccagatttcagtcagtgatttaaacttgtagtcgtcagctaccatttgggggattagatgacagtggtagtcaataatcggcattttagccgcatgctcgtgatacaacttttgtgcagtttctgtctgcagcaagaagttttcatccatgaagttcttcattgttactgtgtttttagtatataaaattattactttctgcatttatacctatatagtattgattttaaagctaataggtgtaaatctttgttttagttttattaaccgttatcgaacacaaaaatagaaaatttacttggagtaacaaaataattcgtatatttgcagcgattatttataatatttaagttttagcactatggaggaccagaactataccatcaaagacattgcccgtatggcgggtgtttccgccggaacggttgacagagtgctgcacaatcgcggcgacgtatctcctcaaagcaaggctaaagtacaaaaggtattggatgaaattcactaccagcctaatgtatttgctatcggactggctgccaagaagaaatattctttcgtttgtctgataccttattatatagagcacgactactggcattcggtagtgggaggcatcgagcgggcacgtcaggaattgcgtcctttcaatgtgagtgtggattatctttgctatcatcaggggaacaaggaaagttatctggaagtgtgtcgcagagttgaagaaagcaatgtcgacgctgtactgatcgctccgaacttcagaaatgagacattggctttgacagactatctgcaagctaaaaaaatagcttatgcattcattgacttcaatatggaggaagcgaacgcactgacctatatcggacaggactcttataaaagcggatacattgccgccaaaatattaatgcgcaactatcaggccggcgaggggcaggagctggttttgttcttgagcaataataagaacagtccggcagaaatacagatgcaacggcgtttggcaggatttatgagctttatcaccgaagagtatgaagagttggtgattcatgaagtggtactgaacaagtctaatcaggaaaataatcaaaagacattggatgaatttttccggctgcatccgaaagctacgttgggtgtcgtattcaattccagagtttatcagctgggcgaatatctccgtagtgcgggacgtagcatgaaggggctgataggatatgaccttctgaaagcaaacgtggaattgctgaaatccggtgatgtgcattatctgatcggacaacgcccggggctgcagggatattgtggcgtaaaagctctttgcgaccacgtcgttttcaagaaatccgttgaaccggtaaagtacatgcccatcgacattatgataaaggaaaatattgatttttatttcgaatttgtataatatcaactttataaattacaactaacatgaaagcattaaacaaagaaacagctcctaaagtacaacgtccggagcgcattatccaatttggcgaaggtaactttttacgtgcatttgtagattggattatttacaacatgaaccagaagactgacttcaacagcagtgtggtagtggttcaaccgattgataaaggtatggtcgatatgctgaatgcacaagatgatttgtaccatgtcaaccttcaaggattggataaaggagaagtggttaacagcttgacaatgattgatgtaatcagtcgcgcattgaatccttatacgcagaatgacgagtttatgaagctggctgaacaaccggaaatgcgctttgttatctcgaacactacagaagccggaatcgcctttgatccgacttgcaaactggaagatgctcccgcttcatcttatccgggcaagctgactcaattgctgtatcatcgttttaaaacattcaacggtgacaagacgaaaggtctgatcattttcccttgcgaactgatcttcctgaatggccacaagctgaaagaaacgatttatcagtatatcgacctgtggaatcttggcaatgaattcaagacttggtttgaggaagcttgcggagtatatgcgacattggtagaccgtatcgttccgggatttcctcgcaaggatattgctgctatcaaggaaaagatacagtacgatgataaccttgttgtgcaggctgaaatcttccacctgtgggtaattgaagctccgcaggaagtggcaaaagaattcccggctgataaggcagggctgaatgtattgtttgttccgtcggaagctccttatcacgaacgcaaagtaactttgctcaatggtcctcacacggttctttctccggtagcatacttgtcgggtgtgaatatcgtgcgtgatgcttgccaacatgaggtaatcggcaagtatattcataaagtgatgtttgatgaattgatggagacattgaatcttccgaaagaggaactgaagaagtttgcagaggatgtattggaacgtttcaacaatccattcgtcgatcatgcggtaacaagcattatgcttaactcattcccgaaatatgaaactcgtgatcttccgggattgaagacttatctggaacgtaaaggggaactgccgaaaggactggtactcggattggctgctattatcacttattataaaggtggtgtacgtgcagacggggctgaaattgtaccgaacgatgctcctgaaatcatgaacttgctgaaagagctttgggctaccggttgcacgaagaaggttaccgaaggtgtactggcagcagagtttatctggggcgaagatttgaataagattccgggactggcagcagctgtaaaggctgatctggattctattcaggagaaaggtatgcttgaaacggtaaagggtatcctttaagtaagtaatatcatataaaaacagcgtcactgttcgttgtgaatggtgacgctgtttttatgtgtatatatgatatcaaagatagttctgatagaaaggagaaaaacagttttctttctattcagcttcagctgtatgaagaatgaatgtggtagctccgatagttacgattgctccgtcttccatgcggacgcggtctttatctcccagaatctcattcatgagaaaggtacctgtgaggctgggggcgtcccgtaatgtgtagacaagctttccctgtttgttacgcttcacattaatgatgcagtggcgtctgtccatactcatgtcaccgctttcgatcggagtattgataacggtacccacgcaacgacggcctatcacattatcaccttcttgcaacggaagtacttgtttgaaaccaaacacgttttcaataaccgtaatataaccgaattcttctttatgaacctccgcttcttcttccaggttctcttcctttctaagggcttttactttgctttttccgagacggatgctgaattgtttgccacaatgttcgcattcgaatacaagcgattgaccttcgctgtatttggtttcatcaaaaaaaaggtaattctcacatttaggacaaagaactcgtttcatgtttcaaaaggggatttattttgccagtaaccaggcattcttataagtttcgttttttctaagctccagtagttgtttggtagcttcttcgcgatttccgaatgaacggatgctgacacgtactttgccatcgctgttcaaggctttcgcttcggcaaatccttttgcctttaattgttctgccattgcttcagcatctttcagaccgattcctcctgctacgataatgtgaaagggatgattggcctgtggctgaactgcgggtgcaaccggagttgtcactgcggtcgtagtcggtattgttgctgtcggtgcggccggtgttgtttcctgcttggcaaccttgacttctttgacagcgataggtcttgaagttctggctttatcagcggtaactttcttcgtctgaccagtcgcattcttttgattatgctttgtttctacagaaacaggagtgactgcaaccgattgtttttctatttgctcaaaaagctcggcaggcagcaactgggcataattgttcttctcgacatacgtattttctacaggagtagagaatgcgaagaacataacgataacggcaatcattgccgcagcattacgaagaagggtacggctgatgctgatttcatacgttttcttttctttcgtcagactggcaggtaccagtattctttcttttcgctgcaacgcagagagctcacgcatctcaaaagaatccaatccatataatgaaggagtcgttatcttatgatcataaggagtgaattcgtagttcccgtaaatgttataacggatttcacccacgttttccaaatcggctttaccttcttcatgaagaatctcgacgaaggcgttcacttctttctccaccatacgggtagcatcggcaaaactggtgtcatgcgcagacatataggactgtaccaacacgccgtcattcagtttaagctgagaattgaaaccgatgatacgggtaggaggtaaaaaaagattttcttcttttacataggttgcgggagcgtagtgtgctacgaatccgccaaaattaggaacgattacgcaatcgttctctaacaacagagcctctatgtgttgtgctaattcaatcatagtgcaaaattaagagattaattgaatatatcccagaaaacttcgaaaaaatcactacttttgcatcgttttacttattactactaacgatgaactatatacagacagaaatagatggggtgtggctgatagaacccaatgtttattctgatgaacggggctactttatggaagcctttaagaaagaggagtttgaagcgaagatcggtccggtagactttgtgcaggataatgaatcgaaatcgtcctttggcgtattgcggggactgcactatcagaagggtgaatacagccaggcaaagttagttcgcgttctgaaaggaaaggtgctggatgttgctgtcgatttgcgccggtcgtcaccgacttttggaaaacatgtcagcgcattgctcagtgaagaaaataaaaggcagttttttattccccgtggttttgctcatggctttgtggtgttgagcgaagaagctgtgttcatgtataaggtagacaataaatatgctccgcaagcggaagcgtctatagtatataatgatgaaacgttaggcatcgactggatgcttggggagtcgcagatgcttttgtcgcccaaggataaagagggcatggctttcagagatgctgtatattttgaataaactctaacaaacgatagatatgaaaatagcgattgtcggaaccggttatgttggtttggtaactggaacatgttttgctgaaattggcgtaaatgtaacttgtgtagatacgaatagcgagaaaatagaatctttgcagaaaggaatgattccgatctatgagaatggattggaagaaatggtacttcgcaatgtcaaggcaaaaagactgaaattcacgacttcgcttgagagttgcctggacgatgttgaggttatatttagtgctgtcggtacgcctccggacgaagatggcagtgctgatttgagttatgtgctggaagttgcccgcaccatcggtcgtaatatgaatcaatataaattggtagtgacgaagagcacggttcctgtaggtactgcgcgcagagttcgtgccgctatacaggaagaactggataaaagaggagtgaacattgagtttgatgtggcttccaatccggaatttctgaaagagggcaatgctatcagcgactttatgagtccggaccgtgtagtggtaggagtggagtctgttcgtgcggagaaactgatgtcgaaactctataagccgtttttattgaataacttccgtgttattttcatggatatcccatcggctgaaatgacgaaatatgcggctaactctatgttggcaacccgtatcagctttatgaatgacatcgcgaacttgtgtgaactggtaggtgccgacgtaaatatggtacgtagcggtatcggttctgatactcgtatcggacgcaagttcctatacccaggtatcggatatggtggctcttgttttcctaaagatgtgaaagcattgatcaagactgccgagcaaaacgggtatactatgcgtgtacttcgtgcggtggaagatgtgaatgaggcgcagaaaggagtcttgtttgaaaaactgatgaagcagtttaatggtgatttgagaggtaagaccatcgccttgtggggattggcttttaaaccggaaacggatgatatgcgtgaggctccgggattggtattgatcgataaacttctgaaagcaggttgtcagatacgcgcatacgatccggctgcaatgaatgagtgtaaacgtcgtatcggtgatgttatttattacgcccgcgatatgtatgatgcggtacttgatgctgatgtcctgatgttaattaccgaatggaaagaattccgtctgccttcatgggctgtcatcaaaaagactatgaatcagcaaattgtgctggatggacgcaatatctatgataaaaaagaaatggaagagctcggatttatttattcatgcattggtaaataagataattagagtatctttatacacaaaatttagacaaatgacgaaatatgtagcgatatcgttagtagcgatcttgctcgcagcatgtaacagcagtaagaatccgcactcttcctccggacaagaggaggatttgagtgcgaaagaactgctgcaaggaatctggctggatgatgagactgagagcccgttgatgcgtatagaaggggataccatctattatgcagattcgcagagcgctcctattacattcaaaattatacgggatactctttatacttatggcaatgatactacctattataagatagataagcagggggagcatattttctggtttcattcgattgcagataatatgatcagattgcataaatctgaagatcctaatgattcgttatcttttgtcggtcaggaaatgattattcccacctatacggaagtaacgaagcgcgatagtattgtgaactataatggtagccgctatcgtgcttatgtgtatatcaatccatccaaaatgagggtgatcaagactatatatactgaagacggtattagtatggataatgtgtactacgataatgtgatgcacatttgtgtgtatgaaggcaagaagagcctgtttgccagtgatattaccaagcagatgtttgaaagtgtggttcctgcggatttcctggtgcaggcaattttatctgatactaaatttgtaaaggtagaccggaatggtttccattatcaggctgttttatccattccggaaagttctatttacagtatagcaaatttgactgtcagttttagcggcaagttgactattactccgacgaaatagccaaatgttttttagtttcttgcaggagaagaggggcggttattgcctttttttccattgttgttattcctttttcctccgaagcttcttcttttagaactgtcacctctcttattgttgtaagagcggggcttgtattccggtgcttctcctaattcggcgggaacgggaattttatatatttctttttcaagaaagttctcgatggatttgaagttgctctgttctttctcgctgataaaggtgagtgctactccgtcattgttggcacgtgctgtacgtccgatacggtgcacataatcctcgctgtcatgggggacatcaaagttgataaccaatcggatgtcgtcaatatcgataccacgggcaacgatatccgtagcaaccagaatattgattcttccggctttaaattcgtgcatgaccacttcacgttgtgcctgttcaagatccgaatgcatttctcctacattcagtttcatcattttcagagcctttgttacttctttaaccttgattttggaggaagcgaaaataatcacacgttcgggtacttcgtcagtaaaaaggctgcgtatgatacctagcttctgattctcgtaacatacataagctgcctggatgattttatctgccggtcttgaaacggcaagtttgatttccgccggattattcagaattgtttttgccagttgctgtattttggcaggcatagttgccgagaacatgattgtctgtcgttctttcggcaaatatttcacgatttgcatgatatcttcgtagaatcccatatcaagcatacggtctgcttcgtccagtataaaataagaaaccttggaaaggtctacgtatccaaggcttaaatgggctatcagccgtccgggagtagctattactacatctgcacctaacgtaagtcccttcttctgttgttcgaaaaggattccgtcatttccaccgtatacggcaacactcgatgcgggcataaaataggagaagccttccatttgctggtcgatttgctgcgccaattcccgggtaggggacataatgacacagttaatggcatcttcgggatgtcctccttcggataacttattcaggataggcagcaggaatgctgctgttttaccagtgcccgtttgtgcaactgctatcaaatctttaccttctagtatgattggaattgcttgttcctgtataggcgtgcactcgtcaaatcgcatggcgtcaagcgcatcaagcacatttgcatttagttttagttcggaaaacttcattacttctttttatttgccgacaaagataaaataatttttggtctcaattacatattcaaataagaatctttgaatcccaggaaatagagcactccgtcaagcccgatggtattgatggattgtttggcatttgccactactttgggctttgcgtggaaggcgattcccagtccggcgattcccagcataggaaggtcgttggcaccgtctccaacggctatcgtctgagcaatatcaaccttctctacctgagcgatcagacggaggagttcggcttttcgtttgccgtctactacgtctcccagatagcgtccggttaatttgccgtctacaatttccaattcgttcgcatatacgtaatctatgccgtatttcttttgcagatactgaccgaaataggtgaatcctccggaaagaatagcaattttgtatccatattttttcagtacatacatcaggcggtctactccttccgtaataggaaggctttctgctatttcctgcatgactgattcatccagtccttttaacaaggctacacgacgtgtgaagctttctgtaaagtctatttctccacgcatggcgctttctgtaatggcctttacttcatcacctacacctgcacggatagccagctcgtcgattacctcagtttcgatcaaggtagaatccatatcgaaacagatcagacgacgcatacggcggtacatattatcttgctggaaagaaaagtccatctcctgttcgctagccagctgcatcagtcgctcctgcatggcgatacggtctttcggggtaccgcgtacggagaactcgatacaggcacgggtacgggtatccgttttgtcctcatccaaagggatacgccccgtcagacgtttgatggcatcaatgtttaagtcttgttctgctagtacgcgggtagcggcagagatctggcgagcggacagtttgcggcccaataccgtcagtatatagcggtttttcccctgcatacctacccagttctcatactgatcggttcctatcggttcgaaacgaatggttactcccaatgaagatgccttaaacagcagctccttcataatgaatccggaatgcctttcttcgcttctgaaaaggatgcctaacgacaaagtattatggatgtccgcctgtccgatatcaaggatagtagcgtcatacttggcaagtatttcagttacggaagcggtaagtcccgggcgatcttcgccggtaactcgaatcagaatcaattcagtatttgatggttgcataaaaaaatagactttaacgctgcaaaagtagggaaaaaagttcgtttttatgctaaataacataaaaagttataccccaaaagtaagaaaatggcttgtttttttggaagttaatttaataattacttacctttgcacccggtttcaaaattaaaggcactgataatcagcggattcctcttcgcctgatgcctgaaaagacaacgtttcgggaagaaaccactgtttaaggacagtcccggatagtattaactaaaaccgcattacatgaattcttatgtaaaatggatttttgttgtattactgatttgttccttgaccgctttcgttgagaaagacaaacctaccggaggtttgagtgagggtgacgtagcccctgattttaaaatcgaatctgcgtcgaatgggcaaccggcttttaagttgggtaatttgaaaggtaaatatgtgttgcttagtttttgggcaagttatgacgcgcaatcccggatgcaaaacgtaagtttgagcaatgtgcttcgttcttcccgtaatgtggaaatggtttctgtttcgtttgacgaataccagtcaatctttaaggaaaccgttcgtaaggaccaaatagttacgcccacttgtttcgtggaaacagaaggcgaggactccagattatttaaaaagtaccgtttgaatcgggggttcacaaactatttattggatggaaatggtgtgattatagccaaaaacatctctgctgcagatctttctgcttatgtaagtgagattggttgacaatctcgaaaagagtaaggagaaagagggattttccgaatcacccatttggtgattaaaatggagaatagacaaaagaggaaatggatacaacaaaaaagttccgcctgtacttgctttcggcaagaataggcggaacttctattttagatctccttgatctaagttttatgtttccttatttaggtgctttctgatacagatagaatgcgatgcctgcatagaggatattgggaatccagactgcaatcgcaggaggcacgttaccgtttatggcaaaggtagaagtgattgtctggaacaggatataagagaagctaagccctaatccaatacccagatgaagtcccataccacccttcgtttttcgtgatgaaagagaaaccccgatgattgtcagaataaacgaagcaaatgacattgcaattcgtttgtggtactcaatttcaaactctttgatattggcaaatccccgtcgtttctgcttttctatatattcgctcagttccggactggtcagcatctcctgttgattcttcatgatcaggaagtccgatgggtccatatttataatagagtcgatccggtctcctttggtgatcttttcttttagtccgtccagttcacgtaccatatagtcgtgaatggtccatttattgaccgttgttgtatcgtaagtgatacggcgtgccgttaagtgggagacaagtttcttgtcgacaaacttatccaatgaaaagcggttgccggttttcattccgtcattgtaattatcgatataggctatgacaccactgtccacttccaactgcacgtttcggaccgagttgactttcttgggtttgatgtatttatcttcaaagttcagacgggtaacactacctttgggaatgatgaacgaactcatcatgaatgttgccgcagcaatgatggcggcagagatcatataggggcgcatcattcttttgaaactcataccggtggagaacatggcaatgatctcagagttctccgccagtttggaggtaaagaagataacggcgatgaatacgaacagcggactgaacagattggagaagtaggggatgaagttcatgtagtattcaaagatgatcttgtcccaaggggcttcatgctccatcagcttgtccatcttctcgttgaagtcgaataccaccgcaattgagataatcaatgcaatggcaaatacgtatgtccccaagaatttcttgatgatataccaatccagccgttttattaatcgattgcttttcattctttataatcttgttgacactctttttaccatcatcggcttccaggtagagaaatctccggcaatgatatgtttccgggcttcacctaccagccacaggtaaaatgccagattgtgtatagaagcaatttgcattgccagtagttcttgtgcgtggaaaaggtgacgcaagtacgctttgctgtataacgtgtctacagcagaagcaccgtctgcctcgatgggagagaagtctgtttcccatttcttgtttcgcatattgatgataccgtctttggtaaacagcatgccatttcgtccgtttcgggtaggcataacacagtcgaacatatcgactccgcgttcaatgccttcaaggatatttacgggggtaccgactcccatcagatagcggggcttgtctttgggaagaatctcgttgacaacctctatcatctcgtacatcttatctaccggttcgcctacggccagtccaccgattgcatttccatccgctcctttggaggcgacgaattcagcggattgcttacgcaaatcctgataaacacatccttgcacgatggggaagagagactggttgtagccgtatttcggttcagtttcgttaaaacgctgaatacaacgatcaagccatctgtgtgtcagccctaatgactttttggcatatgcataatctgaatctcccggaggacattcgtcaaaagccatcatgatatcagcgccaatggtacgttctatatccatcaccttttccggggtaaagatatgtttgctgccatcaatgtgcgagcggaattcggctccttcttcccgaagttttcgtattcctgctaatgagaatacctgaaaaccaccgctatcggtcagcataggacgatcaaaaccattgaagcgatgcagtccgcctgccttttcaattacgtctagtcccggacgcaagtataaatgataggtgttgcccagaataatctgtgcctggatatcttctttcagttctgttacatgtactcctttaacagtgcccagtgttcccacaggcatgaagataggtgtttgtatctgcccgtggtctgttgttatcagacctgcacgggcattacttttagtgtctgtatattgtaactcaaatgtcattcctggctgggtttctttacagataaatcaatggcatccgcaactttctcgtttgtcaaggcgattgcgaatacttctttaatgtcgtttacatagtggaattgcagtccttttaaatatatgtcctgaatttcatctatgttctttttattttcggcactcatgatgatttctttgattccggcacgtttggcggcaagaatcttctctttgataccaccgacaggaagcactttgccacggagagtgatttctcccgtcatggcaaggtttgcttttacctttctttgggtgagggcagaagctaaagaagtagccatagtaatacctgccgacggtccatctttcggaatagcaccttcggggacatggatatgtatattccagttgtcaaagatgtcttcattcagatcgaggatggaagcatgtgctttgatgtattcgagtgccagcatagctgattctttcattacatctcccaaattacctgttagtgtaagacgcgcacctttaccacggctcagactcgtttctacaaagagtatttcaccgccgacggcagtccatgccagtccggtgactacgcctgcatagtcatttccctgatatttgtcacgagtatactccggtgctcccaggaattcatacaaatcagtcggtttaatttctgatttggcgaaataaccgtctgttgcatattgacgggcagatttgcggagaatcttgccgattttcttttccagttcacggacgccgctttcacgggtatatgattcgataatcgcttccaaagtatctttcggaatcttgatatccgtctttttaagtccgtttgcttccagttctttcggcaacaggtgcttacgggcaatttcaactttttcttccgtgatgtatccgctgacttcaatcagctccatacggtcgagcaacgggccggggatcgtattcagattattggcggttgcaatgaacagtactttggaaaggtcataatctacatccaggaagttatcatggaaagaggtattctgttccggatcaagtacttccagcaaagctgatgacggatcgccttgacggtcggcactgactttgtcgatctcatccagtataaatacaggattagaggctcctgccttaatcagactcttgatgattcgtccgggcatagcgccaatataagttttgcggtgaccgcgaatttctgcttcatcgtgcacaccacccaaagacatacggacatattttcgtttcagtgccgatgcgatggattttccgagggatgttttaccaactcccggagggccgtacaaacagataataggtgatttcatatcgcctttcagttttaatacggcaaggtgttccagaatacgttcttttactttttccagtccgtagtggtctttattcaacgtcttttctgcatttttcaaattcagattgtctgttgtataaacaccccaaggcaggttgagcattgtttgcagatagttgagttgtacgctgaagtccggtgattgcggatgtgtacgttccagtttcgccagttccttcaggaaagtatctcttacttctgcattccagtgcattttaactgctttcaggcgcatttcttcaatttcctgctcctgaccgctgccacccagttcatcctggatcgttttgatctgttgttggaggaagtattcacgctgttgctgatcgatatcctcacgggcacgcatttggatggatgccttgatttctgccagctgtacttcgcgattcaagatttccaatagatgataagtacgctctcttaatgagttgatacttaataaatccatcttctcatctttcttgaatggcaggttggcacaaatgaaattaatgaggaacatcggattactgatgttttttatagcaaatgacgagtcctgatgcatttctgatgatttgatataacgcatcgtcaagtccttgcatgtttcaaccagggcttgaaactctttatcgtctttgtttgggacatcttcttccaaaagttcgacctcgcccttcagataagggtgtgtatctacaatatctttcagacgcagacgtttcattccctgaaggatgactgttgttgtctggtcaggcatttccagtacccgtacaattcgtccgacagtgccgacattgtgcaaatcttccagtttggggtcttccgtgtgtgccgatctctggcaaatcactgcaatatctttgtgtttcttttcagcttcgcgaaccagctttaatgaagcctttctgcctactgtaataggtaaaaatactccgggaaacaacaccatattacgaagggggagaaccggaagaatatcaccggattttatattcacatcaaacacatgttcgtcattgccatcatagtcggtaatcagtgagaagccgttctcaccaacttcttcttccaataagtatctttctttcatcttttcgttttaatttagtttatgtcatacataatatgcataaatcgtttgcaaagttaattgattctctttaataataaagcacagtgtggaataaaaacacaaaaacaatgccaaaatatcgggcgttaatggatttattccataataattatttatttttgacggttttcggcaaagatcagtaaaaaacaggtttagatggctaataagatggcgaatcctttctttcagtttaagcagtttacagtatggcatgacaaatgtgccatgaaggtaggtacggatggggtacttttaggggcgtgggcttctgttcaaggggcacatcgaattttagatattggaaccgggacggggttggttgctttgatgctggctcaacgtagtctgccggatgcaaatattgtggcgctggaaattgacgaagccgctgccgggcaggctaaggaaaatgtggcccgttctccctggaaggatcggatagaagtggtgaagcaagattttctgttctatcagtctccggataaatttgatgtgatcgtttccaatcctccttactttgtggattcgcttagttgtccggaccaacagagaagcatggcacgacataacgattctctgacttatgaaaagttgctgaagggtgtggctgatttattgaagaaagagggtacttttacaatcgtaataccgacagacgtggctgacagggtgaagactgcagcttccgaatatcatttatatgcaactcgccagctaaatgtaataaccaagccgggaggaactcctaaacggatgttaattacttttacgtttaataatgagggatgtattaaggaggaactgttgactgaagtagcccgtcatcaatatagtgaagagtataaagaattgactcgtgaatactatttgcatttgaaataatatttttgcataaacaaaaaaaagagctacttaatgtaactcttttttttcgtcggggtagcgggattcgaacccacgaccccctgctcccaaagcggcgtgataataaaggatattcagctacatatcagtcaattataatgatgcgagctaaccatttcaaagatagttcaaagaacgctcttttgggggcttcattttagccctttctaactcatgatttaagagagcaatttcttgcttttgaactctgttttctcgcaggactttccggagttgttgccggagtgatgcgattattttgtctttttcttccatatattatatattaagataaaacactatgc

SEQ ID NO: 128 - DNA, 22313 bp, Bacteroides thetaiotaomicron
ggatataataacaaaaataatttcggagaagaaacttttttggataagtttcgctataatcggttatttttgtttattatatctaaatgcctattttgcaaaatctgacttagttttcatagggtggattcaagaactactaacgataccatttatactttttcagtttatacttttgatcatatcgattttgtactgtattaaagatacatttcgagtaaatagatattcgtttgggagtttcttcattttattgactaataatctatttgttatctgtagtctaatcttcagataaatatagttcaaaagcgaagtgtttcttgaaaactacagcccctttcaccgcttatcgtgaaatctatatccaatccccaacattaaattgttagggtctttaaacttactcaactgataccccacgtgcaaaaacaaatggcgggtaacataagttttgagagccaatatttgatagaaaccttccgtatcatcgccactatatatcatatttcgtccgataccgacattaatggagaaaataggcatcaccagttctgcccgaagagacaaccccaccgcaaattgttcgcggaatggaggacggtgaaactttatatcatccccataagttcctactagcttatagtccttaatattagcactctcgtcaaattgcgcatccacagaaagtcctgcccggaaatagttattgaaattatacatcggggcaaaattgagacctacaataccgaacgaaccgggaaccaaagtggggataccttctttaacgaatcctcttttgcgagtggcaccgtataccaacaagtcatagctgacgtgtggccttatgtaaagacgtttgggagcaattgctccggacgccttatcttcggcattaaaggtacgtacaatgccgactctccctccgatagtattgagacctccattgggataacgcgtatttccattggagaaatgagtgaagtctacccctgctgctagtttccactgtggataaaactgccagttcaagacaaagcccaaattgatatacgcattgattttagaaccgatagcgtcattgtaccaattgctatgttcatcatattgtttccaaccgaaagaagcaccgaaattccactcataatccaacgacaaacaggatgaaagtcgtacaataggcgccccttgaaaagcatataccgccactggatttcccagttcagcggaattataaaatgtattatgcgaaacaccgatgccctgataggcatgaggatacaacctccccaaataggaatctttgctgaactggaaagcatacttcaagtgcagggaaagtgaccgatcaattttctgccgttgtgcattatcgccttcaaggaaactgtttgtcggagctacatagcccggacgaacgtcaaaaccgatctgatggatgagggcatggttggtgctgtcattcgcttgtcggacagatttcactactgtctgagcgtccaatttgttgccgactgctgaaagcagcagcaagcagattatatacagagaccgtctggtattcatatttctactcatttgatattctcgcgtgctatgtaacattttccgggcattttactttgcaacgtaccggttatagtgcgctgtctcccattcttagggtgaacagcataaagggtgtactccgtttcgaaccactcacattctaacagcacgatgatacgttgggtagttttaggcgggatagaaatctccttcttctccgtatcagggaaaggcaaaggcagcgcttgctgctcagacgtatattgcgcctgtacaccgttcattcccaaccattcgttttccatgcttggtatctctactgtcggattatctcctcccaatagtcggaaagcctcagggtcatcgcttttgaacaccacttcatggtgggcgtccttgtaagggaataacaggcatggggagggagtacctaaattattagattgtataaaactcatagtttcttccagtctccattcatgagaatacccatttaaagaataagtgatatgatcgaacacatatctgtccgacggagtaatttgaacatatatttcttgtgattcatactcattgctcactacaagcatgaatctaaagtagtcgttacggacgttttcgcccaccgttatctttagctctttggggttactgcgttgaatgatgaaatcggtcagcttttcattgcacacaatcttacctaatcctttcaggtagacatcctggtttctcattatcagattgtcgtcggcatcataaacttcatattgatgggtaaagtcactatcgtaagtatacatccaaaccaaatcccaattggaggatgcaaaacgaatagttacctcatcaccattcccgtccaaagtaaattcggtatcggaagtccggaagtcgtcgacgaatacatcatcgttacaactataaagtcctaatagaataagaatatatgctgttaagtttacgattgttttcatgtcggtcgttatctagttattttgttgacgacaaaagtaatacatatttttagaagagagttattatcacccctgtttagttgccacataaaggaaaataaactatttttgttctcaacattaaagagggagcaattatggatgcagcaataaagaaaataccttatgggatgacggacttcgagagaataattcttgaaaactattactatgtagacaaaacacaatatatcgccaaagtagaaaaagtgacctccttcttcttctttgtccgtcctcgacgtttcggaaaaagccttttcctaaacatgctcggtttatactacgacatcaaccaaaaagataaattcgagaaaatctttggtaatctttatataggcaagcatcctacgcctgatcgcaacaaatatctggtgcttacactcaatttcagtagtgtagccgccaatatggatcgtttggaagaaacattcaacacctattgcaaaatcgtaatggatggatttgcagaacgaaacgctcatctgttagggaaagaagccgttgaaaagctacatgaattaaaaacaggagatgccttattgggatcactgtgccaaagcgcccaaaacaagggacaaaagatatatcttatccttgatgagtacgataactttgccaacaatattctggtagattatggtaataaacgttatcgcagcatcactcatggcagcggattcttccgtagtttccttaaagtggtaaaagactattcaagttcagtgatcgagcgcatcttccttacaggcgtaagccccgtaacaatggacgatctcactagcggattcaacattgcggataattatagcagttcacctatctttaataatatgatgggatttaatgaacaagaagtacgcactctgatcgattattacaaaagttaccgggaactaccgcacactacagatgaactaataaccatcatgaaaccatggtacgacaattactgtttcgccatgaaagcactaaaggaaccgtctatgtacaattcagatatggtgctctatttcatgaatcattatatgctgaatgaagacatccctgacaatatgctcgatgctaatattcgcaccgactacaacaagctgcgccacctcatccacgtagacaaaactttcggtgaaaatgcaagcgttgtacaagagattgttgaaaaaggttctactaccggaatcattgcaaacagtttcccagccgaagacattatcaaaccggaaaactttaaaagcctactctactattacggcatgctaaccatcagcggaatggaaatgggtgagcccatactgagcgtccccaactgggcagtgcgcgaacaactttacggttacatggcagacatctacaaagattccgccgacctatatctggagacagataagctggtggaccgaatgaaacgaatggcatacaaaggagaatgggaaaattgcttcacatacattgccgaccgcttgaatgcccaaagcagtgttcgcgacttcatagaaggtgaagcttatgtaaaaacctttattttggcttacctcggattgacacattattatattgcccgtcccgaatatgaaagcaacaaaggatatgcggatatctttctgcaacctcgtctgctgcaacttcccgacatggtatacagctactgtatcgaagtgaaatatgcaaaacgggatgcttctgacaccgagatagagaaattgctgtccaatgcaaaaatacaactgaaacagtatgcagcaagcgaatggattcatcaagacaaagggactacagaattaaagagtatcgcattagtattccaaggctggaaactggtgagagtggaagaagtataaactgctaatcaaacaattctttcagtacatccagcgactttaatgcaggaaaatccggcagatgcaaacgataataatcattcataatcgtcaggcagcgagtgcgttccgcacggctcatgccaaatagatgcatcgtctcataattcatgcgcatcagctggcgaagacgtccagcctcttcgggattaatataagaagaatgcaactgcggacgagtagaagtgaaacaagcattcagcaaatcaaagtaatcaccggtgtgataatcttccagattcggatacaaccccaaaaaacgggaaagacgcatcagaaaaaccagatggaaattggcaaacccttcgcgacattcgtccagccaaatgacagaatgctgcaaataagcgaacaacggacggttttcagcctcttcacggacagcacgatacagaaactctgccagaaaaagtgccattgaagacttgtacgggtcataaggaatggaggtaaaaggataaaaagacttcgcctcttttacccgatagagagtagcattcggacggaaatccgcctcaaactcaatgaaagacaaaggctggaagagcactgacttgactgccgccttccgcgaacggggtacaggaacgagaaaagaagtccgcccggataactccgtgtacatatctacaatgatagaagtatcattatatttaagcgtatgtagaactattcctttcgtcttttgcagcataatgcactcctctttttatcattccggaacaaaactacaaaaaaatgtttggcaatcgggagctttttagaggcgttaacaacaaaaaagattgctatttttgttatactccctgaagaacaagtaaatatagacaagagtatgaaaagaaaaagtaataaaaacagctttaccggatgcgcaaaagcatacatccggaatctacaagaagagggtcgttactcgacggcacatgtatacaaaaatgcaattctgatttatacatgaagcagaaggtgcaaataatacacctggctatatctataaacactttacttttctcataattcacaactatactccttaacctttatatataataaggtgtaaatatagcacattattcatagtcttatagacgaagatatttttttcgaaaaatcgcaatctcatattttattgaaaatcaagcactatagagtcaccatacagaaaaaaagagaaaaaactacatatttttttcatgaattgtttgtcagtttcaaaaaagttcctacctttgcatccgcaatcgagaaacaaacactgattcgagaaagcaaaaagcagaaatgcaacaacaggatggcccgttcgtctatcggttaggacgcaagattttcattcttgaaaggggggttcgattcccccacgggctacaagtaaaaagaataaagaactaaaaaaatagattagtcgaaatggcaaatcacaaatcatcactgaagagaatcagacaagaagagacaagaagacttcataacagatattatggtaagaccatgagaaatgctgttagaaaacttcgtgcaactactgacaaaaaagaagctgttgcaatgtatcctggcatcaccaagatgttggacaagttagctaaaacaaatgttattcacaaaaacaaagctaacaatctgaaatctaagctggctctttacatcaacaagctcgcttaataatagaaaaataacaattctatatagcattcaggctgaacttttaagttcggccttttgtgtttataaaccattgaatatcagattactttcccattcactaattccgcttttattctgcatttttcgcctccgaaacttcgccaactcgacaattttcactatatttgctctgttattataacttagaaaggcaattatgagcgaagaacaaatcactcccaataacgggtcttattctgcggatagcatccaggtattggaaggtcttgaagcagtgagaaaacgccctgcgatgtacatcggtgacatcagcataaagggacttcaccacttggtatacgaaatcgttgataactccattgacgaggcactggccgggtattgcgaccacatcgaagtgacaatcaacgaagataattcaatcaccgtacaggacaacggacgtggtattccggtcgactatcatgaaaaagaaaagaagtcggcactggaagtagcgatgaccgttctgcacgccggaggtaagttcgacaaagggtcgtataaagtttccggaggtttgcacggtgtaggtatgtcttgcgtaaatgcactgtcaacacacatgactacacaggtattccgcaatggtaaaatctatcagcaggaatatgaaattggtaagccgctttattctgtgaaagaagtgggtgtatcggatattacaggaacccgccaacaattctggccggatgatacaatctttaccgaaacggtgtatgattataaaatactggcttcacgtctgcgtgagctggcatacctgaatgcaggtctccgcatttcactgaccgaccgtcgggtagtgaatgaagaagacggtagcttcaagagtgaagtattctattccgaagaagggctgagagagtttgtacgcttcatcgagtcttcacgtgaacacttgatcaacgacgttatctatctgaactctgagaagcagggaatacctattgaaatagccattatgtacaatacaggattctccgaaaatgtacattcctatgtcaataatatcaatacaatcgaaggaggtacgcatcttgccggtttccgccgtgcactgacccgtacgctgaagaaatacgccgaagacagcaagatgctggaaaaggtgaaagttgaaatatcgggagacgacttccgcgaaggtctgactgccgttatttccgttaaagttgccgaaccacagttcgaaggacagaccaaaacaaagttgggtaacaacgaagtaatgggtgccgtagaccaggctgtcggtgaagttttggcttactacctggaagaacatccaaaggaggcaaaaacgattgtagacaaggtaatccttgctgccacagcacgccacgcagcaagaaaagcccgtgaaatggtacaacgcaagtctccgatgtccggaggcggtctgccgggtaaactggccgactgttcggataaagacccctcaaaatgcgaattgttcctcgtcgagggagactcggcaggtggtactgccaagcaaggacgtaaccgtatgttccaggccatccttccgctacgcggtaagattctgaacgtcgaaaaagcgatgtatcacaaagcactggaaagcgatgaaatccgcaatatatatacggcactgggtgtcactatcggaacagaagacgacagcaaagaggctaacatcgaaaagctgcgctatcacaagattatcatcatgaccgatgccgacgtcgatggttctcacatcgacacactgatcatgacattcttcttccgttatatgccgcagattattcagaacggttatctatacatcgctactcccccgctctacctctgcaaaaagggtaaagtagaagagtattgctggacagacgcgcaacgccagaagtttatcgatacctatggcggcggtctggaaaatgcggttcatacacagcgctacaaaggtttgggtgaaatgaacgcccagcagttgtgggaaacaacaatggaccccgacaaccgtatgctgaagcaagtaaacatcgataatgccgccgaagccgattacatcttctccatgctaatgggtgaagacgtaggtccgcgccgcgagtttatcgaagagaatgcaacatatgcgaatatcgatacataattttaatattacgtttttataaaccaacctcacatcttacaacgaagaagcgtcggcaagcgaaggaaaatcctccgtgtcggcgcttttctatgtcttaataaaacctaacagttaaatctttttccggtcaaaatcactatcttgccgaaaatgaaggaggacacttatgaaaacgactaccccaaatcctgtatttgccaagatcaggctctatctcagaattctggcatcctgtgtgattgtcacttgcctgttcctgattattatccatccggaggcatggattactccggcttgcattatcgtagctatgatctgcctattatttcttctgatacgatccaaacacaaagagtcgaggaaatgaaagaaatatcagatcatatcatgcgcctttaattccttcactgcgacttccagttcctggtaccacttctcgccgaatttacggatcagaggttctttcaagaattggtagacagccacattttcttttttccccagcaacacagccgccttacacacatcccaacgatgatagttcaccgccttataaggtccgtaatctccaatccggatgggatagagatggcatgataccggtttgtaaaagtccgtcttgccatcccgataagccttttcgatggcacagtaacaacatcctttctcgtcatagcaagtaaagacgcaatccttattattaacaatagaagtcaccagatcaccttcctgatccgtgtataccactccttgcttctcaatgacagcacgtgcttccggcgacagctcttcccatattatcggcagaacctcttccagcttttccacttcatccaactctacaggcgcccctgcatccccttcaatgcaacattcgcccttacaggcgtccaaattacaaaggaacttttcccgaaggacatcgaagctcactactacatcttctatctgaatcataatttcattcttatgttaagcccacaaaagtacgaaaaagtagtaaaagagattttaaattactgcatttgtatgtagtaaacactaaaaaatcatctatgagagcactattctggatattattaattgtctcttcgaactgctgggagcaaacttggaaagaatttaaccctacattgggtaaaacaatcgacctaagtagagaaggagaaaaagcattcatcaaaggacttgaaaatgatgaactcattgatggaaaagacaattactaaaaaaactagagacattatgaatgttagtcaaactaatggatgacggactttacagagttttttgctttctcttttatccattctactttagaagatggtactttcacctttttcttcaaaataatttctgcaatttgaattgttttcttttcttcccccttcaactgatacaacttcattaattcatacaatgggacaaatcgagccgggcacatcaaagaagctaacttcaaatgcttttcagcgttatcatattgagtcgtatttatacaattatcagccatcagcaattgtaaattataatcagcccaaagttcactacattgctctgccatctcttgactttgattgtaatattttccataattaagttcagcagcataattatagagaaacaaataattgtctcctaatttaggcaacaactcattataacgagcaaaagtcatatctgtttgctttattaatgaaaatttagccgtgcggttccatgctgtggtatagagtatatgtcgggttatataaatgaaagccgccaatgacaaaccgattatcaacagacacatacttctccgaagccattgaggatatttagctatatatccggcgtgaaaaataataacatatatactgtatatcatcatcacccatacaaaaggataagatagcggataagaaaagcaagcaaaaacagcaatgcctatcaagcaaacggttgcaatattagtttcgagacaagaattacgtcgataacatttccacaaaaaataaacaaaagtaagaaaaagaagaaaacctattagaccataatttacaaccaacaatatatattcattaaatggatgtttaacatcacctgctaacatcgcatatttattatcagtatctcgcgcaaaatattcagcctgataattcatataattagccaaaaagcctccacttccatatcctgtaaccgggttgtcttttatcattagcgcggaacatttccaaatgagcagacgaccgtctgccgagtcttttttaaagaaatacagcaaagttacaaataccggaaatagtaataaaagtaacaacaaatatttctttcgagaacctatttctgttttctgtaaaaaacaaacaatacacattaccgcaatacttaatatccctgttcgtgaaccggacaatacaacaactattataacacatagcccggcaagaataacactcccccttattagttttgaacaataatgcatataaatataaaacactgcaggaaatccagcacaaagggaagcggcatatccggcaggattatcgaaactgccactaagacctaaataagaatgaaatggaataatatgagtatattgcaatatcccatgcatcgctaaaacaacatcagatagaagaacaatgatatagaaagatggcagtaacttattcagactccatgaaaaagaggacatactaaaagtactgtttgctattagaaatagtaataaaaggataatggaagcataccatttatcccctatagtaataatcggactctctatctgcaagaatagagaattggcacataaaagaaatgccagtatatagagaaccttatatctcataccaatcttaggcagcagtctccttccagtcattttgttaaagtattatcatcacattttattttcaactttaaatttattatttcattttatctcaaattctcttgtttcgtacaccatttctccttcctctgtcaagccctcaattaccactttatatgtggtagccttatctgctgaataaaataaaaaatcacattctcctgatgaatctgtttgtaagctaggattccaataaagtgtagaacgaaaatccggtatcaacgcattatccttattgcctttatcatatttgggagaatagaaagctactggttcttggtatcctccagagggataaacatccgtttgaatatcatcaagcttgccatagcccttaaatcgttgttcaatagaacataaatgtaataaaggatccaatattacgcctggataaagtactaattcaagaatggcaacagaagtatgctgctcatattcccataaatacaaataaggctttaggattttttttctatcaatactatttaaagaaataacttgaatatcactcaatgacaaataattaagaattccagcattggaatgcatgttaccatttatcattaacacaagaggcatatctttataaaaacatgcccaagcattcattatcttcacagaagctttacaagatcctttcattgttgaggtataatatggatatttgaatttaactcccatatagtcaaccaattcccacatattcttaaatttaaactttgctatctcccttaaggtcaatctcttattcagtaatttggatttaaccgtcacctgatttaataaataatcactcataccaaccggatacaccatatcccgctgaattccaccggatatttctgacagaaacggctgtggcactgttttgtctgacagaatatacagttggtccttatcgagaattatttctgccttattacgcccataattttcacctttccgtatgaaccgcttgcctatcatcccaataggaacgccttccgcaaactcaacactatccactcgaaacgctccatcttgaccaagttttattaccctattaagaccgaactccaaattcctcacgtacacatcataacggcttttaccttctcctttctcatttttcagccttcctgataaggaggtaaacttctccggctccattacaggtctttcaaagtttccttttataatctccggcaatcggtatctcttccatccgtgtatcataagaagcaagtccagtgccttttcagcctcgggattatccgtttgcaaataaaaagacggagtttcaattctccccttcaattcggatgaaagcagcaaagtagacaaaatagaatgtgtggtatccgcaactgccatggacttgtctgtgattgcaacagaaaggttaccctttacaggattgccattcatatccgtaagcaacaggctcgtgcgaaccggtgttctttttccataactgtttttatcattctccattttacacacaatggtcttccggtaaggaataaaacccagcctttcacttaatacattataattcttatccaacaacagacattgaacgattccggacggatactgatcttttgcaatagtgattatgtcgcctttatcggacagtaaccatcgcgcacaaatcatttttccacgtacatgcgccagcaatagaagtttctcgtgaggtgaatgtaaagcggaatttatggatatctgtatatctttttttcgactctgcacaacgattccgtatgctgattcctgcacttgtggcagttcaaagatttttcttataccctgtttattaagcacttgcacgctatacttttttccacttttgggagtaaaggtaaatgcacccattccggcatacagagttttactctctgccatcacattcccctgttcatctatcaattgtaaggtggcatctatgctattgccactaacatccagcactttataagcagtccgacaaggcgtatctgccaacaagtgtcccccctccgggtaaaaagtgacatcataatcctccatccccgtactgatagcggcatattgtcgaaaagtattgtttcggacatcggtcatatccagccgcacacatgcgtcgggagttacttttttattgcgaatgctcagctctatttttttttctttatccagtttgacagagactgcttttcccttatcgcaaacagctttcacttttttcaacgggatttgctcctgcctgttattccaaagttgaagttgcaattctgtattttcttcatgtgatgatgttttgctgcaagctttcaagtgcgtagtctcccaattacttgccatcgcgatgcagacttcccttttaaataccagctgattcttttccgaaagcatatagcgggtataagcaagaagagcatactttccacctggcagaccttcggggagggagatatatccatgaaattgattcatatcatccggtctaacttttgccctacccactgtttcattctccggattgaccagttcgacatatacatatcggcttagccgaataggaatatgagaagacgcattgaccatgtaggctttgaaccacaaagtgtctccgggaaggtagcacgaacggtcgatgtgaatatgcaatttttccttgggatagatacgaaactgttctgtcatacaatgggcaatagtatcgaatgatactattgtctgtgcagacagggagtggacggtcaatgaaatcagggcaaagcagcagattttcttatatttatttattaaatccttcataataatcagtttaaccaacgaccaaaacaatcattccattaaatataccaaacaatgaataggatacttgaaattaaacctcctaattctttattcgatacaatgtaaataaagagaattttaaaacttcaaattgaatataatctcttaagttccttcattaaagaagttataatacaagtcatattaccaaaaagtctcatgccaactaagactagcattccactcttgtgctacaggtagccatgtaagcattagcgtataatcataattttcatcaaccgaataaatctgccagcccgaatatctagaaacagttatatttatactaaaataaagactacctttactatagcctgtattaggattgatatctggaaaaccacatatatactcagggtctctagtagtaaaagtgcaattcacattatcggatttccaatatcctgcaatatcttgccagcattcaatctcaatgtctcgaactgtataagttgcccaatgtgtaaaatcgaactcttccttgtaaacagttcttgttcttgaaaaattctttttttcagaattacatttaactttcactaccaaatgaccatctggcttcagctctatattttctgaaggtatttgaatcgaaccggagcgttccctatttttatacgctgctaaaaaaagagatgcctccttttcagtcattggaggattaactggtttactactaagtttttccactttaaaccccgcttctctaaacatttctgctactctatcttcttcacttaattccgtattatcttcttcgaaattagaaatacaaccctgcataaaaaggcagggtatcaaagcagttaagagtactaataacaatttatgtttcatctttatgatttttagaataagttatgagctaatttaattttacataccgaatcaagtatctgcatctcatacaaatcttagacagtagcccaccgtctatcttgcaaaagcataatctttacatttaaatttattgtttcattttattaccaactctcttatttcgtacactatttctccttcctctgtcataccttcaatcaacactttatatgtggtaatcctgtctgcggaatagaaagaaaaattacatttccctgataaatctgtttgtaagttaggattccaatagagtgtagagcgaaaatccggtatcaacacatcattattattacctttttcatatttaggagaataaaatgctatcggttcttgatatcctccaaagggataaacatccgtttgaatatcaagtttgccataaccctttatacgtttatcaatgccattaacatattctaaagattcaacatcaacatcagaatgaagttttaattcaagaatggccactgaggtatggtgttcatagctctgtgcatagctgtataatcccaaaaacttttctctaccaatactatataaatgaatcgcgcaaagatcactcaaagataaatagttaaaaatcccaggatccagaagtgggatatagccgtttacaattaatgcaagtggcatatctttataaagacacttccaactaccccacaatgtgacaccaatatgacaacgtccttgcattaatgaatcaatgaatggataactaaatttaatacctaaatattcagccaattcccacacattctttaatttaagttttgcaatctcccttgaatttaaactcttatttagtgcatccgacttaactgtcacctgttttaagaaataattactcataccagccggatatattatatcccgccggataccactggacatttccgaaagaacaggttgtggaactgttctgtcggaaatattatatgtctgttccttatccagaattatttctgttttactacgcccgtaagtttctcctttccgtataaatcgctggccgatcattccgatgggagtaccttccgcaaattcaagactatcgagccggaatgcaccatccggaccgggggttatcgtcttattcagtccgaattccagatttctcacgtaaacttcataacggcttttaccatcacctatcttatcttttagccttccggataaggaagtaaatcgctccggctccattgctggtttctcaaagttaccttttatgatctccggcagtcggtatcttttccatccgtgtatcataagaagcaagtccaatgccttttcagcctcaggattatccgtttgcagataaaaagacggagtttcaattctccccttcagttcggatgaaagcagcaaagtagacaaaatagaatgtgtggtatccgcaacagacatggactcgtctgtgattgagacagaaaggttaccctttacaggattgccgtttacatcaacaagcgacagattcgtgtgaatcagttcccttttcccatagctatccttgtcatttctcactttacacattatagcctttcgataaggaataaaacccagcctttcgcttagcacattataattcttatccaacagcagacattgaacgattccggacggatattgatcttttgcaatagtgattatgtcgcctttatcagacagtaaccattgcgcacaaatcatttttccacgtacatgcgccagcaatagaagttcctcgtgaggcgagtgtaaagcggaatttatggatatctgcatatcttcttgatggtcttttatgacaattccataagcagatgattgcaccggaggaagttcaaagactttctttaccccttgtttgttggatgtttgtacgatatacctttttccactttccggagtaaaggtaaatactcccattccggagtgcagcgtttcacttgttgccattacatttccctgttcatccattaattgcaaggtagctgctatactattaccactaacatcaagcactttataagctgttctacaaggggtaccctccaacaagtagcctccctcaggatagaacgtgacatcataatcttctgttcctgtacttatcgcagcatactgtctgaaaacgttgttccggatatccgtcatatcgattcgcatacaagcctcggacgtcactttttcattttgaatacgcaactctatctttccttcgtcatacagttttgcagaaaccggcttccccttgttacaaacggctttcactcttttcaagggtatctgtttctggctattgtcccaaagctggagttgcgcacccgtgatttcaccatgaggtgacaagatattcgctttcaagtgtgcagtctcccaattgcttgccagggcgatgcagacgtcccttttaaagacaggctgattctcttcaaaaagcatatagcaggtataagctagcagggaatagtttccaccgggcagatcctcggggatagagatgtatccatgaaactgattcatttcatccggtctgatttttaccctgtctattgtttcattctccggattgaccaattctacatatacatatcggctcaaccggatgggaatatgagaagacgcattgaccatgtaggctttgaaccacaaagtgtctccgggaaggtagcacgaacgatcgatatgaacgtgcaatttttccttgggatacatattaagctgctcggccatacggctggttatagtatcaaatgatactttttcctgtgccggaagtgaggggacaactaataaaattaaaatgaggctacaaattatcttatacatattctttatatcttaaaatcttaccattttacgttctttttcctttttgtcccattcttcctttttcttcagtatttccggtttcccattcacaacatcctctctggcaaatagatgcttgcgggaattatccaatgaaatccactgctcagccacagccaaacgcaattcataatctgccaactcacttactacttgtacactatccttcttccttataaaatcatagttctttaattcatcccaatatctttgagcctgttcatctgctcttttttgagaaacaaacttaaaataatcttccaattgctgatgagtaacaacatttatcaaacattttccttccaatttactccgttcaaatttagtttctccgtttttggatgcgtcttcatacatagctttgtactctgcctgcttaattcgataatattcagccagtaactgttcaatttgctgttctgataacttcgtcacttcccgtttacaaataatatccaacagtttattatgagaaaacgattcaatagtttccaacttaagtagtagtaatggcttatgtgcattgagtcgataacgctctttatcgtatcctttattatctcccctactgctcatatattctaatatcccgcttttttctctttcaaactcatacaattgttttataatagctaaactatcgcaagtcgtagaacataattggtgcacctgtatctgcttccattgctgtgcagctattttctcagcctgtcgcgtttttctaattataaaaaaagccttatattgcgtttctgaaagaatctcagccaaatattgtttttccatactatcatgtttgtaatcttgaactccgaatcgtttctctatttcttcactatgatgtaaaagttgctcaatttgaacatgagacaagttcaattcctgtctatatttaaccaccgtacgcagatctgaaatatatggcagttggggaccgttattcttttgatagaacatataatcattcccttctaacggggtcaataaactcgctattgtatttattgacggacaataccatcgggcaatctcatctaatgattttccttttttcaattccatttccgccaaactatcgttttcttggaagaaggtccttaaattcatgatactttcatcagaaagtgatattttactgctgatagcataaatttgcatagcaatacttatagaattctgagatatgacaacagactgctctttgctttgacaaccagataacaacactattacaataaatgtgcttattaatttcatttttcttcttgattatattacaaattaccaccaatatcgtgtcccatccggcataataatgaaaggacgctcttttcgttcggaatactccggcacaagaagcattagtacattttgcggtacctgattgaattgcagacaatcggcatccattgttgcaacttgtgttcccaatgaaatccatgcattatcccaataaaaaagttcatatttcttatccgggcgaaaacgcagatagcggtcctgttcttcaatttcaacagtcatagtatgcaataaatccggaactaaatacaattgatggttataaccatttactataggataacctatcggtataagttgatgctccttatatatcataggaagaataaccacgccacgaggcatattatgaaatgtaactgaattttccattcgttcaccccaccactcagcattccatctacccatactaaacatgcaggcatatataatgtgagtagtatcattaaacaaaggaatggtcacatcagatgtttcccaatattcatgggttacatcaatatagtttgttttttgtaaaaatccagtaggaatacattcttccttttctttagatgctaaggtgccaggttggctggaataagtataacgaattactttagacggttcccgatcaagtggatgatctacaacagcgtgtgtggtaacatccaacttcaccggtttcatcttcgtatcaaaaacggtgttcgagaaatgtgctccggcagaggttgcccataatggcacagatatgtaagcagccggaataccttgcgaacgaaaaataaatgtttccaaagctgctatatcctcacaagctcctttcttacgaaacaacaattgctgcgcacttagacgggagagaggctcatttctcgtttcacttccataagtgaatgtaaaccaatctttgtaatcgatagcagcataatcaagtacattctctaatggcttattctgaaggctgtctgtcaaccagtgatatctcttacaatattcttttcgccattccgttacaggctctactgtaacccggtaaggtaatatatattcgcagaaatcgttaaaaggtatgtctttatattcagatagccgccaagtatcaaccgcatgatttacattattaataagatatttaccagttaaactatttacatcgtaaatgatagtatcttgaaaatccaaggaaccatattttttcctcattgaatcgattgcctttacggctgtttccaaattagcataatcgaactccgaaaaatccactcttttcccttcgcgcgttttccaatagtaagtttcactgtaatggatatccatatgcgccaccaaaaactctatggcttttatctttatactgtctccctgtttataaaaataatccagtgccttttcaagttccttacggttattcccagctttcgctaatacagtttctacactaaatggatattttgtttgttgtgtgtcacatccggtatagaaaaaaaacagacttactataaataggtagatgtttttcatcgtaaaaaaatatatttgcacaaaggaagctgtttttaccttcagaagagtactagaatcaaccaaaagagttcgaatttcattcaatcacatttttcatgaaagagaaaggaaaaataggataatataaatcagataaactacaaatttcactgcacaatgactgcagttataactttcttacgaaatcaagctgtttgtgaaattaaagaaacaaaataagggggcactttgcgaagtgccccctttcattattacagtatcaagtaaattacttaatcaaaatctgaccgttcatatcagccggagcttccagccccatgattttcaggatagtcggagccacatcagccaggcgaccgtcttctactttcgcagctttgtttccggttacgtaaacacaaggaaccggattcagagagtgagccgtattcggagtgccgtcttcgttcaaggcacggtcagcattaccgtggtcggcgatgatgatagcttcgtaatcctgtgccttagcagcttcgattacgtctttcacgcaagcgtctacagccacaacagccttctcgattgcttcgtagataccggtatgacctaccatgtcaccgttagcgaagttcaccacgatgaaatcatatttgttttcgttgatggcatctaccagcttatccttcacttcgtaagcgctcatttccggtttcaggtcgtaagtggctactttcggagatggaacaaggatacggtcttcgttgtcgaacggagtttcacgaccgccgttgaagaagaaagtaacgtgagcatatttctctgtttcagcgatatggagctggttcagtcccttggaagcgatgtattcgcccagtgtgttagcaacgttttccttgtcgaacaggatgtgaacacctttgaaggatgcatcatacggagtcatgcagtaatattgcagtcccgggatcgtatgcattcccgcttccggcatatcttgctgagtcagtacgacagtcaattctttagcacggtcgttacggtagttgaagaagataacaacatcaccttctttgatggttccgtcgcagttggcgtttacaatcggcttgatgaattcgtccgttacaccttcatcgtaagattcctgcatagcctgaaccatatcagtagctttcttgccctggccatttaccagcaggtcataggcttccttcacacgttcccaacgtttgtcacggtccatagcataataacgaccgatgatagaagcgatcttgcctgccgatttctcgcagtgtgcagaaagttcttcgataaatcccttgccgctcttcgggtcagtgtcacgaccgtccatgaagcagtggatgaatgtattgtcgatgccgtattctttggagatgtcgcaaagtttgaaaagatgaaccattgagctgtgtacgccaccgttggaagtcagtcccatgaaatgaacgctctttccgttttctttcgcgtaagagaaagcagaaacgatttcggggttctgcaggatgctgttgtcagcacatgcgcggttgattttcaccaaatcctgataaaccacacgtccggcaccaatgttgaggtgacccacttccgagttacccatctgtccgtcgggcaaacctacgttctcaccacttgcctgaagttgggaatgaggataattgttcatcagataatcccagtaaggagtgggagtgttgaagattacgtcgtctttcttttggtcgcctagtccccaaccatcgaggatcattaaaagggctttcttactcataatatttcaa

SEQ ID NO: 129 - DNA, 21879 bp, Bacteroides thetaiotaomicron
ggattaatacttagtgttgtattgactgccggagcttgctccggtcagttggacacgatccaagagtatctggatgccggtgaaactatctatgcggcaaaaatggattctgttgacatacgtcctggatataatcgggtagaagtaacgggattacttaaatatggtatggatacagaaaggtgcgttattcattggacaccggacaatgactctttagtagtgcctgttaaacggatagatccggtagatacttttcgtgtttttatagagaatttacctgaaggtacttatcaatttgagattgttacctataacaaaagtgggtatcgttctatttcaacctcaaaaggaagtaaaacttatggtgatcggtacataagttctttacgggtacgttctttgttgagtacagaggttgaaggggaaaatctgttactaaatttttcctcagaaatggccgaagcattggcaactaaagtgttttatctgaatagtgccggcgagaagcaggaacaagaggtggcaagaggagataatcagattaagattactgattggaagccgcggggagcctatgaagtcaaaacatattatattccggaggtgaatgcagtagatactttctctgtttcttcaacgggggtattcccagaaaaaatagttgaaatggataaaagtacattccgtgaaataatactggataatgatatccgattgaacgcttggggaggagcattatggaaagcatgggataatgcatacgaaaatacaaactatgcacatagtgataatacgaatccgatcgtttttcctgcttggtttactttcgatttaggagagaaagctcttttaaagcgttttgacttgttttcggttgttcgtgatgatttgaattataatggaggaaatatgaagagctgggaaatctggggtagagaagatgaaccggcaaattcttcttgggatggatggactaagctgataacttgtaattctttcaagccttctggcaagcctgttggcgagaatacggatgaagacaattcttatatagcaaaaggagaaaagtttgattttccatcaggtattccggaggttcgctatataagaattaaggttctcgattcatggagtggacagggatatgtacagttctcggaatttacattttataaaagtgaataaaaatgaaacatctacttgctggtattttagtatgggtgatatggggactttgttcttgtcagtctgatggtaaggtgatcattccttcacccatttatgtagataatcactatcatggtccggctgatccggagataacctggaatcctaaaacagaagaatggatgattttttatacatcacgtcgtccttttaaagatcaggcttcttatgtaggaacgcctgtgggggttgctgtgtccaaagattttgtacattggaagtttgcgggatattgctcgttcgatggtgtaggcggtcagccggatagtgagaaaacgtattgggcaccgggtgtgattgtggaaggtgatagtgcccatatgtttgtgactttgaaagatgactctactccggtctggggtggacctagtaacattgttcatttctctgcacctttggaagatatgatttcagggtggagacgggtaaatacagtggtggatactccgatttctattgatgcgactgttgtaaagaatggtgatcgttgggatatgtggtatcgtgaccgtccgacagaagatacaggcggattgtattatgcacaaagtaatgatttgtatcattggacattaaaggggcttgccaaaggcgatattaataatgtcgaggtgacgaagcatacatatcaggagggggcttatgcttttcagtggaaaggttatttctggataatagctgatcctcataaaggattggccgtgtatcgttcgaaagatgcggagaactgggaatatcaaggaattgtcatgtatgaaccgggtactcggttctttgacaatactcgcgcccggcatcctagtgtcattatcagaaatgatcgggcattcattgtataccatgtgcaaccctttttaggatataatccaaatacacacgaggctggtgatgatgtttaccagaaactgagtttcttgcagatggcggaattggagtttaaggatggaaaacttatttgtgaccgtaataaggtactgtataaataagattgcaggatattggatgtcattatattagatattatttctgtaaatgagtaaatagattaagtaaagcgtggaatattaccacatatttcacgcttttactatatagatgtgtcagattaaaacaatatagagatgaaaaaactgttgttaatagaaattctccttaccataagttttacgcttatggcagaagatcccgctaagacttataagaacccggttgttaattatagtttgcccgatcccagtgtgatcagggcagaggatggatacttttatttgtatgcaacggaagatatcaggaatttaccgattcaccgttctaaagacttgatcaaatgggagtctgtcggtacagcttttaccgatgaaacacgtccgacttttgagccaaaagggaatttatgggcacctgacattaataaaataggagacaaatatgtactctattattcgatgtcttgctggggaggtgagtggacttgtggaataggcgtagctactgccgacaaaccggaaggccctttcgtagatcatggaatgatgtttagaagtaatgaaattggggttcagaattcgattgatccattttatatagaagatggagggcggaaatatatgttttgggggagttttcgcggcatatatggaatagagttaacagccgacgggctaaaagtaaaatctggagcagacaagaaacagatagcaggaaccgcttatgaggggacttatattcataaaaagaatggatattactatctgtttgcttctaccggaacttgttgtgaaggattgaaaagtacgtatcagacagtagtagggcgttctagttcattgtggggaccttatttggataaacagggaaggtctatgctcgataataaccatgtggtattgattcataacaacaaaagctttgtaggcacaggacataatgcggaactaataaccgataaagcagataatgattggattttatatcatggagtgagtgtttccaatccctatgggagagttttattgttagatagagttgattggaaaaaagggtggcctgttgtgaaaagtagttctgcttctacagaatcccccaaacctcatttttaaaacgatttctttttagatattgacaggagagattaaaataggtattattccaatataattagttgtttttttaggcagtttgaacagaatttttcttttatcggtcaatttgtggcattctgaacagctgatgtttgctaactttgccttcgtcatcaaagattttattttgtagaacagacagaattaagataacaacaaaatttaatactaacagaatcggagattgattgctactgattcgcataatttgatttatatgaatttaaaatgcttactttgtggaatagctattttggtatgtgtcggaaccgtaaaggctattgacaatgtgtcggaacgtgtatccgcatctatttctttgaaagtgccgggaaatgaggcaaaacagtacccgttgactttccagaagaccaaaaacgacaaaagcgcttatcagttggaagcctctgaaagaattccgttgacagtttatcaaacaatagaagaaaaaggcggaaaatcgcagataacagtatgtatcactgcattggaggatgtatattttaattacagtcaacaagtgtcaacagggttccgccatgatgactgccagttctacatgcccggattctggtatcgccgtaatcttcgttctccaaagtcggctccctcgtttcatacttcggatagttggttggtgcgtgaagataggttaagtacccctcttacaggtatctacagtgagggaaccaaacgttttatgaccgtaaaccgtatcgatcagttcgagaatgacgctttgactactcatcgggagggagaggttattctttccggtaaaacctcccttggtttcaccggctttgagaatcgtaatggcatagctacactttctttcggtttcccctatcaggaagctcctaagagctatattcgcaagctgacattggccccgcaggtaaaggcttttcagttgttgaaaaaaggtgaaaccgttttattgaactggactatttatgaagatgcagccgaagattactcggattttattcgtcatacttgggaatattgttacgatacttatgctccaaagccagttgatactccctattcaatagcggacatgaaaaatactcttagttcttttttcgtgaatagcttggtgagtaaaccggagttgacttactattcaggggtaggcttgcggacagatgattgtaaaagtaacggagaggcggaagtcggttttgtcggacgtgttcttttgaatgcattcaatgcttgggaatatggctgggaaagcaatcgggcagaactgaaggaaaacagccttaagatttttgacagttacttgaagaatggctttactgaggcagggttctttaaggaatttgtgaatctggatcgtaactttgaggaaccggttcatagtattcgccgtcaatcagaaggaatctatgcaatgcttcatttcctggcatacgagaaagaacaaggacgtcgccatccggagtgggaacaacggatgaagaagatgcttgacatgtttatgcaattgcagaatcaggatggtagttttccacgtaagttccgggatgatttttctatagtcgataagagcggtggtagtactccttcggctactctgccattagtgatgggatataagtattttaaagataaacgctatctggatagtgccaagaagacagcggattatctggaaaatgaactgatttcgaaagcagattatttctcctctacacttgatgcaaactgtgaagataaggaggcatcgctttatgctgcaactgctacttactatttggcattgataaccaaaggagaagagcataagcattatgccgacctgacgaaaaaagctgcatattttgcgttgtcatggtattatttgtgggatgtaccttttgctcccggtcaaatgttgggtgatataggactgaagacacgtggatggggtaatgtgtccgtagagaataaccatatcgatgtgtttatctttgagtttgcttccgtgcttcagtggttgtctaaagaatataaagaacctcgttttgcagattttgcggaagtgatttctacgtctatgcggcagttattgcctcacgatggtcatatgtgcggcattgccaaagtcggttattatccggaagttgttcaacatacgaactgggattatggaaggaacggaaaaggatattataacgatatctttgcaccgggatggacggtagcctctttgtgggagctattgactccgggacgtgccgaaaagatgttggttaagtaattcatctaatctgtgatatatatgctaaagaaacgattctatattctactgttcttctgcctgcttcttggaggaaatgtaaatagcagtacagtggataaaggtgataacaatgctccgtttgagaacaaacgtacggaaacggactacttgcctattgctgatccgtttgtgatgctttacaataataagtactatgcttatggcaccggaggtacagtgaacgaaggatttgcctgtttttcttctgatgatctgaaaaactggaaacgtgagaggcaggcgctttctgcagatgattcatatggtaaatggggattctgggcgccggaggtttattatattcaatcaaagaagaaattttatatgttttattctgtagaagaacatatctgtgtggctacctcagattctccggtaggaccttttcggcaagagtcgaagcaacctatctgggaggagaagagtatagatacctctcttttcattgatgacgatggtactccatacctctattttgtacgtttcacagatggaaatgttatctgggtagctcagatgaccgatgatttaatgaagattaaaaaggagactttatcggaatgtataaaagcagaagagccgtgggaactattgcaggctaaagtagcggaaggaccttcggtgctgaaaaagaagggtatgtattatttgatttactctgccaatcactatcagaataaaggctatggagtaggatatgccacttctaagtcgccaatgggaccatggactaagtatgacaagaatccgctcttgcaaggggatgagtctaccggactggtaggtactggacatggtgctccttttcaatgcaaagacggcagttggaaatatatttttcacgctcattggaataaagagaaaatacacccgcgtacttcatactttaaagactttaccatatctaaacaaggtgtcgtttctataaccggaaaggttattaaaccgaaagttataaagtaaacggttatctttattttttctgagcaaatattgttcaaaaagtaggagacttcagatattaatgattgatacgtcagatattaatagttggcatgtcaggtcttaacagttgagaagtcagttattaatgtctgataacgcaggcattagtgtctgaagtcaggtatattaggcattgttacaacagttatttatccttgccggaatacttatgtttgcttgtcaatctttccatacgtattgagtggattgcataagatatttattttattcaaactgatagagggatcgaatacggttcctctattgttttatactactgtatcgttgttttagttatgtatttccatgtatttgcatagaatctgttaacttttgaacaatttttgatacaccaaatattccatgtttgctacttttgtcttataactaactaataaatcgaatagcgcatcatattcaataaaccattatctttcaccggtttctctttgatgtttgcttattgtataatagtaccaatgatggaagggtgttctgctcacttgatttagtgacaatggcatctgttatttgagatattagattaactttgttgtatataatacttttttaataagatgaggagcacgttatgagaatattgcacagtctttctatattgattgtttttatctttcatactttttatgtatttgccgatttgaatgagggttatgcttttcgttcactggatataaataatggcttatctcaaaatacggttcacgccattcttcaggataaacagggttttatgtggtttggaacgaaggatggattagaccgatatgatggcatttcctttcgggcttttatgaaagagtccggcactttggggaataacttcattacctccttgtacgaagatcagcaaggacaaatctggataggaacagatgtaggactctatgtatattcgcctgagcacgagactgtggaacgttttataatgaaaagtgatttagatacagggatcgattatacggtcaatctggtgacgggagataaggacggaggaatttgggtggtgacacaatctcaggcggttttttattataatcctcagactaataagctgataaattatctgtcagatcaatccggcaggttgaaatttggtagtcttgggcaactttactttgattcggataatgtatgttggctggatatacgtgatggcaacttgtatttttcaaaggacaaactccaaaccttggtcccggtatttcctaaagatggaaatgaacctttcaaaggagaatatatatgcaaactacttcccggtccttataattgtatgtatgtcgggaccataacggggttgaaagaagtgaatctgaccaataagactgtgcgtactcttttatccaaagatgaatccggagatgatatttatgttcgggagatagcattctattcggatgatgagttatgggccggaacggaatctgggctttatatttataatttacgtacaaagaaaactgttcatttacggaatgtgagcggtgatccgtattctatttccgataatgccatttattcgatttgtaaagatcgtgaaggggggatatggattggatcttattttggtggtgtgaactactatcctaagcaatatacttattttgataaagtctatccccggacagaaattgatgaaatggggaaacgagtgcgggagttttgtgccgatcatgatggtactctctggatcggtaccgaagataaggggctttttcattattatccttctacagggctgatcgaaccattcaggcatccggacatttatcataatgtacatggattatgtctggatgggaattatttatgggtcggacattttgccaaagggctaaatcggattgacttgagaacccacgctgtaaagcattattttgatgctcctaatgatatcttctctatttgccggactacttcaggtaatttatggcttggaacaacagccggattattccgttatcattctgaaacaaaccgttttgaacgtgtacctgaacttggttgggtatttatatataatatcaaggaggataaacaggggaatctatggctggcaacttacatagatggtgtatataagagaaatgtacgtactggtgagtgggaacattatatgcatgatgaaacgaatccttcaagcctgccttccaacaaagtgctgagtatatttgaggatagccaaaatcagctttggtttacaacacagggaggaggcttttgtcgctttgatccttctggtaagatatttgtgcgttatgattcgagtattggattgccgagtaatgtcgtacatcgaattgaggaagatgaaaaggggttgttttggattacaaccaataaagggctggtacattttaatccgaaaactttagaatttaaggtgtatacgattgctaatgggttactgagtaatcaatttaattatcagtccagttacaaggacaagaatggacggatatactttggtagtattaatggttttatttctttcgaaccgtctgtttttgttgacaatgattttcttcctcctgtggtaataacagattttatgctctttaataaaaaggttccggttggtagtacggactctccgttaaagcaaagtatcacattatccgactaccttgagcttcaatcgaatcagaactcgttttctttcagtgtagcagctcttagttatcagtcacctgatatgaatacagtattatataagctcgaagggtatgattcagaatggtattcggtgggtaaaaatctgattacatattctaatttaccctatgggacgtatgtgctaaaggtaaaggctgcaaatagtgatggaatctggaatccggatgttcgtactttaaagatccggattctacctccgttttatttgtctgtatgggcttatatcatctatgtaatattaatactcggagcacttttcgctactttcttctactttagaaagcgggcagtcgaaaagcaccagagagcgatggagaagtttgagcaggaaaaagaacgggaactttatacttctaagatagagttctttacgaatgtggcacatgagatccgaacccctctgacgctgatcaaaagtcctttagaaagtgtacttaccgagaaggaactgcctgaaaatgtgaagatggaattagaaattatggaccagaatgcagaacgattactgaatctgacaaatcaattacttgatttccgtaaaacagaaaataaagggtttaagttaaatccggtagagtgtagcgtcggttctattattcgttctgtttataagcgcttcaccactttggttaaccagaaaggaattgagcttaaggtagagattcccgaggaagaattattggcttctgtggataaagaagctttaactaagattctcagcaacttgtttacgaatgctttgaaatatgcccaaacatatgcttatctcagcttatctgttgatgaggcagggaaagagtttactattgttatgagcaatgatggaaagataatccctattgagatgcgtgagaacatatttcgtcctttcgtacagtatcgggatggaaaagacatagttccgggaacaggcattgggctggctttggcgcgttcattggcagaattacatcaagggacgttaacgatggatcaagatatggagtgtaaccgcttcatcctttccattccgatacggcatcagacggcttcggatgttttggaagaagaacatcgtgaaaagccagtgtatgatgaagaagataatgaaacacgtataatgccttctgataaggataaaaaggaagttgcttcggtcttgatagtagaagataataaagatatgttggcttttgttgcccgacagctctcgccattataccatgttataacagccgagaacgggatagaagcactaaaagtacttgaacacgagtatatcaaccttgtgataagtgatataatgatgcctgaaatggatggacttgaattgtgtgagcatttgaagtctaatttagactacagtcatattcctattatattgttaacagctaaaacaacactggagtcgaagattgaaggactggaacaaggagcggacgcatatattgagaaacctttttctgtagaatatctgcgtgtcaatgttgccaatctgttaagtaatcgtgaaaggctgcgtcgtcgttttatagagtctccttttataaaggccgatacgatggctcaaacgaaggcggatgaagtttttattcagaagttgaacgagtatgtatctcagcacctcgataacaccgatctggtgattgatgacatggcggaagctatgaatatgggacgttctaacttttaccgcaaactgaaaggagtattggatatgagtccgaatgagtatcttcgtttgatacgtttaaagaaagctgcccagcttctgaaagatggaagatatgggattgtagaaatttcttatatggtaggattcaattcaccttcttatttctcaaactgttttaagaaacaatttggagtgttaccaaaagatttcatgcaatgaacaaattcttataaaattgctctaaaactgattctgactatctctgcactgttttttggatagaatttaataatatcaggttaatttcttatatccttttcaggtaggttccgataactttgcgaatgtctcgaaggtaggaacttattttctgaccagtctatttggttgggaaaaaactttcttctagatcaattaatatagaagtaacggataaataccagattagaaactggctttataagctattaattattattaatcaatatctaatttttcgcgcgaatatgattttgtatgtattgtttggtagatagggagaagagttgatacataaataaggaattggcaggtattagtttttttataaaactcttcttccacttttcttcgctgaagtatataatccttaaataatacgatttatgaacaaattccttttataaggatcatgatataaatgtttaaccaaaataataaagaaaatgaaaaacagttttttgtgtgtcggctcttttctattggctgctagtttttttactagttgtacagaagacaaggattggtccggtggattgaagaattctgatctggtattccagacttatttgccaacagaaggtgccaaaggaacggaactttctattcgaggcaataattttggagaggatatcagccaagtccaagtatgggtgaatgaaaaagaagcagaggtgatttcggttacttctacccgtattatggctagggtggctgaagctagtggtagtggcgtagtgaaagtcagagttggggaagtagtatacagttatcctgatttattttcctatggttatattcgcaatgtgtacactgtagctggtaatggtcaaggtaccacagttgatggtgcatatcttcaggcttctgtccaatggcctattgtgatggtttatgataaatgggatgatgccatattgttcttgcaagatgaaggagaacaccgcatccgtcgtatgaaagatggtaaaattgagactttatgttccacaaaaagcttagtgaacaatgcacgcagtatatgcttctctcttgatggagatacattgtttataggcaatgataatgcgaataactatgtggcaaatcctgttgcagtcggaatggtaactcgtaaaggtggtttcaaagatcttaagtcatatattccttctgagaaattagctcagccccatattaatggtatcgctgttaatcctgtagacggttcgctttttacttatcattggggacgccatgtgtttcgctataataaagctactgagacttgtgaatatgtgattacacgagatcagttcaatgaattagtagttggtttgttcccggatgctgacggaaatatgcaaaatataggtggtgacggtggatatggtggacttgctttctctccggatggaaagactctttattggaatggacgtgatccatatcagggtatattaaaagctgattatgatcttgtcactaaaaaatgtactaatctaacccgctttgcaggtaatggagtctgggggattattgatggtcaaggtgtttcttcacgtatggaccagcctaatcaaatagcagtggatgcggaaggcaatttgttagtaacaacagtttatgggcgcactgttcgcaagattactcctgaaggatatgtgagtacatatgctggaataggctaccagacgggatatgtcgatgggcttgctgcagaagcgaaattcaacaaaccttatggtattgctattgatgcccaaggtaatgtatatgtaggtgattgtgagaattggcgtattcgggtaatcaaagaagaatgattgttagaactaataactggtatagaaaattaaagagtatattttatgttcaagaaagaaatatatagtctattgctattctcctttgggcttttgtttacttgttgtggagagagtgcaacagatgacgaggaaaaagataataatggtcagggaagtgttagtgtggagactaattacctgcctattgcagacccctacgtgatgttctataataataaatattatgcttatggtacaggaggaacaactgccggagaggggtttgcctgcttttcttctgacgatttgaaaaactggaaacgtgaggggcaggctctatctgcaaccgattcttatggtacatggggtttttgggcaccggaggtctattacgttgagtctaagaagaaattttatctgttctattcagcagaagaacatatttgcgtagcgacttctactactcctgaaggtccattccgacaagaagtaaagcagccgatctggagtgagaaaagcattgatacttctttgtttatagatgatgacggtactccatatctttatttcgtacgttttacagatgggaatgtgatatgggtggctcagatgactgatgacttgatgagtataaagacagagactttgaatcaatgtataaaagctgaagtatcatgggaacttttgcaaggtaaagtagcggaaggaccttctcttttgaaaaagaatggcgtgtattatctgatttattctgctaatcattatgaaaataaaggatatggagttggatatgcaacctcagatactcctatggggccttgggtgaagtatagcaagaatccacttttacagggtgatgcagctaccggcttagtaggtacaggacatggagcgccgttccaatgcaaagatggtagttggaagtatatatttcatgctcattggagtgctgcggagatacaacctcgaacatcgtatattaaggattttgccatttcggatcagggagtggttactattagtggaactgtaattaagccgagagttctgaagtaaaaggataccggataaatgaatatcatttttaatttaaaactaatactataatgaataaaaataatcgaatgagcaagaggcttttgaactatgtcattgtccttttggtgtgcttgattagtagtgcggaatcttttgcacaaggcacaaagtttcaggtcaagggaaatgtgacggacgcttcgagagaaccgattgttggtgctacaatcaaggtgaaaggtacttcgcaaggagttataaccaatattgatggtgaatactctatcgatactcgtagcaacgcaattttggagttcagttatatcggatatgtgtcacaagaagtccctgtaagtggaagtaaaattataaatgtgactcttcaggaagaggtcagtaaattggacgaagtggtggtggtaggttatggaacgcagaaaaaaatcagtgtgaccggttctgtgtccaatgtctctaccaaagaaatagccaaaatagctactccatcattaagcaatactttaggcggacaaattccgggtattgtgactcgtcaggctacaggcgaaccgggatatgatcaagcgagcatttatatccgaggttttggaacatggacaaatcgtagcccgttgatattggtagatggtattgagcgtgatatgaatacgattaatactgaagaagtagaaagcatttctgtcttgaaagatgcttccgctacggcagtatatggtgtacgtggtgctaatggcgttatcttgataactactaagcgtggtcaactgggaaaaccgaaagtgacattgcgctcagaatatgcagtgcttaccggacttcgttatccggagtatattaatgcggcggaatatgccggtttaatgaatgaggcacgtgacaatgcaggcgttgctaatatggcttatacggatgaagaaattgaattgttcagaaacggtagtagcccttatctttatcctaatgtgaactgggtggacgaagttcttaagaagaatacaacacagagcattacaaatttaaatattaccggtggtaccgaagtagtacgctattttgtaaatgtgggttatacaacgcagagcgggctttatcgcgataatggcgataatgcatatagtacaaacagtcgtgtaaaccgttataattatcgttcgcgtgtagatgtaaatctcacgaaagatctttcagtagaattaggggttggcggtattattcagaatcgtaatttcccaggaaagagtcaatatgatatcttttatgcgattcgtaatacttctcctttagcatttcctgtaaagaatccggatggtacaccaggtgcttcaccgacttatcttggtaataatccatggggtatgactacacagagtggttatgaaacacaaaactggaatacattgcaagggactttttctgcacgttgggatttatcttcacttgtgacggaagggctttcagtaagcggacggtttgcttacgatcattattattctaataataaacaatattataaggattttgaagtaaaacagtatatgggagaagacgcggagggcaatgccatctataatatacttcgtaatgagaatattaagaatgtgactttagcggaaagtgccaaccgtgccatttactatgaagtggcagccaattatgatcgcacatttggtatgcataatattactggaatgtttttgttcaaccgtcgtgattatgtaaacttgcgtaatacggaccgtacgggatccgttccttatcgtcgtcagggtattgcgggacgtgccagctataactacttgcaacgttattttgcagagttcaatttcggatataacggttcggaacagttcccgaaaggtaagcgttatggctttttcccgtccgtatcattgggatacgttttgacgaatgaagacttttggaaccgtaactggtggataagcaacttgaaattacgtggaagttatggtacggtgggtaacgacatttcttccagcacccgtttcctttatctaactaccatgaatatgaatgtgtcggcaggatatatggggaaagaaggcaataattatatggcaggtattatggaagggcagaccggtaatcagaatgtaacttgggagacagcgaaaaagttaaatgtcggttttgatctgggtttatttaacgatgtggtttctttgcaggtggatatatttaaggaaaagcgtgacggtatcttgattactcgtaaaactgtgcctgtattggctggtttctcaggtgcaagtattccggtaggaaatctaggtaaggcggagaataaaggtattgaaaccgcacttgaagtgaaaaaaagagttgctaacggattattctactcattacgtgggaatttctcgtttgcccgtaataagattattgaaaatgatgaaccgaagccgaagtatgaatatcaagatgctcgcggacgccgtattgaccagacattcggacttgtggcactaggattcttcaaggatcaggatgatattaaaaacagcccgaagcagacgttccaaagtaccgttcgtcccggggatattaaatacaaagatataaatggtgacggtgtagtggatgagtatgataaagtagctattggtgacccgcgtactccggagattatgtttggatttggtggtacggtggcatataagaattttgatgtcagtttatttttcacgggtgctgccaagacaagtttctttttggaaggagcaactgtttatccattcctgaatggtgagggcacatggaatgtgctgcgtgaggtgtatgataatcgttggacatctgaaacagctgctactgcaaaatatcctattgttcttaatgctaatagttacaataactaccaaacttccacaatgtatatgcgtaatggttcttacttgcgcttgaagagtgccgaaataggttatacattcaaaggaagactgattgataagatgtttatggataatatccgtctgttctgtaacggacaaaatctattaacacttgattatatcaagattgtagacccggagtcgaataatggtgtaggtaactatccgatgcaacgaactattaactttggtttccagattaactttaaataaatatgaatatgaaaatatcgaaaatgaaaataaaggtggcaggactatgtttgctgacatgggcatttgtatcgacttcatgtagtgattatctggataaaactccggacgatgctacttccataaccttagaggaagtgttttccagtgaaatttatacagaacgttttctgttaagagcttacgattaccttccttgtgaaactaactataatgataatgattattgggcattgggtgcctggagtggtgcatctgatgagatgaacatcacttggacttatccgatggctaaagaaatgaatcgtggtagctggaatcctaaaatgctcgaaggtagttccagtcagggtacgtcttatgcaatgtggtggcgttattatgaaggtatccgtcaatgtaatgtgtttcttgaaaatatagacttatgtccggcagcgcaagctacaaaaaatgtgtggatatgtgaagcacgttttatgcgcgcaatgttgcatttctttctgttgcgtagtcacggtcctattcctatcatggatcatgcgctgaaaatggatgatgaaatgacatatttccctcgaaatacgtttgatcaatgcgtagattttatagtttcagattgtcaatatggcattgatggagcgttgccgatgatttataccaatgcgagtggtacggtggccgaatctttgtatgggcgtgctacaaaagccgcagcttatgctttgaaagcacgtgtattgctttatgctgcaagtccgctgttcaatggaaatgctgattatgctaaatttgccaatgaagacggtacattgctctttgctcccaaagatgattctaaatggggaaaagctgctgcggctgccaaagaagcaatagataagatagagggttcttcttattatggtttgtattattcggatgaacctgataacggttatagaaactatatggagttattcctaccttcaaaaaaatggaataaagaatatatctttgccagaaatcaagggacaggctatagtgacaatatccatcaggagaaatgtatggcagccaacggtatgggaggctggagcggtctttgtcctactcaggaactggttgatgcctatgaaatggctaatggttcaacaccgattatcggatataatgcagatggaacgcctataataaatggagcaagcggctactcggaaactggttttgcggcaacggctggcaaacattatccggcaggagtttataatatgtatgtcggtcgtgaacctcgtttttatgcttcaatcaattttaatggtcaacagtggcgtggtcgccaattggaattttggcaaggtggaaaagatggtattaatgtctccaaagtagattattgctgtaccggatacttattgcgaaaaactgctgatgaaggtgtagatgtgattaatggtaagggaggaatgaaagaagcctctatccttttccgggtaggtagtctttatctggattatgcggaagcattgaatgaagctgaagggcctgtagatgatgtatacaagtatgtagacgctattcgtaaacgcgccggtttgccgggattggcaaaaggcttggacaaagataagatgcgtgaacgtattcagcatgaacgtcagatagaattagcgttcgaagccggacatcgctatttcgattgtcaccgctggaaaattgcagagaaaacagacaacggatatatgcatggtatgaatataactgctactaataaggtagattatagtaaacgttcaacagtaggtgattctcgtgtattcgaaaagaaacattatctgttccctataccgcagagtgaaatggataagcggataggattggtacaatctccctattgggaataaataaaactgtatttcctccctaggtatttatctgtttagggaggaaaatttgttatatataaaactgttgatatatcatgaaaacaaaaacaaggcgtttattgagcctcttgaatttttgtgttcttacacttctggcctgtggaaactctgatggtgccggagaagatccaggagtcccttatttagctaaaaaaggagaacctgttgacggtgttcgtattggttgggattatggaacaatccggcaactggcaactaggggaggatatccacgttccatccgtttacaggataatacagtggtggctgtatatgagaactatgatacaggctatgaaatgcgctgtagtacagatgaaggtagtacatggggggatcctgttattcttttccccatccatagtataacgaatgataaaggaactgcccgaataaatatcgctaactcagaaattatacaacttgctaatggggatttgctggctgcttgtaattatcgtcctcaaacacccgaaataactccgtttgctatagcggtacgccgtagtactgataatggagtaacgtggagcgatcctcagattatttatgaagcggaacctcgtttttctgacggttgttgggaaccgtcttttcttcaacttcctaatgaagaggtgcaagtttattttgctaatgaggggccatatactcattctaatgaacaggaaatatccatgatgacctcagtggataatggtaagacatggggagggtataagacagtttgttttcgcgcaggtagtcgtgatggaatgccggtaagtaaggtggttggcgatgaaatcgtttgtgtgatagaagattgtgggtttgttactttcaaaccatacaccgtacgtactaaattgtcggataattggtcgtctcctgtattggcggattctccaaatcgtgctatggcattgggcgaacctgtagaagattggatttacatgggagctccttatttaggtgtacttcctacaggagaaacgttactttcttatcaggtggatgatatacgtcacgacgatcagttgggtgacaggctgccttatagtaccatggaagtggcaataggtgacaagaatgcccgtaactttgtaaggcgcacgcgcccttttcctgtgcctgcgggaaagcatgcagtatggccttctgtagctgtttgggatgcgaatactatagcagctcttgctaccagtaactatcagggggggacggaggctccgtttttcatgaaaggacatgtaatgcgggatttagaagtgaactcttctgatattgtaaactatcctatttttattggtcataccggaatctgtaatttacgtttaggagtcgggaaagatgcagataatctttatatcacctgcaaggttaaggatggagaactgtattccggtggacaaggaactcaaaaaggaagcggtgtttttatctatcttgatacaaagaatgaatgtttgaaagaacctgctgaaggtgtttataaggtatggtgttcatataaaggcgatataactgtctggcaaggtaataaggggaaatgggagaatagtgagttggaaggattacaaatcactccttctgttgtgtcgggaggttatgaacttgcttttaccattcctttaaatcgttcatttaataaagatgcgatgaggttgtgtgccacattgtctacaaagacctataccgaaacattagttcatagtaatgctgacaggtcgtgtacatggatgaaaatgaatttaggtgggcattaatgcaaagaacgcatatttgaaaacgcagcaggtacttgacaaacgcttttaaatgttgtatatttgtagatcaatagcataaacctataaaaaacagatgaaagaaaaaagtaaaatcatattcctaaatggtataatatagcaacaagtatggactatcttcctgagaaaccttaggtgatagagtaccagatataggctaaaggctgcagactttatgaagtttgcagccttttttgtcttaaaaacttaatgattttattgcgaatttcatttggggagtttataataaacggtggggacgtttattataaacgatcatggaatttattataaacgtataggctggtttatataaacttgttgctattttttatataactacaattgtctttctttgataatgattgttgttggtaattatcgcagacatactgcgcggtaatctaagtaaacaaaatcttagaactgctataggggctataaaccgggtgcctgtttaattcactcaagtctctcttttttcgaaaaaagaggaattaaatctgagcagttttgattttggatacatatattgtggcagttttgatattcgtattttggttttccgatctattggttttagagaaatacatgttaaatgtagttcgaaaaatagaacattaagaaggtaggaaacatgcaaacgatttagaaaaactatgtatttttgtgttataactttcaaaacagtataagaagctttactcattttaatgcagaattgacttgtttgcgagtttaagcacaaatagttatttttattatattgacgaattaatgcttgatttaggataaaacaaacaatttattgttggaattctttaattatttatataagggcaactaaagaatcattttaaaatctgaagaattctataagtaaagaacattttatacttttgcactgttttgaat

SEQ ID NO: 130 - DNA, 21683 bp, Bacteroides thetaiotaomicron
cgatagacagatggcgctttttcgccgttaaatgttttttttctgtcgataggcaggttttttgagaaaaaccatacaaatcatgcaacattttgccttacttgtttgttttaattataaaaattgtatatttgtactcattacaaattctaaggtcagcttatgaagaatacactgcttgcaatatggaacttttatttggagggtttccgtagtatgacgttaggtcgtactttgtggcttattatcttagtgaaattattcattatgttcttcatcctcaaaattttcttctttcccgactttctcggcgatcatcctacagatgccgacaagggtacgtatgtgggaaatgagctgatacagcgtgcacttccggagaaaaccactgatttttaactcttaaactacataagattatgattgaaagtattgacacctcgctgatcgattggtcgagagcccaatttgcgatgacagccatgtaccactggattttcgttccgctcaccctcggactggctgtggtgatgggaataatggagacgttgtattataaaacaggcaatgaattttggaagcggacagccaagttctggatgaaacttttcggtatcaacttcgccattggtgtagcgacaggattgatcctggagtttgagtttggtacgaactggagtaattattcttggtttgtaggtgatattttcggtgcaccgcttgctattgaaggtattctggcgttctttatggaagccacgtttatcgctgtcatgttcttcggatgggataaggtgagcaaacgcttccaccttgcttctacctggctgactggtctgggggctacgatctccgcttggtggattctcgtagcaaacgcatggatgcagcatccggtaggtatggagttcaatcccgatacagtgcgtaatgagatggttgatttctgggcggtggcaacttcgcctgtagcggtcaacaagttctttcatacggtattgtccggatgggtacttggtggcgtgttcgttgtaggaatcagttgttggtttctgctgaagaaacgtaatcgcgagtttgcgcttgcaagcataaagatcggtgctatcttcgggcttgtctcttcactgctggctgtatggacgggcgatggttccggctatcagattgcacagacccaaccgatgaaactggcggctgtagagggactttatgaaggaggaaccaatgtaggtctggtgggaataggaatgctgaaccccgaaaagaagacttacaatgatgggaaagaccctttcctgttccggattgagatacccagtatgctttcgttccttgccgagcgggatgtggacgggtatgtccccggaattaccaatattatcgaaggcggctatcagctgaaagacggtacgactgctttgtcggcagccgaaaagatagagcggggtaagaccgctatcggagcgctggctgcttatcgtgcagcgaagagcgccgggcacgaggaagatgccgctgttgcctatcaggttttgcaggagaatatgccatacttcggatacggatatattaaagatgtgaatcagctggttccgaatgttcctctgaacttctacgctttccgtataatggttatcctgggcggatattttatccttttcttcatagttgtgctcttctttatatataagaaagatttgagtaagatgcgctggatgcattggatcgctctgctgaccattcctttggcttacattgccggacaggcaggatgggtggttgccgaatgcggtcgtcagccttgggctatccgcgatatgcttcctacatcggcggctatctctaaattggatgtaggctccgttcaggctactttctttatcttcctgatcttgtttaccgtaatgctgattgcggagatagggattatggtgaaggcgattaagaaaggaccggaagaagagataagtaataggtaataggtattaagtaataatcgtagctgctgactgatttatcagcatggttattacttattacctattacttattacctgttacttattacttaaaacttaatacttacatattatgtatatatttctacaacaatattggtggctggtcgtttccttgctgggggccatacttgtatttttattatttgtgcagggaggaaattctttattgttctgtttgggtaagacggaggaacatcgtaagatgatggtgaactctactggacgtaagtgggagtttacgtttactacgctggtaacgttcggaggtgctttctttgcttcgttcccgttgttttacagtaccagtttcggtggggcttactggctttggatgattattcttttcagttttgtgttgcaggctgtgagttacgagttccagagcaaggcagggaatttgctgggtaaaaagacctatcagactttcttggtaattaatggggttgtaggacctctgttgctgggtggagcagttgctactttcttcaccggttctgatttctatatcaataaggcgaatatgacggatacgattatgccggttatcagtcattggggaaatggatggcacggactggacgcgttgactaatatctggaatgttattctcggactggctgtattctttttggcgcgtgtgttgggttcgctctatttcattaatagtatagcggataaggaactgaccgataaatgtcgtcgtgcagtattgaataatactattttcttccttgtattctttttggtatttgtaatccgtacattggtttctgacggttttgctgtcaatccggatacattggaggtttatatgcagccttataagtactttatcaactttatagaaatgccggtagttctgatcatcttcctgataggtgtagtattggtactttttggaatcggtaagacagttctgaaaaagactttcgacaaaggaatctggtttgcagggataggtacagtgctgacagtcttggctttgttactcgtagccggatataataacactgcttattatccttcatatacggacttgcaaagttcgctgacattggctaacagctgttcgagtgaatttacgctgaagactatggcttatgtctctattcttgttccgtttgtgatagcttatatattctatgcatggcgtagtatcgaccgccataagattacagagaaggagatggatgaaggaggacattcctattaaatataacttttcctaaatggaataaccgattgaatattttattgggatttaccggaaattccccttatataaggcaatttctatgatatggagttgacttacataaggggagttcttttaattataacatcctctgtaatagcttttcttttatgtaactcatctatcgtgtttcaagcagagatatctttttgggtattgtcagtactcttggcaaataataaatatactaacaggaagatattcgctattggaacgattaataccaataaccacagaccggataacgaaatatcacgcaatcttttcatacattgtgcaagaaaataccataatgttatgagaatcataactgtagttataaacagaatgattcctccccaaaaacttaatgaaggtgttgttcccgttttgtaatcgcctccaaagtgtataaatagatcaatcatggatattgctagacatacaatgaaatttataattgacagaatcatggatagcagaaactcttttctattaattgtgcctttcaggttaaactttaattcgaacatattcgtgaggtttattagtataagatttaatttccttttaaggaatggtaagatggggtagagtataaaggctgtttcaaaataaaaaagaaacagccttttccgtattattcaaatatatagtcttttacttattcactacattttccggtgttccggagatataagcctgtagattgctaatggcaatattcatcagacgctcacgagcttctgtgcttgcccacgcgatatgcggagtaatgtagcagttctttgcagtcagcaacggattgtcggcacgaggaggttccgaagaaagtacatctactccggcagcataaatcttgccactgttcagtgcatctgcaagatcttgttcgttaaccaatgggccacgacctgtattaattaaaatagcattcggcttcatcagagcaagacggcgtgcgttcaccaattcgtgagtttccggagtgagcgggcagtgcagactgataatatcacattcgctgaacaactgatccaaatccatcttcttgatttccggtggcaactggaagtgagactttgaagtcaaagcatatacctgcataccgaaaccgatggcaacgcgagcagtagtatatcctgtatttcccaatccgacaagaccgattttcttatcccgcaattctatcaacggagtatcccaaaaacagaaatccttgttattggtccaacgacctttgtggacttcttccgaatgatgctgtacctgctgacagatattaagaatgtgcgcaaataccatttgtgcaacggaagctgtgctatatgcagggatattagttacaataataccacgttctttggctactgccgtatccactacgttgtatcccgtagcaagcacaccgatatacttcagttcgggcaaggcagtcatgtgatcggcgttgatgattactttattcgtcagaatcacttcagctccggctgcgcgttccaatacttcttcgggggcagtacggtcataaatggtacattctccgagagctttcaaaccttcccatgataaatcaccggggttggcggcaaagccgtctaaaactactgttttcattatatttaagtattaagttataagtattaagtattatgggatgttcccattgttctttagttttacaattgttgctgtcagtaatttaagtatttccagacagtcagtattaatagattcatattgttcatcgcttatatattctgtttgctgaagtaaatatagccaatattctgtttcagaacattccttttgagaaatagagtatttgtgtataaagtcaagatgtgattctgcataaatagcttctctaatattagcaccgatagaagttccactacgtaatatctgttttgatagaattgtttctttcttgcaatctcttaaatacttatatagattaattattcgaattgcaaatttggtagacttctcttttaataaattttctttcacggctacggctaatacctaatacttaatacctaatacttatttgaacctttctccccataactgttgcatccgttctgcatgcttctgttcggcggcattgttctgaggttgccatattcgtttttctttcagctcgtccggcaagaattgttgcttcacgaagttgccttcgtagctgtgggcgtacttgtattcctgtccatatcccagttgtttcatcagcttggtgggagcattgcgcaagtgcagaggcacaggcaagtttccagtggaacgtaccagttctaatgcatcgttaatggcactgtatgccgaattgcttttaggactcgttgccagatagatagttgtttccgccaaagggatacgcccttcgggccaaccgattttcatcagagtttcaaagcaggcattcgccagcagcaatgcattcggattggccagacctatatcttcggcagcagagataacgagtctccgtgcgatgaaagcagggtcttcaccaccttctaccatgcgggcgagccagtaaatagccccgtccggatcactgccacggatagacttgataaaagcggaaatgatgtcataatgcatttccccgtccttgtcgtaagccaacggattctgttgcagacgttcggtcaccatgtcatcggtgatgacaaccgtttcctctgtgtccgattccactacaagttcaagtatattgagcagtttacgggcgtctccgccggagaagcgcagcatggctgtcgtttctttgagttcgattttccgttctttcagtatggtgtcggtggtgatggcacgttgcagaagttcgagcaaatcttccttttccaaagatttgagcacataaagctggcaacgggagaggagagggcggatcacttcgaatgatggattctcggtcgttgcgcctatcagcgtcaccgtaccgttttccacagctcccaacaaagaatcctgttgcgacttgctgaaacgatggatttcatcgataaacaagatcggactggattgcgagaaaaagcggttgctcttggcacgctctatcacttcgcgcacatctttgacgcctgaagtcacggcactcagcgtataaaacggagtttccagtttattggcgataatctgtgccaatgtggtttttcccactccgggaggtccccagaggataaacgaagaaatacgtcctgcatcaatcatcttgcgcaggatagcccccggtccaactaaatgtttctgaccgatataatcatccaatgtctttggtcgtaaccgttctgctaaaggttgcatagtcttagaataccattaataccatgaaacgaataccgttcttgttgatacccggattgtcacggtaggtgaaacgatgtacatattcaacgtgcagcaacttgaaaatgttgtagatacctatacttccttcgatatacggcaccttcgggtccatcacgaaactggtgaatttaccgtcgcgtgtcgggaaacggaagaggtcggggttgctgctcttgaatggattgtttttgtcggtcaatgtcccccacaatgcgcggatacgaaacatttctctccatttcagattcttgatcagcgggatgcggttgaacaactttccgttcatgtcataagaaagtgacatggacgcataacggtcgttcaggaattccatattgttgatcagggaaaatgtctcacgttgagtgatatatgacaagttggcttccggcagaatcaatagcgggaaaggtacgacattccattctgcccctgcttttacgctacagtctatctttccccacgaagcgggaagccagaaacgtttccagatgcttgcttccgtgcggttgaagttgtattctccgcccagcacgcctttgaagcccatggcatgagtcagcgtgaagataggagcgtccagcgacaccggaacacggcgctgcttggagttgacgaaagattctcccggagcataacgcagtgtcacactcgcttcggaagtcgtgatgtcatgcacacgggtttgtgcggcgtcattccgcagatattccagttttccggtaggctcgtcatttcgatggcggagcatggctttcactccgaatcccgtcagcgtttcgagttcgtagttgatggtagcatcacgcatatatgacatctggtctaccgttgtcgttttcatcgaaaggaagatgttgtctttgtccgtaaacaggaacttgtccatcggtgacattacatcataactgtacgttgcagatataaaatgtttgggaaactcccatactacataatctcgtttgttgaaagaataagtcagcgttccgctatatttccacttttcgtctttcagaccataagctccgtatccgctcaggaaccaatgcttgtcaaaatgggcagtagtcataccactcaggcggaaacgggttccgtcgatgtagttgcttgaaatcatggtgttgataggaccgatatccactttgctcttatggcctttgctgcctgtttccacaaagttctcgatcaatgctttcgcaccgaagatgatatatttgaatcccggaatctgttccagacggttgacgaatacatccatattgctttcctttctggtcaacggcacctggcgcacactcgcccagtattcgtcacttttcgaaagcatgtcggcctccttgatcacaggacctttcaaacggaacaatcgctgttctatcggatcaaatttataattgctgtatttagtcgttcgttctacctgtaaccctcccgaggttttgttggaactccatgaaaggtctaccgtcatgtcgtcatccgccaatacccagttcccgttgggaagctgctcgtactgctgcacgatgtccatgcggttgacaaagttgacaccactctttttaggcaggttcatcgtacacttctgaacggcataggtcgaatctttcagcacataaagatggcctgtaaatccgaaatcctgtgagttctgcggtacgaacgtcagatgtacgcattcgcgcttgtccaccatcagcgtatccatcaggtagtatttatagaatgagatggcattgttgccgatagggcttacgaatcgctgttggagcagccggatgtcatcatcatagatgttgatatcggcaaaaacatccttcagaacagtccccagcatgtctcctgtggagaaaaactcttcgataccattggagttctttcctttgataatggtctttttgctttcgggatctttccggaaaatggtttgtgaggccgtttcctgtacggagatagggagaatcagtttgttggtcgtctccgacacttccacctgatctttgaggaatgagtatttcttgtagatacccttttccagtttctccggagtcaggtcgttgatagacattttcattttctcgtacttgtcgtactggtagtaatcgttcacttcgagcacttgtgcttttttgtgttcgatcactttcttcatgaattcgactgccggattattcttgcgggagtatttttctttctgtggctttacgactacttcggtgagcattacatcgtccggagagagtttaacattgacggtctgatttccggagcctactttgacggttttggtgacatatccgatggaagagaaaacgagcgttcctccgtttctccgcgcgtcgagcttatattctccgtcaatattggtgacagtacccatatctctcttgtcttggtagtagacagagatatacattagtggttcatgagtgactgaatcagttacaaccccctttatttgctgcgcaaaagcatttgaaactgcaaatacgactaagagcagtatcagtattttgttatatcgttgtatcataacgttcgtagtagggctgcaaagttaacaaataagtctgagtaaaatagagtatataactttttttacccatcgttttttgttatttacaagcttatatcattcaacaatggaaggaggcagattgtttttgtctttttatacttcccttttcaacgtatgccacatcttgcgaaccggcatgctccgattcttttccgtagttccaaaatctgtttcaacggttgaaacaaaaagtttcatgccttgaaactctagttcccactgcttgaaactctggtttctacgccttgaaactttggtttcctcggcgtgaaactttctgaaacacttgtcgaacctgatagtggtcggctacttctgtctggctattaagccggctcgttgatcatcgaatccggctcaaccactccggttatttacttgttaaaatttgtacgattcgttcggctgttcgtccgtcccagcgttcggggagttcgcctttcttccattcacctttcatcagcgtatccatagcctgagcgagtgctgccggatcttcgccgaccagttcattcgttcccacgcgccacgtttccggatgttcggcatacgtgttgagcgtgatacaggggatgccgaggaacgtagcttcttcggctacattgccggagtccgtgatgattcctttggctttattgatcagatatccgaagaaaagataattctgcggaggcatgatatgaaggttcggggcttctatgccgaggtctttgatcgcattgcgcacataagtgtgcatgggcgctacgataggcataccggcagctttttcgatcatcgtttgcatcaacttccgcaggttctctttgttgttgagcagtacacgtcggttgagggtgagcaggagataattaccttcctgaagtcccagtacggagaaccataccggtttgagcagccggttccggttgaaacgaacggtatctaccaaaatgttgccgacgtaatatacgttttcgctttccgtgcctgtctgattcagatttcggttggccaccatgccggcggtaaacagataatcggatactccgtcggtaatcatccggtttacttccttcggcatcttcatgtcgaaggaacgtgtgccggctaccagatgggctaccttgattccttgtttcttggctacgatggcgcaactcatggttgctgtcagatcatccactaccaggacgacgtgtgccggattttccgtcagctcctgttcgaaggcgatcatgattccggctgccagactggtggggttactgctttccactccaaggtagacatcgggagctttcatgtcgagatccgaaaacagggaagcatccagacttgtatcgtcccgtctgcctgtgtacaccaaacggtaggagatgcttttacccagccctcttgcggcttcgatggcgcgtgtgataggggctattttcatgaaattggggcgtgccccggcaacaattgttattttcatattgtttctatctaattcgtgtagcaaaagtacattttcttacggaatttattcgttactttgcatacaaaataacaaatatatgccgacattcgttcaaattcttgattttataggcacatttgcctttgctattagtggtatccggctggcttcggcaaagcgtttcgactggttcggagcctatgtcgtaggtcttgctaccgctatcggtggcggtaccatccgtgatgtactgctggatgtgacgcccggatggatgacgaaccctatctatttgatctgtacgggacttgccttgatctgggtgatctgtttcggtcgctggctgatccgtctgaataataccttttttatattcgataccatcggactggctttgtttacggtggtcggtgtggggaaaagtatcgctttgggctatcctttttgggtagccatcatcatgggtagtatcacaggtgccgcaggaggtgtgattcgtgatgtctttatcaatgagatccccttgattttccgaaaagaaatctatgcgatggcgtgtgtagtaggcggcatcgcttactggctgtgcgatgccgcagggatggaatcttatgtctgtcagctcgttggcggatcggcggtatttgttacacgcatccttgccgtgaaataccacatttgccttcctatattaaaaggtagtgaagagactgacggcgattcttgaagattttatttcttgtccagatccacttctccccggtagctgattgcctgacggttctgcatcgtgacgtcaatgctggtggtgccgtcggggaacactttcgccctgaactcaaagaagtcttccggacttcgtgcggagaatttgataacggcgtttcccttcttatccatatccatcgtgtattctttgaggggagcgttgaatatcagcccgcttcctccgccataaggaacgctgtaagcacgtccgtaataagggaggtaagagaataccgaatcatttctgatttgcagtgagtattgtgaagtcagaggtatagaacgtccgcgcatgggcatagcagtgttgacgtctatcttgtagtcttctgatacgatcagctgtctgacagcttctttcttctgttccttcttctccttcttggtctgtgccgaaagagtcgggattcctgctagcataaccagcagtagcataaggatttgttttcttgttttcatatcagttacagtttagtgtatatatgtataacactcaaatatactaaaaataaggagtcctcctgctttctttaatgaaaattaaacagaaatccctagaactgttccagaatggagatgcgtttctcgataggaggatgcgtggcaaagagtccgctaagcccgctgagggcacttttcgactggtcgcccggattctgaatgaataattgcgctacatcgctacgttttaccgcttctatatccggatcatcggaaattttgcgcagggcacttgccaatgccaacggattctttgtcatctccgccgaaccggcatccgccatatattcgcgcttccgtgaaatggcgaagcgcatcagactggcaaagaagtaaccgacagccgctattactaaagcaatcagtatgatgaggatagctcctccaccgttttttccgttgctacgtatgcgcgtgtgcgtaatagtatagaaagtgatttgcgtcagcatcgagaagattccgacaaatacaatcgagacgatcagcaggcgcacatccctgttgcggatgtgagtcagttcgtgggcgatgactgcttccagttcttcgtcgttcaacttctgaataatccctttcgagagagtgaccgtataggtgcggtcgttgataccgctggcaaaagcgttcaatgaatcgtcgtcgatgatattgattttcggagccttcattccgtttgccatgcagaggttctcgaccagattatagacacgtttgttttctctgcggtcgagaggtttggcgcctgtggcggctttgatgatactcgtattcgcccagaaagctatcaggaaccaaatcaatacgacacccatcgtataggggagggcattgatgaaaagaggattagccaattccaggatacttacttccatgctctcaccgtgcccaaaggcgaccaatagataacaggccagataaagcaatgctgctaccaggcagggaaatagaaataacagaagaacagagcgccggttgttccggctctgctgtgtttggattccgacgtactgcatacgtgctcgtttttagaaactgatcttcggtgcctgttccagattcgcacgttcgttggtacccaggtcgaacatgatttctctgcggaaacctgccatacctgctatgatattggacgggaatgtctgaaccgcattattatattccttcgtagccgagttaaagtaacggcgtacagcagccaatttattctctacatcggatacttcttcttgcagttgcaggaaattctggtttgctttcaggtcgggataagcctccaacgtgattttcaatcccgataaagcggaagataattgattctctgctgctatcttttcgtcgattgtcttggcgctgactgcaccgttacgtgcctgaatcacccgttcgagggtatctttttcgtgtgcggcatatcctttcacggtatccaccagttgcgggataaggtcgtggcgctgtttcagctgcacgtcgatgtctgcaaaagcattttcacggttatttctcagtctcaccaatgagttgtacatggaagcaaaaatgattcccaacagtacgattattcctacgataataagtatagtcatgtcttttactttaagttaataatactacccaaaagtaagttattttgtattgccaaacaagaagaagagaataaaaaacgtcctaaaccacctaaaaactatcaaaaagcacctaaaatctatcatttgacagtttcaccccctaagaaatgacgaatttccccctgttcgactcataaaatacctttaaacttgcaaacgtcaagaaagaaacgaaatattaaccgtaaaacccttaaagtatgaaaagtttaagtttcagaaaagatttaattggagttcaggaagagttgcttcgttttgcttataaattaactgccaatcgtgaagaagcaaatgatttattgcaagaaacatcattaaaggccttggataacgaggagaaatatgttcccgatacaaatttcaaaggatggatgtacacgatcatgcgtaacatctttattaataactaccgtaaaatagtacgtgaccagacattcgtagatcagaccgacaatctgtatcatttgaatctcccccaagactcaggatttgaaagtacggaaggcgcttatgacttgaaagagatgcaccgcatcgtcaacgcgctgccgaaggaatataaagtaccattttcaatgcacgtatccggttttaaataccgtgagatcgctgagaaactggacctacccctcggaacggtgaagagccgcattttcttcacacgccaacgtttgcaacaagagttgaaagattttgtataaatagggataacacattagtcaaacaattaattctggtaaggagcaacgagtaaaaactcgcttgctcctttgattttgtgacaatatgatattaaacatatctttataccccaacttattctctctatatttgttattatgtcagaaaactcaatatatttgtatcaactagttaacctaagtaatataaatctcatctatttacggcaatgaaaaaggaaatcaaattcagtctcgtttatcgggatatgtggcagtcgtccggcaagtatcaaccgcgtgccgatcagttagtaagaattgctccgttaattatcgaaatgggttgtttctcccgtgtagaaaccaacggaggcgcgttcgaacaagtcaacctactgtatggcgagaacccgaacaaagccgtccgggctttcacgaaacctttccacgaagccagcatacaaactcatatgctcgaccgtggtctgaatggtcttcgaatgtatcccgttccggcagatgtgcgtcggttaatgtataaagtgaaacatgcgcagggagtggatatcacccgtatcttttgcggcttgaatgaagtcagaaatattattccttccattcattatgccctcgaagcggggatgattccgcaggcaacgttatgtattacgttctcgcccgtgcataccgtagaatattataccgccatcgccgagcgtctgatagaagctggcgcaccggaaatctgtctgaaagatatggcaggtgtcggtcgccccgaaatgctgggacgtctgacgaaagcaatcaaggaacggcatcccgaaatcatcatccaatatcacggacatagcggaccggggctttcgatggcttctatcctcgaagtttgtgagaatggcgcggatattattgatgtcgcaatggagccgatttcgtgggggaaagttcatccggacgttatctctgtgcaggctatgctgaaagacgcgggatttcaggtaccggagattaatatgaaagcctacatgaaagcccgtgccatgacacaggagttcattgacgattttctgggttattttatggaccctaccaacaagcatatgtcttctttgctcttgaaatgcggacttcccggaggtatgatgggttctatgatggccgatctgaaaggagtacattccggcatcaatctgatattgagaggtaagaacgaaccggaactgagtatcgacgatttgctcgtgatgctgtttgacgaggtggaatatgtgtggccgaaactcggctatcctccattggtgactccgttcagccaatatgtgaagaatgtggcattgatgaatgtgatgtctctgatcaagggagaggagcgttggacgatgatcgacaaccatacctgggatatgattctgggtaagagtggtcgtttgcccggtgcacttgctccggagattatcgcactggcaaaagaaaaaggatacgaatttacggacgaagacccgcagaagaactatccggatcagctggacgagtatcgtaaggaaatgacagaaaacggctgggacttcggacaggatgatgaagaactcttcgaactggcaatgcacgaccgccaatatcgggattataaatcgggtattgccaagaaacgtttcgaagatgatttgcagcgtgccaaagatgccgcattggcaaaacagggattctccgaagaagaagtgaaacggatgaaacgtgccaaggccgaaccggtgacggcaatggagaaaggtcagatcatttgggagattgatgtggaatcgccttctatgccgcccgaagtgggacataaatatgacccggacgatgtgttctgctacattgctactccttggcatacatatgataaggtgttggcgaattttagcggtcgtgtgatcgaagtatgtgccaagcagggagcattggtagataaaggcgaaccattggcgtatatcgagaggtgtgaggaaccggcatagtctgtatcttaaataacggaaaaaagaaatccctttatccttgtcttgtttcttgatgaaatagactgtgataaagggattgctttatttctttttcttcttcctggtgtctttcttatcgaccgccttcttctctacaggcggaaacttaggaaccagattcattaatcgcaatatctgtttttgtcgtttcaataggtaagccgaaggcttcgcagagttaaaccgtatcgggttagggagcgtagcggcaatcagtgcgcactgtcctgagctcaacttggcagctgttgtgttgaatttatactttgcggtagcctgtgcgccataaatcccttttcccatttcgatagagttgagatatacctccataatccgttctttcgaccagaataactctatcagaaaggtgaaataaacttcgaaacctttgcgtacccaagacgattgcggccacaggaacacattcttggctgtctgctggctgatggtacttgctccgcgcttccgtttccgtttctcgttctccttcatcgctttctctatctcgatgaaatcgaatccgttgtgttcggcaaagcggttgtcttcggaggcgatgaccgccatcggcaggtgaggagatatcttatcaaaagaaacccacgtgtgtttccacgtgggtttatctcctgacgcaagctgctgtacacttcggatgaccatcagcggagtgacatacaccggcataaagcggtagacgatcacagccagaatggtagatgcaaagaagaaaatcagcaggttgcgcgcataacgcaatatttttttaattggaagcggcctgtgcatctttaatcatctgctcacttgcgtacatgtaaacttctacacgacgattctgttctcttccggcagctgtgtcgttgctggcgataggatcgctttcgcccattccctgcacacctttaatctgattggaagaaacgccgcagtttaacaggtagctggctacactctgtgcacgttcctgtgacaagttcagattcttctgacggctttgttcggcggtactgtttctccagccctgattgtcggtatatccgtagatggatacgtccatgtctctgttctggttgagtacgttgttggcgaacttgctcaatgcagacttggcagcagcactcagagtcgcattaccggtagtgaaaagaatacctgaatcgaatgtaacttttactgcctgcaatccgttgttgtcagttatctgctctacttgtgcgccttcaatttgttttgcttctgctgccgctttatccatcttctttccgataagggcacctgttcctgcacctactgcagtaccgatagccgcaccgatggcagcacccttgcctttaccgataacaccgccgaggatagcacccaatgcagcacccgaaccaccgccgattgcggcacctttgcccgtattgttcatgcttgcgcagccactgaatatcatggttatactcatgaagagaaccatccatttcatcttgttcataatgcaatgttttttaaataggtttataaaataatactttaataaattaacaacgcaaagatacatattatttgccaaggtcatactttttaggttaaaataactccggatgatctttgtatatgtaaaataacaaacgacacggctaccttgttgacacggaaggcagatttaagcattttttcctgatcatggtgaaccatcccaggagaatcagccctttggcaatcgttgtgacgcatactgcccaccagataccttctactcccatgcccatccgtacaaacaggatggcaagcggaatacgcatatagttgcatacgatgctgacaatggcaggaggcacggtacgcccgatgccgtagaacactccctgcattgtgatttcgagcatcataaacagctgcgaatatccgtcgatacgcagaaatacacctccggcttcgtaagccgcctgttcggggacaaagatcgaaaagacctcattgccgtaaaagacaaacagcagcgtgcagaaagtcccgaagattcccgtcatccatagggtggtgtgccaggctttcagtacccgttctattcgtccggcggcgaagttctgggcaataaaggcgctgagtgcggtggagaaaccttgggaggtattccaggtgatggcttctatctgtccgccggtggtgaaagtcatcagtccgatgtgtccgccctgttcggatgcggtacggcagaggaacatattgacgaaggcgaacagtgtgtttagggtagctacgggcaggcctagtttcagaatacgccgcgtgtactttttcttcagtcgggagaagaaggggaaaccaccgagcagggcgtctttgcggaaacgcagctggtagatgaagatggcgaaaaccgttgcctgcgagagccatgtagcgtaggcggcaccgtttgttcccagaccgaagccgaagataaacagagggtcgagaatgatattcataatcagtcccgtcccactgatatagaatggaattttgcttcgtcccgctgcattatagatacctgtgaaggcagcggacaggaatatgaacggcaatgcggtggaaataatccgcaggtattcgatggcattggctgtgatgtgctcttctagttcatagatgcggataatggggcttgcgaacatgaacagcagtccgccccagcagatcgaaatgatcagagcaatcgtgatattgtgtgaagcgaactggcgtgcatcttcctgattctgcgcgccgatggattgacctacgctgacttcggaccctaccttatttaataaggagatagaaccggacatccacgtcaggattcctaccgaaccgatggcggcgactgcctcactgcccagtcgtcccacccatgccatatctgtaaggctgtatgccatctgtataaacgacgttgccatgataggcatcgccagattgaaaagttggcggttgatagggccgtgtgtcagattcttaattccttgcatatcattttttctatttaaaaggaggcgcaaagatacataaaattactatcttcgcacatcaaatattcattaatcaaagtatacagatactatgaaacagaaattctcttctctttttgtattgctggtcctgctattgacaggactgcaagtctcggcacaaagtacgccaaaaccatttgatattgaacagccttctcttcgtgttttcctgccggcaccggaactggcgacaggtcgtgctgtggtagcctgtccgggtgggggatactccggcttggcggtcaatcacgaagggtatgactgggcgccgtatttcaacaaacaaggaattgcattgattgttctcaaataccggatgccgaaaggcgaccgcaccctcccgatctccgacgccgaagcagccatgaaaatggtacgtgacagcgctgacgtatggaatctgaatccgaatgatattggtatcatggggtcttctgccggaggccatctagcttcgaccatcgctacacatgcgcctgaagcacttcgtcccaacttccagattctcttctatccggtgatcacgatggacaaatctttcactcacatgggctctcatgacaatctgttgggcaaggacgcttctgccgatctggaaaaagaattctccaacgagaagcaagtgaccaaagagactccccgtgctttcattgtttatagcgatgatgacaaggtagttcctcctgccaacggagtcaactattatctggctttaaataagaaaggtgttccttccgttctccatatttatcctacaggcggacacggttggggaatccgtgaagatttcctctacaagagtgaaatgcagaacgaactgacttcttggttgcgtagtttcaaggctcctcgcaaagatgccgtccgtgtggcttgcatcggcaacagtattacgttcggagcaggaataagaaatcgcagccgcgacagctatccttccgtactggcccgtatgctgggcgacagctactgggtgaaaaacttcggagtgagcgcccgtaccatgctgaacaaaggagatcatccttatatgaacgaacctgcttataagaatgcgttagcttttaatcctaatatcgtcgttatcaaacttggtacaaacgacagcaaatcattcaactggaaatacaaagcagacttcatgaaagatgcgcagaccatgatcgacgctttcaaaggtcttccttcacagccgaagatttatctctgctatccttccaaagcttatctgacaggtgacggcatcaacgatgatattatctctaaagaaatcattccgatgatcaagaagctcgccaagaaaaacgacctgtctgttatagacctccatactgctatggacggaatgcccgaactctttccggaccgtattcatccgaacgaaaagggagcgcaggtaatggcaaaagctgtctatcaatctatctctactttaaaataaaaaatatgttaccgatcattgagcttttaaccggataattgtattaataatatagcccctgataaaagaaaggagaatattatgattagaacagttgctgtctttgtttttgtgtcttttgcttgtgttgctactgccttttctcaaactatagaaaaggagaataaaatagatgtgcaaaagaaaaatagctccgcggaagtgagcggacggcagttgcccgaagcaaaaaacatagaaccgaagttaccggatatagaggctaaaaagctcgcaacagatgataagtccatgcagacatacggtctgacaccttcaagtcctgcatcgggcttatctccctattcttacgattttccggcattgctggaaagtaatccgacattgacggatttttataattttcgtcagcattctatgaatggacaactttcctttattgggagtgcagaacaaaagacttatctgggattggggcaatatgtagcggtaaatgccggaatacgctggattccttctcaaagatttttcgttgaagcgggaggggacttgagtcggcaattctatttggctttgcctatagcgaggcaagatatagcgggaatatatacgagaatgcgttattctttagtcagaaatgtccggttaaatgtctggggacaatattttatggggggaaatacacctcctccggcttataatccgttatttccacatacaggggtaggagcctctatctcggtcgatgtgaaaaagaatacggaagtaagtgtcggtgcggaataccagtacgacaaaaaatcaagagaatggaaaatggaaacgtcaggccgcgtatccattggcttttgacacatatttcatcattcatttggctctgttatttatttctcatatctttgacgcattaaaattataatgtttcattaaaactagtggatg

SEQ ID NO: 131 - DNA, 21660 bp, Bacteroides thetaiotaomicron
gaaattcgaacgatagaaatcgccaagaagttcaagctgataaggactaaaggtcatgtcactctttttcatcttttattcattttagttgatacttatagtagtcaaccaaatccagggtaagacaaactacttcttggagaataatcttgtaggagagatgggaaaaggaaagccttggtgacttcgaggcaaataaagaagatcggcttgcactgcgacgattgtcgtgtagcaagccgacctttatttcattttatctatgtatcttatacgttctttaccttgatcagatactcagcgatctgtacagcattcagtgcagcaccttttttgatctgatcgccaacgatccagaatgtcagaccgttttcatttgtaaggtctttgcggatacgtccaacgtacacagggtctttgcctgcaaggaacaacggcatcgggtattccttttcagcaggattgtcctgaagaacgagaccctcgcctttggcgaatgcttcacgggcttcttctaccgagatcggacgttctgtttccacccagatgctttcagagtgagcacgaagtgcgggaacacgtacgcaggttgcactgactttcacgtcagagtgcataatcttgcgtgtttcgttatacatcttcatttcttctttggtataaccgttttccgtgaacacgtcgatctgcggaatcaggttgaatgccagctgataagcaaacttctctactgtcacaggctcgttggccaatacctgacggtattgttcgtacaactcgtccatagcggcagcaccggcaccgctggcagcctgataagtagatacgtgcacggtttttatatgagaaagctgttcgatggctttcagtgcaactaccatctggatagttgtacagttaggattggcaatgacgccacgcggacgctccaacgcatctgcggcatttacttcgggcactaccaaaggcacatcagcgtccatacggaaagcgctggagttgtcgatcatcacagcaccgtatttggtgattgttttctcgaactccttggatgttcctgcaccggcagaagtgaaagcaatgtctactcctttaaagtcatcgttgtgttgtaagagtttgacctcgatctgtttaccgcggaaagtataggttgttccggcactgcgtttagaaccgaacaaaactaactcgtccatcgggaaatttctctcatcgagcacgcgcaggaattcctgtcctacggctccgcttacgccaacaatagctactttcatctttttcttttgttaaatgtgaataatgtggttaatcgctgcaaaattagaacattttatcatataatcagcattttggagatacttcttcacattttatcagttcccatcctttaaattggagcaaaatgcaatgcaatgcagtcccttcactgatagttgttacctttttatcccggctatattgttttagttgccctctgccttcttccgcttgttcttccagttccttatcggtggcggtgcgcgggaggtattttaattccagaatataactgtgtgccgtgtccgggtagcgggatttgtccggcaggaggaaaaagtcacaatatccgtaattcatctccaattccggctgaaccagataataagaagcaagagcaaggtatgctttgaagaaaccttgcaaattgtgttctccctcgatggcatcgcggatggcggagttttctttataggcaagggctatgtactcaaacagagggcgccattgtccgtcgaaggccatgtcgtcaattaaatcttttaagtgaggcaagaatacttccttacgctgctggtagtattcccgaaggaatccgaaatactgctcacggacgcaattgttaggaatgcacatcacaatacggtctccacgtgtgccacacattgtaagcagtccataataataaagcaggctgcggaaattgtctgtttcaacaatcttctctgccgggaaggaggtgtggaggtttaccagtatctctcctttagcagctatctcttcaatcgtactcatgcggtcttcccccgacacattctcatggtcgaggcgtgccaacattttcagcttgctgtagtccgtacggatattcttgtcgatcaattccttaggggaggcgtcgaaattaacccggtgacgcaaataatatagcgtcatgtcgcaattgaacattctcggatcggtcttcaaactggcttctgcaaagcagtaattgtcataccacggtttcatttcattaatcatggcatctatatctcctttcagcataccttctttctgataatagccgaacatctcccgtacatccgtttcgctgaatcccatcatcatattgaaatgtgggtccacactgatattccagtctatgttatatccgctggataagtcgtccagcgtaacaggacttacccccatcaggaagatgcgttcgaacatacccttgaactgcttgaagtattctcggtagaagccgctggcgtgggtcaggtcgcggaaaaggtttttcccctgttcactcaggatgacattcgtaaagttgtcatattcatcaatgatgaggtagagcaaatgtcccaggcggcgggcggtggcttccagccaatgcagctttgtagcggcttcggtagaagcgatgatttgctccagttctttctcgccttggtagtattcccggtaagtactgaagaagtcgttcaactgtatgcagcaataattgttgaagttgtcttccagacttccacgtcccaggtttgctttggaaaagtcaaaatagagcacctggtagattccctgaagcggggtggggtgcttaccgatccatagattgccgaaccgttcttcaaaacgatctttctgtgaaatatcgtaataggcacgcatcatggtgagaaatacactcttgccgaaccgtcggggacgaataaggaaaaggtagtttgctatttcttctatctggggaatgaaatgcgttttatctacataataataattttggtctatcagcctgctgaagtccgatatgccgtatgggattccttttgccataatgcgttcattttattgggatggatgcaaagttaagttttctttttatctccaacaactatccttctgcaattgttgctattattcctattaaataaacaggaggatgagatttataatacctgcattgtgattctgcgaacttttttgttcctttgcgtagaaatcctaaaaccacggacctatgaacctgtttgaattcaatttagcgttaccgataaccgatccgacttgggtgttttttctggtgctaattatcattctctttgctccgatgattctggggcgccttcatatacctcatattatcggtatgattctggccggtgtgctgatcggcgaacacggattccatgtgctcgaccgtgacagcagcttcgaactgtttggtaaagtggggctttactatatcatgttccttgccggactcgaaatggacatggaggacttcaagaaaaaccggatgaagagcgttgtcttcggcttgcttactttcctgattcctatggcgctgggtatatggagcagtatgagcatgctgggatacggttttcttaccgcagtgctgctcgccagtatgtacgcttctcacactttgattgcttatcctattatcagccgttacggattatcccgtctgcgcagtgtcaatattactatcggtggtacggccattacggtcactcttgcccttatcatccttgccgttattggcggaatgtttaaaggcaccgtcgatggtctgttctgggtgttcctcgttgcgaaagtagccttccttggtttccttattatcttcttcttcccccgcatcggacgctggttcttccggaagtatgacgatagcgtgatgcagttcgtgttcgtgctggcgatggtcttcctcggaggcggactgatggagtttgtaggaatggaaggaattttgggagctttccttgccggattggtcctgaaccgcttgattcctcatgtctctccgctgatgaaccgtctggaatttgtgggaaatgccttgttcattccttactttctgatcggtgtcggtatgattatcgatgtcagaagcctgtttacggggggcgaagcattgaaagtggcggtagtcatgacagtggtagctactttcagtaaatggcttgccgcatggatcacgcagaagatttaccgtatgcagcccaatgaacgcagcatgatcttcggactcagtaatgcacaggcggcggctacgctggcagcggtgctgatcgggcacgaaattatcatggaaaacggagagcgtctgctcaatgatgacgtactgaacggtacggtcgtgatgatccttttcacctgtgtcatcagttcgctggtaacggaacgttccgcccgccggtttgcactgaacgaagatgcgcagcccgaagataagggagcgaagaaagcgatggagcagattctgattccggtagctaatccggaaacgattgagaacctggtgaatctcgccctggtgatcaaggatgccaagcagaagaatggcatgattgccctgaatgtgattaatgacaataacagctcggagaataaggaactgcaaggcaagcggaatctcgaaaaagccgcaatgattgccgctgccgccgatgtaccggtgacgatggtaagccgctacgatctgaacattgcttcggggattatacatacgattaaggaatatgaggctacggatgtagtgatcggtctgcaccgcaaggcgaatatcgtcgattccttctttggcaaccttgccgaaagcctgctgaaaggtactcaccgcgaagtgatgatagccaaattcctgatgccggtcaatacgctccgccgcatcatcatcgccgttccgcccaaagccgaatttgaaaccggtttttccaaatgggtagagcatttctgccggatgggaagcattctcggctgccgtgtgcacttctttgccaacgaacgtacactgatgcgtctgcaacaactggtgaagaagaaattcagcggtaccccgaccgaattttctctgctcgaagagtggggcgaccttctgctgctgaccggacaggtgaactacgatcatttattcgttgtcatctctgcccgtcggggttctatctcgtatgatccgtcctttgaacgtctgccggcacagctgagcaagtatttctccaacaacagtctgattatcctgtaccccgaccagttcggcgatccgcaggagattgtgtctttctccgacccgcgtggttacaacgaatcgcagcattatgaaaaggtgggcaaatggttttataaatggtttaagaaaagctgatggaagaaaataactggcaacaacggacagaactcctgttgggagaagagaaaatgaagcgcatccgtgcttcgcatgtattggttgtcgggctgggaggcgtgggggcgtatgctgccgaaatgctttgccgggctggggtaggcaggatgacgattgtagacgcggataccgtgcagcctgccaatatgaaccgtcagcttcctgccatgcactccaccctggggatgccgaaagcggaagtgttggcggcacgctacaaagacatcaatccggatattgaactgaccgttttacccgtctatctgaaagacgagaacatccccgaactgttggactctgctaagtttgacttcatagtggatgccatcgatacgatcagccccaaatgctttctgatttatgaagcgatgaagcgtcatataaagattgtttccagcatgggcgcaggcgcgaagagcgatattacgcagatttgctttgccgatctttgggatacctatcactgcggactcagcaaagcggtgcggaagcgtttgcagaaaatgggagtaaagcgtaaacttcccgtcgtattcagtaccgaacaggcggacccgaaagcggtattgctcacggatgacgaacggaataagaaatcgacctgcggaacggtcagctatatgccggcagtcttcggctgctatctggcggaatatgtcattaaacgaatctaagaagctattatgataaaattagaaggaataaccaagagttttggttctttgcaggtgctgaaaggcattgatctggaaatcaataaaggtgagatcgtcagtatcgtaggacctagcggagccggaaaaacgactctcttacagatcatgggaacgcttgacgaaccggatgcgggcacggtggcgattgacggaacggtagtcagccggatgaaggagaaagaactgtccgctttccgcaataagaatatcggttttgtgtttcagtttcatcagcttctgccggagtttaccgcgttggagaatgtgatgatccccgcatttatcgccggagtatcgtctaaggaagcaaacgaacgtgctatggagatactggctttcatgggactcaccgaccgtgcttcccataagccgaacgaactgtcgggaggagagaagcaacgggtggccgtagcacgtgccttgattaaccatccggcagtcatccttgcggacgaaccttccggaagtctcgatacacataataaagaagatttacaccaattgttcttcgacctgagggaccggttgggacagactttcgtcatcgttacccatgatgaaggactggccaaaatcaccgatagaacggtacatatggtggatggcacaattaaaaaagattaataaggaaaccaaacttctaaaaatggataccaaatcactagaagattgtgtgagttcaatcttttagctatatatttatagtcgcttctctacgtaagtctgtgaagatgtcagtagagtgtttgttttgtttgtgtgtgatgcattcttgtctggtgtgataggaatgcatctttttttatatatcacaacaaatacgattttagtcgtaacaaacataaggcgccattcgttcgaaatctgcgggtgtgaattcctcgtaaagcatcagttgtttcaagtctcttactttccccttcttcttccggtactctgcaatgaccttggcttgataatagctgatgtacggatgatgcatcattcgctctacacttgccttattgatgttgatccggtgaatctttccagcatccacggagaaccacgaacggagcttttccgcttttaaccgaatctcccctaactgttctatctgatagaatcctcccaataaccggcgatggtttacaatcgatcgggcaatccggcttccgatccccggaatctttttaagttcggtggtatccgcctgattaaggtcgatgatagtgcccggcgggtatttcattaaagtatcatatggtgcagtcgcttgtactactaatatccggctggtatcttgaaggaccggtgtttcggcaatgcgtatatacggttgaagagtccggtattgttcttccgtcagcccgtatattttccgaaagtcttccggacgtcggaatctgccttgctttctgcggtatcgcagaatattgcccgccatccaggtaggcaagccgagactgaggaaagtggcggagtcggcggtattcggatcgaacgctgccggtctgatttcttttttcggataggcgggcgatgaatacctgcctctgtaaactggatatttcttgtcctgctttgcttcttttatggaagagataaattcattatattccttttcggatttcgcctgttcagtcgggtcggttttctccggtccggagaaagcctgcaagagtgcggggattgtgtatacccctataacaagaacgacaaggacgataatgccttgtcgttcggttttagtaaaataaaaaaagtctttccacattatagtttgataagtcccaactcattgataaagatcagagagatggcaatcggtgcaatatatcttaatataaagatgatcagtttgtatacgggaactttcagcgaaccgtcattggtgatctccgaccagacgattttcttgtcgagataccatccggtaaagatggaaatgcacagaccgccgagtgtcagcatgatcttagccgtgacaaagtcgaataagtcaaagattcccaatccgaagatggtgaatcctttcatcactccgagcgacaaagaacaaaggatacctaagaagatacatcctccggtcaccagtctggctgccttgccgcgtgtgaagttgaattcttcgtgcagataagcggtgaccacttcgtgcagggaaatggtggaagtcagtgctgccatggcaagcaatacgtagaacatgacggagaagatataggccaatatcggtactccgctgaatgcctgctggaatacattgggcagtgtgataaagataaggctcggacccgcatccggttgtatgcctacagaaaatgcggccggaaagataatgaagcctgccaatactgccacaaatgtatctataatccctacgctgaatgctgtcttggtcagattggtttctttgctgaaataagaagcgtaggtgcagagacatcccatccccaggctaagggagaagaaagcctgtcccatcgcactcagaaatacatttccgtccaccttgctgaaatccggtttcagcagaaactcgatacccgcaccagctcccggcagggtaaccgaacagattacaagtatcaatataataatgaacagagtcggcatcatgatcttggaagatttctcgatacctttctccacgcctttgacaataataaaatgagtaaccaacagaaacagaaccaaccacaagaccggtcgccacggactgctggagaactgctggaaggaagagatgaattctgtgggagtcttacccgtaaagccgttcgtaagagcttcatacacatactccagcgtccatcctgccactacggaataataactgagaatcagaaaagctgcgaggactcccatgcgtcccacccagcgccaatgagtgccgggagctaatttctgataggctcccgctgtatttgccctcgaacggcgtccgattaggaattcggcaatcaaaatgggaagtcccaaaaggaaaacgcatcctaaatagatcagtataaaggctgcgccaccgtgattacccgtttcatagggaaatctccagatgtttcccaatcctactgccgagccggcggaagcaagtattacgcctaatttacttccgaagttcgctctatcaattttcgtcataaatcttgttttgtcttacaaatcgttataaaatgtacgtattaaaatgcaaatatagaaaatgatagttatatttgtaccggaatcgtaattttatttagatatgctatcttatattaagaaatatcctatttcactttttatcatcttaactgtgatttatctgtctttcttcaaacctcctaaaacggacttgaatgaaatccctaacttagataaattagttcacatctgtatgtactttggtatgtcaggtatgttatggctggaatttctgcgggcgcatcgtcgtgatgacgcaccgttatggcacgcatgggtaggggcattcctctgtcccatactgttcagcggctgtgtggaattgctgcaagaatattgcacgacttatcggggaggagactggctggactttgccgccaactcggtgggtgccatccttgccagtttagtggcttattatgtggttcgtccgcgaatgatgagaagggaatagaagactatagtaatgcataatcatactcatgcctatgagaaaaaattctcattgcagtgagaaaatattctcataggcatgagtattttttctcatcgtggtgagaattttttctcaaaggcatgagaatactttgagaaattaacagcgatattatagataatctacaaccgaactgagcttaattccgttggaccctttgatcaggatagtgtatcctttcggcttgtcggcttccagttcctttattacttcctgtacgttgggataggtttggaaggagtgctctgctgctgcaaactgatctcctaccagccatactttttcgaacgcgcattctttgaggtagtctgctatcttctgatgttcggcagcgctttcggcacccagttcgcgcatatcaccaaggatgagcattttgtgaggaacttccatgttgcggaagttctgtaaggcagccatcatgctggtcggattggcgttgtatgcgtcgatgatcagtgtgttatcgtccgttttctttagttgcgagcggttgttctgtggtgtatatccggctaaggcttcgttgatctttgcatcttccactccgaagaagcggccgatggtgatggcagccagtgcattggggaagttgtattctccgatcagttgcgtctgaacctgataggatttaccatccttgcccgctttccattcgaaagtgaggtaaggggagttgccggtgattcgtccgtttacgtaaaggtcatcttcggtgccgtaagggatcaggttcagtccttcggcaatgttcatcagataagcattgtcgtgatggataaagacggtagaaccttctttcttacggagaaagtcataaagttctcctttggtttttatcacaccttcgaaagaaccgaagccttccaaatgggctttgcctacattggtgatgataccgcagtccggctctgcgatttcgctgaggaatttgatttctcccggatgattggcgcccatctcgatgacggcaaggtcgtgttccgctttcaggcggagcagggtagagggcacgccgatgtggttgttcagattacctagcgtataaagaatgttgtggctctgagagagtacggcggagatcagttccttcgtagtcgtcttgccgttggtaccagtgataccgattactcgtgtacccagctggcggcggtggtaattggcaagctgctgcaatgtttgcaggcagtcgtctacgagtatatatcgttgatcgccttcaatcgcgtattcggattcgtcgatgacagcataggcgcaaccggtttccaatgcttttccggcaaaagcgtttccattgaatgactcgcctttcagagcgataaacagtgatccttcaggacagttccgactatcggtcgtcactaattggcaatccagaaatatctggtaaagagcagaaagtttcatagcctgagcttttatttttaaatgttgcaaagataggctattctttcggatttggtatcggtcagaagcgttttttactcagcatataccaaaggaagagtcagcaccatccggcacccgtccgtataggatgaatcgatgtggaggctgcctcctaacttttcggcaatcgtccggctgatcgacagtccgaggcccgtgccctgtgagaaggagttcattttgtagaagcgttcgaatactttttcctgtttctccttagggattcctataccggtgtcggtaacgctgatctcgagtttcttttctgcttccaataccgaataagtcagttcgatgctgccatgagtcgtgaatttgatcgcattgtgtgccagattggcaagtaactgcgaaatgcgttccggattgctgagtatgattagtttttccctttccggtttgaaaaggaattcgactgtgtcttgtttctgcattttagctacttcgatagatagctggcagatcatattgatatccgtttggatatttgtagggagcttgttatattggtcgagctccgacaatgcgagcacatcggtcacgagtcgaagcagatcgtccgtgttggctttgatgatgttgacgaattctttcgtttcctcattgccgtagtggtcacttaatacttgtgagaagcctatgatcgaattgagcggtgtccgtatttcgtgagacatactctgaataaaagtcgttttcatctggctggtcgcttctgcctgatctctggctttgcgcagttcttctctcgaataagtcagttcttcgttcttatttcttaattcactttccgaggccttcagcctccggttcagacggctttcccgatataagaacaagaagaggatggctaacaggatgatcaatgaaaaaatcagcgtcgttttattgctcaactccttttcttttgtccgaagcattaattcctttttctccgcattgagcttttctacatttagcagcgtggcatattcgctgctcgccagttgttcattggctattttcaaagaatcgtctacttcaatatactttttcagaaatttcaccgcttcatccggtctgcccatctgtctgtagatttctcctttgaggcggtattgtccgctgctcatggcgtactcattcagccgttgctcttcggttttctgcttctcgacagcttccagtgccttgacgaactgtttgctgcgctggtagtagaaagcctctgtgcggtaaaacctttttttgagtgagtccagccttttgtcctggtcgaacagttccctgcattctttcagcatcttctccgctgctgagaaatctttaaattcactgtaatactctacgtatgtcagctttgccagtattttatggctggcggagttggctgtttttactgctttttccagtgcttccagcgctggttccggctgatgatgcgtaatgtagtaattggcaagttgagcgtaagtattactgatattatagttttctaatttgtatttttcggtcagttcgatttctttcacgcgccattcggacgccatgacatcaaagttcttgattgtgtaaatctgcgacatgatgttgtagcagtacatgagtccggtcttgttgtcctcggcttgtgcctctttcagcactttttcggcttcatagagggcgatgttactccttccggttttcaggtaatataggatcagccggttggcccaggcgaaatagtagtacttggactgctgtatttctttagcgaattgttttaccttattggtataaaaaatgatgctgtcttcattattggcctggtaataataatagtccagccgggtggagagagctaccgcctgcatccgctggtcgttttgtccgctagccatacggaacagcgtatcggacatactcagcacgaccggttccagcaaatgttcctggcaacgctgatagtaggcatacaaagaggaatcaacgttataaacttcagcttctttctgggcttttgcaggaataacgatgaacaaaaaagagacaaggtatcctaagataattcgggacaatcggctcatggtattcgttttcggtagttctattgattgctattgattgcaaatatacgtttatttcctaattttaatacgaatacttgctttttttatctacatttgcaacagtctaactggaatataatcaagaatgaaattgatctctccaacttatataaatgtgaaaggacgtctgctcgatcttgctactccgcaagtgatgggtattctcaatgtgacacccgattctttttattccggcagccggatgcagacgcaggaggaaattgcagcgagggcacggcagatcatcgatgaaggagcctctatcattgatatcggagcttactcctcgcgcccgaacgccgaacacatcaccgccgaagaagaaatgaaccgcttacgtaccggactggagatcgtaaaccggaatcatccggatgctatcgtttcggtcgatactttccgggcggatgtagccgaacagtgtgtggaggagtatggcgtagctatcgtcaatgatatcgctgccggtgagatggacaaccggatgtttgagactgtggcccgcctgggagtgccttatatcatgatgcacatgcagggaactccccaaaatatgcagaaagaaccccattatgataatttgatgaaggaagtgttcatgtactttgctcgcaaggtgcaacaacttcgtgaattgggtctgaaagacattatactcgatccgggttttggttttgggaagacactggagcataattatgagttgatggctcacctggaagagttcagcattttcgaacttccactgttagtcggtgtttcccggaaatcaatgatttataaactattgggaggaactccgcaggattcattgaatggaacaaccgtactggataccgttgcgttaatgaaaggagcgaacattcttcgggtgcatgacgtgcgcgaagcggtggaagccgtccggattgtggataaactgagaactgagagtgaatatggcaaatgatagaatggcattatccgttggtgatactctcttgtcgtttgtgaattaataacttgtaataagtaataagtaccgtgttttttgacgttggcataaaagattttatcgatgtactgctggtcgcccttctgttgtactacacctacaaactgatgaaggcctccggctctatcaaggtttttaccggcattctggtttttatcctgatctggctggtggtcactcagattctggagatgaaactgctgggctccatattcgataccttgatgaatgtgggtgtgattgctttgatcgtcctttttcaggatgagattcgtcgtttcctcttgacgctgggctcgcatcggcatgtcagtgcattggcgcattttttcagcggggcgaggaaagaagccttgaaacatgatgatatcatgccggtggtaatggcttgcctgagcatgggaaagcagaaagtaggcgcattgattgtgatcgagcataccactccgctggatgaagtggtccgtacgggagaaattatagatgcggctatcagccagcgtctgattgagaatatatttttcaagaacagtcctctgcacgacggagcaatggttatcagcaaaaaacggatcaaagccgcaggctgtatcctgccagtctctcacgacctgaacatcccgaaagaactgggcttgcgtcaccgtgcggctatgggcatctcgcagaaatcggatgcgcacgccatcatcgtctccgaagagacaggagctatttctgtagcttatcgcggacaattctatcttcgtctgaatgccgaagaactggaaagtctgctgacaaaagaaaactgaaactaaatataagtgaacatggacagacgaaattttctaaaaaccggaggtatagctctactcggatcattggcgacaggttctgctatggctctgactaccccgggtgcattgggcggcgaaggagctgacaagaaagcagcagttgctttggctatgaatcatttcggagtaagcgaggcagacttgaagaaggtgcttgccgcggcattggagaaaggaggcgattatgccgaccttttctttgaacacacgatatccaacagcatccgcctgatggatggtgcagtgaacaacagttattcgaatattgactatggagtcggagtccgtgtactgactggagaccagagtggctatgcctacgtggagaatattactgtggaggatatgctgaaagctgcccgtactgccgcccgcatcgcttccgccaacaaaggcaacaaaccgctgaatctcaccgaaaaggaactgaagaagaactattataccgttgcttccccgtgggaggaagtcagtttgaaagataagatgccttatctgcaaaaactgaacgaccggattttcgctttggacaaacgggtacataaagtacaggcaagtcagagcgataccacttcgcatatcttcttctgcaattcggagggagtgatgttctacgattaccgtccgatggtgacgctgggtgccgtgtgcatcatggaagaagacggaaagacggagaacggctacgctgcccgtgcttaccgcagaggattcgatttcctgtcggacgaggtagtggacgtaatcgcccgcgaagcggtagaccagacttctcttctgttcaaggctatcaaacccaaaggcggtgaaatgcctgttgtcatgggtgccggaggatcgggtatcttgcttcacgaggctatcggacatacttttgaggcggacttcaaccggaagaatgtttccatatttgccgatcagctgaataagaaagtatgcaacgaacatatcaacgtggtggatgacggtacgattccgttcaatcggggttcggtgaatttcgacgatgaaggtgccgaaggacagaaaacttatctgattaaagacggagtactgactagttatctgcacgaccgtatcagtgcaaagcactacggagtggaaccaaccggcaacggacgtcgcgaatcgttccgcaatatgccgataccccgtatgcgtgctacatatatggaagccggaaatgtgagcgaatcggatatcatttcttctgtaaagaagggaatctttgtagataactttacgaacggtcaggtacagatcggtgccggagactttacattctttgtgaagtcgggctacatgatcgaagacggtaaactgacgcaaccgatcaaggacattaatattatcggtaacggtccgaaagctttggcggatatcacgatggtagctaccaatgcgaagatcgacaacggtacatggacttgcggaaaagacggacaatcctgtccggtgacttgcggtatgccttcagccttggttagcaaactgactgtcggtggagagaactagaagtaaatgcttactttaaaaagacgaacctatgattacagacgaaaataagaaactggcacagtgggcgatggactacgccttgaagaatggctgccaggcagcaaaagtccttttatactcttcttcgaacacttctttcgaactgcgcgatgcgaagatggacagattgcaacaggcatcggaaggcggattaagcctttccctgtatgtggacggacgttatggtagtatctctaccaaccgcctgaaccggaaagagctcgaaacatttatcaaaaacggaatagactctacacgctatctggctaaagatgaggcgcgtgtattggcggacccttcccgttactataaaggtgggaaaccggacttaaagctatatgatgccaagttcgcatccttaaatccggacgataaaatagagatggcgaaagccgtagcggaagaagcactaggcaaggacgaacggatcatctctgtcggttcttcctatggcgatggcgaggactttgcttaccgcctgatcagcaatggtttcgaaggagaaaccaaaagtacgtggtactcactttctgccgacatcacgatcagaggggaaggcgaggcgcgtccttctgcttattggtatgagtcgtcgctttatatgaacgatctgattaagaaaggaatcggtcagaaagcgctggaacgtgtattacgcaaactgggacaaaagaaagtacagtccggcaaatatacgatggtggtcgatccgatgaattccagccgtttgctaagtccgatgatcagtgcgctgaacggctcggctttgcaacagaaaaactcattcttattaaataaattgaatgaaaagatagctagtgaccggctgactttgacggacgaacctcatttggtgaaagcttccggcgcccgctacttcgacaacgaaggtattgctacggaacgtcgctccatctttgacaagggagtactgaatacctatttcattgatacctacaatgctaagaagatgggagtcgatccgactatcagcggttcatctattttggtcatggaaacgggagataagaatctggatggactgattgccggagtggaaaaaggtatcctcgttacgggctttaatggtggtaacaacaacagttcgaccggagatttctcttatggcatcgaaggtttcctgattgagaatggaaaactgacgcaaccggtatccgagatgaatgttaccggcaatctgattaccttgtggaactcgttggttgcaaccggaaacgacccgcgtctgaactcctcctggcgtatcccttcactggtatttgagggagtcgatttcagcggattgtagacactgactttgaatagacttaagtaatggtcaggagatgatggtcataaaatggagatcatctcctgaccattactgtaatattaccctctgaattttataaatataccctgctataccccgtcttctgcctaactaatgctttattaattaacgtattatctggtttttgcttacctgtatttataccccctctttgtttgctaatttgtgggatgctgtttacttttgcctgtgtcaaaattaaataggatataactattgaaaactgatatacacacaaaagtaaaagcatgggaattatatattttggatcgggacttatactgctaatcgcactttggtatatttgggcagtcaacaatttgatcgctaagcgaaacagggtgaagcaatgtcgtagcggtatttgcgtggcattaaagcagcgaaatgacatgatacctaatttggtggccgccgttaagtcatatatgggtcatgaaaatgaaattcttacccgcattacggaacttcgatcacattctttccaaccttcacaggaagccgaacaaataaaaagtggcaatgaattgtccggtctgttaaccaaattacagttgtcggtcgagaattaccctgaactgaaagcgaatgaacaattccatcgcctgcaaaacagtattgaggacatggaactgcaactgcaagccatccggcgcacctataatgcggcagtaacagactacaataataccatcgagatgtttccttcttccgttgttgcccgtcagcaaggtcatcatcaggaagaactgattgatattcccgaaccggaacaacagaatgtaaatgtcgccgaacttctcagataatacgaatatggacacaattgattttaagaaattatcagaacagcttcgttcggagcttttacgggtaaatggctggagaaaggtggtacgaacaggaagtattgcagtttatctttttgtattctgctggtttatgtttgtgttgtttggcggtgcgcttgtatcttatataggtcttgagaactatatgcagtttacgcagtatataataccagtattcattggatttatagtggtcaacttcgttttcactcgctgcatggcgaactttcaggaacgggagtcggaggctatgcagcacattatgtctaccctgtttcctaccgtttatttctcggcttcctctcaggtagacagccggatattgagagacagcaaactcttttccgcctctttttctgatccggcactggcagccaatacgtatggatatatccagtttccgcacggcgagcactctttgcatgtggcggatatcggcgtgtcttacgggctgttgaacaagttgcagtacaatcctgtattgggatattttgtcatgatctaccgttttgtgcttcgtccgctgtttgcttcgcggctggatagcagtccgcacaattttcgggggatgtttggctggtgtaagatagacaagcgattcaaaggaaatattatcatattgcccgatcacctggaacaaaagatcggatatctggcgaagaatatccaggggttgaagaagcgctatagtgcccgactggtgcaattggaagatcaggagtttgagaactattttgccgtttatgccgatgatgaagtagaagcacgtatgttgctcactcctgcgatgatgcgtcatatgacggcgctgcaccagactttcggatgtgatatcatgctttcgttcagcagaggtactttctactatgccgccgtgatgccttccggttttttatgtgtgcgtccaagtgcgttgaatgacgggaagctgcttgaggacatatataatgatatcagcctgtcctgcaaagtggcagaggaattaagattgaattagtattaacaataaaacaaaaacactatttatgacagacatgagttggatgccttgggtcgtaggcggagtaatggtcctttcttttctttatatgaaggtatggccatttgtccgtactattataagagcttttcgggggcctcgttttaaatcaaaatcaaaattatccgtagaacagtataaaaaactgtctataggttcattgtatgccttgcagcaaggcggatatctgaacactctctcgttggatatcaaagataagttgcctactattcttggtgaatggtggggaataaataatgctcatgatgcccgcgaaacattggatgatttgtgccggaaaggttacgattactactttccgtttgtttatgaggcttttttgcttgacgatgaaaatgcgcaagacgatattttccagcagaacatggagagtcaggaagattatgaaaaagctgtcgggcaactgcaaaatttgaaagaggtctatgaggagttgatagcttatgaagtgattacttctaaagaagatatagcccgctatggagtgattggctgggatgccggcagaattaattttgttgcccgtgcctgctgcgatatgaaatatatctcagaaatggaagcgtggaattatatcgacaaggcgtatgaactggctcattcttcttttacatcatggcacgatatggcgatgagttatgttattggcagggctatctggggagggaccaatgctcacaatttaggaatgaagggaatggcagacgatctgttgtctaatcctaagagcccttgggtgcaaatcaaatggtaaattgatcaagatagtttaatcacaaaaacacataattatggaacaaaagaacaacaagtactacagttacatcagcgagtattatgccgccaacccgactaaatttgaaaaaagaaagaacaatctgaaacctgtgttatatttaggtttggccgtggtaggagccgttctggctatttttcccggtttgcttccattggcaggctggttggtgcgtacagccggaatcatcatgacactggtttgcctgatagctgcctatctgaataactttgatatatacaactttcaaagtggaggaaaagtcaagagtatgggagtcaagaagtttaagcgtgatgagacaaaccctgcgaagatagtggaagctttcttatccaggaactttgaatatctggcagaccttcccggaggaagaagtgaaccggtacaacttcatattgaagaagacgccacaggacgtgaaatgtactgtttgctgaccacttatgattcagattcgaatattgtaggtttggcagatgtcatcactttatcgggtaatgattatgatgataatattgatctaattaaacaaatgtttaaagacgaagaagataattgattcatcggggctggattataaaaacagctctgaggagaagaaaactcttctaaatggaagaaaaaacacaagaaagaaaaacattcatactataaaggaaatcgaccggaggggtgggtacagacacaagtaacctgtcaacaaaaggtcgtatttcctttaaaaataatctgtctcaggggattttgctttatttctaaccttttttgaatgataattggtacctgcggtttaggtgaatcgcctatctttgccgtatactatatataattataattc

SEQ ID NO: 132 - DNA, 21602 bp, Bacteroides thetaiotaomicron
tacagatagaagcgcccgtttgtaaacaaatcaccactatcaaaacagtcctattaatatatcatatttttaccacataaagaaaggaagagaactttactcaaaaaaagttttctccctttcttacactacacccccggaatcgaataaactccttcatcgtttttaataaataacgagagagtttattataaacggtccccaagtttattataaactatttttaggcgtttccagcagcctcaatggaattattataacaaaaatgggcaagaaccttcgcagtttcttgcccattcgttatcctggctatgcaattctgcacatccacctattgaacttatgttataatttttatatatcctatcattactattccgttttatattcctccaaatatacgaaataaaaacaagaaagtcaatagccggacggtatttgccgtgatatttcttcatttatcaggtattaccttgttattcgggcaataccttattataaaagaaaggtttttttcactcactacgtggttatctgaaaataaacacgtaaatttgctggctcaaattgaaataacagtataaatcactataaataaaaactttatcactatggagtacaatttcagggagattgaaaagaagtggcagcaaaggtgggtggaagagaaaacctaccaggttacggaagacgaatcgaagcagaaattctatgtattgaatatgttcccttacccgtcaggggccggactgcatgtagggcatccgctgggatacatcgcttcggatatttacgcccgttacaaacgactgcgtggcttcaatgtactcaatccgatgggatatgacgcatatggtttgccagcggaacaatacgctattcagaccggacagcatcccgcaatcactactaaagctaatatcgaccgctatcgcgagcaactcgacaaaataggcttctctttcgactggagccgcgaaatccgtacgtgcgaacccgaatattatcactggacccaatgggctttccaaaagatgttcaacagctactactgcaacgacgaacagcaggcacgccctatccaggaactgatcgatgcattcgcaatctacggaaacgaaggactcaacgctgcctgcagcgaagaactcagctttaccgccaaagaatggaaagccaaaagcgaaaaggaacagcaggaaatcctgatgaactaccgcatcgcctacctcggcgaaacgatggtgaactggtgccaggcactgggaaccgtattggcaaatgacgaagtcatagacggcgtcagcgaacgcggcggcttccccgtagtccagaagaagatgcgccagtggtgtctgcgtgtatccgcttatgctcagcgtctgctcgacggactggataccatcgactggaccgaatcactgaaagaaactcaaaagaactggatcggacgctccgaaggtgccgaagtacagttcaaggtaaaagacagcgatctcgaatttaccatctttactacccgtgcagataccatgttcggtgtgaccttcatggttctggctccggaaagtgatctggtagcccagctgaccactcccgcccagaaagcagaagtagacgcctaccttgaccgcaccaagaaacgtacggaacgcgaacgcatcgccgaccgcagcgtgaccggtgtattcagcggttcgtatgctatcaatccgtttacaggtgaagcagtgcccatctggatcagcgattacgtattggcaggatacggaacaggagccatcatggccgtacccgcccacgatagccgcgactatgctttcgccaagcatttcggactcgaaatccgcccgttggtagaaggttgtgacgtaagcgaagaaagcttcgatgccaaggaaggtatcgtctgcaactctccgcgtccggatgtaactccgtactgtgatctgtctctgaacggactgaccatcaaggaagccattgaaaagaccaagcaatatgtgaaagaacataatctgggacgtgtgaaagtgaactaccgtcttcgcgacgccattttctcacgccagcgctactggggggaaccgttccctgtatactacaaagacggaatgccgtacatgatcgacgaagactgtctgccgctggaacttccggaagtagacaagttcctccccaccgaaacaggcgaacctccattgggacacgccaaggaatgggcgtgggacacggtaaacaagtgcacggtagaaaacgaaaagatcgacaacgttaccatcttcccgctggaactgaacaccatgccgggattcgccggttcttccgcatactatctgcgctacatggacccgcacaacaacaaagcattggtggacccgaaagtggacgaatactggaaaaacgtagacctttatgtaggaggaacggaacacgctaccggacacttgatctactcccgtttctggaataagttcctgcacgatgtaggtgcatcggtagtagaagaaccgttccagaagttagtaaaccaaggcatgattcaaggccgcagcaactttgtatatcgcatcaaagatactcacaccttcgtttcactgaacctgaaagaccaatacgaagtgactccacttcatgtggatgtaaacatcgtatccaatgatatcctcgacctggaagcattcaaggcatggcgtcccgaatatgcggaagcagagtttatcctcgaagacggaaaatacatctgcggatgggcggttgagaagatgagtaaatcaatgttcaacgtagtcaatccggatatgattgtggacaaatacggtgcagacacccttcgtatgtacgaaatgttcctcggtccggttgagcagtccaagccttgggatacgaacggtattgacggtgtacaccgctttatccgtaagttctggtcattgttttacagccgtaccgacgaatatctggtgaaagacgagcctgcaacgaaggaagagttgaagagcctgcacaaactgatcaagaaagtaacgggagatatcgaacagttctcttacaatacgtctgtcagcgcattcatgatctgtgtcaacgaactttccaacttgaaatgcaacaagaaagagatactggaacagctcgttatcaccctcgctcctttcgctccgcacgtttgcgaagaactgtgggatacactgggacacgaaacttccgtatgtgacgccgcatggcccgcatacaacgaagaatatctgaaagaagatacgatcaactataccatctccttcaacggaaaagcacgcttcaacatggagtttgacgctgatgccgcttcggatgccatccaggctgccgtattagccgacgaacgttcgcagaagtggatcgaaggcaaaacaccgaagaagatcatcgtggtgccgaagaagattgtaaatgtggtagtttaaaataagtaacaggtaataagtaataggtaataaccgcagctgctttccgagcatatccgcaaggttaatacctaatacttaatacttattacctgtacctatcgactacgacttattacctattacttaatacttattacctattaattaaatgcgcaaaccagcaaaagcggaaataatgagagaagtgaaggattatatctacatcactctcggattgatcagttatgctttgggatgggcggcatttctgctgccttaccagataacgacagggggtactaccggtatcggggctatcatttattacgcaacgggatttcctatccagtggtcgtacttcatcatcaatgcggttctgatgacatttgccatcaagatattaggtccgcgattcagcataaagactacttatgcaattttcatgctgactttcctgctatggatattccaggtgttggtaaacaactacatacaaacgcccgatatgtcggccgacggaaaacctctactgctcggcagcggacaggactttatggcttgtatcatcggtgcggctatgtgcggtgtaggtctgggcattactttcaattataacggcagcaccggaggaacggatatcatcgccgctattgttaacaaatacaaagacgtatcccttggaaggatgatcatgatttgtgatgtgttcatcatcggttcctgttactttgtgtttcacgactggcgtcgggtaatcttcggtttcgtcactctgttcatcattggtgtcgtgctcgactggattatcaacagcgcccgtcagtccgtacagttcttcatcttctccaagaagtatgatgagatagccgaccgcatcattaaagatacagaccgtggggtgaccgtgctcaacggtaccggatggtacagcaaaaacgatgtaaaagtattggtcgtactggccaaaaggcgtcagtcgctggatatcttccgactggtaaaacgtatcgatccgaacgctttcatctcgcaaagttccgtcatcggggtgtatggcgaagggttcgatcagttgaaagtgaaataaacaggtgaatgaatccggataattccgctaaaaaacaagaataagacaatgaaacgcaaacttgtatttgccaccaacaatgctcataaactcgaagaaatagctgccatcctcggggataaggtagaactgctcagtctgaatgacattgactgccacacggacattcccgaaacagccgaaacgctggaaggaaatgccttgctgaaatcttcttttatctaccggaactatcagctggactgctttgccgatgacaccggactggaagtggaagctctgaacggagcgcccggagtgtactccgcccgctatgccgaaggcgaaggacacgacgctcaggcgaatatgcgcaagctgctccacgaactggaaggaaaagagaatcggaaagcgcaattccgcactgccatttcgctgattctcgacggaaaggaatatctctttgaaggtgtgatcaaaggggaaatcatcaaagagaagcgcggagattccggcttcggttatgacccgatattcaagcccgaagggtacgaacagacttttgccgaactgggaaacgaaacaaagaacaagatcagtcaccgtgcactggctgtacagaaactttgcgagtttctgcaacgctgattctttagcatattccgcacaacagcctgtcttgacatcaacgaagtgccagcagtaaaattctctcaggtcatttcttaactatatgacacagagtttaataaaagaatttttgtaatcttcagaagaaaattatttctttgcaaaaaaaataaagcgtaatgaagaaaattgcattatttactttccttacattgttattatgtacttcatgtgtaacgaaaaagaagttcatgatgacagaagccgcacgtattgcaagtatcgacagcttgcaaagtttattgactgattgccgcaacacgggcgaccagctgtcagcacaaatcaagaagctcctgcgtgataccacccagatgggaaacagtatccgtcagtatcagagcatgcttagtactaacatgacggaacaggaaaaactgaatgccttgttgagtcagaagaaaaacgaacttagcgaaagagaacgcaccatcaacgagttgcaggacatgatcaacgctcagaacgagaaagtgaaacaactgctgaacagtgtgaaagacgcgttactgggctttagcacagacgaactgacggttcgtgaaaaggatggaaaggtgtatgtggcaatgtcggacaaattgctgttccagtcaggaagcgcccgtctggataaacgcggagaggaagctctcggcaaattggcggaagtcttgaacaagcagaccgacatcgacgtatttatcgaaggtcacaccgacaataaaccgatcaacaccgtacagttcaaagacaactgggatttgagcgtgattcgtgctacctccgtcgtacgtatcctgattaagaactacggtgtaaatcctttgcagatacagcccagcggtcgcggcgaatatatgcctgttgacgacaatgaaacagcggaaggcagaagcaagaaccgccgtacggagattatcatggctccaaagctggacaagttgttccagatgttacagacttccgaagaggttaaataagaaaataataataagagactgtcaggaggtagacagtctcttattatatagaaacaaggctataatatttattgccctatatgatataactcatccatgtttctattagatacaatatctgaattcatactgtttactttccccatccggatggtttcttacccatcttgaataccatcgtaccaccgttcatgatgtcctgatgagtgatgaagaaatctttgtgtttcttcccgttcaaagtcaccgactgaatgtagatatcttcgggagacttgcggatggtccggatacggaactccttattacctgccagtttcaaagtacactcatccaaaagcggggaaccgatgatataccggccgtcggcaggattgaccggatagaatcccatcgcactgaatacataccaggcagacatctgaccgcagtcatcatttccggcatatcccgaagaagtgttgttatacagcgtgttcagaatatgactgacatacttttgcgtcttccacggctgacctgcaaaattatagagataagctacgtgatggctgggttcattaccatgtgcatactgtcccacaaatcccgaagcgttatgattcatctgctcactcttataggtagaggtaaaaaaggtatccagcttttgttcaaaggctttcgttcctcctgtcagttccatcaaggcctggatgttatgcggaacataccaaaagtattgccatgcatttccttcggtaaacggatgcccgccgtttccaccgtattgatacgggtcgaaaggttcgatccattctcccttgtcattcttggactggaagaacttcgttttcggatggaaaaggttccggtaatattcggagcgtttgtggaatcgctgataatcggcatccttgttcaattttgcagccagttgggcaacacaccagtcatcaaaagcctgctccagagtgatggagacagattgagtctgaatgttttcgggcataaagccgtatttctcccatacctcaaaaggagagttggggtgtgaggttaccgaactgttatagactgcttcataggccttctccatatcaattccgggaatacctttcaggatggcatcagtgatcacagggatggagtggttaccgatcatacagtaattgtcctgtccccataattgccagataggcaggtagccgtaatattcatactggcgtatcatgctcttcacgaagtcagtcacccgttcgggttccagcaatgtgtagagaggatgagaagcgcggaaagtatcccacagggagaatgtggtgtaatgagtttcattgttcgctactttgcgggtcgtatagtcggcagccatgtattcgccgttcacgtcggacatggtgttaggctgtatcatggtgtggtaaagagccgtatagaatatctctttctgcacttccgtacctttcacttcgatctttcccagttgtttttcccaatcagcgtccgcagcagccacatagcggtcgaaatcccagtgcggtgcttcctgttccatgttctgacgggcattctccatagagacggatgaaagggctaccttacacgtcagtggtttgccattcagttggccgaaacggaaacagccatgaagattcgtaccgttgatcacggctgtgttttcatgaacacgcccgccgtctctcagcgtagaagtaaggataggactggaaaactccatgtagaaataaatcttgcgcagtttcgcccatccggtgatgatacggtaaccttccactgcatgatcattcagaatgcggatctgagagttaatgatccggcgtccccaactgcccttatctgccgagtggtccatatccaatataatctccgcatctttgccggcgggatattgatagcggtggataccgtttctctgagtagtggtaagctctgcattaatattctcatctttcagcattacctgataatagccgggacgggccttctcttcgtcatgcgtgaatgcggaagaagtgcgtccgctactggtcggcatcaatgtaatgtcgatcaggtccgaggctcctgtcccactcaggcgggtatggctgaaaccgaagatcgtattccggttatagtcgtagccggaagcgtccccccaattgggagcttcgctggtgtccggagaaagctgtatcataccgaacggcgaggtcgcccccgggtaattattacccgaaagtcccccatcgatggcccccgttccaataaacggatttacatatttagtgatttcccctgcctgcaacgtagcgagagtcaatgaaaatgcacatacacttaaaagtaatttcttcatggttcatggtgtttttataagatatgtttcttatgtctatggctttttattcttctgttatttcaatgagacggctgttgagctgctgtgttgtgaaaagatccagtccgacgttcattagatattctccggagaaaacctggttgttacccttcaatgaggaaccgctaccgggcatcatattgatttccttcacacggtacttcttgtcggcattcaacccttgcaggcggacaggcaatgtcttttccgcatagcgcggatggatatcgaaggcaaataccgcagccgttttcttgtccttgcctacaaacatggaagaagtatggttgcttccgtaaggagaaacgaggcgatacaaatcaccttcaaggatgacaggtttcagacggttgtagttcttgactgcctgatcacagtaaaggtgctcattctgattcatgtcttccagtttgatgtcgaatcctaatttgcacatcatggctacatcggtacggaacttgatactggttccacgattccaagtagtgacgtgggcacacagtgtcttacttgggaagatctgcgaatagccccattggataaacaggcgttcgataggatcggtattgtcgcttggccagaactctgtgaagtacttcaatgcttcatagtcggagcgtccgccgccaccggcacacagcatcatcggaagattaggatatttagccttgattctgtccagcaccttgtaaagtccgcgcacataatcaacgtacagatgagactgtttatctttcagatacaccgaatagatattcgtaatcgggctgttgcagtcccatttgaagaaagcgatgccgggatatttggtcatcaggttgtccaccacgccgaatacatgatcctgtactttcggattgctaaggtcgagcaccatctggttgcggaagtagtattcatcacggttaggcagatgaatcacccagtccttatgcttttcgtaaagctcgcttttgggatttaccatttccggctctatccatataccgaacttgatacctttcttttgtgcttcttcaacaagacgccctactccgttcggaagtttgtcggcagtctcttcccagtcgcccaacccctgatggtcactgctacggggatatttgttggcaaaccaaccatcgtccagcaggaacatatctacgcccagcttggtagcctcatccatcaagccgatcagtttattttcatcaaagtcaaaataggtagattcccagttgttgagcaaagtcatgcgggtatcattaccgtttttcacctgatgattgcgcgcccagtcatggaagttacggctggcctcacctttcccctgcgtgctgtaagtgaaatagaagtccggagtacggaacacttctctggcgggcaggctgtattcggagtcgtacgggttgataccgctgataatacgcagttcgtttttgttgtccacttcgaaagtaaagcgaaagttacccgtccatccgatggttcctaccagcacttcgcctgcattctcctgcgaaggattgtcaagagccagctggaagaaaggagatacaaacatattggcacgtgcacccaacttcgtatcgatcacctttttaccgaaagccagttctctttcggtcacgttggcttcgtgtgcccagtcaccggaaaattcagtcaggaaatacttgctgctgttcaggtgaagcattgatgaagcatacttgcaaagtatcacaggtttcttctcttcatggctgatttcagtaaacgtacggataatgttctctttgccgtaagccacataatgcagcttcacggtcacagggtatttatcatccttaagggtaattacggtttcgttgaccccgttaccgatggcattgctcgaatgatctacgtatttcagcagcaatgaagagttattatcgttatgacgtatgtgaatagccggttcaaagtagtcctccataccgtgagtcagataagcttcagtcccttgtggcagatactggatatcggaatcatggttaagctttttgcccaagtatttctgatacagacgtccgttgtcagctacttgatagataaggctggtccgttcggtttctattttgatcagcggcttgtcggcagcctgcaaaagagaaaaagaactcaatagaaaaaaaagtaagaatgcttttaatttcatggtttacattgttatggttgatatttattctctggtgcggaacgggggtacgggaagcccgttcttgccatatagattacaaacaggattgtctgcccacgcatagcaggccgccgtcggtatttctatccggtcggattgcagaatgacttcttttccccggataatagcctgtgccggaacgtatttcccgtccggtcctgccagtataaagcctttcggagtaccttctttggctactacttcctgatcgaaactaagaatcagcgtacgtcccgaaatgcggtatccaaggaatgcgggcacttcgtatgtacctttgttataggtcttcgccaatgccgcttgcgccagtcgctttcctacttcctgtttgtttttcgggtggatatcataagcttcgccgaggtcgatggcacatgccatacctgtattaggtaggtgcagcgcatgtgcctgtgcatcacggagagccgcccatttggagtccggctgtacttcttccggcttcagataattggccaactgcacaaagtagaaaggaaaatcctgtttccatgcccttctccaatctgtaatcattgattggaaaagtactctgtactgctcgtcgaatcctacattattttctccctgataccagatagcgcccttgatagggaagacggtaaaaggatgtatcattgcattgtaaagtacggtcggatagcaggatgtcggccagccggttccttcgggagacaatggtctagaaggtgcaccggtcatcgatactccggtgtgatagttccagttgcccgccaaggaaatcttcttgtcgttcgcttccatatacatctgctgaggttctccgtggataccgccttcgccgccataatctatggcacggatggtgataacccctttgcctgcctttgccaaggctgcgggaatcttataagtacgcatcgtattgcatcccgaagttcttcctatctccttcccgttaaagtaagtaacatcgtcgtcgtcgatcatagccagatggaaggagatttccttgccgttccagtcagcaggtatttccacttctttctggaaccagacagtgccgtcaaaattcagtccgcgagtttcccaataagcgggcagttccatcggtttccattcattccctgtctgaagagctgatatccattggggaactccgtctttgaatccggcatccttggcatcaaactgctgaagccactcgtccatttcccgatggtaaagttcgacaagtttctctctttggaagcctgcgctttccatttcggccatctttttctgaaatcccacgacttgcttcaatgtctgatggcttgtccatgattcggcaggtgtgccgccccaagtgcagtcaatcaccccaacgggcacattcagttctttccacaacttacgggcatagaaataagcaacggaagaaaactccggtacagtagcggaactacattcctgccagccgttcatattcatttctacgttatcctgcggagagaaagcgacggtcttctttacctgcaacagacggatggaaggataatcggcatcggcaacctcctgttcgtaattcatcacttttccccatccggcaacgggcatttccatattcgactgaccggaacatatccagacttcgcccgataagacgttgttcaacactagtttctcaccatccgaaacaatgatctgataaggtcctccggcaggcggagtcgggacttctatgctaaaatgaccatcagctgacgctttagccgtatatttctcatgattccagctcaccttcacagtcacttgtttaccggcttttgcttttcccggcaacgtcagctgactgttttgctgaataaccatattatcggtaaagaatgacggcaatgtgaccttcgcttgcgcaaaggctgccacacataacgataagagtgttaattgatattttttcatttcttcggttatttaaattcaagtaattgcacgtctttggagggtacggtcacttcaagctgtcctgtggcaaaagtctcattgccgctccacaactctttcacctgatagccgcgtgccttgtccaatcctattctttctaacgaaagcacagttgtctgttcctggtccgaatagttgaataccgcacaatggaaacgaccatcgggtgtcttccttacaaagatatgttccgacttctctccgtttccttccacgggacggaacacttctcctgtcgctactgcattcactgccgcattggtcagatatttctgtgacttttctttggcgtcttttcctcctcccgcactgaaatcgtctcctgtaatgtaaatacccgtaatgacacccgaagtaatacgggcacggttttctccgtcggtagcatctctcagtacaatatgatcggcatcgttatattgatagatatacttctgccaccagccgtatgaaagagcgttcaatgtatattcggtatccttgatctgattccacgcatcacaggctattctgcgtgactgcgcatactgggcagggaagacaggagaaatggagagattgatatacatatctccaaaatattgattgagcagtttcatgccataattatatccctgtatacctgtggtaatctcaggattataccatttgtccgcttccatcgcaccgtgtgtcatgaagtccatcttcacatactcgaatcctgcacggtggaacaaaccggaagtcttcttcatcatagcttccactgccggatgcgttggatcgactgcataagcgccgtccagttcctgcggctttccgttggcatagagatagatatctttgtatttatattccggtgcggcatctaccgtccgttccggatcgcgtgcccagtcggtgaacggagtccagtagataccaccgatctgtccgttcgacttacatttttcgataaatgacttcagttgctcctcattcatacagtcccaaccggaatccagaccgatatagacagtctgatcagggtttacaaaatgattattctgcagattctccttgaaataatcggagacttccatcgctttctcataagtcagattgaattgtaatgccccccagctgttccaaccaaatggaacagctttctcccatgctttgggaggggcaattacagcgttggcttttgcatacgcttcaagtccatcgcaccaatcttcaaagaaacccaaaaagactttaggggatttaatctttttacctgctaatgcaccgtgagcctttacgtcacgagtctgctcatctgctatgcccccataacataccagcgaaccaatgttatcacgatcccccttacctattgaaatacctgttttccagttatcatgttctacggagccgatcaccagaccgttccggctttcattattgaatatggctgtcacttcataactcaccaatgtatcgaaaccaagcgggtgagactgatatctgatccatttgtcattgtcgaacggaacaaaaagagcacggttatcacctgcctgcaagaatccggatatagaatcgacattaacaggagccattctgccggaacggatttcctctttcgcttcgaccgtaaaatcggtcagtatatattccttacccggataaagatagaaatactgagtcagcttcggaagctccttatccgtatactccaccttatatatatgtcctttcccgaaagaatcggaaactttgcccgtactgattttatggcgggcatagtcacttgtcttgatctccttcccttcccattgataggaagcatacattccgttacaaatattttttgacttataagtgagtgctattcccccttgctgatcatcgtaagttatattccatacatcggtagagaaaatcttgtctccactggcacagttggaaatgaaaagaaacagaagaagcatcagggatactcccgacattttttttagtagtagcttttggtttttcatatggtacaatgttcttatgtaaaaaaataaagcatacccgaataagaaacctttttctcttattgaggtatgccacaaaggtaaggattggcatctcctttactatatacaaacgattcaaaaaatgataaaaatacggcaaataagctccaatgcgggctaaaagaggtattttatctattttgtgccctctcctgcctcgacattctttatctcctgcgtgataatgatctgcttgccggattgatattgtttctcaaaatctttgggtgtcatgccgaattgtttcaggaataacttgctgaaataagacggcgaattgatgccgaccatatagcagatatctccgatccggtatttaccttcctggataaactcggctgcctttttcaacttgatcaaccggataaaatcgagcggagacaagttgaacagtgtcttgattttccttaacaaactagaacgactcatgcagagtatatccgccatccgttctacaccgaaattatcatcggttatgttatcttcaatgaccttgatcactttattcataaattcctcgtccgccttgttcatctgcatattgttgacagagaagaaggggcgtttcgcaaaggcttctctttccctgcgcctgttgtcaagcaaggacaggacttgttctttcagataattgaaagagaaaggtttctcaacgtatgcttccgcaccatatttcagaccgttgattttgctgtcgatgtcattcttggctgtcaggaagataataggaatatgagaaagctccatatccgattttacttccttgcagagttggtatccgtccattacaggcatcatgatatcactgatgatcaagtcgatatggctgcttctcaatatttccagtgcttctaccccgttcatcgctgtctctacggtgaagttttcctgcaagcgttcgagaataaaggtcagcatactttcgttgtcttctaccaacagaagggtatatccatacatatcggccgtgacgggcgtatgttcgtccagctcgacaatgtctttctgtatggctttgttgttctcctgtttaatgccctccatattcaaaggaatggtcagtacaaacatattgttttcctgacgggtatccagatagatcgtgcctttgtgcagggatgccaacgaacgtgccagagacaagccgatgcctactccattacggggcttctcctttctgtccacctgatagaacggttcgaatatatattggctgacttcggccggaatcttgtttccatcactggtgacacgaatcgtaaagctgtcttctcccttttccagttctaccagtacattctggctagcatacttcagcgcattattgagcaggttgctcagtatcttggtgattgcttctttatctacagctgcccacacctgctcatctgtcgattttaactgcaattctttccggttcaggctgaacgtcacttcaaagcgtgccacgattccggcaagaagttcggtaatgtccacgctctcaaatttcatggtcagcttgttggcaccgatcttctggaagtccagcagttgtccggtaagttccagcaggcgtttggtgttctggaccatcacactgatatacttcttcatcttgggctcctgtatctccatttcctcaatggcttcgagaggaccgttgatcagtgtcaaaggggtacgcacttcgtgcgctatctctgtgaagaagtccactttggattcgtacagttccttctccttttcgatctcgaacagcttttgccgttcttccagttgtttctccttgcggcgtttgtaccataagatggtgccaaccacgatcaggataatacatacggtatatacaatgtaagcaatgatagactgccaccacggaggaagaatgataatagacagagagcgtgtggacgactcggacttgctgccgtgagtagcctgcacacggaaggtgtattttcccggcggaagtttggcatacgagatgttctggttgctggctgcccgtacccaatccctgtcaagcggttccatacgataatagtattggttggactcggccgtagagtagctgagcaatgccacatcaaagcttatattggcctggtcgtaaggcaggacgatttcatccgtatgtacaatacattgtttcaggggtgattcaggagtatgcaccgtcacctccttattatatatactgaacttggaaatgtaaacaggcggaagcggcttttcctcctcctgaacagtaggatcgaacgcgatcaatccgtccacccctccgaagtagaaccttccatcctgagctttcaatgccgattgataattgaactgattacccagcaatccgtccttattggtaaagacacgtacatctccactctcgggattgaacttgaccaatcctttattggtgccaaaccacagatttccggcatcatcttccaatatgttgtaagctacgtcatccggtagtccgtcttcaatactgaaagtggtaaagttgtcctgcgcttcattatatctgcatataccaccacggtcggtagagaaccatatattccctttactgtcctgcatgatggagctgacggagttggagcttagagagttgtcaactccttccttataagaataattcttataagaattattcttaggatcacatttccaaacaccatttcccatagtagcaagccaaattgtaccatctctagcctccattatatcgaaaacccagttatatcctacttcttccacacggtgaaatttcctttccttaggttgtgatacatataatccccacccaggtcctatccaagtacgacctttactatcttttaaaaaactatatacacttccttcttcaatacccaaatccttatcactgacgtatttaagatgttcaccaggtatactaatatcattcattccttgtttaaataatccaacatatatatgattttcataatgttttactgatagtgtaatgagacgacctggaacattatcatatatctgatgtactttacctgttcgaggatccaatacattaacaccattatcttcagtacctatccaaatacacccattattatcttctgccaatccacggatacgtttggtatttaaagaatatgaatcgcttcccggtacatatttagcaaaagtcaagatacgattaggcagatagttgacacctccaaacattgttccaatccaaattcctccttcataatctttataaatagaataaatactattatccgataaactaaatgaacgcatcaggtcttctttcaaatgaataacattattttctttctcattaataatgaaaattccatgaagagaacctacccaaatttcatctccaaaacacattacatctcgcaaaaatgtttttttctcaccaaggaacgaaacttcactcaactcatctgttcgagtattatatttcagcaaatctccttcatgtattcccaaaatagcattttctttctgaaaacaaatacttataattgttttgtcaattaacgaacgtcccattcggtctgtcaaatattgttcaaaattatcatcccgataattgtacttgaataaacctattcctgatgtacctacccatacttcgccctgctcattgatacaaatacattccggattattattttttaaattgtctttatctatcaatgaataatgatgtacctttccgtctttataacgaaaaagtccctgatcaggaatcaacacccaaatattatctagtgaatcagacagaatttccgctacccagttatcaagagttatcccttctgatgaagctattttgaaacgtttaaatacatcgaccgccggattatatatataaacacccctgtctgttccaacccataaattcctttctttatcctcaaaaagagcaccaatattatgattacctgtaccctcctccaaatcatcgcaatcgaattggagaatagaagttccatcatagcggttgagcccattttttgtcccaaaccacataaatccatagctatcctgcaagattgcttttacattactctctgataaaccattttctccattaacacgggtgaaataaaaatcagaatattcttgagcaaaaatacaaatagataagaatagcaatccatttatgaaagctaatcgtagtaggtgtttcttcataaattatatagtggttatatttggctgtgcgcgcaaatatacactaaaaaacagtatataaaaaggagttgacgcatttgtttcagtaatagccgcatttgttcatttttacttttcccttctcctatacctttgcaatatcattttgaaataaactattttataacatgagaaacgtaacattaggcctgataataggggccgcacttctagttagtggtagtctgtcactgaaggcaaccgagaataaaatgaaattatggtatgataaacctgcagatgaatggatgaagtctcttcctttggggaacggtcgtcttggtgtaatgatctatggtggcatagaaacagaaacactcgctctaaacgaatcaacaatgtggtcaggggaatatgatgaacatcagcaacgtccattcggaagagaaaaactcaatcaagtaagaaagctattttttgaaaataacttgtcagaaggtaatcatgtcgcaggaaatatgatggcaggtagcccacattcagtaggaacacatcttcccataggtgacttgaaaataaatttttcatatcctcaaggagaaatatcagattatcgccatgaactggatttacatactgctataaatacagttagctataaagtaggtaatactgaatatatacgccaatgtatcgcttctaatccagatgacgtagttgctatgcatataaaagctagtcgtccaaaagcaataacgatggaacttgaattgaaattactcagacaggcaaatgtagtagcatccggtaaccaacttatttataccggtaatgcagaatttgaaaaacatggtaaaggaggagtacattttgaaggacgtattgctgtacaaataaaaggaggaacaataaaggctgaagggaaaaaactttatattgagaaagctactgaagtcactttattatctgatgtacgtaccaattttaaaaacaatacgttctctggttacaactacaaaataaaatgtgagaaaacaattgaattagcatcaaagaaagattttaagactctgaagaaaaaacatatagaagactattctccacttttctcccgggtaggactttcgtttgagcatcacgcaaagtttgatcacctaccaaacgatgaacgttgggcacgggtaaagaaaggagaatctgatcctggattagatgcattatttttccaatatgcccgctatctgttgatcgcttcttcacgtcctaattctcctctacctgtagctttacaaggtttttttaacgataatctcgcttgccatatgggatggactaacgattatcatttggatatcaatactgaacaaaattattggattgctaatgtaggtaatttagcagaatgtcatctccctctttttgactatattaaagatctatcaattcatggtgcaaaaacagcaaaagatttatatggttgtaaaggatggactgcacatactacagccaatccatggggatatacagctgtatcaggtagtattctttggggattattcccgactgcatcttcttggcttgcctctcatttatggacacaatatgattacacacaagataaagattttttaaagaataccgcatatccattattaaaaagtaatgctgaatttctattagattatatggtaatagacccacgaaataactatttggtaacaggtcctagtatctcgccggaaaacagttttcgccatcaaggacaagaattttgcgcatctatgatgccgacttgcgaccgtgtactggcttatgagatattctcggcatgcctgcaatctacggaaatattaaatgtcgatgcctcatttgccgacagcctccgtaccgctatcagcaaactccctcctttccgtatcagcacaaacggaggagtacaggaatggtttgaagattacgaagaagcacatcccaatcaccgtcacaccacacacttattatccctctatccttattctcagattaccttaaataaaacacccgaattagcaaaagctgcccgaaaaactattgaaagacgtttagcagccaaagattgggaagatacagaatggagtcgtgctaacatgatttgcttttatgcccgattaaaagactctgaaaatgcttataatagtgtaaaacaattacttggaaaactatcacgtgaaaacatgtttacagtttctcccgctggtattgccggagcaggtgaagacatcttcgcttttgacgggaatacagccggagcagcaggtattgcagaaatgttattacaaagtcacgataattgcattgaattattaccgtgcttacctaaagaatggaaaaacggaaattttaaaggactttgtgctcggggaggtattgaaatagatgcgagttggaaaaatagccaaatagtaaatgcagtactaaaagctaccgctccaatagaatttactcttcgtctatcaaatgcaaaactatactgttggaagttgaacaaaaaaacattcattcctaaaataaaggatgatggactaatttatatatccatgaataaaggctttatattataaacatctgacgctgccgacgaatgaacatatacctatctattaggtcgcgatgagcatgatgaacagacaagctacaatgcacataggtgagagcaacatctatataca

SEQ ID NO: 133 - DNA, 21276 bp, Bacteroides thetaiotaomicron
attctatttgattaagtatcccgttgaggaaagcgatagctactccgtaatttgtcatcggcacattttgtaaccttgctctttcgatgcggctcagcacatatttgcggttgaacatacaagcgccgcaatggataaccaaagaataaggagtaagatcctgcgggaaatcagttcccgccacgatatctatcgataacttttctccaatccgctttcttaacagatgcgggagttttactctcccgatgtcttcggatagaggggcgtgtgtgcaggcttcggctatcagtacacgggaagattctgtcagacttccgatggctgaggcacttttcacatagtaccggatatctcctttataacctgcaaaaagaacagaaaaagaggtcagtctgctttcttcaggcttttgctcgtagactgttttaaagacttgtgagtctgtaataatcagtttaggagggcgggagagggcttgcaacgtttcctgtaacttatctgtggtgcagctcatgatcagacatttcttgtcgagcaattcccgcattgtctgtacttgtggcaaaataagcctccctttgggggcttgaatatcttgtggcatgaccagcaagacaagatctccttccgttaccaggctgcctgtgatactttgctgatcgaaatcttccggcaacttttccagaatggcttgtcgtatcagttcgacgcctgtcttctctttggcactgacaggaatcggctggcttccaaaagtctcctttatccggatggcaagggatgcggtgttcttccgtatatctgccttgttgatgagcagaatggtcgggatgttttttgccttgagttgttccagccaatgaagttcttcggtaaagtccggttctccggtttcctcggcagagccaccacctgcacaaagcagaagggcgatatcggttttctctacggctttccatgtgcgttcgatacgcctgtttcctagttcaccttcatcgtcaaatcccggagtatcaatgaacaggcaaggaccgataccgtgaatttccattgctttctgcacggagtcggtcgttgttccgggagtatcggaaacaagagcggtatcctgtccggtcagtgcattgatcagggaggattttccgctgttacgctttccgaagagggcgatgtggagccggttggcattgggggtgtggactaaattcataaatcaagcaattgttgtaacgttaattatccgcatggaaacttggcaggggcaccttgccccttaaaatctgaaatctctttttccttccgcaatatcttttaagttccggatggctatttctctgattttgggattcggaatccggtcggtctctttggctatcagcttcatacctttgattcgggtgtcttccgacgcataatcttcgaggtattctttcagagtcattaatgcattggggccgcagcagttggctatctgtcccgatttgactaaggacataaatcggtccccggtgcgtccttcccgatagcaggcggtgcagaagctggggatatatcctgattcgagcagccaattgaccacttcgtccagagtccgggtgtcgcttacatcaaattgtgcggagttatcttccggaagttccgtttccgcatagccgcctacgctggtgcgggagccgccgctgatttgtgagataccgagttcaagtactttttcgcgggactcctgtgattcacgtgtggatataatcatgccggtgtaaggaaccgctatccggatgacagcaacaatcttgctgaatatatcatcggaaatcgcattgggaaaatcccccgcatcgatgtcgtccgccgaacagatgcgcggtacgctgatagtgtgcggacccacaccgaaacgggcttccagatgttctgcgtgcatcagtaatcctacgaagtcatagcgataggtattcagtccgaagagtactcccattcctacatcgtctatgccgccttccatggcgcggtccattgcttcggtatgataagcatagttacttttcggtccggtggggtggagagcttcgtagttctttttgtgataagtttcctgaaataggatatacgtgccgatgccggcatctttcaaccggcgatagttctcgacggtagtggcggcgatatttacgtttacacggcggatagccccattcttgtgtctgatactataaatggtccggatggattccagtatatactccagtgagttgagagtcggatgttcgccggcttcaagtgccagacgtttatgccccatatcctgcaaagcgattacttccttgcgtatttcttcctgcgtcagtttcttgcgggcgattgttttgtttttggcatgataagggcaatatacgcatccgtttacgcaatagttcgacaggtaaagcggtgcgaacataacgatacggttgccgtaaaacttctgtttgatttctttggcgagatggaagattcgttctatcaggtcaggttggtcgcattccagcagggtagctgcttcacggtgcgtcagtcccttgcaaagagcggctttttcgatcagctgttctatgaatgcgcggttgtctttgtgactccatgcatattcaagagtttccagaatctcttcatgatgaatgaattcttctgcttggggtgaatctactttatacatttctttattgtttgtaatcgcctctggagaaggagatttgataaccgatcttttccagctgctgttgcaatatgttgagtccttccgcagattccgctccgagggaggctttgttattatacagattgtactttttgcgttcttcctgtggcgacaaattgggcatgacaacattggcgcctgccagtattccctgttcccggccgtcgggagtgagggtagccagtgccgtagttgccggaatcagcgccgacggatgcatcagacggaagatggataataaaaggagcgtccgttccacggttccgctgggggactgggcaaaaggtgtgtcgcgatgagacaggaaggggccgataccaatcatttcggggcgaagctgttcgataaacagaatatcctgaatcaggtgttctatcgtctgtcccggactgccgaccattattccggtgcctgtctgatagccgatgtcctttaaatcccgtaagcattgcagacgatgctcgcatgacataccggcagggtgcagttgttgataatgttctttgtcataagtctcgtgacgcagcagatagcggttggcgcctgcctgaaagaaacgttcgtatgcttcccgtgacttttcaccgagtgacagtgttatggcgcaatcgggataactccggcgaatcgttgagactatatcctctatccgttcctctgtcagtgcggggtcttctcctccttgcagcacaaaggtacggaagccgagtccatacccttgcttgcagcaattcagtatattttctgtggataaccgataacgttccagattcggattccctttccggataccgcagtaatagcagttatttcgacaacagttactgacttcaatcagtccgcgaataaaaatccggtttccgaaatgacggagactgacttcttgcgcctgtttattgatatagcgcaatgattctccgtcacattcggtcagcagttgccggaattcttccggtcggagtgtcctttcttctcgcagtttatctatccattgtctcatagctttctttccgcttgagcagctcttgtgctaattgacgacgtcctgaaacaatgtcgttgtgcgtactcggtccggtgatacagccaccttcgcaagccatcacttcgataaactgtcccgctgcttttcctgttttggcacaggcacgcagcaaggctatattttttttgttgatatccgacacttggatagcattgatcttgtccgcttcttctttcagatatgcttttacggctcccatcacaccaccggcttgtgcaaaaccatgtgcttcgcggacggaagtatgcagtatagagaaagaattcacctgttccagctgaatgtccattccatccaagatagaacctacttcctcgaatgtcaggatatagtctacagcatcgtcacggcgtacctcttttcgtttggctacgcatggaccgacaaatacaatcttcgcatccggatgtttctctttggcgattcgtgccgcataatacatcggtgatcctgtggtagaaacgtacggtttcatttccgtcatgtgcttttctactagttcaatgtaagaaggacagcaggaagtagtcatgaatttctggccttcttccagtttttccagcagttcgtgtgcctcattgctggtggtcatcatggctccttcggctacttcgataatgtcggtgaatcctatttctttaaaggcgccgtatacctgttcgatagaagtcttgaactgtccgaggatagacggagcgatgatagctaccaacttttctcctttcttgatgtgttgcagtacatcaaaggtttgtgaaatctcaaagatagcaccgaacgggcaggcattcatacattttccacagtagatgcacttgctttcgtcaatatgttccacgccatgctcatctttgctgatagctttcaccggacaggattcttcgcaaggaacggggatatatacaatcgcgtgataaggacaactcttatggcagataccgcaactgacgcaagtatcatgatcaatcattgcctgaccgtttttcttgaaacgtattgcatccttagggcaattcatatagcagctgcgtgccacacatccccggcaaagattggtgatttcataattaatctgtacgcaggaagaacaggcttcgtcaatgacacacatgatattttccttacttggttccgggcggttcaatgccatccgtgcatattcggagagaggagttacttcgtcgtgttcgtccgtcatatccagtcccatcagcgggaaggtcttgtatctccatacagcacgttctttatgtacgcagcaacgccccagcggttttgatttgcgcggactcagctcaatagggagacggtcaattttttctactaactggtcgtttttccagagtctgacgagatcagccagcaatttatgccggacaatcataatattattagtaaaagccatatagtaattaaaagggttgttagtggctgcaaagatagtaactagtttgcggataaactaataatcgttaaattgaatgtagcagattgttacattaatatttccggaaggataaaacagcctgtatgcaggagactatttccctccggttggttaaataaattcaatatttaaggtttttgaaacattcttgtcaattttttgtagcatttcggtgttatctttgtgaaacataaaataaacagctaacggaatagcaaatttgagaaaagcgtagcgaatagactggaatagcgttcgttacgcttttcttttgggttggtataaagccatttcaagccgtgttaaagccactaagcgcaagagttcagttaccacctcattaccgtgcggatagagcagatttcttgctaagtgtttgtttttctgcgttctgcggaggtttgcttagcagtcgataactcactgtaatctaattttgtaacccaaaaaagagtgagttatgcgaagtacattcaaagtattattctatgtaaagaaaggcagtgagaagcccaacggcaacctgccattgatgtgccgccttacggtggacggagagattaaacagttcagttgcaagatggatgttcccctgcggctgtgggacgtgaagaacaaccgtgcttcgggcaaaagtatcgaagcgcagcgaatcaaccgtgccgttgataaaatccgtgtggaggtgaaccgccgctatcatgagctgatgcagacggacggttatgtcactgccgccaaacttaaagatgcctatctcggcatcggtgtcaaacaggaaactctgcttaaactctttgaacagcacaatgtcgagtttgccaagaaagtgggacacagcagggcaaaaggtacattccagcggtatataaccgtatgcaagcatctacatgaatttatcctgcatacttacaagcgtgaggatattcccctgaaagagttgaatctcacgttcatcaacgacttcgagtatttcctacggacagaaaagagatgccgcaccaacactgtatggggctatatgattgtgttgaaacatatcatttccatagcgagaaatgacggtcgtctgccgttcaatccctttgcgggatatatcaattcaccagaaagcgtggacaggggctatctgaccaaggctgagatacagacactcatggacgctccgatgaagaatacctatcatgaattggtaagggacttattcatcttttcggtttttacgggtttggcgtattccgatgtgaagaaccttacaacagacaaccttcaaacattctttgacggcaacctgtggattatctcccgaagaaagaaaaccaatacggaatccaatatccgactgttggatgttccactaaagataatagagaagtacaaaggaatgacaagggacaacaaggtatttcccatgccgagcaataccacctgcaacaagatactgaaagaaatcggcagtcagtgtggtttcaagacacggctcagcacacatgtggcaagacacacgaacgccacgaccgtactgttatccaacggagtaccgattgaaaccgtaagccgactgttaggacataccaacataaaaaccacgcagatttacgccaaaattacaaatcagaagataagtcaggatatggaagttctgtcgcacaagttgacggatatggagaaaaatatttgcagtaacatttgataaccttaaaacgaatagcaatggacaggaaaataaatatcatcaagatggacgagcatggcaatatcaccatgcctaccgatataagaacaatcgccatgagcgagtgggaaatctgcgaattgtttgggataacctctcctactttccgtgctgcgataaaggcaatctataagagcggcgttttgcgtgaatgcgaagtaagacgctccatctgcttgtcggacaaatgcagcatggatgtttactgctttgaaatggttgtcgctcttgctttccgcattaactcatacggagcagaacgagtacggaatgccgtaattgaaaagttgtacttgcgaaaagagaaaacaagcatcttcttttcgctggattgtagaaaggaagcacctaagtatcaggtataaaatatatagctataacgacatgaagtaatgaaaccgatgcgtattcccattgccaacaatatatttatgcgagtgtttgaataggcgcattgccattcatacgtattaagacgacaggtcccgaagaaactgccattaaagtggtatttcttcggtttttttgttgttatactccctaacaggctgcaagtttttcactccgtgtgttttttgcgccattctgccgtgatttgcgtatcagggggttaagcggctcactctaactttgcatacgattatttatcaaccatttaagcgtatgaacaatgagtgaatcagacatcagcaaggaggagtttatccgggtgggtacgaccctctacaagttagtgaaccagccccgactgaacggcggctatgtgaagaaacgcatcgtgtggaataacgagaccctgcgacaggactacggcaagcactttctcgccaccgttcccaagtatgatggcttctgcacagttcccgaccatgtgaattaccgtcctgtggtggacaagttcctgaacctctatgaaccgataaactataagccgatggagggtgattttccctctatccgttcgttagtggagcacattttcggggaacaatacgagttgggcatggactacctgcaactgctttacctgcaacccattcaaaagttgccaatcctgctgttggtatcagaggaacgcaatacaggtaaaagcacgttcctgaactttctgaaagccttgtttcagaacaacgtgacattcaacaccaacgaggacttccgcagccagttcaattccgattgggcaggcaaactccttattgtggtggatgaagtgttgcttagccgcagggaggacagcgaacggttgaagaacctaagtaccacactctcctacaaggtggaagccaaaggtaaagaccgtgacgagatagcgttcttcgccaagttcgttctgtgttccaacaacgagtatctgcccgtcatcatagacgcaggggaaacacgctattgggtgcggaagatagaccgcttacaaatagacgataccgacttcttgcaaaagctgaaagcggaaatacctgctttcctctaccatttgcagcacaggcaactatccaccgagaaagagagccgtatgtggtttgccacgtcactgctgcacaccgaagccttgcagaagattatccgaagcaaccgcaacagattggagattgagatgtgcgaacttatacttgatatcatggcaagtatgggtatcgacactttctctttttgctgcaatgacattctcacgttgctggcaaacacgtatgtcaaagcggagaagcatcaagtaagaaaggtattgcaggaatgttggaagctcatacctgcaccgaacgggctgacatataccacttatcagcttaactacaatcgggagtgtcggtatgagccgataaggagagtgggacgcttctataccgtcacaaggcagcaacttgaaacgctgtaattccattatctttttgttgaattgttgaataaggatataatcatactgataataagcaatatatactctcaacaaaatctcaactgaccaaaagagaagttgagcataaagccacgacctattgtcggtttctcttttggtgagtggtttgttgagcggatgttgagcatctatttgtatgtatataaacatattacatataccattcaacgaatcaacgattttcattcaccattaaaaccataggaagattatgactacacaggaagcaaagaagatacatatcgcagactatctgcaaagtttgggctacagccccgtcaagcagcaggggaaaagcctttggtacaaatcaccgttcagggaggaagcggaagcatcgttcaaggtgaacaccgaactcaaccaatggtacgacttcggaacaggtaagggaggaaacatcatcgctttggcgcaggagctttacggttcggactatgtgccttatctgcttggtaagatagcggaacaagcaccgcacgtccgtcccgtgtctttctcttttcgccagcaagcatccgaaccgagtttccaacatttgaaagtgggcgaactcacgcaccctgcattgctccgctacttgcaggaacgtgggataaacaccgcactggcgcagacggaatgtaaggaactgcacttcatccataacggcaagccctatttcgccatcggattcccgaatgtggcaggagggtatgaggtgcgcaaccgtttcttcaagggctgcatcgccccgaaggacatcagccatataagacaacagggcgaaccaagaaacgtgtgttatctgttcgagggcttcatggattacctctcgttccttaccatcagagtgaagaacaatccgcaatattcacgattgacaacgcaggactatatcatattgaactccgtttccaatctcgcaaaggtggaaaacctattggcgacctatgtacagattggcagtttccttgacaacgacacggcaggacggaacgcctgtgaatccttaagggcgaagttcggggaacgcttgcttgacaagtcgctgtactatcgtgaatacaaggacttgaacgactacctgtgcggtaagcccttgtcccaatcggtagagccgatagagcaggagaagcaagtccaatccgcaaggcggatgatgcatccaccgaaaaaacgagggctgaagatgtagaaagcgaatgcttgcagcgacacggatatttgccaacggaaaatgccatagcttattagggaatttgtccgagccgcattgcaagcaacgctgaaaattccccaataagccaaagaggttgcacctctctggacacacctcagccaacggcaaaagccgtacaggagtaaaatcatcaaccattgtttcacaagctaaaaaaaaagattattatatgggttatgcagtattacacatggagaagacaagcggaacggatgccgccatgtcagcgcacattgagcgcaccatcaaaccgaagaatgccgatgagagcaggacgcacctcaatcgggaactgataaggtttcctgatggtgtggaaagcaggacacaagccatacagtaccgattggacaccgcaggactgacacgcaaaatcggtaacaaccaagtgagggctatccgtgtcctgctaacgggaactcatgatgatatggaacgcatcaccaacgagggcagacttgacgagtggtgcagcgacaacctgaaataccttgccgacacattcggtagagagaatatcgtgtcggcagtcctgcacatggacgagcagacaccgcacatacatgccacccttgtaccgataatcagaggagagcgcaagcgcaaaaagaaagaggaacaggttagaaggcgataccgcaagaaaccgaccggcacagcccgattgtgtgccgatgagattatgacacgagccaaactcaaatcctatcaggacacctatgcacaaaccatgagcagatacgggcttcaacgtggcattgacgggtcggaagctaagcatatatccacacagcagtattaccgtgacctgatgcagcagacggaacagttacgaacagacatagggctgctccaagacagcaaagaaatagtacaggaagaactcaggcgagccaagaaagaggtgcagaccgagaagctgaaaggggtagccacgaccgcagccacccacatagcggaaagtgtaggttctcttttcggcggtaataaggttaagactttggaaaggcaaaatgcagcattgcaaaaccgcatttatgaacttgaaaatgaagttcaacaacatgaggaacggcaagccaaacagatacaggaaatgaaaagcgcatacgaacagcagaaccgcaagttgtccgagttcgtggatttcgtcaaacgttatttcccatacgtggataaactgataccgacaataaagttcctgcgtgattctctgcactttggcgatgccgtcattagaaaactatgcatattcaaagacgccaccattaaaggtgagctatattcccgtgagtttaaccagcattttaaagttgacggtgcggtttgttcactcaaacagagcacagaaggaaattttgaactcaacatagacggcgtttcgcatgtcaattggttcagacgaaagaaaggcgagttcatggaagcgttgggaatgccgacaaggaaacaaaataggggtattaagctgtaaatcataataaagtccgtgatagtagaatactatatcacggattttttatacttttgtatccggattggggcaaccctttccaagacataagaaaaagaagaagcgttatgcttatcttgtagaacggaaacctgagaaatttctgaattgtgtacaatggtagcatagtggttctcacgctatagcgtgggctgctattactacatctgtacacagggttttctcaggacctccgaactaagacgtagcatcgcagtgccacgctttcttcgttggttggattatgttagtaataaacgattttaaataatacaacagattatgagaaaacttattgtagcgttcgcatttatggtaattactttgacatcgtatgctcaaagcggttcggaacatcttacttttaaaggaattcccattgagggaagtatgacagaattctgtcaaaagttaaaaagcaaaggatttacatctattggcagagaaaacaatcttgcattgtttatgggagattttactggtcgtaatgcaactataggcgtaacagctactgatgatggtaaaagtgtatttgctgtagccgtgttatttgacccaagtggtgaatggaatacacttgttaatacttacggttattataaggatttatatactcgcaaatatggaaacccaactatctcaaaagaaaagaatccggctcactcagattctaataccgctttaatggcagaagttcatcaagggacagttgtgtggggcagtgcatgggaggtaacaggtggagatatagaattatcaatagaaaagacttctggcgtctatgagggtatggtcgtaattcgttatcgtgatactcaaaatgtagaaacaaaaatccaaaaagatttagaggatatttaattttcaataaacagaacaattgattatgagaaaactttttgtattacttgcttttatagttgtcgctgctacatcgtatgctcaggtatataagatgtataagactcagaactaccataatcgacttcgtttaaatacgatgacaggcgaagttcaacaaattcaagatgatggtcagtcttgggaagtttgtagtgcaagagaagttttaggagataaagaaggacgatttcgcctttatgaaacacagaatatgtggactttcataatgcttgatacatatacaggtaagaattggcaagtccaatttagcgtcaagggtgaagactatatgtttgctgcacctatcaatatgttttctcttgcatatccggaaaaatcttcaaattggactaatagatttaagatgtttgctactcaaaatatgtggacatttatattgttggactcatataatgggcgactatggcaagtccaatatagcacacaagatttagacaacctattttgtattcctatcaataaaaacgaattagtagaaaataacgaaaggtgtatattctctattcagccactaacaagtatgtatcaatactatcttataaacgataatacaggtgatatgtggaaatttcagtggagtaccaaaggggatgattatagatggattgaaagattcagataaatattatttctaatatgcagctattgtttattatgatgatttgtataattgctatttcggttattgtgatagcaatggtgcgaatacgccttaaaaacaagtccaatgaactttcagacaagttaagccagatatcttcatatagtgagaaatcaaactatgagcaagcaaaagagagattatctgctctcaatgagaaagtgtttatagatattcctaccaacttgaacaatggcttttatggtaatataatctcagcaacgcaggaaaaagattttatcaatcattacaaaccacattttcaagaagcgtattcgcttcagaagaaactcaaagcctttaatatcactccatctgaaactatattaaaattcatcaatgattttggagctatcaatagacttgtaaaacagcataatgagggtgttattgcatttctgcttgacacacataaagatttcttcgacaaatgcttaaaatatccattggataagcaacaaagacgctcaattgtttcagaagaggataattgtttggttgttagtagcgcaggtagtggaaagacctcttctattatcggaaaagtcaagtatctaacagaaataaaaggcattgcacctcatagaattttacttattagttacactaacaaagcagcagccgaacttacggaaagaatggctactgatggcttgaaaggttatacatttcacaaattagccattgatattatcggaaaagcaacgggaacaaagccgtttatttgcgataatacagattctttatttattgctctttatcacactctattagagaataaggcttttaagaatagcgtagtagaatacttcattgattatcaaaccaatgaagcggattgggaacaacgcaagaatgaaaggcgagaaaaattgtcggaacaaaagaatgttcaactaaaagcaatgttccccgatatggatggtcgggctatatatgtgagaagcgaacaggagcaaaagatttgctttgtcttgtcatcacttggagtaaaattcagatatgaagagccatacgaatatcaattagcggatgaaatgcactctcaatatcgccccgatttctcaatatattttgagcaaacaggagaaatcaaacgcatctatttggaacatttcggagtagatgaacatggtcttgttcctgcttggtttgcaaaagacaagaatataacatacgaagaagccaatcaaaaatataatgatggtataacttggaagaaagctgctcacgagaaatttggtactcaacttttagtaacatcaagtgctgatttccattattccgatataagagataaacttcgacaattattaaatgacgcaggtgtgccaattcaagaaaaaacagaagaagaattatatgatttagtcttacccaaaggcagtaaacaagaaaaggcttttattcggctggtagttactttcgtaacattggtaaaatcaagttgtaaatcagttagagaggttcttgaacaagcaaaaaatgcaaatgatgagcggagcgtttttattatcaagaacatatttcagcctgtatatgaccgctatataagtgcattgagcgatagcaaccaaattgattttaccgatgcgattcttcaagccacagaaatatgtcgtacttcacaccctgttgagtatgattatatcattgtggacgagtttcaagacatatcggttgaccgttacaatttcttgaaagtattacgagaggggaatccgcctgcgaagttgtattgtgtaggcgatgattggcagtctatatatcgtttttcgggaagtgatatggctctttttaatcaatttcctgaatactttggcgcaacagagataaacaagattgaaaccacatacagatttggagagcctttagtttcgttgtcctcccacttcatacagcgtaataaagcccaaatacaaaagaatatacactcgttcagctctgaaatgaaaacagaattggagttttattcttacgacagacgtgattattgcaaaacaataggagaactaatatcttctattccatcggataaatctatatttctattaggacgttattcttttgatgactattacctgtcatttatgtataaaggagtgaaagaaggtaatagattttattatgtgataggaggaagaaagatagagttcttgacagtacataaatcaaaaggtcttgaagcggattatgtgatacttttacaatgtaataaggatacttatggctttccatcccttgtaagtgatgaccctgtgcttaattatgtcctgactaaaagtgaccaatttccatatggggaagaacggagattgttttatgtagcagtaacaagagcaaagataaaaacacttgtactatatgacaagcgtttcccctctgtatttgtggatgagtttttacaccctgaaaaggtttcagaagaaagttatgtaaagcaccccaatgccaataaaagatggacaagaagtgcagaccaatttttattgaaactgtataatgagggtaagagtgtcaaatatatcgcaaacaaaatgggcagaagtcaaacttcgattgtaatgcgattgaacaaactcacccaatagtagattatatttattcttctatactgcatgtattagatatttttttacctttgcaaaagaaatgagttatttgacagcatagcaccgcaaatcgctgaaaatcgcacggtttccaactcgttaccgttgtttctcaaatactccgttaaaagtttattcctcaaatggttgtatcaaaccgttgaaaatctaaaataagagaggagaagagatatgagtagcagtatgttggaacaaagaagtcgttttgcgatgatcggtgcattaatgatcatcatcagcctgatgttttggtattatatggggagttcgctggttagtgctacaaagaagtacctcgaacaggtacagacaatagagatcacttgcgagtaaaaaacagatatttgtttgtatagagcgatagttatccggctaaaatcattacttttgccgcaagcaaaccaaataatgatggaagagaaagagaaggcctggaaaacagtaagtagcaaatatctgtttcgccgcccgtggttgacagtacgctgcgaagatatgctattgcctaatggaaaccacatccctgaatattatattcttgaatatcccgattgggtaaacacgatagcaataaccaaagacggcaaatttgtatttgtccgtcagtatcgtcctggattgggacgtacctcttatgagctctgtgccggagtttgtgataaagaggatgcttccccattagtttccgctcagcgcgaactgtgggaagagaccggatatggaaaaggaaactggcaggaatacatggtgatatctgccaatccgagtacgcataccaacctgactcattgcttcctagctacggatgtcgaaccgatagatcatcaacatctggaagataccgaagatttgtctgtacatctgctgacttttgaagaagtgaaacaactgctggaaaacaatgagatcatgcagtcactcaacgccgcccccttatggaaatacgtggctgaacatgcggcagactttgaacaggaatctgtcgagaaggtggaacatgaaaaaacggaaaccatctcacaccgtatcaacgatttgctttattatcagaactcaatttcacggtctttgtcccgttttctgaaagatgaagaagtcgagacaggaatttatgagatattaaaagatattctggctttttatcgggcgggacgtgcctatattttcgagacggacgaagaaaatcatttttataactgtacctatgaagttgtagcggaaggagtaaaagcggaaataaataaattgcaggaaattccggtagacttcatgccgtggtggacatcacagatattgggcaagaagcctattttatttgaaacattaaagccgatgcctggaatggggcagggtgaatatgaggtgttgtcccgtcagggaattaaggctttgatggcgactccattggtagtcaatgatcatgtctacggatttatgggagtagatttggtggatggttccgcttcatggtcggacgaagattatcgctggctgtcttctttggccaatgtaatcagtatttgccttgaactacgcagggcgaaagagaaagtaatcttcgaacaagcagctttggcacgcagtgaaagactcttcaaaaacatctttgccaatattcctgccggggtggagatttacgataaagaggggaatctggtggatttgaacgagagggatatggatattctgggaatttcagataagtcggaggtgatcggactcaatttctttgaaaacccgaatgtggatgcccagatacttgagagtatacgcaagagcagtattacggattttcgtgcccgttattcgttcgaatgtgcccgccacacggggtattatcgtccattgaaagccggtgtcatcgaactttatacaaaagtccgcaaattatatgataatcatggtaaccttaccggatatatccttattaatatggataatacggagcgtattgatgccttgaagcctatttctgattttgagaatctgtttcttcttatatctgattatgccaaggtgggatatgccaaactcaatctgctgaatcgtcagggctatgccatcaagcaatggttcaagaatatgggagaggatgagaatacacctctttccgatgtagtcggtgtttactccaaaatgcatccggatgaccgttcccgtatgcttgctttttttgaagaagcaaagaaagggaaagcaaaagccttcaaaggtgagatgcgtattttgcgtcccggtacgaagaatgaatggaactgggtgcgtaccaatgtagtgttgaatctctatgagccggaaaaaggccaagtggaattgattggagtcaactacgatatcactgccttgaaagaaacggaagccaaactgatagaggcaaaagagaaagccgaagaatccgaccggttgaagtctgctttccttgccaatatgagtcatgagatacgcactccgctgaatgccatagttggtttttccagtctgatggtggatacggaggacatggaggaaagacggcagtacatggatattgtggaagaaaacaatgacctgttattacaattgatttcagatattcttgacttatcgaagattgaggcgggaacgttcgatttcaccgaacgtgaagtggacgtaaatctgctttgtgaagatattgttctcgctatgagaatgaaggccagaccgaacgtggaaatcctttttgaccgccatctgccggaatgtcgcatcatgagtgaccgcaatcgtttacatcaggttatttccaactttgtaaacaatgcgcttaaattcacggaagaaggaaatatacgggtaggctatgatcagcttgatgaggctcatctgcgtttctacattgccgatacaggcataggtattgagccggaaatgcagaacgagatttttgagcgtttcgtcaaactgaattcctttgtacatggcacaggactcgggctttccatttgccgcagtattgtggaacaactgggtggcgagattggcgtagatagtgaaccagagaaaggttcttgtttctggtttaccctgccgataaagtaaagttgttcttcctttgtgcggttagtccgtgcagctctttctgataaagactgtttagagtgccggcatgggggcactgacattttttaagatgtcgctttgagcaagatagctgctattattggcatagataaacataacactgccatctttaattgtattaatgatgggcttggctagttttgtcgggagggcaggacatcccagacttctccccaaacgtcccgaggcggctactgtcggattggcgtatgaagccccgtgcacgacgatggaacgttctttagctttgtcattgattcctttttcgagtccgtttaggatgagtgaatagccgtttccgccttggtaagtgttttcagtgagataaaatcccaatgagcttttataagagccgttttggttggagaaagaagtggcataattctctccgctgtttcgtccgtgtgagactactgatgaatacagcagttgtttcttctccatatcgaagacaaaaaaacgtttttcggtagacggctttgagaagtcaatcagcgtcagaatcggtttactcttctccttgatgcggttgtaaccggcgacagcctgacggaatgcaatgaaattgacaattccacccaactccatttcttcaaagagctgttcgccggcagctaattcggacacaggagtcggaaagtcagatgcaggaacggccattgtgtcgactgaaacatggctgaatggaatgaaaaggaatgataaaaataatataactttctgaagcatagggtttaagcttgaaataaaatcgcggtaaagatagggatttttattccaaaacaaaaataatcgtctcattaacaggtgcccagtcgaaaataaatttggcatgggaagttgcgttccgtacacacatatgtgatcggggagtggttcccagtgaccagctatattctatctgtgtctttcggggctcattgacaggtactccgtgaatgtaggccccgtccgtgaagcggctggcgtaaggcgcatagcctcctgtctctttcgagccgtctttcagaaatatcattttcaccttcttttcctgcagtacgaacattcctaaaggagtttcctgcgcatacggcggtcggtgaagtccggtagtagaagggttcatactgcgtactacccatttccctttttccgtgcgttccagtgcggtaatattctgattatggcggtccacaaagatggctttattgaaaaccaccgtatctccgatcactttaacatactttttaggaatcatccattcgccttctgtaaatatcggttctgctttgacaaagttttctccgtcttcgatgaaacgcgtcagttcaccatcctgcccgtagcgttcgggtgttaccgtatccgtcagcagataaagcgggacagactggtatcgttctaccccaagcgtgtccgctacccgtccgtaggcatttcttttgaagtttttcaccaatggagcttcaccgtttctgttcttgtaattctggaggatagcccattgagacggctgtatttgtatattttcgagcaaagcaagctgttcctttattttctcccattggaaactgcgggtcgtatctttataaggatatgtatcttccagcgtgtacttatcatacagcagctctttggtgatttgaatttcttccggagtaatctttttgacgacaggttctgccacagtttccgcaattgtatcctgtgccagcgaatcgacctgcaaagtttcatcagaagatttttgtcctgtacgtgaagtgcaggaacagagtacgcaaaaagcgatggatatgccaaaacttattttattcatataatctatacagttcatcttggggttcgtttacgaatatacgttattataaggaataatccgcttctattgtttaaaaagtgtggaacaaatatgcttttttgccattaataacctgttgtcagtcattttgtcagtcaatttctgccaaacaatcattattttgctttggcatacttttcgcaactgatttagcgtcttcttcaagaagaggacaaatcatgaatataatgtataacaaataaaatcaaaaaaaagaactatgaacattaaaccattagcagacagagtgcttatcctccctgcacctgcagaagaaaaaacaattggtggtatcattattcctgatacagcaaaagaaaaacctttgaagggtgaagttgtggcagttggtcacggaacgaaagacgaagaaatggtattgaaagtaggcgatacagttctttatggcaagtatgccggaacagaacttgaagtagaaggcactaaataccttatcatgcgtcagagcgatgttctcgctatcttgggttaattc

SEQ ID NO: 134 - DNA, 20860 bp, Bacteroides thetaiotaomicron
cttatggattgctgcttttaatgaaggagtatcaatgattgatttaaataaaccattagtgcagaattactcttttcctgttattcgggaaaagacggggtttgttacaaatataaagaatatatatgaagataaagaaggagatttatggatagatcagaatcgttggggaataggaatttataatccagattctaataaacttctcttttatacagatatcccttctctaaaaaacattgctaatctgaaaaatgtaagctgcattacctctgttccattgcttaatgagatttggctgggttctgagtattatccggaaatttacaaggtgaagaaggataaaaaaggagtagagctattgggaactttgaaattaacagattacgtagataattcaggatttccgcgtttattttatactgatagtaatcataatctttgggtgggaacaactaaaggtattttggttaaaccggcaaaggaaaagatacttcaagacactaaatttccatttgtagatataataggaattagagaaggtaaagatggttcattatggattagtacaagaaagcaaggtgtgtataatgctaaaatatcctctgatctgacattagaagaaaagaatttaagaaatttgaaaactcatgcagaaggagtaataagtgataatattggagcaatctgtgtggatgataatggtttggtgtggatggggagtcaggatggagatgtgttcacttatgaccctcaaacaaataaagtggaaaacttatccgatatgtttgatatgcttgaagaaggtatttttaatattataacagatcagttgggacatatttggatttctaccaataagcgggtaattgaatacgaccctaaaaatggtggtatcatggactactcgacaatgactgatgtgatggtaaattcttttatgcctaattcttattataaaactcgttctgggaaaatactgtatggaggaaataaaggaatctcagtatttactccttatgatcatttgtctgataatcctcgtagaattagaacgatggtgtcagatgtcaagatagatggtgtttctagtcttttggagaaaaacaaccaacgttttaatttaagaagtcagatcatttctttaaatgcaggagataaaaatattgagatagatttttcttctttaaattatgcgtttcctgacaaaattaaatatgcatataaaatggatggagttgatgatgattgggtgtatgtcagaggcgatcgtcaatttgcattttacaatcaattacctaaaggtaaacgtactttttatctaaagacaactgatgtaaatggtttatggagcaattatatagcagaagttcaggtgtttaaacagccagctttctatgaaacattgtgggcttatttattttatattgtgtttacacttttatgtctgtatcttttctatcacaggatgaagcgtcgtattcagttgcggcatgaactgagaatagctcagatagataaagagaagtcagaagaattggtgcaaactaaattacgttatttcacaaatatatcacacgatttattaactcccttaactattattacttgtttgatcgatgatgcggaaatgacgaatggtagtcggatttcgcagttaactatgattcgttctaatgtgaataaattacgtagactattacagcaaattttagatttccgtaaggtggaaagtgggaacatgaaattatctgtatcaaaaagtgatgtcatatcatttatagatgatgtttgtaagatacactttactccattgatgagaaagaaaaatcaaacctttacatttttgactgaagatagacatttgatggcttattttgatagagataaactagataagatagtatctaatttattatctaatgcttacaaatatacagctaatggtggaaatataaaattaatagtagattcatattgggagtctgaaaatcatcatttgcgaatacaggtcgttgataccggagaaggtattgctcctgctgatttggagaatgttttcaaaagattttatacaataaataaaggagatgaaagtgaatctaatgggatcgggttatccttaacaaaggatttagtggagttacatcatggcactattaatgttgaaagtgaattaggtaagggaagtacttttactgtagatcttcccattaataaagatagctatcaagaagatgaattaatatcagaacatatttcggcaaatggcataaatacggatcttattttagagaaagaagcattggctgattcacaggttggtgaagatacgcagatagctgacgttcatttgttattggtggaggataatgaagaattgttgtttttgatggagaaaattctatccaagcattatcatgtgcttattgcaaaagatggattagaagctctgaacgttataaaagataatgaaatagatattattataagtgatgtgatgatgcctgaaatggatggtttagagttttgtcgcgctttaaagtcaaatttggaaaccagtcacattcctatcatattattaacagctaaaaataccgtggaagatcgcattgaatgttataatgcgggagcggatgggtatatatccaagccatttgaattaaaaatattagaggctcgtattaataattttataatgcataagaaaaacaaacaggaagagtttcgttctaatgtagaagtcaatattgattctttagaaccttcttctattgataaagagtttttggataaagtgatttctgttataaattcaaatatgtcggaaggagattttgatgtggttcagttagcggacgcattagctgtgtctaagtcttctctttataggaaaatgaaattagcaacaggactgtcacccattgagtttattcgaaatataagattaaaacatggaagtcaattattgaaggataaatcaatatccgtagcagaggtagcttatgaatgcggattttctaatcctaaatattttgcaacctgttttaaagaagaatttggcgtaactccaaaggaatatcaaaaatcttgttaggataaaaataatatgaacttaaaatacacaagtacgcgtcttaatggaagatgcgtacttttccatatatcaatgatctatcccatttgaatgattcctgaacttatattgaacgatttttagacctgttatagttaatagcgattatggtccaattttggaagtttttgaatgattagagaacttctttctactggataactcgcacttttgtgacgcatttgatgcacaactaatacttatttggtctaaataactttataaatctaatagtatggtgataattttacctaatttctttttgcaaaagcctgtttgtcgtttgctggcagtcgtgggctttttaggatttagtggagcgatagcgtctcaatcaagttcgcccgcgaatattgattctgtgaagacctatatgaaaaaaaactcttttgagaagaatgtaggatctcgtttcgttactaatcgtagtatagactcctttggggtgagtgatactgttgatatcaaaatgttgcagcgctctcaatttttatctattcagcaattactgaaagggaatgtgcccggtgtatatgtacaggaaaataatggagagcctggtaccattcaaagcatgctggttcgtggcttatcttcacctgtcttttctaataaagatgtgtccagtgttcagccgacagtttatttgaatggcgttccattgatgctggaaaatagctatgtgtacgatatcaaacagtttgatattaatccgataggagctgctgccaacatgctggcgggattggatatatcttccatagagtcaatcgaaattatcaaagatccgcttcagcttgccaaattaggtcctttagctgctaatggtgccatctggataacaaccaaagacggttattatggcggtgaaaacgtttctatcggggtttcggcaggaatggcctttgctccgtcttcagttcgtatgacgaatggatcatacgaaaaagcattccgtcaacgtttctatgatacgtattctcttacaccgggtaaacaaccctattatcttatggatacaagagatgtacgttattttggtaaaccggactgggcagacgattattatcagtcatcactcttatataatgtaaatgcttctatcggtggtggttcaaagaaagcgaattatgtatttacactcgcaacgacaaaagatgcgggagcagcggacaatacctcttatacgaaatataatattggttttgccttgaatatggttcctttggatggcttgaatgttagtacaattattaatgccgctaagatagaccgtgtcaggaatcggaattttagagacaggtttgctgagatggagtacatggttgatttttcaactccgcttgcacctgccggcaatttgtataatgactttttaatatccaatgatttgactaaagatgataattataacaatttactgaatggattgttggctttgagctatactaagcaaagattcaatgctacagccagcatcaaacttgattatacaacaaatgttcgtcgcgctttttggcctatggctttgttggagtccgtcaactttgtctctaactattcaggatacaatcaacggattataggtgaaacttcagcgagctatttgttgcctttagctgatattcataagttgaatgttcagtggaatggctctataaccagcgatttgtatcactataattatactcgtgcctatgatggtgatgatgatatgaagccgacaacaagtaccgggaacttcaagcagtatcgttatgttgatcgtttggagaatagatgggtatcgacttcaatagctttagattataagtataagaatttgcttaatgtgggattattggcaagatacgacggaaattccgctatccagtcggatcacagatggatgtttacacccgctgcctctgctgaatggaatttaaagaatcatttttttacaggtagtactgcattgtctggattgtctttgcgtgcatcttatgcacgaatagccaaatcattccagtccgatagatatgaattaggtcctcaatacttggctacaagtatcacatggagtggcgaaccgttactttcctcagctaatggatttgcaacaatcactcgtccgtatgcatcgggttgggttggttatgatttaaagcttccctattctgataaaatggagcttgctttgaaaggttcttttttcgacaatcgcattattgcggaaataagtctgtataagaattatgaaaagaatttattgacatatttgcctgtcactcaagaaatgggatatgagtataaactggccagtggaatggatatcagtaatcagggattggaattaaatctttcggcatccattttgaagaacactccgttgaagtgggatttgtctttcaatgcaagttataataagaacaaactagagaaacttcccgaaaaccagaagacaactgtgataggcgaccataaactacaagtaggacagtcagttgatgccttttgggtgtatcaaaataaaggcatttatacaaacgactcagaagttcctgttatgaatgggaaaccactgaacataaatggagttccttttaaagcaggagatcctgtttggacagacgttgacggaaataatcagattaacgacaatgaccgtgtgctgaccggacatgccattccaccctatacaggaggattgactaaccagtttgcttataaaggattcgatttcagcttcaatctcttctttgctttggggcatagtgctttaaatctgcgcgatcagcaacgttacgactttgcgactttggataatattcagtccttgcagtctgttaaagagattttcttttggcaaaacactaatcagcgtgacgattatcctatatacaatccgcaaagcagtgttcatccttaccgtgcagaacaggatttgttccttgaaaagctgtcatacctgaaactgagaaatataactgttggttacacacttcctataaagaaagttggtagtaatatacctaaaagtttgtatttctatctgacaggatctaatctgttatctttcagtaatttttcagcaggtgatccggaattagttaacttcaatggtacctatgacgggtattcgcttcccattcctcgttccatttctttgggactgagatttaagttctaaaaatatcggagatgataaaaaatgaaaaacaatatgaaaaacaatatgaaaaaattgcgattagctcttttctccgcacttgtctgtttatttctgcagtcctgcaatgactttctggatgtagatcccaaacatgcagcttcggaaacccaacaatggaagactcttgaagatactcgatcagcattgatgggagtatatggcttgacacgcgcagccttagccgataacaatactcattggatatgtggtgatttgcggaagggggattttacggtttataagcgtagtgacttacaagctgtgtctgataatgaattgaacaagccatatgacttgttgaagaaagtatctaactggagaagattttatgcggtaatcaatgcggcatctgtttttatggaaaaagctccacgaactgtcgaacttgaccggtcgtattctgaacaaaacttgaaatatgacattgctcaagtacgcgctttgagggcatttgcttatttttatatggtaagaatctggggagatgtgccgttagtcacctattcttatgataacggaacttttccgtctatgccccgtacagacgctcaaacggtgctgagttatgctaaggcagaactgttaacagctatagaggatttaccctatcaatatggtactcaaacgaatttatattatggttcatatggggcccaatggcagggaaaactgttcaataagttatctgcatactctgtattagctcacatctgtgcttggcagggaaattatgcagaagccgagacatattctgcatttataatagatcatgcatctgagattaatgcaaaatatacttctattgccgacttgacttcagaaacagggctgttttactcgaatgcgagtgtaaaaggttcaaggattttaggatttaattttgctcacaatgataacgaagcaactcaaagcggacatcttgaacagttgactttagcttatccattggtacaaaaatcctatcctgaaatatacatttcaaaggacagcttattttcgatttttaccaattttgatgacttgcggtttggaatcatagataccatcaaatattcatcctattatgttcagaatttgaatgaagaaactccggtgttcagtaaaataaagattattcaggatggatcggcgaaagacaatgatttcggagtatttggctcgtcaattgttttcactcgccttgaagatatcaccttgctacgggctgaagcattatgcgcactaaacaggagcacagaagctgtatcctacctgaatatgatccgaacaaatcgtggattgagagaagtatcttttaaaaaggattttgggaataatcgcgaaagcttaattgccgagatatttgaagagcgtcgcagagaacttatgggagaaggctggaggtggtatgaccttgtccgtcggcaaaagctgatgaaagataatgaggcattcttgcgactgatcagcagtggtggaatctactggccggtatcggaagatatcattactgctaattcacagattgaacaaaatgagttttggaaataaaaagaaaacgacaatgaataagatactatttattttatgtctgacttcggcttccctttggatgctgtcttgtacagattacgaagtggcttcatatcctgaggaaaatgaaaccgaagtatttaatggaaccgttctggattatttgtccacagggaatgaaaggctgaatttgaaatttgattctatgatggttcttgtcaacaatattcccgatttcatacaacagatggaacagacggatgtgcaatatacagtttttgccataccggatgcatgtatccgttcctcattggcgcaacttaacgagtaccgtaaacaaaaggagttgggtgaagcgatttatttgagtgatttattaattgaaccgtttgttgttaaagatacgatcgttaatgttataacaccgactttaaatgatacgatcattaacgaatatcattatgattatagagctgaccttgagcgaatgttatgcaagtacattattaaaggtagttacgataccgataatattctagccaatgaaggaaataactccttaaattctttgaagtacaattatcaaatgaatatagaatgttctcgcaaaccggcatccggatttgtaggcggaggagtcaaacagcttattttcagtgatatgaaaaactctcaggtaaaagataactggaacagagtttctacggtatggaatgatgtttatacaaataatggtatcattcacatcctttctccccaacacagtttcggttttgatgaatttatttacgtatttaataattatggcaatgaatataagaagtaaaaatattgcgctgctgttttcctgcgtattattaagcatatcgtgtgtcgataaatatttgccggatagtttggatgctttcgacagagacgtcaattttactacaaaactatatcgtcctcaactaggaaaaaatactttgatgtccgacaacttttcatcgggtaattcaacgcttcctcttactttcgaaatatcacgaatcgtgagggccgacggaagtcctgcacctgaattgacggaatatttcccggtaaaagtttggaaaactccatatatgggtaccgaaaagtctatagaagaaatagaagctaaaagagaaatagaatatcgtactctttttcaggttaaaaagcattccggagaatttatgatgtggtccaatgccgaatcttcttttgtgcagtgtgctccgagtgatggctatatttttgatgtgctggtgaaaaactcgggaggatataaaacatttactgatatgcagcttatacctgtcagagaaagtgattacgaaccgagtatatacgatccggaaacagggttggtgcagggacaggactatgttacaccaaattcgttaaccctttttcaaacagaaagtggagactatatgtttcctgaagatgtacatatttattttcgtgagaaccaagataatgatgatgatgtaaaaagtttgacttttcgtttttatggaccggattatacaccgatctctccttcatcttttaatcagacagactgggctaatctgattcatggtttcaatatggagaaaacagatgaatatgtaaagtatgatgtagtttatccgatgccattggttgaaatgaaatcaaaatataccaataaagatggtaatagaataaatgtcaattttttatatgaccgtattacagcaagtggttatcgtatgacatccactatgtcatttgaatttgcgatatacaaggaagctcattgggagataatagttgtatttacagcaggagcccccttgtttgaagatggaaaataactaattaataccatgattctaatatgagaaatatatttaaatatggcttgttggctatggcgattgccgtcacctcggttggtgttcgggctcaggatattcctgtcagtggtgtagtcaaagataaaagcaataattctacattgccttatgcttctgttattgttaaaaatgaaagtggaaaaacggtgcctcagctttcaaccacaactgatgataacggacgattctctacaaaagttaagagtggttaccgacttgtattctctttcttggcgttcgacagtctttcagtcaaagttactaaaccttcagaacgcatgcaaatatatctgagtccgacagagaatatgcttgatgaaacagttgtagtcggatttaaaagagttagtaaggctgcggtaacagcatcggttacggttattaaagcagaagatctggtcaatactcctgttgctaatccgatggagttgcttcaagggcgtgttcccggattaaatattcagatgaataatggtactcccggaggtcttccaagtttttcaattcgaggagtctcggatatttccgttcaatcttccggtgatggcgagtttatgatggggctgactcctcctttgtttgtagttgacggtataccgcaggaagacgtaacgggctatgatgcagctggtttgctgtcaggtgcaacagtcagtccgttggctatgattccacttgaagatattgcgaatatccaagtattgaaagatgcagctgcaacttccctgtatggttcaaaaggtgcttacggagtaattcttatagaaactaaaagaggagaaacagccaaaccgaaagtttcttattcggctaactttgtagtgaaaacaccaccgaggttgagagatgtacttgcaggcggggcggagagagcgctcagaattatgcaaattttgggaaatgatacatccgcctatcacggatataatgaaatccataaattgcaggcactgtcagatagcttgaatccttattacaataataatacggattggcagggtgtcttttatcagacgacttacaatcaaactcataatcttagtttctctggtaaacctaatgagaaatttgactataagatcaatgcaaactattatacggaaaaaggaattgtgaaaaacacggactttaaccgatacggtatcagggcagcagtaggatataagcctaatgatagatttcatttggatctaaatcttgccactacattaacccgaaatagtaatggtagcggaaatgctttctcacaatccggcgtagccgcaggttcggcagcttcttccttgttgcctccaccgtctatgtatacagcttccaattctgcattgtctgttttttctgtccaggcagataatcagaatgtagtctatgatgcaagtatgaatatcatgtatctgttgccatttgatataagatggagaagtactttaggatataaatacggaactgtggagaatgagaaatttacgccgggtattttgaatgccaatagggctacttggaataacggtagtgaatatagttataatatgtatgttcgttcattgttgtcaagaaccgtaaaattgggaattgtaaattttgatttacagggaggttttgaactttcatccgaaaagtatagcggtaactttattatgctgaatggattggcaagtgaccatatatggtcgtccggtatgccgtccatggcagctggaaggtcgaatttttcagataaaaagaatacgtttgcacttattatagatcctcagttatcgctgcctggtgggaaatacgtatttactcccaatattcgtcctgaaataaattcatcttatgggtcgcaggcgaaatgggcaataaatccttcattaggatttcgctggaacttcagccgtgaatcttttgctaaaaaatggaagtttctggatgccggagctcttcgtgtaacttggggacgtagtaccacttataaagctagtatttatgatatatggggaagttacaatctgagcaaagatacttataatggagtttctattattcctattgataaaaacgctatgccgaatccggatttgaagccggtaacgtcaacatcatggaatctcggaacagacttatcattccttaataataaaattatgttcgttgccgaggcgtattacaaacaaattgacaatcagctaagttcgatagagttggctaaccacaatgcttttaattccgtaagaagtacgaaaacgagtctggttaactatggattggagttttcgttgaacgtccgtccgttgtcaaggcaaagtaattgggatttgaatgtagcgacttcactggcaattaataaagacgtgatcgcaaagctgcctaacgaggtgcggcagattattaacagtgatgcggaagtggtgaataaattaggttctaacgcgatggggaattatctctatgtgtataaaggcgtatatgcgactgacgaagacgtgcctgttaatccgctgaccggagaacgcttgcggatgggagggaatacttctactcaagcatactttaaggcgggagaccctatttgggtggatgtaaatggtgattatatcatcgatgaaaaagacaaggtgattgtaggtaattcacagccgcgaatgaccggtggtattagtatcaatcttcgttataaagcgttttctatcaacactaactgctcgtttacgttgagacgtgatattatcaacaaggctctggcagaccgttttagggcttatggaacacctgtagcaggtaaggtgaaccttacaggtagtggagctttaacacctattgaggcatataatttctggacagaagataatatctatgcccaatatcctaatccgtttgattatacccgttcaagtattattcagcctttcagatacgaccagacattgtttatggaagatggctcttattttaaaattaacggtatatctgtggcttatactattccaaagaaaatgctggatttttttaggatcagccgatgtcagcttaattttagtatgaacaatatttatactttctccaaatattcaggcatcaatcccgagaatgtaaacaatttgggatatgacacatccggtggttatcccaatggtcgtactgtgacatttggtgtctcaatggatttttagatgaacgattaaatatagaagaatatgaaaaatatagttttaataatgactttgatagtatcttgcctgtttgccggttgtgactcgcttgcaaataagagtgaagataaattatcgggtgatgatttttgggcgcagggaaatgagacgaatgcggaagcttttttgttgagcatatacaattcgtttcggaatgcaacaatgtcacaacgtcctttccttacgtatagcggagatatgcggtgcgctccaataacagcctacagcactggggataaatatgtagcttatctggctaacaacgatatgggtgaattgcgtaatacatatcccgatgatgctaggggcggtttaataatgcaatgggatgtgttttatactgctattcaggatgccaatattctgcttgctgaaatagacaaagtgcccggcatggatgaattgaaacggagtcgttttaaggcagaagctattttcatgcgtagcttgtcttatttcttcattgtaagggcttttggagatgtgccttattatacaaatgcctataatgaagctcccttgccaagaaccaatatggttatagttttgcaaaattgccttgctgacttacaacctttgcttgacgatgatccgggagcggaagtattaccatggtcatattcatcttattcgagcaaagggattagagcctccagaggttctgtcattgcgctgatgatgcatataaacttgtggcttgtacagtttgatgcacaaaataaagagcaatattataggaatgttgtttcgctaggcgaggaactggaacgtaacaatggagcttattcattacttgatataaatagaagttccgtgattttcgcaggaggatcggacgaaggcttgtttgagattgcacagaatataaatttcaatgagatatttatgatgaatgcaaagttttctgataatgtttcctattcctgtttgaataagtcaatgccgctattctgttattcaggagattatcttatgacgctgttccctatgtatgaagatgatgcgagaaaagaattatggtttgacgaaaaaatctattctacatcggtttcaagttctgctcctaaagaaatcaagaagttttggaatattgatacttatggaaacggaacaattacatctaattccggcaatcaaatagtattccgttatgcaggtgcacttttgttgtatgctgaagctcttgccgctttggggactaacgatacgaaagcctgcgaattactcaaccgggtccgcaatagggcacatgcttccgaaataaatacctcgggtagtgaactgatggatgctattttctgggaacgctgcagagagcttatcggtgaaggacattactattatgatttggttcgtacaggaaaggtgtataacagaaactattgtatgaatccgatgacgcgtactaatttcaatgtgggggcatggacatggcctattcatcgtaatgcgttgaaaaacaacacacagattggattgaatttattttgggagtaactctgataaacttaaaatgtatagatatgaaaaataatatcaaattatggaagaaaattgtcggatgttgccttttggcagtactcatgtacaattgtgccgatgatagttatttaattgatggtggaaaagcgaacccttattataatgggaatatgatgcaatatttggaatcaagacccgattattttaaagatttggtggaagtcatccggctgtccggtatggaagatgtttttgaagacgaacaaattaccttttttgcacctaccgattggtcaatccgtggtagttttaattatctgaaccgtatttggtatcgtatggggcatgatagcatcaagagttttagtcagataaaaccggaagtctggcgtgaaatgctgtcaatgtacattgtaaaagataaatatttgctgaaagatatacctcaaattgatacgactgccatagcagcctatccgggacaggcatttttatcttatggtcagcagcctatgaacatgggtgttgtttattatgatgcaaacaatgtgaaatatgccggtgcaagacaaatcatatactcttatgtctatgatttcactataggagatatgaaaaacgcttatgtagcaacatctgatatacaaccgaccaacggagtggtacatgtactcagattaaccgatcatgcatttggttttgaaccatatcttttcgctaccaaagctataaatgcgacaatagaaacagaaccggataattaactataaataaagatagtacaatgaaacatattaccatctattcgttaatgattgtttgctccgtattcacttcgttattggtaacatcctgtaacagtgatctgaacagcaatattaaagatgatccgtacagtggtggaaaagctccgcttggaatcggtttgctggctgaatctccttctccggaaagcgcttatcccaatgatacggttgtattcaaagcaaaagggatgttgaactggtgtgatccgcaatcaggacgttacgatttcaagttttatatttctgatgaagaaactaaaattgtaactgctaccgacacgacaatcaccgtgaaagtacctggaaatcttagttcgggtacggcttatattgtattgaaagaacaggttttctatggacctcgtctcactgtattaggaaatattaagatagatcagtcatacggctttaaaggcacttcgggacctatttacgattgtgcggaacattattcaaaagcacgggtatattatccagttggcgactatatgcaggcctactacaatgaaaatagctcgcagagtttttcttgtatatctatggttttgacagacggctctgtatcgggaaaatgggtaactgacttcaaacttgatcctggtcagggagccggcattgatctggccaatccgggagtgacagatattgaatgttaccttaattcatttacttattttcctagtgaccacagggttcttctctcgggtaaattttcagaatacggctgggataagttgccggtcaataacatcacgatagctactaatgaagtagcctcgtattataaaactgtagcgctgccttcgaaaaagaataatacaagcataaattgtaagataccggtattcaacgggggaactcttgaagcgcctgtccgtacatttataacttccaatgagaaggtggtagcagtaggaaatattacaaactactgtcgtattaataccgaaaaatcctatgctgagagtatggttttggattattcgaaggttgcaagtgtattgcgtatgtcaaggactggagaacttgatgatagctatcgcagggatgcagaaggagttatcgggcagattttagatgcttgtatggtcgaaagtgacggtattgtcatagtagggacattcagcagtttcgatggacagtctgtgaagaatattgtgaagttgaatgccgaaggtacccttgatgaaacttttatgaaaaacatcggtacgggcgcaaatggaagtattactaaaatccggtacaataaaaacaaaaagaaaatccttataactggggagttttctgagttcaacggtattcctgcacagagtgtagttatgttgaatgatgatggcacacgtgatgaaattttcaagatcggaaaaatggaaggaggattggccaattttgcctgtctgcttgataatgataatattgttgtttcaggtgcgtttacgaaatacgatggtgtaactcgccgtggtttccttatattgggtcgtgatggaaaggcgctgcaacaatttaatgtaccgggcatcttccagggtgaactctacaaagtaattgaaactcgtacttcgaccaattcaaacggattgctgctgcttggtgattttagtcgttttgatggtaatatggttcgcaatgcgataatgatagaagttgattatgaataacttattatgaaatacaatggaaaagttgataaaaaatataatgctttgcctgtttgctgtatttgcattctcgtgcaatgaggagatggaaaggcttttgactgatgattatccggagtcgggtactgaatatactacgggacacgtattgatggtggttatcgatggtgcatccggaatagccgttaatgaggcgtataatacacgaaaggctccagttatccgctccatgacggataaatctttgtttactttttacggacttgccgacaatgaagaaggggtaagtaaagaacgtggatgggcaaatttgctgaccggaacaacaaagaacgggcttgatgtcaatcaaggaattgacgaactcgaaacgccttcttttcttcaacgattgaaagaggcggatgaaaatctaaaagtcagcttttattcttccgatacggagtttttcggagctttcgggagtgttgccaatactaaaagaaagacttcggccgacagtgaaaccgctgatgctcttattgctgaaatcaatggtgaaacaatctcggatatcgtagttgcacagttcggcggtgttcaacagactggtgagcaatatggattctggagcaatgagacaactcctaccagtgaggttattgatgcgatttacaatgtagatgctttcatcggtaaaataatgaaagcacttgaagcgcgttcgcgttacgttcaggaaaactggcttgtagttattacatcttcttatggtggtgtttatgaaggtaatgtaactccggcatcgttgtatgatgatccgcgtctcaattctttcatgatgctctataacagtcggtttgcatccaaattgttgcaaaggccgggctcggatgaactacaatacaaattctatagtccttatttcgtcggtcccggacaaaaagcgacaacaaatgccgttatgactggaaataccgagttttttaatatgggtaaacgatggagttccaatccggatgaagaggtggataaaagtggatataccattcagtttaaaatgtttgataagcacggcgacccctggggtaatagaaatataatatcgaaaagatatcaaaaagcaggtacaggctggcagctaatgttttctaataatactcaagtcgaatttgctgcaaattttaaagagggttcttcggtattccgcttaccatctacgagacgtgacggatcatggcattcttatacgctagttataaaagaggttgatgatacccagaaaggtgactccatcttattttatcttgacggtaagtatcagatgggatgtaagatagacggcagtaaagatatgtggacagatgcgcctcttgccatcggacatacgttttctccggacagacctaatcaggcaaatctatatataaacgatctccagttttacaacgttgctctacctgctgatattattgcggagtatcattgtactacaaaactggaccttttgggtgaattatatccgtattggaataatctggtgggttattaccccaacgatcgcgaagatgatatcggattatcttatttggaagattattcgaaatatacatcaaaagataaaagattatacttcaataagccggttggtacgtttgcgcctaccgatgattacgtaacgcgcaggcaggagagtattgtaacggataaggtatgcccacttatagacgattcctactataaaacggttcttaatacagtcgatttatcctatcagatttttcaatggtttggagagccggttgattcttcctggaatttcgatggtgaaggctgggcattagattacgtttctttaaataattaaattagaatgcaatatgaaatgctttaataaactaaaagccgactatgcagttttgctgtcattcatttcctgtatgttttttatgggaagctgcaacattgcttatcaatatgatatcgaaagcgggacagaggatgataccgccgattctaccaatgtaaccatagtaacaggtgaaggaatcgatgtcagtatgtatgaaagtgcccgtgtttttccgggtttggtagatactttagtcgataatactgtcaatacactgcttgcgcttgatttaagcaagagatacattcctgcatacgatcttgacgtgcaacaagttcctcgtccgatatacagcaccgggctttatgccggagcaggtgaattgattactataaccattaatgacaacactatggggttgacggttatcatcggttctcatttagatgatttgacggatatttctccctacttgcgtttgccggtagttactacttcgaagcaactgttcccgggaaaaaacaccattcgtaatcctttgggaggcatgatatggatcgaaaaaagcaaggatgtgaatggtagtgcggattttgttatggagattaacggggcttatcgttcgcctgattttattgtcggttctactgatgtaacagcgtgggttgagcagttgcgtacaacgactgtaccgtggctcgagttgcgtggccggcatgtcgctttttccgttcagcgtgagcgattattggatatgataaatgatgatcctatcattgctgaaaagatgccgaacacactggaagcatgggacaatgctgtcgagacctattattataactattacagtttgcaggttggggcacaggatttttcaatgcgtgctcccgattttcctgagcgtgtggtgctggatgtggagttgttggacaatctgtatattcgtaatgccgattatggtgtagtggcattgaatacaaattatctgttgaatgagctggctagctatcaaacgttgaaatccggtaattctgttgctatttttaatgcgttatatagaaattactctttcagagatataaaatcaccctggtggagcgaagtatctgatgcggtaaaagcaattcccctatatcgcatggctgagaaaggattaagagaggatgggtatccgatgggaccgattttcccggaagaaggcagtagcattgcggagcaattccccaaagcattggcatatgcagataccgatagtagccgctggtttgtatctgatataaagtcggaagtacggccgacatacgcattggcaagcctcgttcaattagctaactacaaagatgacgattgggctttttatatagagttgaaccgtatgattaaagataaaatttccatagatcattctacttctacctatttctttaaggctttatgtgactattttaaggaagatttttcaccattctttgagcattggggctattcgctgacagacgaagcccgtagttatgcatcgaaatatccgctgatggataaagccatatggaaatactcgcctctggcagaaaatccatcaagtggtgtggttgatttcccaagtaacgggtatcactaccgtcataatcgagctgactgggagatttatgcactggatgcaaatggaagcgataactttaattcagggcagtcgccggaccgattgttggacagcgacaaatcaacaggatggacttcatattacaacaacgatacaagtactccgccacttccgtattatttgtttattgatatgaaagagacgacagatgttaatggtgtatttctggctggcaacaactcagactttgcggcaactaagctgattatcgagactcctgtcaatcaggatattattaatgatccgcttgacgaaaatatagtttggagggaaattgtgcagattgattccattgcacatcccgagttgcccaatattaaaagtgagggtttctatgattttccgtcaaaagaacaagtgagatatctgcgtataaaacttcctgaacctaatcgtaatgataactggaatgaaacagatatgtctcgttttaggttcagagtacagtcgtttaccgagtttggtacattttattataaac

SEQ ID NO: 135 - DNA, 20790 bp, Bacteroides thetaiotaomicron
agagtgagggaaatacaaaaatacagcaaaatccatataaaaaagaatcaatggcatgggcagcatggattattgcaaggttaggagcatggagtgcatacaagagccagtccattccaggatatataacctttaagaatggactggatagatttaatacacagtttgaactgtatgagttaatcagctaagacttgtgtataaagggtagcttcctgaaggaggggagtttagttacttttgacttttgacacacctccttctatctgaaacagaataaaattctttttattttttcattttcggcatcatcttgcccattttgctgctggttaccatcttcatcattttgcgggtctggtcgaactgtttcagcaaacggtttacttcctgaatcgttgttccgctacctttagcgatacgtgtacggcgtgagccgttcaatatttccggattggaacgttctgccggagtcatggaatagatgatagcttcgatgcttttgaaagcattgtcatcgatatcgatatctttgatagctttgcctacgcccgggatcatggatgcaagttctttcagattacccatcttcttgatctgggcaatctggctgaggaagtcgttgaagtcgaactgattcttggcaatcttcttttgcagacgtttggcttcttcttcgtcatactgttcctgagcacgttctaccagcgaaacgatgtcacccatgccgaggatacggtctgccatacgtgccgggtggaactggtcgatagcatccagcttttcacctgtacccacaaacttaatcggtttgttgactaccgaacggatagaaagagccgcaccaccacgggtgtcaccatccaatttggtcagtaccacaccgttgaagtccagacgttcgttaaattctttggctgtattgacggcatcctgtcctgtcatggagtctaccacgaacagaatttcgtccggattgatcgcttctttgatagcggtgatctcgttcatcatctgttcgtctacggccagacgtccggctgtatcgacgattacgaggtcatatcctttggctttggcttcctgaatggcgtgttgtgcaatctctaccggatttttgctgtccagttctgagtacatcggcacttcaatttgttctgccagtacacgcaactgttcgatagctgccggacggtaaacgtcacaggctaccaataatggtttgcgattcttcttcgttttcagcatgcgtgccaacttaccggagaaagtagtcttacccgaaccttgcagacctgacatcaagattactgccggacgggattcgaggttgatttctaccgtctcgccacccatcaactgggttagttcgtcgtgcacaatcttcaccatcaactggcttggcttcacagccgtaagtacattctgaccgatggctttttccttcaccgtgtcagtgaaagtttttgcaaccttgtagttaacgtcggcatcaagcaatgccttacgtacatctttcagcgtctccgccacgttaatttcggtgattttgccttcacctttcagaatcttgaatgaccgttctagtctttcacttaaattatcgaacatagttgtttaattacgaattaattatttgagcctgcaaatgtacaaaaatctcttgtatttatatctttttattctgccattttgcttttttgaggtaaatatagcttgttatcaacagcaaggtatagtacagaatctcaatcgtaaagcagatttcaatcggtgctttgagccacattccgacgaaaacgatgtaggaaccgtaaatggcaatcgtgatggtttcgagcaacagggctgcctgcgtatttcctgttccggagatgccgttgaatacgacattggctactgatgcaatgagcatggcgcagcagataacgtataccgaaggcacggactcggtgattaacgctgcttcgctggtatatacggagaggaggaactgaggaaacaaaaccgacaatcccaccagtcccagcatgatgaagaacgagaatcgggctattttattgataagcggcatgacgtattggatacctcctgcgccgatggcattgctgacaaggctgttggtcgttgttgccagtgcattcaccggaatcagcagtacgacgtagatactacggacaatgttggcaatggccagttcccgttgtcccaaccgttctacggcaacaaagaacacgaaccaggtcgccatcgataagaaatattgaagcatcgtgaagcaagaaatgctgagaatacgcatcagcaatgccggatcgaacgagcgcagacgattcagaccatactttttcaaatcaacactgatatatgtatagatcaggaagaagagaatggaagaggcttccgccagtacagaagcgatggcagctcccttgattcccatttccggcagaccgaatttaccgaaaatcagtgcatagtccaatatgacgttggttaatgccatgacaacagcattgatggtcaagaccttggtacgtgtgatgccgatgtacagggcacggaacatgacattgacaaacgagaagaagaacccgtaaatacgccagtccagaaactccatagtgccttcgtagatggattcggaagaaaccagcaaccgcatgatatttcctccgaacgctttggtgaagccgaacatcaatatagctatcaacaggaggaacataatcccctgaatcattacgggacctacatcactgtagcgtccttctccattgcgtcgtgcaatgacaatttgtgatcctgtgctgaatccgaaagcgatggtgaatatacatatataaaatagtccacccatagccgaagctcccagggccacttcactaacgtgccctaagaatgcggtatcggtgacattgatgacattttgcgccagcaagctgagtagtatcgggtaactgacactccaaatctgtttgttggtatacataattaagcgtttaagtttacagtttgcaaagatagcgctttattccgattctgaagcaatgggataggtgaaaacaatttccgggccttccgttccccgggcgtttacctgatagcttcctccgaagtaagccagcaataactggttgatctcatgcctgatgccggtctcctgtgaggtgaaagcctcgtccgccaatggagagttgagaatgcggaaataaagcatttcgcctttccggcttaatgtaaagcggataatccgttcctcctgttgtccctctgtttcatgttcatgcggataggtcagggtactgagcagagcgtatcccaatcgggtggtatctgtgcgaagggacagtgactcgacttccggagtgaagcggacttgaatgcctgtcttttcattattcatgcgtgccatgtagcatacttcgttgcaaagtgagacagcatcatagtcttgtatctggaacttcatcattttggcttctagacgagacaggtcgagtacatcattgaccagtctcattaatctttctgagctttggtggatgatcgccgagtattcttctcttgttttttcatctatattcggttcgctggctatgagttgcgagaaacctaccacgttgttgagcggggtccggatgttataactcatgtttgacaggaagcgattttttatttcgttggttacccgtaccgtttccgctgctttgcgtatttcgctctcggaatatttcagggctttgcgtattttggagagccggaatagggaaataaataatacgatcagaatggcactgattacgatcaggctgatcagacgtatttggttggtctgcttttgttgttccagttctatcttgtccagattatagctttttttgatttgctccatttgggtgttggagagtgccatggcagccgagtccttgatggccagtgcctgttggtagagagttgtcgctctgttattatctccggcttccacccatattttagcctgtttcagcaattgttcggcatagtcgctggtgaaatctttcttgagcatagttaatgtcgtgtcgatgtaggctgatgcctgctgatattgtttgatactctgatagtatttcgcatagatgtcgtagtagagcaccttatacatgaaataggtgttttcagtcagatactttttagacttttctatatgtgaataagcgagttggggctgatcggtattcagataataatgcgcgtagaaaatctcattgaaaatgaatacgtcggcaaatccgtcttttaaagatgggttgtcaatgatgaatttgcagagtacattttccagttcttgcaggtatttcagttgcctgttattgtctttcatttctttggtaacggatatgagctgtgacaagacggagatacggactaccgcattgccattctttggaagcaacctgtaggcttcttccagcgctttgagtccttcgtcccagcgctggctgccgatgtatgcgttggacaggcattgataagcggctaccattccacggttgttgtcgatatcaagggctttctgtttcatcttgtttgcttcgctgatggcaagctcatattgttcggtaaaggtgtataggtcaatctgaaagcgtcgggcgtcgaagaaatagtcccataaaccggatttttgtacaagcggttccatcttgactatccatttggctacactgtcctgttcgcaacggttgtaataatacaaaagatgatagtaggcggccagactggcgtacttatcattctttagttttaatgcctctagcatcaacgtgtccgaatattggatacatttgtagttgttttgctctatttttatgattgcattcagtgtagagaggcgtgtggtatcatgcggcagtgtctgcaacatttgcagcagactgtctgaggcagtatcggtgtttgcatagcccaacagcaggccatagcaggtgatgatcagtaatatcagtcgtttcatcgtgcttcctccttttttatctgcgcatggcgaatcgggtgtgtgaacagaaaacgtgctcctttgtcatagtccgggtcgatccatattttgcctcccagttgctcaatgataagctggcagatagataatccgagtcctgtgccttgtgcgttttcatcgagcttttcgaagcggttgaatatcttgttctggttctccttggagattccgcaaccggtatcactaacggagaaaagggccgtatcttccgtttgtttcaccagttccagggtgatagtgccttgtgcagtaaactttgtggcgttgataagcagattgatcagtacttgttgcaggcgggcactgtccgtggtcagcttcagtgaactgagagaggtggaaaaccgtacttccgcttgagtctgctttattttctctaccatgtcgatgacatttctgcatagcgctacaatatcacactcgttgaatttgaattgcatttttccaatttcaaggctggataagtcaattacatcattaatcagtttgagcagcagttctgagttctgctggatgatatcgttgcactgttgtttcgtttcgttgtcgatggattcttctgtcagaatagctgaaaaaccagataaagcattgagcggagtacgaatctcatggctcatattggagagaaaaaggcttttggtgtggatagacttttctgcttgtttcttggctttttcctgttcctgttgtgattgcagaagacgattgttggtgcgcttgatgcggaaaatggcaatgatgatcagtactacgatcactaagatcacagacagactccaataatagagatttttttgtatgttgatataattaagttcgcttttatctatctgatacagggtatgcagttcgtttatctggctgagataactttgggcgtccaatgaatctttgagatgattaatctcctcataaatcttgcacgcctcttgtttctgattcataagtaccaggactttggcgcgttcctgtaataactgaacatgtctgaataaagccgttttctttgttatggtgagtaattcttcatattctttcagcgctttatcatattcttttgactcaatatgatagccggcatacatatagttgctgattgaagaatagtagggatacggatatttttcgtagatggagtccagctgtttcagatactccagtgcttttggaaggttgtttgtctgtatataataataggcatagctgcaaggcagatagaagtcatcgggcaaacctgattctttatggtaaagagactccagataggcaaaatctttttcgatatctgtcatttgcctgtatttgagtttgctcaggatcaaatgaaacatgcttgtcttaagatatggaatacttgccggaattttttgcattattttcaaggattcctcataagactctatagcagactggggatttcccgaactttggtaggtgtctgcaagggcacgcaatgccagtgccgttccgaaaggataatctatagctttggcttgctgatacattgagttggcgttgttgactgccagactgatatttccttctgtaattaatgcctgaactgccatcattttcaatggaaacagaatatgatattcttgctgcttttcaagttcggggcttaagagcttttcccataagatgatgctgtccgttgtaatatcgatatttgtattgaaagaaagatcatgctcgacaagtggctggagtaaggtaagtcgttctttgttcaggtttgttgcatggagagccgccgatatgaatatggctgcaatgagtgctattatatgctgtaaattactattcactattttgtttgctcgtatggtgatgtgcaaaagaaataaaaagagcgaagactggcaagcaatcttcactcttttttatagaattattttcttttgaggatctcccgtgccccaggaccttcgtggctggggtagccgggagtatgatttctgcaccggggatcggcatctaccttcaaactgcggtaatcatctttggaacgtgtgatgtaatcgtccagcaaagcacgatgctcggcgagtattttggagtatttagggtctttggcaagattttttctttcacccggatcttttttcatatcgtacagttcttctccgttgccttccagataatgggtgtatttatatctcggtccgcgcaccatgcgtccgggagtggtaacgtactcatattcgctgtgccattcggagacaacgtaagggtggcttttcttttgtttctctccccttagagtcggtgcaaggctgatgccggctttttctgccggaacggcgatgcctgccaggtcgcaaagggtgggcaggaggtctaaggtcggctgtgtcagcaggtggtctacgggtttcttctgctgcttgatgccgggaccggcaaagataaacggaacgttggtcatttcatcatagaagctgatatgcttggtcaccatgcggtgggatgccatgccgtcgccgtggtccgccataattacgacaatcgtgtttcttccggcaggggtggagtagagggctttcagtacgctgtctacttgcttggacaccatcttggtgtaatgctggaaggcggcgatgtagtgacgatagttttcttcgttccaatgggcagcctgtgtcatgcggcggtgactgcaacagatatattgtacgggagtcggaatattgctccagtcttccacgtcaaagttgtccggcaattcgggcagtggtccgctgatcggccggtcggtgtgtactcctgcgttttcgccgatgaatccgcagatattatgcgggttctgaaaatctgcaatgcaaataaaaggttctttcggaggattgctgaggtaggcaacggcatcctcgcaggttcctacatccaggaaactgtcattgttgaccggaaattcgggatcggtgaatggcttggctaccggttctttatgtttgaagcctctcagtgagcccatgtcgtgagtcttgccgaagtgtacggcctcataaccgctttcggagaagagactacccagtgtcggcacgttttccggcaggcgggtgttgacgggttcgctggagtttgaacgtacattggtctggtgaggcatcatgccgctccataatgctgcgcgtgaaggttggctgagggggcagcctacataagcgttagagaagataactcctcttgatgctacttcgtcaatgggaagtgtgcagccttgtgtctgtccgtaagcgcctacgacacgttgtgtgagatggtcgcactggataatcaggaagttcggcttttcttgtgcctgggctgctgcgccacaaagggctaatcccatgaatggataaattgttttcattcttggctagaattaagtaattgattgggtagcaaaagtaggaaaaaacaaaaagcaaaaaagggcgggggagtggttttggacgtaaatgaaagtaatttgtacaaaaatgaaatatgcgatgaacgattcatgaggaacagcgaagaccgcgatgaataataaatgaaaagaattaatggaaatcataaaaagaacggtgaataaactgcgattattcatcgtccagtatattcaccgttccttatttatgatcgtttattcttgatcagctattcatgctcatcaggaattcgtcgttgtctcttgttttttccagacggtcttttacgaaatccattgcttcgataggattcatatctgcaaggtatttgcgtaatatccacatgcggtcgagtgttgtcttgtcaagcagcagatcgtcgcgacgagtactggatgcggtgatgttgacagcagggaagatacgcttgttggacaggttgcggtcaagctgcaactccatgttacctgtacctttgaattcttcgaagataacttcgtccattttggaaccggtgtcgatcagtgcggtagcgatgatagtcagcgaaccgccgttttcgatgttacgggcagcaccgaagaagcgtttgggcttgtgaagtgcattggcgtccacaccaccggaaagtactttaccggatgcgggagatacagtattgtaagcacgtgccagacgagtgatagagtcaaggaagatcactacgtcgtgtccgcattctaccagtctttttgctttctcgagtacgatacctgcgatttttacgtggcgttctgccggttcgtcaaaagtagaagcgattacttctgcgttgacgctgcgtgccatgtcggttacttcctccggacgttcgtcgatcagcagcataatcatatatacttccggatgattggctgcgatggcgttggcgatatctttcatcaagatggtcttacctgtcttcggctgtgctacgatcagtgcacgctgtcccttaccgataggagcgaaaaggtctacaacccgggcagacatggagtctgaataaccgcctttgcagagtctgaatttctcgtccgggaagagcggagtcaagtgttcgaaaggaacacggtcgcgaacgaaagctgcgtcacgtccgttgatctttgacacctttactaacgggaaatatttttctccttcctttggcggacggatgatgccttctaccacgtcaccggtcttaagaccaaataacttaatttgtgactgtgatacataaatatcgtccggagaagaaagataattgtaatcggaagaacggaggaatccgtatccgtcctgcatgatttccagtacgcctactccgctgaggatatcatcgaattcataaggcttttcacgctcgatcactttgcgttccggctgttgttgtacagccggaaggttctcggcaacgttgttctgctgttgtgcaggacgttgttgcatcggaggacgctggttgttgttattattacgctggaaattattattgttgttagcatttacattgttattgccggcgttgttattgttgtcgcgtgggcggacaatgcgctggcgttgttgcggttgtgaatgctgttgttgctgtggttgtggagcttgctcgggggcggcttgtgctgtttctgccttggtcgcttcgaatttgccgaagagttcggtcggaagctctattttttcagaaggcaggtcttcgattgggataaagtcatcatcgtcttcgctggataagatggtactttcttcgtcgatcaccggtgccgatttcttttgcggtttggctattaccggtttttctgcaacggcaggtttgttttcttttactttcttttctgtctcctgtgtcggagttgctttttcagccgccggtgcaactaccgttttttccgcaacagctttttcttctgttggtttcactatcggttttgcgttttccacctccttgttttctgctttttcagcgatattggcgtctttgcggggacggcctactttgcgcttaggagcagctttctctgccttcggttcagcaacgggagcttctttggctttgttggcagcctcttctttaggctgttgctgaggtttggctgcaggagcattttctttatttttagtaacttccgcatttttggctgcaggtgctactttctcttcttttttaggtgcggctgtgcgcgaacgcttgtttttatctcctttgcgttcttcttttaatttctctgcggcaactttcttagtggctccggctatggcttgctcatcaagaatcttgtatacaagttcttctttcttaaatgagtctgcttttttgatgcctagctctttggcaataacttgaagttccgacagatttttgtcgttcaattggataatgttatacatatagtatggtaagttattaaaatttctgtcttgatgaaatatggacagcattactacagcgtaataaccgcagatatgcgagcatatgttttgtttttaattatgaattagggatgtatgtgttgaatcgtagaatgtttcaacggggcaaagataataaatatttttggtttcatgaacaatcaaacacttttttcagcgtaaaaacgtatctttgctgtataaaagaaaatagtatgacagtaaatgaagctcgtttaatttatttttcgcctacacacacatcaaaacaagtagccgaagcaattgttcacggaaccggtataaaaaatgtcatttcgataaatctcacattgcagactgtcgaggaaaccgttattcctacgtctgcattagctgttatcgtagtgcctgtatatggaggccatgtggctcctttggctatggaacgtctggaaagtattcgtggtctggatactcctgccgtattggtcgtggtttacggaaaccgtgcctacgagaaggcgttgatggaactggacgcttttgccatccctcacggattgaaggtgattgccggagcaaccttcataggtgaacattcatatagcactgacaaatgtcccattgcggacggtcgcccgaatgaatcggatttggattatgcagaagatttcggaaaaaaaataatggagaaaattcaggcagctgccggatccgataccctttatcaggtggatgtgcgtgccatcaaacgtcccagtcagccgttcttccccttgttccgctttttgaggaaggtggtcaaactgcgtaaaagcggaactccgcttccccgtaccccttggatagaagatgagagcttgtgtactcattgtggcatctgtgcggctcgttgtccggcaggagcgattaccaaaggggacgaactgaacacgaatgctgaaaaatgcatcaaatgctgcgcctgtgtgaaagcatgtgcaaacaaggcaaggaaatatgatactcctttcgcttctttgctgtccgagtgtttcaagaaacagaaattgcctcagactatcttgtagataatcactcgtttagtcgtttcgtctatccggaagcggttatctgtccgttcgcctatcagccatgcaatgcgttcaccgcagcagagaacccattggcgttctttttggctgatggagaatttgcggtcggtcagataatcgcttatttttttcttgcccgtcatgccaaaggggatgaatgtatctcccgcttgccatttgcggcagtgaatttcctcatttaatttgtctgcatcgaaacaggcggtttctttttcccgtggaatccggaaatcgggtgtgaattctctttcctcttttattaattgatagggaagggtagattcgtcttccggccggatggtttccagtagcagcaaattccggtctttaatgactctccattctttgctgacgaattgtttccccggctgcccgtgaagcgaattggctatatctttgatttgtgccgaattgaatcccagtggatgcaatgtttcaaacaagaaagcttcgggagcgggttcgtccagtagagcatcgattcggataccttccggagtgataatccgtgttttggcttcgtctattaccttattatatatagtagctacatcattcaggtgattgcttgtttctatcagactgtttttgaccgacggatttatttcctgcattagtggaagcaggttgaggcggattttattacgggtatattcgtcttccagattggtgctgtctgttacgaagtcttgtccgatctgttgcaggtagcggatgatttcttcccggttgatgcagagcagcggacgtacgattgctccgtttcgggggcggattcctaataaaccggtaatgcctgtaccccgaatgaggttgaacagcatcgtttctacactgtcgtcctggtggtgagctacggcgattacatgggctccgcactcttcttttatcttttcgaaccagttgtaacggagttctctggctgccatttctatcgagatccgtttttctgttgcgtactgagtcgtgttgaagtcggtgatatgcaggcggatgccgtatttttggcaaagttgccggacaaaccgttcgtcacggtttgattcttcaccacgtaaatggaaattgcagtgggcagcttcacattgataacctgctgtgtggagtacacgcagcaaggcaactgagtcggctccaccactcagggcaaccaaaagtttatcatccggcaagaataaatgctctttctctatatatcgtataacccgttgttgtatcatatctgcaaagataatagtttattgaggtatctcaagtgaatgctaattgtttttatcggactggctaaggaaaaaactcccataaattaattttttctttagcgatttctaattcgttctactatagttcctcttgcgtgccactatagtagggcgtaaggggaactatagtacttcttgcgtaccactatagtggtacgaactaattgttgcatgtaaactcaatagatgtaggcagggaattagttacctgttgtgacttgaacttttgatgggtttatttagataccgtcagcatacgaaaatcctgctatttaaaaacattctaaataatttgcgtgctcggaagttatgaattatctttgccgaaaatttagatagttatgcgtttatccgaattaggaacaggtgaaaaaggtgtcatcgttaaggtcttgggacacggaggctttcgtaaacgtattgtggagatgggttttatcaaaggtaaaactgttgaagtattgttgaatgctccactgaaagacccgattaaatataaagtcttaggttatgaaatatctcttcgtcgtcaggaagcggaaatgattgaggtagtcagcgaggaagaagcaaaaaaacaagccgaaaaagctgtatatcacgaaggtctgcccgaagatgtttctgtaaaagaagaagatatgaaacggttggcgttaggtaagcgccgtactatcaacgttgctctggtcgggaatccgaactcaggcaaaacttctcttttcaatctggcttccggcgctcatgagcatgtaggaaactatagcggtgtgacggtagatgccaaagaaggatatttcgatttcgaaggttatcatttccgtattgtcgatttgccgggaacgtattcactgtcagcttatacaccggaagaaatttatgtccgccgtcacattgttgatgaaacgccggacgtaatcatcaatgtagtcgattcttcaaatctggagcgaaatctgtatctgactacccaactgattgatatgaatgtccgtatggtggtagctttgaatatttacgatgaacttgaatccagcggtaatacattggattatcatttgttgagtaaattgttcggagtgccgatggtgcctactgtcagcaagaagaatcgtggactggataccttgtttcatgtagtaatcaacctttatgaaggggttgatttttttgacaagcagggaaatatgaatccggaagttctgaaagacctgaccgaatggcatgattctctggaagaccggaagaatcatgaggaagaacatctggaggattacgtgcgcgaacataaaaggaaagggcgtgtattccgtcatatccatatcaatcatggtcccgatctggaaaaagcgattgacgctgtaaaagaggaagtatccaagaatgaatttatccgccataaatattctacccgctttctgtctatcaagttgctggaaaacgatcccgatatagagagctttgtacggacgctgcccaatgcgggagagattttccgtattcgcgacaagatggccaagcgcgttcaggaaacgatgaacgaggattgcgaatccgccataacggatgccaaatacggttttatcagtggtgcgctgaaagagacatttactgacaatcatctggagcaggcgcagacgacgaaggtgctggatgctatcgttactcatcgtatctgggggtatcctatctttttccttttcatgtacctgatgtttgagggaacatttgttctcggagaatatccgatgatgggaattgaatggctggtggggcaaatcggtgacttgattcgcaataacatgtcggaggggccgttgaaggatatgctggttgacggtatcgtaggcggtgtaggtggtgttatcgtctttctgcccaatattctgattctgtatttctgtatttcgctgatggaagactccggttatatggcccgtgcagcgtttataatggataaaattatgcataagatgggcttgcatggaaaatcgtttattccgttgattatgggattcggttgtaatgtgcctgctatcatggcttcccgtactattgagaaccggaaaagccgtttgattacgatgttgattaacccgttgatgtcttgtagcgcgcgtctgcccatttatcttttgttggtaggagctttcttcccgaacaatgcgagtttggtgttgttaagtatttatgcgatcggaatttttctggctgtgctgttggcgcgtctgttcagcaagtttttggtaaagggtgatgatactccttttgtgatggagcttcctccttatcgaatgccgacggcaaaatccatattccgtcatacatgggagaagggagcgcagtatctgaaaaaaatgggagggattattatgattgcttctattatcatctggttcctcggatattatccgaaccatgaggcgtatgagacagtagctgaacaacaggaaaattcttatatcggtcagttaggacgggctatagagccggtgataaagccgatgggctttgactggaagttgggtatcggtttgatttccggagtaggggcaaaagagctggtcgttagtacgctgggtgttttgtatgtggatgatccggaggccgatgaggctagcctggcggaacggattccgataactcctttagtggcgttctgttatatgctgtttgtgctgatttacttcccttgtattgcggcattggcggctattaagcaagagtccggcagttggaagtgggcgctctttgcagcttgctataccacagggctggcctggctggtggcattttcagtttatcagattggaggaatgtttgtatgaataattggcaggaatgggtagtcggagtactgattgtactctgcattgcccgtgtaatatatggaatttatcttttttttcgtcgtacgcgagaaagtgagaatccttgtgatagctgcgtaagtggctgtgatttaaaggatatgatggagaagaaacgtcaagagtgcggtgtaaagaaaaaaagtacaaagaaaaattgctgcggatagttggtagtttcaaaatttgtactacctttgcaaccgcaaacgagaaaaaatggttccttggatgagtggcttagtcagcggtctgcaaaaccgtgtacggcggttcgaatccgccaggaacctcataaaaccctttcagatgatctctgagagggtttttcttttctcttaatccaaaatgttcccactttgttcccagcttttggttaatatcatgatataaggatggtgttttgagaggaaggctgttttttattcttctatttcttttattctttcgatttgtttattcaagaagtaatcagtgtaaagagaatattctccagtttcgcaaaaagatattaatcctttcttgtagttcaagacattaaaatagcaagattcttaacttcgctatgataaagctcagaaagctttgataaagggctttcgatgatgaatgcagctttatttatttgttcttcattaaatatctgtttcatgtattccaattgtctcactattgtttttatccttgaccgacccttgacatcattaggggaatttgtcggaaatggcggtatttcatctaaattgaaatcctaaaagggactttggagatatttactggtttatttttttttcttctctccaataatcgtaatactgcatgggattccacctttcagcatttctgcgtggataatgaccggattggcatacataccgttctgacattctatgctaattttaccatttttgtcagtttgtatagtaggattccaataaagtgtacggcgacgatggttgacatttgcagtcggtattttgtctttgtagacaggagaatagaaagctaatgggcgagaatatccttggattattgtacgacgtgttccatgggcagccttcattgacttttgcgttaatctgctataattggagtcaaaatgcggagttatgtagaataaagcatattgtccgaatcttgaaaaatcgatattgacgtttacattattgttgattcctgatgatttctttctaaaaagggggtctgatttggccttttcagtatcgtctaacgatatttttttctttgcagcatctccataaagatagaaactgtcatcaaaggtacgtgggggattcattgctgtcatcatgtcttttacattttgtccttttgtcatatttgaaccgtgtattgaattaagcacttcattagtatacgaattgcttccttcgcatatcataatctgttttataccatctatctcattccacaatgtccaagcagttaaagtatcaagtacttgtttgccaacaatgagacagattgttttctctttatatcgtgagcttccgtcttgcacatcgtatgaaaagttaggattcactttactaagcaagtcgggtatagtattaattactattccctgatcgcgtaattcatcaaccaatcgcgttacatcatagtatgcgtctacgcttttctcgaatacttgagtagtgatgttcttattttttcttttttttgctatttccacttcgctcaataaataggtgttgttagttttgctaatagaatctacatatagcgagtctatacggttggaaagggtgatccatgagtttttgtccatccactgtggatgttcttcttcatagctgaaggcacgtggggtaggggcgaagttacggtcgagcataacagaagcatctttcttatgtttagatcccctacggcgtatctggaataccgcttctacttctccttcaaaactagtaaccggaagttgaaatttgccgttttcatctgtaaacgtatttcctgctacaaatgtattgtccactttagccatgacgcttacctccatatctttcatttctttttttaatagagaagaacgaatctgtccttgtagtaacaactctttttcagctgactgttgaagtagcttttcatttttaccggaaataagttgtgataagtcatattgacgccaaccgtgaaccatgagcaaaacatcaagttcttgcaatttgcgaagtgtaatatctgcaaaataataccccggtttatcaatatatccttttaaaccggatgttaataacatatctgtaaatatattattatcatattctgcataatccgaacgtatagcatctcttactgatatggataaagaaccttgtaaaggatttcctttttgatctgttacttgtatttcgcagcgaattggttcgaaaggccggtaaatgtctttaattccatttaattgtattgaattcaatttattgggttgcacaaatgtaaatcgttcgcacagcatattcccggttttgtctagtagactgacttggtatatgcctccgggaagatcgcgcgttttaagtaagaaagtttgatttccacctgatctcattcgtagtatccaatacgaataggggcgaccttcatgacttatgaatgctacaatgtctgcatccggggtattctcattgctcaatacgttacctacaatagctccgcttgaattattcacgttcaatacatatccggcggaaagggcgtccggtagattgaatttatattctttttctttataagttactttagctactgctggtttttcttcgggtgtataagtgaatattcccattccgtcatgtagggtttttatttctgtcagcttttccccgtctttcgtataaatggcaccttcaaggataacattaccatcttctctactttcagctttaaatgccacacgagaagagatgcctttcacgagtgttcctccttcgggaaagaattggatagcaagtttatctgtcacatttttcggtcgctgtttcatggaaggattcagattataggtcgaaatcctccgttctggtctttcttcttgtgcagactgatagatcgggaatgtacgtgagaagtaagaaggttcgctgaatgcgagcatccaacgggtgtaagctctgatttcataatagccggacatggtactttcattcaggattatctgtccatgtccttcaccgctattcaattcaatgatttggcgttgggtaatatgccctgtctggtcgagcatttctacataaaggggtttgctgatggtgcttggcatattgttctcagcatataccgtgtaggctttaaaccatatagtatctcctacataataactactattatcaaaatgcaagtataccttctcacgtgggtatgtgtcagcaaaagcaacggcattatcgaagaactgtttgaagatgatgtcgctgctagcgttttgtgaacggagaaacaaaatgctatgtagactgcaaaatagaattaaaagtattcgtttcattattgtgacatgtaaggttgttaatcatagctaaactcattgcaactaaacatgatataaatttctttgcttgtatatttttgatagataccgtgtcgcactgcagttttaaattcttccgaaacattgcctgcgtattcagctgttatgagatattctccagtcttcctaaattttggaacagtaacttcatatcttccgcctactaattggggaaaaactaaatatccatcaacaagcactcttacagaaaaagatgagccacacttaggatcattaattatgaattttagtgattccatattgttgaaatcctgtgaattataaccataagggttattataagttggctgattgtaatctttataatgccatccagttgcaaggtttttattgtaccatttttctttatcattaatacttttatctgctttccctgggaaatctttatgcaacaatctatatctaaactgaactctagtaggcaaatgtgtagcatttaaatccataggatcttgaaatccattgactttcactattccataattataattccccgggcccccttcacctaaataacgccaaggaaatgcagtagtaccacttattagcctatgttgtacttgcatatattgataatccatccaattagcttctgtaataggaggataacaagtccaaataatggtcatataatatatgcaagtatcaggaccatgtccagaaggaaaatcacgacaggatacctgatattcatatagagcaggtagcgcaccttctctatctttccaccaatccatcccctcttcatattcttgtttagtgaagaatgcattagtagcagacgttgagttggatattgtgttgtctttaccaagcatagtactatctgttgctacatctgaacttattaaagtattgctttcgtttaagagagtttgttctattccttttatttcagtgacagcaatagtttgcaaatcattattacatgcagcaaatagtgcataaaataataatgcaagcaatgagccggaaaaataattaattgttttcataactactggattttaaataatgttactatttttcggactttaaggcgttgtgtaaaatatgtttttgttatttgcttggatctctttaaagtatttaaaattgttggtttattctctgacctttaatat

SEQ ID NO: 136 - DNA, 20652 bp, Bacteroides thetaiotaomicron
caatataatctgatccctgatttttttactatatttgcaaagtattgtataacatttaaaaatatgaccatggaaaaaacatttgcacaaatcagtgaattgtttgatcaattttcaaaagatgccagcctccaggtagaaaaaggaaacaaagctgccggaacccgtgcccgcaaagcatcactcgaacttgaaaaactcctcaaacgtttcagaaaagagtcactcgaagcctcgaagtaatttttactctggtctcgacggtatggaaatggcggcatagcgtgtaccatatcgaaaaaaaacttttcgtttcacagcggggaggctttattagttgtgataaaattaaatatcaattatgtgaaatttctatttcgcttctgaaaaaacaactctactttcgtatatctgttggattccgcaggtgtatagtcggcaatttctccttaactaattctgataatacgttcggccgatattccatgtcattccagttctgtagcaaccaagcaagctcttgatatattcaaagaatcgttgatacctgatgtaccagtagaactgtcggcagcaccagttactctcacggataaactgtattttttcgttacacgggccagttcgttaaaattaagcctttgtgaggtatcctttaggacaccgtattggaagcaaaaaagaaatagataggtgtaccaatacattccccatcagcgtatgaaaaaaacattggaatccatagaaagggtgtcctgaaagccaaactgcatatttcgggaaatcgtataattacatgatggctttccactttcagattgaaaggttgtcgtgtcaagaagtgatgaaccgctccaatagctatgcttcagccctccacgaagtgagttcaaaccgctgtaagcgttattggatatgtacatctagttatattatatttataaaaatatcaaaaacaataagttacaatataccataagaagctatttttatttatccgaacacaaagttatgctttaaaaataaaatgtcaaggctgaaatgaattatgattttttaaatatgctaaattgcttctgttttaatactgttgtcttttcacttataaacataccaactccggaggcaaaggctgggatggtttgtcggcatattcgccgttaaaccgtcctgttttcgtttaacgaaaacacaacttgctgtcccctaatggggacaacgttttgaatatcacgctatatccatatagtgctataaagccttttgtcaggggaaaaatgcatacggtttctgccattttttccgcatttccggttttttgaatgtaaatgtttccccacagaacatgcgtcttcccactatactgctataactatatagccatataaaagaatcagaaattaaaatatcattgattgacagcataattcaccgatttacgggaatgtcttctgtagtctttagtccgctataccactatcagtatagctttagttatctctatttcgaggtcatcctctatgcagctcaccatatcatgttatatcactatcagcatatccccgtttatccttattccgatgtcacgccctataccgcacggcattcgtttggaaccctgatgctgtcctccggcatcccgatagagagcatcgccaagatgatgggccatacgaacatcaacagtacgcaggtctatgcataggttaccgaccagaagatatccggtgacatggaccggctgatgaaaagaagacagaaagggagtacggtccccctaacggaaatatccgaataatgaaatgccagccgaaaccgatgtttaatggttccggccggcattcttgagtattgaacgtccgattatatcagggcctcatgataattatcttccaggagtttctcaatgtcggataccttatacaaaatttttccacctagccggatataagaaatacgcccctggtccctataatcctgcaggcatctgcggctgatttttaacaggtccgacaattccttgtcagagagaaaacgctcaccgttaaacagggggcggttatcctccgcaagcctttccagcttcgtctgaatgttatccagcaggccaaagaatcggcggacactgcacgtctctttgctaataattccttccatgttgcatccaattaattattcattctttcttttttctctcaccgccttttccttgcgtttcatggcggcatagaccatcagcttttccacgtcctccggcctgtagtagattttccgttggatttgggtgaatgccagccgtccggtatcccggagagtctgcagggtacgtggagagatgtcaaggcgcaggcagacatcctggttatccattcactctcccggtttcttttccctgtttttttcatacaagcggtccacctgtgcggacaggctatcagccctagccagcatttcctcaaagattccggcttcaatgtaatatacttccatttttcttgtttttatttaaaatagcttccttttagaaactcaaattattgaaatacagttcaaaatactttccaaatgcacttccggatgggagtcgtgatttccgactccccctccagagctgttttaaggaggacttcccgtcatattacggctgtaacagtttgtaatctcgtcctgtgatcttctttatcatgccggcgttttctttgatatgttcaaccagtatgcggcttataacaccggaaacagtaaaatccttacgtctgactgcccagacaatgtctgagatacattcgtacacctgtgcatcaatatgcaggggcttgcgccggttggatgaaaaattgttcaggagggcttcaatgtatttttttacctcttcatccgttatcgtctttttactttccgcccgggatgaagactccttgtggggcggcacctcttccagattctcggaaatactgctcaaatatgagcctttagcggcaactatatccagtatctccttctcgttgatattatacggttttgtttttttcctttcaatgctgtccataactatgatttatacattaattccatgtgacaattgggcgttttgtaaggcggatgttcctgatggcggattatcgtcctactctgcaaagaaaaaaagaataaacgtgggaaaggataccttgtcagttatagtcatatatagacatgaatagtcaatgccagcaaaagacataacaaatggcagtccggcgggaggccaggattctccccgatgttgctaggattgtgacatgtcaagccatggagatattgacagcttacattcttgggataatggtacaccaggctacggatattgtaacagcttatgttattggaatagtgatatgtcaagctatgaagatagcgggaactcatgttggcaagatagcgatatacgaggagacagcaggacgggaacactacggcgatgaaaagaaaaatccctgttggtccatgtgagaccggcagggagcgtaacaataaaaggaacgggcttctcagcccctgatgtaaccgtactttttcaggtcgtccatgaactgctccggggtgtcggttctcaccgtcaccccgtgcagttccctgtaccgtccggagaaattcactatgtactcctcgtcggtgcatccgctgtcaaaccagctgccttcacgcaggatgcgtacaaactcggaagggccggaggcggcaatcctgccgccatccgctaaaatatatatgcctgttcatgtcgatatttttttagtccttaaatttataatatagtttctgttcactgtcgaggaaggggatgttctggagcgcggtggccacaggcacctgtcccctcgtggcaaaggtaactaatttgtggagaaacagtacccagttgcgcatttttgtgaagcaggtcgttccggaatgctggcggaactcgatcgtcttgtgccgtgagtaggcctcgaggtccaccttatggtaacggtcaccgatccttcctttcagctcgtccaccatccgggcggaacgtatcatcccgtcagagacatgacccaggccacggcaatagtagttgtccctgcgggatgccggtatgaacctgtcgatgaccggttccaggtgcttgtagctcagggacaggttacgccaggtttccatgctgaaaccggcggcatcgatatgtacatgaagcccgcagctcccgttcaccttcacgtcacacaggtcaagcacccagcagcccttctccagttcctgtaacccggcttcaccgaccaggatcggactgaccagttcaaaggtgtcgttgccgttcagactgccgtccgtcacgagtttccaatgcggacgggtggtatggttataactttccaccataacctcgataccggcctccctgagctcgcgtgcgagccgttcacgggagcagttgtaagcctcgatctcgataccgaacttgcgggtgaaagtataatccagtgcagctgtcgccggatggatattcagaccgccctcacgttcattcatccggcgcagggcgttcacgacaaaaccgtaattaccgttggtcaccatccttgcgatttccgcacggggaatccctaaaagatacagttgccggatcttgctcgtttttgttgtctcttgtgctaaaatgcttctaacttgcttgttcataacttgttagcttctttatttactctactaagataatgcttttataggagaaactataatcataagaactttattatcactgcattagcttactttgttttagactaaaagtccttattggggggatccttatcttatccgctgcaagtcccggatgacaaaaggcggcaatatatcggaatagtcagataacgatatatcatgatatggctgaccgcataagatgtgacatcgaaataggaatagacggggatatgttgatagcggtataacgggttagccggatagcgatatatcatgatatggcgaaccacatagggggtgacatcgaaatagagataactaaagctatgccgatagtggtatagcggactaaagactacagaagagattctcgaaaatcaatgaattatgctgtcaatcaatgatatttcaatttccgattcttttttatatggctatatggttatagcagtatagcgggaagacgcacgttctgtggggaaatattccccttcagaagatcggaaatgcagaaaaaccggcggaaaccgtatgcgtttttcccctgacaaaaggctttatagcactatatggatatagcgtaatattcaaatcgttgtccccattaggggacagcaagttgtgttttcgtttaacgaaaaccgaatggtttaacagcatatttcgctgccaaaccattattcagttcatgctcctaagtcgcacagaatcataaaaccgatatctgtctttggactatttatccctacaaattgcgctattagattctcataccacacgaaaaaaaagacatccagagacttttacaatgtatgggatgtatacaatcggccaatgttcagtatatcgcagcagacactcaatccatactttaataccatcattcaatgctaacacatcacctctatttttcgatcagtccattcaagtattataacatagattatagtaatggactgtaagaccattgctgaagacaagaacaagattttttatacctatttcaatactctggacatcatccttgctaatgttttgaacagattctcctccatacataatctcaacggaaataaattctatattacgatactgcttgtaccatctctcgaatagaaaataaactacacctttcatctggcaaaacagaacgattgacatcaaatgggaaacagttttccaaccactcatgagaaggaggataacgaaataaaccaaacactctacatctattggctgggataaatagctaaaaagaaaatttgcgaatcaaatatcattttatatttttgtttctcaaaatttttaatgaactaaaaagaattaaaatgcctgcaaaactcactcgtccagagaattcttttaataatatttatatgcgatattacaaaaagtcttttctatttgtaaagtcgtatatacacaatgagatggtagccgaggatattgcatctgaatcactcatcaaactgtggcaatggatacaggacaacccggtggaaaatattgaaccgatgttgctcagtattttgcgaaataaagccttagactacttacgtcatgaaagcatgaaacaacaggtcatcacacggattagtgagaaacaaaatgaagagttagctcttcgcctctcctcactggaagactgtaatccaaatgaaatattctcgaaagaagttatggatattgtgcaaagaacattgcaatcattacctgaacaaacctcccgtatatttactctcagccgatttggaaataaaacaaatcgggaaattgcctgcgaattaaatatttcaatcaaagatgtggaatatcatatatccaaatcacttaaggctcttagaaaaacgctaaaagattacctgcctttattttatttctttttttaccatatgtaacaccgattactacgcacgttcctttatcttttgaaaaaaatattctttttcgtttagggtaaaccgaagatgaatcgttatataaatgaaaacgataaaaagatggatgaactattacaaaaatatatagcaggaaatgcctctgaaaaagagtcacagaggataatggagtggctgcgcgaagatgaacagcatcttagagaatataagcggcaacgtaaattgtatgacattacgttatggcagactaaaagtcccgttgatatacaacaagagaagaaagatccgctgaggagggttctcgatgttattgtacggatagcggctgtcattgtttttactgtggcaaccacttatttttacactcaccacgttttacaagacaaggaggagaatatgcaaacggtagttgttccggcaggccagcatgccgaattatacctggctgatggaacgcatgtatggctgaattccggtagccggttgacttttccgggacggttttctaaaaaggtacgtcatgtagaattagatggtgaaggatattttaaagtcagttctaatataaaacaaccttttattgttggaactaaccgatgcaatatccgggtgctggggacagaattcaatgtgctggcctatgagaaagatagtatatgggaaacagccttattggaaggtgctgtagaaattctgcaaaagaaaagtgaagtatctctcatgaaactgaaaccaggtgacatggccagactaagtaaaaaccaacttactaaagaaaagatacatacaacagactattttcgttggaaagaagggcttatttgtttcaacgatatctccctacgcgatataatggagaaattaaaactctattatgatgtgaattttgtcattaacaatcaacagattcttgatgcgcactataccggaaaattccggacccatgatgggattgaacatgtaatacgtgtgcttgccctcaataataaatttacctatattaaagataacgagagcaatacgataaccattaattaactttttaatatttctaatgcctatgaaacaataaagaaacatttaaaaaagaaaaggggacagtgctgcaacaccatcccacattttccatcagtttataccaactgacaaaatagttctagatcaagttaaacctaataaactaatatgttgcgaaaatatgaaaaattctctataccaggaattatttatagaaaataaacagttattccgtattatgaaaattattgtttacgtctgtttcttatgtgtaggaaatcttctagctataggaagctatgcgcagacagctcatgttacgattgtttccaaccatataacaatcggacaagtgattaatgaaatagagaaacaaacggactatctgtttgtattcaacgtaaaagatatcaatatcaaacgtaatgtcaaagtgaatgcgaaagataaagccgttaatgaagttttgaatgatatattcaaggatacaggcattcgccatgctatagaaggtaaaaacatcatgctcattaactctacggataaggaaaagggtgcgcagcaaaaagattttttagttacggggatagtaaaagatgaaaatggtgagcctattatcggagcaaatattcaagtcgtaggaaaatcggcaggcacaattacggatatgaacggacgtttcagtatcagtgcctctgccaattctacattgcaaataacctatattggctaccaaacgcagactgtcaatatcggcgagcagaggaatattaacattattctacaggaagacaatgcgcaattggatgaggtagtcgtagtggggtatggtacgatgaagaagaaagatctcaccggttcggtaacagctgttaaaggagacgaacttgctgcccgtcgtaccacccaactttccacagctttgcaaggcgcgctttccggagtaatggtcagtcgtgacaatggagctcccggtagtagtgcttctatccagatacgtggtgtaacaactattggtgattccagtccgttggtgattattgacggaattccgggtgatatcaactccgtaaatcctgaagacgtagaaagtatgtccgtattgaaggatgctgcttcggcttcgatctacggttcacgtgccgcagccggtgtaattgtcatcacgaccaaacgtgccaagagcggtgatgtggctttgagttacaactttgagtacgggtgggaaataccgactaagttgccgacctatgtaggagcccagcgttacatggaaatggtaaatgaaacacgctataacgataatccagacggtggatggtaccaaacatatacggaagatgaaattaccaactggagcataaataatgcgactaatccggacaaatatcctatgacggattggggagatattctgttgaaaagctccgcaccccggcagacacatactctaagcattgttggtgggggtaagattattcgtacaaaagcctctttccgctatgacaaaacggacggcctctatgtaaacaaggaatatgaccgttttatggtacgcgtgaataatgatttcaatataaataaatatatttccgcaaatctggatttgaacttttcccgttctaaagctctctcgcctaattccaaccccatgggggcaggtggacgaaacattccgccaatttatgctgctacatggaccaatggcttatggggtgatgtgaaagatggagaaaatatgctggccaaaattacagatggcggcacttttaccaactggggaaccaatattggcggtaaactcggtattgacataactcctgtcaatgggctgaaaatatcagcagccgtggcgcccaatttcaataatgtaaagaagaaaacttttgtcaaacagattccatacacccgttcagaagatccgaataccactgttggttacatgggaggttatcgcactaccaatttgacggaaaatcgtaatgacagccatgatataacaacacagttctttgccaactatgccaagacactggggcgccatgatttctctgtcatgatcggttacgaggattattatgctttctgggaaaacctggatgcatccagagaccagtaccagttgacaagctatccttacctggacctcggttcggaggattatcgggataatggtggcaatgcggaagaatatgcttaccgctcattattcggacgcatgacctatagctatgcagaccgctatcttatccaagcaaatctccgccgggatggttcttcacgttttgcatccaattgtcgttgggccaattttccttccgtgtcacttggttgggtaatttctgaagagaagtttttcaagaatataaatatggattggttttcttacctgaaattgagaggctcttggggaaaactgggaaacgaacgtatcggggcttatgacgatgacggtaactttatttataattattacccttaccaggctgcaattgattacagcactgcactatttcagaattcacaggggattgtttcttccgtgactacggccgcacagcagaagtatgccgtacgagatatttcatgggaaacaacagaaagctgggatatcggtttagatgctaattttctggataaccgtctgcacttctccgctgactattatagaaaaaatacgaaggacatgttgctggcactggaaattccacacttcatcggctacgacaacccggaagtcaatgccggaaacatgcacactaccggctatgatattgaagttggctggagggacaaagtcggtgatttcacttactccatttccgctaatctgtcagattttacctccaaaatgggaaacctgaatggtacacagttcctaggcaatcaggtaaaaatggaaggaagtgaatataacgaatggtatggttacgtaagcgatggcttgttcctgactcaggaagacgtggacaagtcgcccaaactgaacaacagcgtcaaagtgggtgatattaagtacaaggatatttccggaccggacggtgtccccgacggagttatctcacctgagtatgaccgtgtacttttgggcggttccctgcctcactatatgtttggactcactttcaatgctgcctataaaggctgggactttggattgacactacaaggtgttggaagtcagaaatctcaaatcagtgctgcaatgattgaagggcttcgagacaactggctcaatttccctactattcttgacggcaattattggagtccgaaaaatacggatgagcagaatgcgacagccaaatatccgcgcctgactcgcaccaatcgggatgctaatttctgtatgtctgattattggctttacaacggtcggtacattcgtttaaaaaatctctctgtcggttatacgctccccaaagcatggactacgaaggcgtgtatgaatacagtccgtctttatgtaagcggaagtgacctgtttaccatcagtaatgcccccaaaggatgggatccggaagtaagtacagaagggtatcctattaccacctctctaatatttggtgtttctattaatttctagccataaaaaacatgaaaaagttactcttatatatcggggcaggaatactcttactctctgcctgccatgatctcaatttaaatccattgtcaagcggttctactgaaaactggtattccacggaaactgaagtgcagatggccgttgatgagttatatcgatatgacttctggccggaagacggacaacaacagaccgactggtcggacgactatacttcacgcgatctcctgacctcttttgatgacggaactctaaatggacaaaatgcttgggttaccagtttatggggcaatcagtacaaagctatttcacgtgccaatgcagttattgagaaatcgcatcgtgctatcgaaaatggcgcatctgccactactattaaccgcctgattgccgaagccaaattccatagagctgccgcttatgccaaactgattgtaaagttcggtgacttaccattggtattaaccgatgtaagtacagaagaagggttgacaatgggacgtacggataaatccatcgtattggcacaaatctataaagattttgatgatgcaattagtgtgcttccaacttcctatactgaccaacagcgagccacccaaggtgctgcactggcactaaaagcccgggttgccttgattatggaagattgggaaacagcggccgatgcagccaaggcggttatggacttgaatatttatgaattgcatcccgattttggcaatctttttttgtctactacaaaaaactcgaatgaatttattttcaaaattccacgtgatgctacatatgacatttatctgggaacaggaaacggaggagttaaccaggtatacaatgatctaccccgtaacgtaggaggatggacgcagacctgtccgtcatgggagttactagctgcattcacctgtaccgacggtctgcttattaacgaatcaccactcttcgatccgcatgaaccatttgcaaatcgtgacccacgtttagcagaaaccattgtaccatttggttccaaccacctcggttatgaatacaacccacacccggaggcactgacgtgtatgaactataatacgggtgaaatcgtgacaaattatgatacacgtgccaatgcccaatatgcttctttcgatggtctggtgtggaaaaaagggatagacgaaacatggcttcagaatggtttcaaggtagaccaggatattatctattgtcgttatgccgaaatattgttgacatatgccgaggcgaaaatcgaattaaatgagatagataactccgtattggatgcactgaatgaggttcgggcgcgtgcttatggtgtggacaagtccgataaggcaagttatccggctttcacttctaacgaccagtccacacttcgccaccagctacgtgtagaacgtcgtatggaaatggcaaaggaacacatgcgatatacggatatcatccgttggaaactggccgaaaaggttatgaatcgcaagacatatggtatcctttatccggcctcactatgtatcgaacgggtaaccagtcagggagattggttttgggctttcacaccggaaatggacgaggatggttgtgcagatttctccaaattggaagaagcgggtaaatgtcaggcacttgctgtacgtagttggaacgatcgccaatatttgtggcctatccctactacggaacttcagatcaacgagaacttaaaacaaaatcccggctattaaatgcaggaaagttgttgatagtccgggaaaaggtaactccttaattattcacccttttatttttctaactttatgattggaaagagctatatttttcacctttttctatttcttctcatattaccagacagtatttattctcaagataatatttgtctgatcccgcaagttgaaagcatggtccggaaaaaaggtacgctatccatcgaacgtctggaaagcatccatttcccggacgaatggaaaaatacaggaaacctccttgtcagcgatctgaaagaactggcaaatttgtctgtcatggtgaatgcctcaaatccttccattcatgtaaaaaaggtgaaaatgcaggagccggaaatgtacatgctggaaattacaaagcaggggatcatcatagaagcaggtgaccagacaggtatgattcatgctttttccactcttttacaattgattctgggaagtgagggaaaagagttaccccggctcataatccacgacaaaccccgttttagttacaggggagtcatgatagattgtagccgccatttctggactatcgaacaacttaaaaagtataccaaacaattggccttttttaaacttaacactttacatctgcacttgacagacaatcaaggctggcgtctgtatctggaccaatatccggatttagcgttcaaaggtacgtactaccggacattcgaggatctatcgggacattattatcgtaaaagcgagttgcaggaattgatcaactatgccgccatgtacggcatagagatcattccggagattgaccttccgggacactgtctggccttgcttgcagcccttccccaactgtcatgtaaaggcggaaaatttgaagcctatccagaggaactggacggacaaaaacggaagagagcagatgagaatatgctgtgtataggaaatcctgaaacctataggtttgtggaaaaactggtagcagaactcactgatctcttcccttcatcattcatacatctgggaggagatgaagtgtcgacacatctatgggaacaatgtccgaaatgccaaaagatttacaaacaagagaatatgacttcatggcacgagttacaggactattttacgaaacgagttagtgaaattgtacgttccaagggaaaaaggatgataggttgggatgaaataaatgaccgtaatgccgctgacatcagtgacgtgatcatgatctggcaacgtgatggaagagaacagcaacagaaagctttgaaaagagggttgtcagtcattatgtctcctaaggatccctgttactttgatttcgggtattcacggaattccacacgcagattgtatgaatgggaaccagttggcaaagaatgtacgaatactcaagcacatctcgtcaagggaggacaggctaatttgtggactgaattcattacaacctcggatgaggtggaaaggatgttatatcccagaacttgtgccttggccgaaaccctctggaacacgaaagaaaagaaagaatgggaagggttccgacaacgtatcagcaagttcggtgctattatggaaaaactgaatatctgttacttcaaagacgaggattgggataacacaggttttgttccgcaaagcgaacaaaggccccgtcttgtatgtcctgcccgtatcgataccaatatgaagggaatcaagtattatatgcctgaatatgcgtttgacggtgatatacagactttctttgcaaccccctattccttaaaaaaaggagattattttactcttactttggaaaaaagacaagcagtacaggaaatcagaattgtgtttgatgtttcaaaggaacatccggaacatgtacaattatctgtcagcgaggacggtacaatatttaagaaagtagctgcagataacaaaaatggagaattgtcagcatctttcagtacactagccatgattaaagccctcaaaatggaattgacaactccactgatggcccggctgactatcaaggagattatccttcgctactatgaataaacaagtataagaataatgaaaattgttatgataaaaaaaattatatatatttctctcatctggatggtatttcacggagcgagtcttcatgctgccagtttattggtagaagcagaaagtttcacggaaaaaggaggctgggtagtggaccaacaatttatggacttgatgggatcaccttatttactggcacacggtctaggtagtcctgttgaaaatgcgagtaccaatgtacaacttccagaaaatggcacatattatatttttgtacgcacctacaactggacgtctccatggcaggagggtgaagggcccggattgttcggtttgtcagtaaacggaaagaaaatctcttaccggttgggtattataggcaatcagtggatatggcagtatgccgggcaatatcaggcaacagaaaagaatattcacattgttttgcatgacttgaaaggttttgacgggcggtgtgatgctatttattttacgacacggaaagatgatattccgccatcggatatggcggctttaaataactttcgtcgtgctaaacttggattattagcccccccaaaaacagaatcatatgatttagtagttataggtgcaggtattgcaggtatgagtacagcagtatctgccgcccgcctgggctgtaaagtcgcacttatcaatgatcgccctgtagtcggtggaaacaatagttccgagattcgtgttcatttgggaggagctatcgagatcggaaaatatcctgaactgggggggctgcaaaaagagttcggtcccgtcaaggagggtaatgcacaaccggcaggcaattatgaagatcataaaaaaatggaatggctgcaagctgaaactaatgtttccctgtttcttaattatcgggcattttcggtgaagaaggaagaggaccggatcatctcgataaccgcttgtcatattgaatccggtgaagaaatcgaattttatggtcgtttatttgctgactgtactggtgatggcactatcggttatctggccggggcagactatcgtatgggccgtgaaagccgttctgaatacggtgagactatagctcccgaaatagctgatagcttagtaatgggcacttctgttcaatggtattctgtggaagacacaaaaacatcctattttccggaattccggtacggcatcgaattcaatgaggagacctgtgaacctgtcacttatggtgaatggacttgggaaaccggaatgaataaaaatcagattaatgattctgaacaaatacgtgactatggaatgttagttatatattctaattggagctacttgaaaaatcaatcggaacgaagaaaatattataaaaaacgttcattggaatgggtagcctacattgccggaaagcgggaatcccggaggctattgggcgactatgtactgaaagaggatgatttaacaaagcacgtagcccatgaggacgcatctttcactactacctggagtattgatctgcaccggcccgaccccgagaatacccggtatttcccgggacgggaattcaaagcgacgacagaccatgtagtaatttatccctatcctgttccctaccgatgtctttattcccgtaatatagacaatctgttcatggcaggacgcaatatcagtgtcacacatgttgccttgggaaccgtacgagttatgcgcactacaggtatgatgggggaagttgtaggcatggcagcctcactatgcaaaaaatatcaagccactccccgtgacatataccattattatttggaggaattaaaatcactcatgcaaaagggagtgaataaaaagggattaccgaataatcaacgatataatgaaggaggcaggctaaaccagataccgaaggtaaagtaaggatacatctctgtctgccagatttccacatacgaaagtttaacaatttattagattaggcattatgataagaaaaatcatattcttagaaatgttattattgggaatagctacattcctgtattcgcaagatgaaatttccaaaataacaataactcatggaccttacttgcaaaacgtgggatctaacgaagctaccattgtatggataacggataagccctctataggatgggtggaactggcctcagatggcaacggcagtttttacgccaaagagcatccgcgttattttgacacgtctaatggcatcaagaatacatcaaccatccatgccgttaaagtcaagggactgacaccgggaaaacaatatcgttaccgtgtttttgctcaggaagtgttgaaacatactgggtataaaatcatttatggaagttatgcttccactgatgtctattatcgtaaaccgcttacttttcatacctgcaatccgcaagcgcctgccacctcttttgtaatggtcaacgatatacatggggacaacaaactgctggaggacttaatgtcccgttgtaaccttacgcaaaccgactttgttctttttaatggtgatatgctctctttcataaatagtgaagatcagcttttcaaggggtttatggatacggctgtacgacttttcgcttctgagatcccgatgtactacgcccgtggcaaccacgaaacacggggagtatttgcaaccgaaatccaacgttatttttctccctgtcaggaacatctttattatgcctttcgacaaggtcctgtctattgtattgttctggatacgggagaagataagcctgattctgatattgaatatgccggtattacccaatatgacctctaccgtaccgaacagtccgaatggttggccagtattttggaaagtaccgaatataaagaagcgccttttaaaataattgtagctcacattcctcccgcagttactgaagctggtcccgatgaggattggcatggaaatgtagaagtagagcagaagtttatgcctttattacgccaggcttatccggatttaatgctttgtggacacttacatcgttttgtgcgtcatgatgccactgacaaaacgtctttccccgtagtagttaattccaatacatctttgctacgtatttatgccacgaccacacagatgaagatagaggtaatggatcgagacggaaaaatgctggatgaatttatcataaaaaaataaaaagctttgcattagtacttggcaagtaattattcgggtgacaattacttcttaatcaatgaagctggtttctgcagattctgcatgtatgagaggctgatgaatttaggaataaccaacatttacggggtaatccagtcgatgtgcctaccatgagcaaggagaagttacgcaagaccaatgctgtgaattgtagcaaattggcccacgagttacctttcggttcatttgaaaaggaattatattctggggaggaaaccacaaaaatacgctctttataagactaagaaacctgattgcaaaagacagcatacataccaagaaccgtatcaagtctttgctcgtttttatggtgtggaaatatcgagaatgtttgcccgatgtaccattagctagggatattcctaaaataggaaaatttaaggcaactaattcattgcgagttagttgccttttggagtttgcccgacatgggcataatctaatgggtgtaagtccccatcgcagccttatatcggcaagcgtacagccgacggcaatggtgtccgtagtgattcggcatctaaaggaagtcttaggcaaagcactgacctgacgtacagaaacttgatactaaggcatatgagtgtgggtaagtctgccaaacaagataaagccctatagctatatggaacactcggtgtaaatcaagcaggtataagtgtgaaagattatattcttaatcggggaggtctcacggacgtgtggagcatgtgtttagattgccaaacacggagtaaagcttattgtgagaagtcagcagaagccatagtacttaagttctttttaaggaagggctgaatcgcaatagctataaacacgtaactaactctaaataggaaagaatgcataaaataagagtcatagaaagtacacttggctaccctcaaaagaataggatggaatccgaaagctatgagggagtgcagacctatatggacatgaaagacggcagtttgatagcagtgcaaccaaataaagatgacttaatgagtcaaattctttctcccgacaatctcaatcgtgcctatctacaagtggtacgaaacaaaggggttggaggtgttgatagaatggattttaagcaactgcttccctatcttcatgaacacaaatcagaacttatcgagtcgatacgcattggaaggtacaaaccgaattcagtgcgtagggtagatatagccaaggataacgggaagaaacggcttataggcatcccaaccgttgttgaccgcttgatacaacaagccatcgtccaagtgctatcgcctatctacgaacgccagttcagcccaagcagttttgggtttcgccccgacgtagtgcgcatgtagcattgctccaagtgtgctgttatacaagcgaaggctacaaatatgctgtaggcatagaccttgttagattctttgatacggtaaaccatagtttcttactgagaatactatcaaggacaataaatgacgggcgtgtcatttctcttatacacaagtatcttacaagcggagtaatgataggtaagcattatgaaccaagtatagagggtacaccacaaggcgcccctttgagccccttgctcagcaatatcctgctgaacgaactagacaaggaattggagagacgtggacactgctttgtacgctatgcagatgatagcatgatactgtgcaaaagtaagaggtccgccgaacgcgtatgctcaagcataacggacttttccttctatttcacgaaaggcaaatgcaggctgtgtgttcacaagacaacaaaagagaaattcaaacgtaaggttaaatctcttaccagacgtagtaacagcatgggttatgcccaacgtaaagagatactctggcaaacctttagaggttggatagggtatttcaaatatgcagacatgaggagtctgctgattccattagaccaatggtatcgcagacacttgcgtatgtgtatatggaaatgttggaagagagtgaagactcgcttttcaaatttgcagaaatgtggaataccgaaaggtaaggcttaggagtgggcaaatactcggaaagggtattggcgttgtacgcgtgcctttcttcagaatgctattgaggacgagtctcttcggaaagcggggtatccaatgttatctcatctttataagcaaatacatatagattgcgaaaccgccgtatgcggaaccgtttgtacggtagggtgagattgtgccacgagaagcatgtgctaaatgcttcgcaactatgtaggagatgagggtaggtccctcgcaatcaacttgcaggaatctcctcagtactgaatgctttgataagattgctgtcgaccaattctttaagtggacatcaattcctacatctaatgtgttactttgtacacgtctcataagctatatcgttttagttaatgagttatgacttcaatataatatgaagtttactaaaatggtatagcttttttagtgctatctactgt

SEQ ID NO: 137 - DNA, 20646 bp, Bacteroides thetaiotaomicron
ttatattagtggaaatgaatcttgcatcaaagatactattttatctttaaaaaagaaactgaattttataacttatcttttttatcatcgaagatattcattgaaatttcgcgagaatttcagtgctaaagctgaactggaaacagccccaaagcaatgatccgaagcaaagattcaacaaaagcgaatgtcatatttaagtacttacattaaatgctgtatttcgatctaaactacctcatttttcattctcaaattccagtaaagtctaaaaatccagtattaggcttttcaaaaagaacaaaaggggtaaataaacctataaaaacacatctataagctttgtaacgcctatttgcttttttagaaacacgattcttgctaccggttcccactatgttcgggaaatatttcatgataggatataaaaacagagcctgtttaaggtttatgtatatatatatcaccattattccctttccgtgagaacttattttcttcatttatgcatttttgaaaaacctaatatggacttttagactttactggattttgaagtcccgaaattaaggtgtcagcaagccaaaaattagctattagcaaaactgaatttgctattagcaaaaccagattagctattagcttattcatttttgctaatagcctatgttcgatataactcaggtctgaaagaatgaagcatattgatctgtcattcagtttcgaccaagctcacttttctattccaaattcagtttgttgccgttccacttcatccaacacccgttgtcgttcttcttctgtcagttgcactttgccgtcggttgcattctcggataaagtagcttttacagttaatgagggtgtgtcctgactaatacagtacttctcatcataacagaaaggaagctccgcaggaacactttcaaattccatttcagcggcagtcggagcctgagtcccttcaaattgtacatgagctttcactttaatcttcccggcttttcgtgtggaacggatcagcagaggagccgaaccgaattctacggcacgagggttggcaccgatccttgcgtcaccaatgatttctccttccccttctaccgtgaatacgatattttcctttgccagacgacgaacgtttccgctatcgtccgtcacttcggcaactactactataaaatccgaaccgtccgctaccaagtttactttttgagtatctgcatacaagcgaagtttggtagaccggcgggaaggcattttcttttgggtacatactactttcccgtcgataataccttcggcaaccatatttactttctgccagttcttttgagtataactgtatccgcgcgcttcccagaaatcccatacattttcgaagatgacaggtgcgttcggcatatgccctttggcatgtaccacaggtttggtccatgtttttgttccatcgtagatagaaaggcggatggagtcacagttactgaatactactacatccttatcggagaattgtgacatttcatgagcaaggaatatcatcggtccgcattctgccaacggatgttggaggcttgccggagattggctgcggaacatttcatacgcatactttttctgacggaaagcgtcataaatgcctccccagtatggatcggggtgataaccacgctggtgatcgaatggatgccactgtgtgccaccgataaactgaccggtagtgcggtacatctcatcataacttttagccagagaaagtgcctgtatcagcagcggacgttcaccccaactgcggcttgcacggttattgttgttgtgggcataccagtcatctacgttttctccgaattcacgggtgaagatgcattgttccggtttgtcctccttttcgtcatcacccggccagccgtagactacatcgtaatgttcctttacaccggcagaatgcacatcggcagcggctatcggacgtcccggatacggatattcttccttcgtaatttcaagtgccttcagtgcaaagtcgagcggatagcgagtctcattcagaatgggctcccacatcagcacagaaggatgattgcggtcacgacgaatcatctcacgggtattctgatgaaccagttctccgaatttcgggtctttgttccagtattgccagccaggagtagcgacgatgacaaacaagccgagttcgtcacaggcatccataaaggatgggtcctgcgggtaatgcgctacacggatgatggtacatcctgcatcacgcagacgctttgcatcacgccattgctgtgaattgggaagagcattgcctacgtatgcgaagtcctgatgacgattggctccgactaattgtccgaaaggttttccattcagccagaaaccctccttgccacgaaattccgctaggcggataccgatacgggtcgttcctccgtcaatggaacggtttcctttctttatgcgggattgtactctatatagataaggagcatccggtgaccagagtttcggattcctcacttccatctgctgacggattgatttcttttctccggagttcagagaaagtttgccggacgtacgtttgataacgttgccttcggcatctgtaagggtcgtttctatagtgacggattccgaacgggtattatcgttctgaatctccgtttctacatatacttgtgcgctcttttcgctgatcttgtcaaagtgaacgaatacgccgccaccgccaactgtgcgggagtcgatggcatcggtaatggcaaccggagatttggcaatcatccatacatcacgatagatacctccatgataagcaaaatccagtgtgtattggggctttccgggagggtatgatttatcgttgctgttgtcggtatagacggcaaggaggcaggagtctccggcttgtacgccgtttgccgtcaagtccagtgtgaaaggcagataacctccaagatgttcctggacacgtttgccgttcaggtaaagtacttgctttcccattgccgcttcaaaatgaaggagtacacgctgtcctttcgttgcagtgggaactacaaaatgcttgcgataccacgcaggaccctgataattgcggcaaccactgccttcggcgggcatcagttccactgtgtgaggagtagaaacgacctcccaagaacgatcgtcaaaatttacagcttccgccccccggatatcgcctttgaagaatcgccatcccggattgaagttatatacttgtcgcccgcaatcgggaagcggaataaatccggcaaccgatatttcgggacgataagtatctgctgcctgcccatcgaaggagaatagcagtagaaatagggataagattaaaaacggtcttttattcatagtgctttttatttatgtattcttttttttatttttctatcattataacaatgtctttctttctgctttccggtgacacctttaggattgttacttttccatcttttaaagttgcttctaccgtcgtattgcccggagcatggagtttgaaatggacgttccattctttgggccaggcggggaacagaagtatttgtgttccattcgtttgtaagagcatctcctgaagtcctatcatgccgctacctccccagttgtggtcgggtgtccagtcatatcccggtccccagaaggcaggaaaacggtggggaccatctgatagctttgccagagaaaggcttttggcttcttcggtcagccccagacaggctgcccagatgttgtcttgcttccatccggtatgggagcggaatttgagtgcgtcgggatcatagaaatacgtatcacgagctatttccagattttccttgcctactccgtagatgcgccagggaaaaaccgggtagagttgtggtgtctctatattgttgattcgttcccagcttttggcgggagaaatcgtttgtttccatgccggagtcatggtagaagcctgaagattaagagaatccttgacttcgatatagcgtaatggaaccggaggaattgtttccagcatcttttgccacttttcattgttgcaaactttgatgtaagtctccaatacagttcgcagtgcggcgatggtgctgctggcgttgttggtcatcttgtaagtttcgcaggcagagccggggaacagtatcaggtgtccgtcaccatccagtgctttgcgtccccgacgggaagcgagtagtcgataatgttcgtcgaaaaaggtcagcgaactttcaatcaaaggcaaatacggagttatgtcggcaccggcataattcttcgtttccagaatcatctggcaaaattcaagaatagtatcccattcatattccagccacgcattgtattccagtcctttgtcaaaccaagccggacgtttgaaaccatattctgcgggattgggtaagccgaagttttctatctgctcacagaagcaggctccctcgtgttgccaatatacatggctgcggagttccgcattcttcaacatccggttatagaaattgaattgggaaggcatcatgtcgaagtcaccgcttttcagcatcggccagtagacaagacgctgattctgtgcagtcatcgttcctcctccccactttcggtagtcaggagtgaatgcctgcttctcgtctatgtggcagggatcgaaggtgaataaaccaccgttgaatttggtggggacactgccgtaagcattgcagcccagcatatagcggaaaagagtgtagtttcgggtgatttctttcaatgcatctttcgcgtcgctcttttctttatttccggtttctttttctactttgctgttctccttgttttcggtttcaccaatcgtttcgataaaactccgttgccagaaagcattccaccataggcgggtttgttttttatcctgtgataccactttagacgatatctttccttgtggggcaattcgttgccaggctgttttcagaccttgctcccattgggtgacggtttccgtctgttctgtgtgtaacacaactgagaaatgatgctttttagaagctttcagagaacgaaatccccaggcgcggtaatcagttccggcatatacactgtctgaagtgcctatatattccagattctctcctgacagataccctccgaaagtcagatttttaagaggattcatcatctgcgacttcacttcattcatcccttgctgggcaactgccacgtcaaacactgtctcttccgcattacgatgataaaacaaaaggcgtttactatccttttcggatgaattctccaatgaaatgaagtcggcatgcgtcatcgttccttttggaggagcccacttataggaacattgctgcccctctccttttctgatcagccgatcctggtatctccagttttcataaaagatttccgcctgcaaaggccggtcattaatcacttctatgtgtacaaccggatgaaaaacatctgcccagagttgtacttgtgtcccttcggcagagatttcaacataaccgtcgatcagctttaattcctgccggaaatcctttgcgtcttcaaaaggattgggagataaccggaggcgaaaacgtccctgcttcaactggcagttgttttcatcgaacgtaccgctcctgctcagataaaatagtatatccccctcctctacccatatgttcatgccgatatctcccccgccgcatggcatcgattcggaggaattccggctgggagtatcccaaacgacattggcatgctggctccaaagaaccgacacgccaacgaatatcattgctatagccagataaaatctcttcatattttcaaattaccaatcgtccgaacggaaagaccccaacggcagcccatcacaatatacatctccttccacataattctcaaatccatagcggacagctaccggatgcggaactttatcactttttactagcattttgctgcgttcgatccatgctttcgccgggtagaatactttgtcttcacctgccacctgaaagtttttcgattcaaaacagtttttaccgctgatccacatattcgcacgttcaaagctgacgacaatagtgtcattcttgatttcaatacttttgtaataagggctttctccgtttactccctctattccgtacgtctttgtcagtgcaaggagtgccagacgttctcccgcagcctgtttctttgcgggatgaattcccttttccattccagcatccagcagtacagccatgccgctgttagacacacgatgttcaacctttgcctgtgcttcccgtagataagcagaattaatcacctctttacctttttcagtgataataccatagtcataaggggctatctgacaatagtagaaaggaaaatcaccttgtttccattcggcacgccaaccgttaatcaatgtggtaaacatatccgcataggtatgggcacgattccagttatcttctccctgataccagatcactcctttcatggtcatgccgatcaatggatgcaacataccattatagagtacggtcggggtacggtttttcgatttgatatcagcttccgattgaggtatctttgcatccggaaatgctttcagccaatcggcagtcatccatgcctcacaagcagaaccgccccatgccgctactacgagtcctaccggaacttctaatatttcattgaccagtcttccgaaataataggccgtcgcactgaaatcacggacactgaccggagccgcttctttccatgagccgacaacgtcgttctgaggggtaatggtagaagttcgttttaccgtaaacaagcggatatgaagatttttgctgcgaagaatatccatattggcattctctacaggttggttcttgaatcctttcataggcatttccatgttgctctgaccggagcacagccataattcgcctatcagaatattattcagtgtcttttgggttccatcgtcgaaagtgatggtatacggtccgccggcttccggagtggagactgaaagtttccatgaaccgttcttgtctgctgttactgcatattgttttccgttccagccggtagtgactgttactttcttgttcggagttgccgttccccaaaggttggcattggtttgttgctgcatcaccatgccgtcagagaaaatagcgggcagtttcacttccgcacgcattgacaggcaggcagcgagcagaaagcttgctaatactgtgcttgttttaattcctgaacttttcattcttatttgtttttattcgctacatcaaaattcaaaggtccgagcaatcctgcaggaagcagggtgttttctgctcttcggtatttggcattcgtccatattccatcgaaaggagcttttccttcatcggctcctttgagtgcattcgcccaagtattggtcacttcgatttccagttcattcacacctttctttaaggctgccgtaatatcagcccgataaggagctgtccatatcgttccgcaatctatgccgttcacacggacagtagccagatcacatacttttcccagattcagatatacttgttggtcttctttcactttacttttccagcggaatgttgttttatacactgctgttccggagtaatagcgtatttgctcatcttcttctttgctccagtcaaagagttcctgtctttggatagtcttaccgtttgctgtaaaagtcacggtatattctgttgcttccaagcctgtctccgaagcttcttttaccgaatccttcttttccttgcgctctttttccgaagtttccttatcatcttcttctgcagggtatacgatgaagacagactcattcggagctaatgttaaagtgatttccgtacgatggcttttttgttcgtaaggaatgtcagcgttaatctcacccgtcaccggattccagcattccggctttctgccgtcgatgcgcatactggcggtaaatgtacgtgtttcttccagttggttggcgataaaataaatatccccctgttctccttgccgatgtgtccaggcaatgttttccggtacgatcagatcacgttccagaccgtatgaggagaaatcatcttctttatatggaagagaaggaatcagtatgcctgcttctttcagttcatttatcttttgttttacttccggagacagtgctgcggggtccggattcatcggacgtggaagtggtaatactaacactttgtaactggctccacccggtaacgtcatcctgccgttttccgctttcgccaaacggagtaacgcgtctttgttaaagctgtcataagcatatcctcgaagtggatttacccacttttcaggatcggacatatttgcggaatgtgttacgcctacaggacgcacacgtaagggttgtccttcgtttgccaaacggattcgttcgctttccacccgctctgcaccgaagatgcccggtaaagaaggaactaaacgttccggcaatatcgaacgtcttggcatctcttctcctgtaaatactgcaatatccgccaccggatgcccgtattgcagcaatgactggcaacgggtgatgtattcacagaaagcctttgcacccttattccaccacgtctggtcacgctggaagaaaaggccgataccatccaaagtcattcccggtttgcggtccagccaaggattatggacatatacatggaagaaaaggcggttgatgcctaaagcatagttgcggtccagtaaggctttcaatattcccggatgttcgttccatgttccgcgtacttccgtgaaaccttctgcctggatgatattcttgccgtagatatgcgctccgctgatggcatccagcatatcattcggtttgtcgtgggttgggctgttcagccagaattctcccatgggaaggtctactttctgataatgcagtaatccgtcacttaccatggtaggcgctacgcattcggctgagaactggcaatcatattctttcgcacagtcggccaagacttgatagaaaacatcgacgaccagttcacctatcgttgtgcggacatcacgcagaatcttttcgcttcgttcggcactctccatcggaatacctgccaacaatggtaaataaggcatcaggtcgtatccacggcgtttccggaattctgcggcaaaagtatcgctccagttctggcttccgcattcccaactatccacgtgcatgtattttaatacgcggcgggcaacgtccggatttgtctttacaaatgcttgcgcaaaccagttgtcgaactgcttgcgaacagcttttggattaaatttatcacattccagtccttttcctcctccggcagttgcgttcgtatgtccggtggcggtatgtcccatgcggagtagtttccactttcctttggggagagtagctgtcagtgttctctctttaaaattgtcgctcggactatttttaaagggatctgtcaggttgataatctgtgaaagggcatagcaatcttgctcccctatttcctccttcttcgtggaggaagctacacgccataccagtccggctttgccttcccactgatccagtcgggcttcccggtgcagacgcagttccttgattttcagatttggtttccattttgcggcatccatgtcttcacttcccggttcactgccttcgggtgtccagtagaagcggaaataacgggcagttgtagcaggaattgcatgagtggaattttcatctgtattctgccatccctgacgtgcagggacgagctgtttcaccaaacggtagttaaccccatcatcacttgccatcactttcaagcggtgcgcctgataattattgccactcagaatgatttcaatattgcggcaggtgaaaggctgttcgtattcatattggatatagcagggatatgatgaacggattactccggcatcatccatgttcacagtcttcttgatgtcaatatgatttcctgtggctatattggcacaggttatttgggccggcataacgtctgccgcttcctcttttacaggcagggcaaataaagaaatatcttcataaaaaccttcgtatgcctccggttgcggtaagtgtagtcctttgattttgccaccatcaacgattgtatcactccagactatcttttgcatcgattctttcggagtcatccacggaccaccagccaatgcaaaaccatcacaaatatgcattcctaactttaatcccaagcggtcggcttcttccatgctgaaacgaaccatttcccaccattcgggtgttagttgttgcgcctttccattgtattgtggtccttctttgatacctttgataggcatcagataagtacctcccagcccagcacgtttcattgcttccaagtcagccgtaatcccttctttggatacggctccaaacatccagtaccaaaaagtccaaggctttgcttcgtcagacggattttggaattgttcgcgaagtaaatgtgtttgcagagcattggcaggagatatagcagtgcatgccaataatgagattgcaaatatttgttgtttcagtcggcttttcattctaatctatatttttacttatagataagacgaaaaacggactgttttgtactcacagtattctccttgctcaaattaaactatttaatttcttaggcagtattgctttctacaaaataagtctcatttcaccgcttcttctattcgggatactaactgcggattactgggacgtgccgcagttccgaaatcaataatctgcccctttctatttattaatacatagtaaggcatcctgtctattttccattgcttacaaattttctgatagttatctattcccaaataatcagtcacatgaacacattcaattccccggtttttcaatgaatactcattcaggcattcctcccattgttctttgggttcactcacacaaatggaatatataatcaaatcatccgtagagaatttgctgcgcaattgttttaaaggttccatttcagccagacaaggaggacaccatctagcccaaaaatcgaaataaatcactttcccacgattcttttcgagcacatcatagacaggtttcatgtatggcatacgtgttgtatgctttgagttctcatggaattcgccatataataaattgtcggaaacaggctgtggattttttagatacgatttggtctgattatagatctgcatcacctgtgcacgtagatgtgacattttaacgattgagtcaaactgtgtacgtttttcgtgaaaagcaagtgtgtcattagtacataaagaaccggctatcaacttagtatataaatactgattcatctcactctcccccattgtagccatgatttcttctatcgaaggattctttttatctctgaaagcgatcccataagcaatatatctttctgcttcatcagcaacatcgtataagcgtgccgagagtatgcctttagtatatagtttattgatttcaggtaaaagtgtatgataacggtccatctcttttctcgttttaaacaagtatgacataccattgaataacagcgcataataataatcttgcttcagcaattcttcagtaaacagtactacatcttccattggcttgtacttcaccagatactcattcctacgttccaaacgaaaattataatccttttttaattcagcctcaaaatccttaacgtctgattccggtttcatattgtaattctgtatatagtaatatgcactttcagtgaacgctaatatctcctgatttagcttttcggcatcacctgtcactttaggatgaaaaagatctttgaagtctatttctacatgtatgctgtctcccgggtggatataaagatgttctgcatagttgcggatagaaacctcccttaatttggcataaaccggaaaacggaaagagaatgaaccatctttttgtatgggcgaacgatactgatttcccatatctctgaaaaatgggataatgagagtcagttccttttcctgaggatagaaatcccgatttagtactttgcctgtgatgactgcttcttcagcatactcttccaatgagggattactttcctctgtttgtgcagaagattcggacaggaaattactctgggctttttgacggcatccggcaaacaacaaggtaattattatcagaaagtataagctgtgtttcattgtgtttgaatattagtatgttcgtaaatctaacatttaagagttcttgcctctaaatgtatgaaattatttttagaggcaagaacttttgacaggttatctgtctcaattttagatatttcacattatatatacatattttgtgggataaacaggccgaatgctatagccaacgtacaaacttcctgatataccagttctttaccaattgcgtcaggatacaataggaaagcaaaataccaatcagccagggaaaataacccaaaggaagagccgtcaggccgatggaacgtccgaaagctgtgaaaggaataagaatgcctactgccataattaagaatgtcagccccataacaggccacgtagcccggctttgtataaatggtattttacgggtacgtatcatgtggacaatcaatgtctgagataacaaaccttctacaaaccatccggtctgaaacaaagtctgatgttcgggactgttacaactgaacacataccacatgaccagataggtagcaatatcaaagatagaactgataggtcctatataaatcataaaacgacttaggtcggatgcatcccatttgcgcggtttcttcagaaattccgggtccatacggtcgaatggaatggttgtctgtgatatatcatataataggttctgaatcagcaaatgtatcggcatcatgggcaggaacggcagaaaggcgcttgcaaacatcacgctgaacatattgccaaaattggaactggcagtcatctttatatacttattgatattaccaaatgtctttctaccttcaagtacgccgtcttccaataccatcaaatccttctccagcaagatgatatccgcactttcttttgctatatctaccgccgaatcgacagatatgccaatatctgactgccgcaaggcgcctgcatcattgatgccatctcccagaaacccaactgtattaccttgctcctgcaacagagagattatttgcgtcttctgcaatggagtgagtttggagaataaagtggtgtcttttactgtttctttcaatgttgtttcatccatttcctccatttctattccggtaagggagtgcccggtatcaatccccacctgacgggcaatagctttcactacggtatcattgtctcccgacaatattttgactgctactccatgcatatataattgttcgatggcttcggcggcagaaggtttgggaggatcaagaaaagcaagatatccgatcaacaccatttccttctcatcttcgatggcaaaattacagtccttctcgatgaaacttttctgggaaaccgccaatactctcataccttgccggttcatttcctcactgatcttttgcgcttttattttcaaggagtcagtcaaaggatgtatctccctgtcgaactcggcatacgaacagacatcgagaatctcttctactgctcctttggtaataatttggcgcttcccttgcctgtcttctataacgacagacatccttctgcgtgtaaaatcgaaaggaatttcatcaaccttggtataggcatccttcaaatgttccagattcaactctcttacatgagagaggattgccttatccatcaggtttcttagaccagtctgaaaataactgttgaagtatgcgtgacgaagaatacgtttactgttgtcatcgctgccgtctgcattgatatacttctccaacacaattttatcacaagtcaatgtgccggttttatcggtacaaagtatatccattgctccaaaattctgaatggcattgaggttctttacgattgttttctttttggacatggcgattgctcctttagacaggttggcagtcacaatcataggtaacatttcgggagtaagaccgaccgccacagatacggcaaaaatgaaggcttcgaaccagtcacctttcgtaaaaccattcacgaaaaacacgaacggaaccataaccagcataaaacgaatcaataaaaagctgaccttgctaatacctttatcaaaggctgtagtggcacgatgtccgaccagacttttggctattgtacccagataggttttattccccgtttcaaaaacaattccttttgccgcaccgctaatcacattggaacccatataacagatattatccaactctatgacacttcccttacgaaactgttgtccctgtacttccggaaacttttctatcggttcggactcacccgtcaatgaagcctgactgataaacaagtcttttgaatcgatgatatgtatatcggcaggaaccatatcaccggctgccaagtacacaatatctcccggaacgagttctgttatatcgatctcttcttcctgttctccggcacgtttcgccagacaagtgttttttaccatcctcattaaagaatccgtagcttcacttgctctccattcctgccagaaacgaagaacagcactgaataataccatggacgaaataatgattacccctgtccattcttgctctccgggttcagccatcaacacatccagaaataaggatatgatagcaagtcctgtcagaacgcctatgaaaggattgataaacgttctgataaacagtataaacggattctttttttgttcatggatgacttcgtttcttccataaatggattgtcgctcctgtacttctcccagcgttaatccaagctttgtagtctgtaaacaggaataaattgacttaccgggttgcgtggcaaccaaaaatactctctctgaattgaatgtgtactgtgatgaacgcagttttttcttccataccatactctctattttttttaagttactaactgcatttattaattcgatgcaaaagtaaggaggacttcgggaggaagccgttagagaatgattagagtggtattagaaaactattagagtttcttagatatgcgggagttttaccacaaaagtagttccctcgtccttatgagaagatacggtaagttcgcctttgtgaaggtgaatgattttctgtgtcaaaaccatgcctataccatttccgggagctatattcttgttttctccccgataaaacagtttaaacaggttttctttgtctgcatcggacattcctacgccattatcagacaagcggataatagcccattgttcccaataagctatcaggacggatgaagtccggttggaagagtacttgcagttgttctctaccagattcacaaaggcagtagtcaacagatagctgtttccgattacggtcagcacattatcttcctcagcttcctgctcaaatactaattcgatatgataatccggatgggcttttaggactaattctctggcatccaacagcagttcatccaaccggacctcttccattgtaatctgttccgactgatagtcggcttttgcaagattcagcaatccgtcgatcaggtttatgatccgtcgcgaatcttgtagtgcattgccgatagctgcctgatattgtccggaggttcgttctttcaacagggccagatccagttcggctgtaagggctgccataggtgtacgtaattcatgagatacattgctgacaaacatcttttgtgagttgaaggacttctccaaacgttccagcagtgcattgaatgtaatactcagttctcccagttcgtcctgttcgttttttacaggcagtcttttgtcgatatgtgaggcggtgattttctccgcttctctcacgatattgcgtatgggctttaaggtgcttcgggagaggatataaccgacaatcgccaacacgctcaatcctcctataaataacagaatgagcatatttctcagtgcatcccggttagcgtatccatagccatcataggcagcggcagtgacaatgtagtattgtccttcaaacggatacacaagtcctattgcctgatattcgtccacatagaaactgatattctttcgtttcagaatacgttttaccatttcgggtgtttccttgactatgtcgttttgaagggcatcatgatatagtattttaaaatctgtggtatagacggctacctctacttcattaataaacttctgattgttcaggtaaatagactgcatcgtttttgcatctacctgattattaagaaataagtgggctttggttatagcttcactttgcaggttgcgaaagaaagcattgctgcgcgaatgctcgcttacgtaatagacagctatgacaaatgcgaagaataccgcagctgtaatgcccgcatattgcagagtcagcgttgtccggattttcataatttgtcagtcagtatgaaacccatccctgctttggtatgaataagtttcggttcaaagttacggtctatctttttgcgaaggtagttgatatatacatcaatgaagttggttcccgtatcaaaatgtgtgttccatactttctccgctatctctacccggctcaatactctttcggcattttcgaccatatataacagcaggttatattctttcggagaaagtttaatggaaacgttatttcgttctacgtccttccgctgaagatcaatgcgcagatccgcataaacaagttcctgtggcaattccggtacatttcccgagacacgtttcaatagaactttgattctggcattcaactctctgaaatcaaagggcttcaccatatagtcgtctgcaccggcatcgaaaccatccagcttatcgttcgttgatcctaatgccgtcaacattaatataggaatacggggattggacttacggatttctttcgtcagctcaaatccgtccatcttaggcagaacaatatcagatataaccagatcgaacgtatgtgcctgaaaaagccgcagccccattaatccgtcataagctaccatggtctgataaccattttcttccagcccgttcatcagcaaacttgccactctgggttcgtcttctataattagtattgtgtacataggaaagaactcgttaatctgaatctataaaacgaaacaaaaataatgattattcctcacttatgactcttttaaaccattttatatttgctatatttgcgcaattatcatcagttgaacttatgtcaggtattaaagagttagaactattattatccaatatggagcctgtgttggatgagcgggattttgttttttgttctttcccaacgctcgattgggatcaaatgcgggagctgaaccccatcgggattttccatgagaaagagggtgtaaccttcattcttgacacgaaaaatgctgtagacaaaaagatagattacctgtccgtttacagacttatcactctcaatgtacattcaagtctggatgcggtggggctgactgctgccttttctgccaagctggcagaaaaaaatattagtgctaatgtggtggcggcctattatcatgaccatatctttgtgcctgaagagaaagcggaacaggctttggaggctattcttgaattacaaaaaaaggtacccaacgcaatgtgagtacctctttatttcatttatttattccataaaccggaaaatgattcgtccgctctgcggaccattcacccattttggctgcgatgacgggccacatagatcagtcgaatttactttattgcgtacaggaggaatcacattcaagacagaaattccactttcaggaagcgtataaagtaaacggtcacgaccgtcacgcggctgatatactccaatgtaagcatccggagtttcattggttaggctgatagtaccctctttcgtacggatgttcatccaggaaacactgccgaaatatcctttgaattcgggatatgtgaaggtttcacccggaataggatcgttatagtcgttttcccagacatcgtattgcgtgccatgaatacggttctgccatacacggtagggccccgctcccagccagcgtttactgatcacctgatcttcgggatagtcgaagcagattcccattaaatctaccacgccggagaaattgtaggtataatccagcaccgcttctccacttggattgattgtccattgcgctttatccagattacccagtttataattggcagtaacaatcagattgcctccgtcttcttttacatccagtttcgtgaatacagcagcatcagggaattcgctgtaggtacgatccttttctttcgctttttcgtcatcgtgattataaaactgatccaatgagcggtcggcacgacgggcaccgatgaaacgagggccgttggcaaagctgatcttgcgattgtttacggatacacctttcagctgaccgtctttctttgagaaaatgaaagtatgattcttcgcttttacggtaagttcattttctgtttctgtagaggttaccttattagataagggagaaagcacttcattagcctgattcagtttgttcacagggaaagtccagcgccaaagttcatgaccgtatcggtcgatggctgtgaggaaaagggcatcggcatccggaaggatcgttgttttaatatccagcacacctgccgaatgggctgcgacatcacttccttgcacttccccttgtttcagaacttgggcagttgtattagaagcatctgttgcggtagggaacttcacctgtttccaaaggaaacggcaagtattcagattcagataatcataacggttttctacggagaacttaccgtcaaactgcttgtcgacagaagtattcatgatttgtaccggactccataactgcttgattgtgtagaaactgccttccttttcatgatgtggccctacaataccgtcagcgccgaaattcccttgattatcaatgaatccgtccatatcgacacgcttcactccttcgtctgccagtacccaaaggaacccaccgatacagcggggatgtttgcgcatcatttcccaatagtcatataatccggcaccatgaccgccatcatacaaaccgtggagaaattctgtcggcataaagatttccggcaaacgcatatagttctgactttctccgtaagaacggtaatgcatggtttcaaaaccagagaaattgccttgcgggtgaatcaccggacgtttctgcggatcgtacttgtgaaattctccatcgagttcggtattccatcctttttcattaccgttactccaccagataatagacgggtggttaacgtcacgttctatcattcctttgatcaggcgtactccggtcggagtatcgtatttgccatgccagcctcctaattcatccatcacgtaaagtcccaaagaatcacaagcttccagaaactccggatcagccggatagtgactcagacggacggagttcatattcatgtctttcatcaaaagaacatcttcgatatttttcgctttacttaatgtacggccactttccggacggaagctatggcgattgacaccacgtaccataatgcgtacaccgtttacgtataatccgtcactttcgcgtacttcgatggtacgaaaaccgaatgtttctgtctcgttgtgcagcacttttccgtctttgtccagcaaagaaaactgagctttataaagattcggcgtttcggctgtccacagagccggatcagagaccttgagctgtaaagaagtccagtctcctcccgcttttacagggacggtcgtttcagttagttttttgcctttattgtccaaaatctgtgcccggatactcattccgtcattagacagattggtatagcaattggcacggaaggaaccatccatctgcgcatcgatggcgatatgacgtaaattaatcgcaggttttacttccagaaataccggacggaaaatacctccgaagttccaataatcggcacgtcgctcggcaagattcacactggcattttcgctttcctttgaaacggttacttccagcaggttcttttttccatacttaaggaaatctgtgacattgtatgaaaaacgatagaaagctccctgatgtttcgagccgactttacgcccgtttactttaacttcggtatctgtcatcgaagcttcgaataccagatttacctgctgtccgcggaacttctcggggacctcaaactcgtacttatacattcctttttcatcggcgataccttcagggaatgctttgccataaaaggtgattccatactgataggtgccaaagccctgcaactcccagcatgacggtacaccgatcttcgtccatttgccggaattgcgtccgtcagtacagaagaagtcccattctaccatatcatcacatccgtgaccggaaaggtattgccgttccgtttgcggaagggtttgagcagccagagtagttgccaacgccaaggttgataataaagtggttacttttctcattgttacttttattattgtgttagtt

SEQ ID NO: 138 - DNA, 20604 bp, Bacteroides thetaiotaomicron
cgcatagactcttccttatttattattcgtatatttctctatatttcagtctgttacacttcaacaagcatccaaatgtagcaaattaatataataaaaaaaatcgcaaaaagtatcaattgtacctaaacggtcaaaaaaggggattattacttcaaaaaacatgcttattatgagttttttttcctatcgtaattaaagaactttttatagcggctgtctatctccgattttcatcttcaccaacactaatcgaaataccctatcaacaaaattagtttatagaatgaagtcttgattcattgacctgcccttcaaataattgccattgaatatatgtatttcaaaccatacaagaatgaatctttacctagtacagtaatgttatgataaataaggctttcttttttcatcaatctatggaaaatttaacttccatagctatagactccggtaggtttcataattgttccttcgctatcttcactcctttctatcataccgtaatcctgttaagtcatatcgtgacaaacattcctattaacatttctccatcatttcagataaaattataaaaaacattaagtttttttctatcacctatcacccaccgctccacatccatttattcatcgcacttgcagacaagatgacaagttatccgaacctatcaccacatctatcacctatcaccacttgtgtcatccaaaacattaatacttatcacctaggatattagtagataagttctactctattagaactaaacttacttttctctaatagataagttattttccacctattgaaaactataaacgcaatctctgtttttataaatgcaagcttcatttataaaaacaaagatttcatttctataattaaaacttgcatttgtagtttataagcggacaaaaacaactttactattagaggaaaggaactttgcaataggaagaaaggaacttttctattaatagacaacacgtaaacctataatagacaacgaaccaaccgatatataaaaaactttaagaaaagtacaacacaaacatttgtgaagccgaataataaagcgtacctttacatgccttccggaagaaagacattaacaataacaaattcaataattagatcattttacagacacattcattatgaaacttactttgatgcgggacaacggagggacaccaaccatgcgaacgttggacataaacctacaaatagaagcgatgaagcatgaaacgaaagcccaaccgatcagcaatctacggacaagcatacgttacgcatcaccggacgccaagctggacgacgccaagaaattgacaaaagtcatcccggctgcagcttttcgcaaaacggccaacggcatacagatgaccgcatacaacggaatcatacaaatagaagtcaatcatctggcaaacttgatggaagtgaaccgggtgaagcaggaagcggaagagctttcgcagacttatcttgctttcatgggttccagcggacattccgtaaaaatatgggtacggttcacacgaccggacaaatcacttcccaaaaaccgggaagaagcggaaatctttcaagcgcatgcctatagaaaagctgtcagcttataccagcctatactctcctattccattgaattgaaaaatccggcattagagcaattttgccggcaaacatacgacccggaactttattacaatcccgactccaccattatgtatatgcgccagccaatggaaatgccctcggaaacgacctaccaagaagccgtacaggcggaaacatcgccattcaagcgattgatcccgggatatgacagtcttgaaacattgtctgcgctcttcgaagtggctttaaacaaggcatgccaatctttaagcgaacttcagccggggatatatccccgatccgatgaagacttgaagcctttattggttcagttagccgaaaattgcttccaggcaggcataccggaagaagaaaccgcccgttgtgcaatcgctcatttatataggcagaaaaaagagtttctgatccgccagacagtacagagtgtatacaccatcgccaaaggcttcggcaaaaaatctcccctgtcggcagaacaggaactggagctgcgaacggaagaatttatgcaacgcagatacgaattccgttacaatacaatgacgacagtaacggaatatcgggaacggaatacgttttgtttctacttccgccccctgagcagccgtgttcgaaacagtatcgccatgaacgcaaggctggaaggactcagtctttgggacagggatgtggtccgttatctggactccgaccggattccgattttcaatccgatcgaagattttctcttcggactggatgtacgttgggacgggcacgaccggattcgcgaactagcagcccgggttccctgcaacaaccgacattgggcggacttgttctatcgctggtttctgaatatggtggcacattggcggcagacagaccggaaatatgcgaattgcactgtaccattgctcgtaggtccgcaggcttaccgaaagtctactttttgccggagtttacttcctcccgaattacaggcatattacacggaccgcattgatttcagtaacaaacgggatgccgagatatccctcaatcggttcgcactgatcaatatggacgaatttgaccagaacagagtgaatcaacaggcttttttgaaacatatttttcagaaaccgattgtcaatgtccgccgtccacacggtacggctacgcaagagatgcgtcgttacgcctccttcattgggacgagcaatcacaaagacctgctgacggacacttccggtagccgccgttatattgttgtcgatgtgaccggaccaatcgattgttccccaattgattacgaacagctctatgcacaggcgatgcatgatctatacaagggggaacggtattggtttgatccggaagatgagaaggtgatgaatgaaagtaaccaggagttccaggtgatgccaattgcagaacaattattccatgagtatttccgggcagctacagaaggagaagaatgcgaacaattccttgccatcgaaattctggagcaggtgcaacatgatagcaagattcgcgtatccgattgcaatattattcagttcggaagaatattacaaaagaatcgggtgccttctgtgcataccaaacgaggtaatgtgtatcgggtggtacgaattaaagcaaaaagagaataaatatatgtgtgtgccgacggtgacaggtgatagatcagtgacagatggtctgcgacctatcaccagcatacattactgatgaataaagagtttcaggaggcggtgacaggttgaaagagaaaatcaattttcattagtttccttcactttcttcccgccaataatattcagaataatgttcatagctccctttcccacgaaagaagtacctaccacgacaactttgggcaaagacttcagagcctctttcacagctgcacgctttgcttttcttttagctttgattccatttaatgaattcattccatcaatcagatagttacgcgtcacgtaaccgatacgtaaagtcatcagcgaattcacgatgccatcgcatatcgaaccgatgactactcccggaattttcacgttagacagaatgctcaaaaagccggtatctcctgaaactgtatctcctatgtcgtccaaatccacatccacatcggcaccatcggcggcagcatcggaaacgtcgatatcggacgctgcatccgaagactggtctgccaatgagccgaagggggcaaccgaacccatatctctaaagacctccgatgcgacgaaagtcattaatgaagtaaccagaatattgacatactgccggaacaactgttgccttgtaggtcggaagccggaagcaacaatcacatcctctatcattttataattcatataaagcacggacaccgtgtccagctttccgttctgcgaaatggcggtaatcataaaaacagatttagcccattcgataacgcgacgattgatgccgatgatacggaccgaatgcatatcctctgtacgcggacctgacgtttctttcagttctcccccttcaatgcgcaatttcagctcttcgcttatgatttgcaccagttcttccttactcgttgcataacgttccaaatcttcacgcaatctctgctgatgcagttttcttaactcgggacaggacttatctttaggtatataattgcagttatccgccagtttatgtccaaacgcaacaagttgtgcagtattccactccccatcaatagacaaagccggaaactgcggagcacgatgcacccgaacgaccggacgtataacgacggcataaaatacaaccagaatcaaggtgtaaaaagcatactctgcccacgcaacctgcgataaggaggctattttctcaccaataataatgatgttacccaacaataaaatcacaaaagagcccaaaaacaggagtgtgataattaataaatttcgtttcattggcttattcttatcttattgaatccttaaaactctgaacttgtgcatttattgaccgaagcaacgcatccttcctgtcaaattcttctttatcagacaccagcgcattcagatacattgttttttgttgttccaaaaaatcaatgatactttgtttgcgtacaggcacatactgatcataaaggtcattagccgccttatatatactcttcccgacagtcagctgaagatatcctttgatcgttttcccggtatgcgtatgatcgattccggtgatacattccatcgcttttctcagaaaactctgaatttccattgtcgaataagtcccgaacggattgggtattccgatatgcggaacagtcggattattaatattcttcacatcaaaagctccctgcaaatcaaaatcgaccaccggaaaatccgtcacttgcggcactgagtcaaaaggtgcacaacctttctgcttcagaaaagtattcatcttctctataaaagccacatcatctttcaagttagagagtttccgcaaatactgccgggccaggctatgttcatgggaatcaaggaacttactttttatcgccgctgacgaatcagtcataaactttgtaacaaggctgcgtgtcgcatctttccccttcgctccaccggcaaatgcggaattgcatccggaatcataatactccctaacgatttcagtaaactctttcaaatcatcatccatatagacttgcaccatttttctaaaatcgctcccatcgtaactaagttcactcgcctgacggagtaactcgtcaaacgaagttgccgcagcctgatattctatatcgattgcttcctgttggccaattgattctccgactaaattatccagtttttccaactgattcagcgttcttccgattacgcttctcagacgtatatcagtactattggagatcaccttgccatacaaatccttctcaaatctctgaaatttcgcagcttcttcctgaagatcctccattccctcatagctggcagcatccgccacttttcccaagttcaaactatatatattctccttcaactggaagttacgtctgcccatttcattctcggcaaattctacctgtgccttaattacagcctgcttctcctcttccgaatgccagtaagccgcttcaaacacattatgtagaagacaaaccggaactttcggattattctcctgcagcaacttcagaaaacgattggaaaccttcgatatagcagaatttgaactttgcacaaatatcacgaaatctgccctttgagagatcgtttcataaataggattatccaaattcacatacccgccatccagcccgggcatatccaccagaaatatattatctttcaaaagctccccaccggaagttgttatggatgtcaccagcgtatgatctgtatttatcacgctttcttccaaagctaacgaaacacactcctccagattagcatcattcaattctttcttttcaatgcttatctcggaaatgttttccagtttttcaaatccgcgcaggctatcaatgaccgaatcaaactgttctacctttctagctttatcagcaacagaaaaaatacgggtaatggattcctcctgtccttttgaaataatggacggacgcaccgtacactccaagaaatgagtggggctgacgtgagcatgtgctatgagatttactaaagtagattttcccgatttcacgggtccaaccactaatataagaaaagatcctccgtcaaactcagaaacacgattgtttagtttctgagttgatttacaaacagcctccaaatcttttattccccttactgactccagagttgacatcaattccttagatctgctcttcagtatattcaagaatatcttaagctccgacgaagacattgtttccactctttcttctataaatttgtatttacccataaacgagatttaaataatggtacaaccgactattcacatgtcattataataatgatgataaagttagcagtttgtcgggaaataaaaaatgtatagagcacaaagattgcataataattgaaagttcgtcaaagttttatggattcaagttcaatttatcaacaaaaagtttcttcatatccgcaaaaaacaagatgttaaaaaccgaaaaagcatgcagtcttttcggtttctattcatcatattaaaataatacacgcacatggatataaaagaacttgtagatttatgtaaaaaagggaatgagcaggcattaagtctactttataaaacctattcgaaaaagatgatgagaatatgccttcattatatacctgataaacaaatcgcacaagatctcctacacgacggattcattgtcattttcacttcgattgagacattacgtacccccgaaaaactggaaagctggatgggaataattatgaagaatatttcattaaggtatctcaaccaaaagagtacaaactctgcaattcccttatctgatatccctgaagacgaggagcctattgataatccgctatcatctgattctattccttatgataaaataacagaaatggtagagaaattgccagaaggatacagcaaaatcttcaagttagctgtattggaaggattatctcacaaggaaataggtaaactgttgaatatagctccccactcctcctcttctcaattattcagggcaaaagtcttacttaaaaagatgatttctgattacaggctgattcttatactagtgattttattttttttcccaacgatacacgactatctatactggaaaagaaaagagactaaagataatcattggtctaacaatgtcattcggaaagtgaaattagataagaaagaagaaaatgagagcattacctcttccggacatatctctcactacaaagaagaccccccttttaatactactttagcaaacctcccccggttagcattagacacaagtgcaacaggattatctaccacttctgaaataaaagactcagtagagaaacagcctgttgccaaaccatcttttacatgggagcatgcagagaaaattattacattctcatattcaagccaagaattcacttcactccccaaaaagaaaatagggaaatggaaaatgatgttggcagggtcagtcggaccacaactggcacaaaacctatacaagttgatgacaacaccacactctgacggtttggaaagcggtctcccccagcaagtcaatacttgggaagaatattatgactatttaaacacccgcaatcaggaaggaaccttaggagactcgcttacgctaatgacaattgccaagaacaacagtggaagaattatagaacatcaacaccataatagccccatcactatcggactagcattgaacaaaaagttgaataaccactggagtatagaaaccggattacaatatatttatttaaaatcagagttcaccacaggaaaggaatatcggattcagaaaacccagaagctccattacataggtattcctctccgtatttcctaccgttttgggaattataaacaattctcattttactcaacagccggtttacaaatggaaatcccgataaaaggaactctgcatacttctcatgtcacagatagtgtccccattaatttgggttaccagtcattagatgtacctttgcaatggtcaatcaatgcgagtacaggtgtacaataccactttacacctcacaccagcatctatatagagccaaccattaattactatattcccgatggaagttcattgcgcacaatccgaaaagaacatccggttacgttctctgttcctgtaggcattcgtttctcttggtaaaaaattcattctccatgcagtcttccggctgatagtttatcataactatagaacagttagaaacaatagacaaatcagatgcagaaacgacatacaaaccgtgaacgttattttgaggaacaagctcagactacgagaaattattatattccttatattaaagaatatactggaaatctgccaaacaaagtattggaagtagggtgtggcgaaggagggaatctgcttccctttgccgagctaggttgtgatgtcattggaattgatattgccgcatcccgaattgaacaggcacaaaacttcttcatcactaaaaggcaaaaaggaactttcatcgcttctgatatcttcttattaaaagatctacagaaacatttcccgcttattctcatacatgatgtaatagaacatatcgacaacaaggagcaatttctgcgcaacttaaaaaaatatctatcgcctaacggaatgatcttcattgcttttcctgcctggcaaatgccattcggcggacatcagcaaattgcaagaagtaagattatctctcatatgccatttatacatttactacctcgtatgttgtataaacggatattggaattattcagcgaacaagaaagcacagtcaaagagttattaactatcaaatacacccgatgtacaatagaaatgtttcgaagagtagtaaaacagactgattatcaaatcgtcaatgaacagttatactttattaacccacactacaaaattaaatttggactaacccctcacaaattaaacaaaacaatagcatgtatacctttcattagaaatgtattcagtacaagttgtttctatttaataagaccaacatagcattttatttcattatttacattaatattcaggaagttatcaacaggctaactataaaagacaaacagcattatcaatcatacaaagcacacaaaagtcatattttgttctttattgaacagtatttttccaaaactataaaagggctgcgttaaatttgcatctgaaaaagtacgttaacattttaaattctaaaaagcatgcatttatctaacacattgccccataataatcgtatagaaatagctgatgtgctacgtgggttcgctgtaatgggaattacacttatccattttatcgaacggtttagcctcaatagctttccggaagagacctgtaactttctgatatttacggatagggtaatttgggatagtgtatttttcaccttttccggtaaggcatactgcatctttgcattgctttttggatttagtttttttattcaagacaattcacaaaaacttaaagggaaagattttcgtgggcggtttgcctggcgattagtattacttctttttatagcttgtattaattcggctttatttccgggtgaaatattggtactctacgccttgcttggttatgtactgatcgcagtctgccgactctctacccgaacagtcacgatcatagcagtcattcttctacttcaacctattgaattgggacaaataatttatgcacttatcaaccccgactatgttattaatgctgatcttgatgctccatactgggagttagtcaatacagctcagaaagaaggttctttcctcgaaatgtgcaaaactgccatatggacgggtaatgttgccaacatgggttggatgctattacacggaagagttactcaaaccgccggtctgtttatggtaggtatgataattgggcgtagcaacgcgtttctctattcagaaaagaatataaaaatctggattaaagtattcatcatagccgttaccgcctttttccccatttatggtttgataaatatactccccgactttataagtcgcgaagcactacttgtaccttctgtccttctatgcaagtcactgtcaaatattgtatttacaggaatcatgtttgcaggtatcatactggtttattacctgacaacccttaagaatgttcttcataaatttgcaccttatggacgcatgagcttgaccaactacctgtcacaatctttaatcggagggttcttgttttacaactggggattaggactttatctgcatacaggcattacagcgtgtatccttattggtgtaagcgtattctttttacaatactttttttgtaactggtggcttcgttcacatcgccagggtccattagaatggctatggaagaaagcaacctggataaaggtaggcaagggataaatgatgctgagagataagaaaaggtgcaattcacttttacgatgaattgcacctttttagtatttttgctgcaaataacacagtctatagaaaatatcgaaaaccttctggtagtgcacattagaaagaaataccctataacaaaaaagctaagtaattgattgctcaattcttagcttttcgtggtacccagacccgcatttgaaataattaaagtggggaaaatgcgggtaaaaagaaaagcgcagaaaaacacagcaatccaactatatttcaagcatttacaattagattaaattttaatctcggttaatcaaattgcaaaatattcagcagatgtggggaaaatgtggggaaaatatctatatttgtatcagaatagaaacttaacccgtacgcccatgaaagtaacctttatcattaaaaaagcagccaagcgatatgatacagaatcaatggctacaatctatgtacgctttagaaacggcaggcaattagactccgttgctcctacccagttggctatcaatcctaacctatgggatgataaagatgaatgtgtaaaaacaaaagcagtctgcaatgaagagatgcgtactcatataaacgaagagatacgccatttgaaaacctatatagaaaaggtgtatcaacaggaaaaggaaaccataaacaaagagtggctaaaaataacacttgataaattctaccatcctgaaaaatacttcatgccagagcaagtggttatcaaacctaccaccggagaactattcgatgaatttctaaacaagcaccctttatcagaagtgcgaaagaaaaatttccgagttgtcaaaagagccctactgcgttatgaactctatgtaagggaaacaaagagaggacaaaaagactttgtcctcgatgtggatttggtaacaccagacacacttcgggatatgtgggatttctttcagaacgaataccaatactatgaactttatccgagtatttatgaaaccatccccgaaaagagaacaccacaaccaagaagcaagaatacactgattgactgtttttcaaggatacgcacgttcttcctatggtgcttcgacaacaagcataccacaaacagacctttcgacaaatttccgatagaagaatgtacatacggtacaccttattatataacacttgaagaaagggacagaattttcaatgccgacctatcagccactccgcaactggcaatacagagggatatatttatattccaaacactgataggctgtcgagtgagcgacctataccgtatgaccaaactaaatgtggttaatgaagccatagaatacattcccaagaaaacaaaagaagggaatccggtcacggtacgtgtccctcttaatgacaaggcaaaagaaatccttgaacgccataaagaatataaagggaaactgttaccgttcatatccgaacaaaagtacaacgatgccataaaaaagatattcaaattggctggagttgaccgaatcgtaactatcttagacccattgactcataacgaagtcaaacgacctatttatgaagtggcaagcagccatttggcaaggcgtacttttatcggcaatatctacaaaaaggtgaaagacccgaacctcgtttccgcactatcgggacacaaggagggaagcaaagctttcaggcgatacagagatattgacgaagaaatgaaaaaagaccttgtgaaactattagattaatatactttaaactttttagcgtataaaatcaagaaacaaataaaagaaattcctaactttgcaagaaaataaatttaaaatttgtattatggatagattgttgccaataagaatagaagcatgcccacttatagacgctttaattgagttccgttttgaagcagctattaccaaaagcgcagtttttggcatcatatacaatctcataaaagaagagtatagaggaaatgtcattaatttgcccattttacaaatcccagaacaaattagggaggttgaccctaacttaaaatttaagcccctatacagaattgaaaacgaaagatttgtaattcaaataggatatgatgttttgagcataagctcaaaaatgccatatataggttggagcgatttttctaaacattcattttcaataatcaacaaggttattagttctggaataataaagcgtgtatcaagaataggacatagatatattaatttcttcaaaggagatattaccaatggtcttacgatgtctttttccatgacagaaaaatacacatctgaaaacttattgatacggacagatgtcaaagatggtaattttatgaacaccctacaatttgtaaataatgcaaactacaaaccacatcctaattctatagaagtggtaggctcattaattgatattgatacgtctcgtgaatattccgacaactatttcacttctaatatagaacaagaaataaatatggctcataaatgcgaaaaaaagttgtttttctctttgttaaaaccagacttcctaaatagtctaaaacctgtttttgaaaatgaatagtttaacgacttacataaataccaatatcctattaatgtctgccttatcatgtatgacattaacagacacggaattgctttctttatcaagtaggcaaacatataatgatgctataataccgtctattaacactcctgtcaatccaataaatatttatacaaattattccattaaggacattcctatctcaacagagaccattcatgttaatattcccgagcatgaagattttgagataatcaattcttttgcgaataagatgttaacggaagcaactcctatagatgaagaaattcaaaatgtcattaatgaccacttttgggatatgctatgattacagaagatgaattaaaaaaatatctacccaaatatttgtcagaagaaaattacaagacccttttggcagaactcaaatctttcccttataacatagatggaaggatgtacacttctatgcttgacaagaatgtcatttttcaaggagatggcttaaaaaaaatgcctataattgatttagttaacatcgaaagaggtgtaaaaaatgtaagctgtttgattttatcaaacacttgtgatatggatttatctaattctcgtatgtttcctgcttcaatcatgtatgctcctattataaatctcacaacatatatttcagttcttcaaaaacaaggtgttaatagtagcaaaattgaaaaccacatttcagatctcaaacaacaaaaaataacccaaataatctttcttcctgcaaattcccaaatggaagattcaatagtttttcttgataaaatctatcatgttgacaatcgctttataaaccgagacacattagaagatcaacgcttattttctttaagcgattatggtttctatatgttaatattcaaattgtcgatacatttctcacgcatacaagagaaagttaatagaggttgcattgctaattaacttgtatgggacaacaagaatatgataatttcaaaagactgataaaggaatggcttgacaaccatccggatgaatacgccgatttcgtagaggaaatgaacgacaagaagtttaaaggattcttcaaagttttcaagatagccacgaaattagcaccgaaatacaaggaagccgcacgtaaaaggataggcgatgacagaacacccgactttgaagaactggaaaatatccttttgcattcagaccttgccgagaaaatagtgaacgagtttcataacccaaacaagaaaagtattgtccccgccatgctcgcatggctgtattacggacggagctatgaatgcatggtggaacagggagaggaactgacccaaagaaaggatatacctaaattgtacaaatggcttatttccggcatggtcaagttcattataagaaaaagcatcaccaatggaatgagaagtaaagaggactggcaagttttcaggaagcaacagaaagccatagaagagaacactcttgtggaatgggcaatagaagaagatgaagatacggacgaggaagacacagataccttatcagaagaacaaccgaagaccgcaggacgcaaagccgacacacgcacactgtctgaacttctgatagaaagacatgccatactgattgaaagaattggcacacgattgaaaacccatgctacggaaacagatatagcacggttgtttatcgcattggtagaataccgtttcatgaggaagtgtcccatcaagactttcagaaatgcgctgcacaatcaattcaaagaacaagaaatagtccacgaaagaggtattcagaaagcatacagaaatctcatttcaccacttggaaacagcaaaaaactgataaaagacattggtgaagaccatgaagctatcgaagaattgaaagcatatctatccaattgaaattcgtttaattcgctttttgattttacgaatttaacgaattgaatatcattgttttacgattaattttcgctatatatttgcgccactatcctaatcggggtagtggcttttcgtttataatactgccaaaacgggaagtcttacaaccggcagtttcaagagcctatgacagacttattggcaattatccaaaacggcaacggcaacattaagttggaagtaacaggagaagatttgcttttattctccaaccagttaataagccgtgcgaagcatgaactttctacagctattgcggaagcaaaaaaggaaaagtacctcaccaaagaggaagtgaaaaaaatgtgcgatgtttgtgacaccacactctggcactggtctaagaaaaactacctaaagcctgtaaaggtcggcaacaaggtcagataccgccaatccgacattcagaaaatcttaggtggacataaccctttaatctaagtctatgaaggaggaagaatatatgcgcgtaggaacaactttgtacaaggtggtcaatcagccatgtgccaatggcggttatgaaaagaaacgtgtcgtatggaacaacagcacattacggcaggactacggaaagaactatcttgccaccgttcccaagtatgacggcttttgcacagttcccaatcatttgaactaccaaaaggagattgaggggtttctgaacctttacgagccgatagaacataaaccgcagcaaggggagttttctcatatccaatccttgatgcggcacatctttggagagcaatacgaactgggtatggattatatgcaactactgtatctacagccgacacagaagctgcccattgttctgcttgtttcggaggaacgcaacacaggcaaaagtacgttcttaaacttcctgaaagccgtgtttgagaacaacgtgactttcaacaccaatgaggatttccgaagccagttcaattcagactgggcaggaaagttgcttatcgtggtggacgaggtcttactcaaccgcagggaagatagcgagcgattgaaaaacctaagcacgactttcacctacaaggtggaagccaaaggcaaagaccgaacggagattgctttctttgccaagttcgtgctatgttccaacaacgaatatctgcccatactcatagacgcaggagaaacacgctactgggtgcggaagataatgccgttgcagagtgatgataccaactttctgcaaaagctaaaagcggaaatacccgcatttctttatttcctgacccaaagggaactatccacaacacaggaaagccgtatgtggttcaacccaagactgacacataccgcagccttgcagaaaataatccgaagcaaccgcaaccgactggaaatagaaatgaccgagttgttgcttgacatcatgtcgaacatgaacgtggaaagcgtatcattctgcctgaacgaccttgtaaccttgctactctattcacaggtcaaggttgaaaagtatcaagtgagaaaagttgtgcaggaagtatggaaacttacttccgcacacaattcgctatcctacaccgcttatgagttcgccccccatcgtgagtgccactatgagccgaaaaggaaaactggtcggttttatacggtaacgaaagaacaactgaccactatctaattattttgatgaaatgatgaataagggaagtaacatattgccttacagatagatatgtattcatcaaacactcatcaacaacgattgctgatgaaaaaagaaaacatcatttttcttttggcaagcaatctgatgagaaaaagatgaatcgatataattctgtttaacagcgtattacatttcaaattcatcaaatcatcattttttcattcacctacaaatctgtaagaaaatgacaatagaagaagctaaaagcatacgaatagccgactacctgcacagcttgggttattcaccagtaaaacaacaaggtatcaacctttggtacaaatctccgtttagggaagagagtgaagcatcgttcaaagtgaataccgaacgtgaacaatggtatgatttcggtttgggaaagggcggaaacatcattgcactggctgcacatctgtacgctaccgaccatgtaccttacatcttgaaacggatagcggagcagacaccgcacgtgcgcccgatatctttctcttttggcaagcaaagctcttccgagccgagcttccaacatctggagattgttccgctgtcatctcctgccctgcttgcctacttgcaaggtagaggaataaatacagaactggcgaaaagagaatgtagtgaagcccgtttcacccacaacggcaagcggtactttgccatcgcctttcccaatggttcgggtgggtttgaggttcgcaaccgctatttcaagggctgcatcgccccaaaggaaatctcccacatcagacagtctgggaaagcgaggaatacctgttatgtgttcgaggggttcatggactatctctcctttctgacattgagacaggaaagctgcccgaattatccggagctggacggacaggactacatcgtattgaactccgtatcgaatgtaaacaaggctctctatccgttgggcaattacgaacgcatccactgcttttttgacaacgaccgtgcaggcatggaagccctccaacaaatccgcaaggaatacggcagagaccgatacatccgtgacgcttctcagacttacagcggatgcaaggacttgaacgaacacttacagaaacaggttgaaagaaaaaggcaagtccagtccgtcaaaggggtgagcagccagccaccgaaaaagaagaatggctttcggttatagcccactataactacacgcttcgctttcgtagttgtgggctctcccgaggggattagggctttgccctaatgacccactcagggcgtttcacccctgagaaccccgagcaaagagtgaccctctctttgcaatctccgcttatgggctacccctaagaacccctctgcgaaagcgaacaaaataataaattgcaaacaaagaaaagaagctatggcaacaaaatcaagcatacacatcaagccttgcaacatcgcatcaagcgaggcgcacaaccgaaggactgccgaatatatgcgtaacatcggggaatccagaatctatgtcgttcccgaactctccatcgacaacgaacagtggataaatcccgacttcggcactcccgaactgcgaactcattatgacaatatcaagcaaatggtcaaggaaaagaccggacgtgccatgcaggaaaaggaaagggaacgcaagggaaagaatggaaaaattatcaaggtggcgggatgttcacccatccgtgaaggagtattgctcatcagaccggataccacactggctgatgtacgcaaattcggtgaagagtgtcaaagacgctggggcatcactccgctacaaattttcctgcacaaagacgaagggcattggctgaacggtcagccgaaagcggaagacaaagagagcttccaagtcggtaacagatggttcaaaccaaattatcatgctcatgtcgtattcgactggatgaaccatgaaaccggaaagagccgaaagctcaatgacgaagatatggcaaccatgcagaccttggcttccgatattctcctaatggaacgtgggcagtcaaaggctgtcacaggtaaggagcatttggagcgaaacgactttatcattgagaaacagaaagccgaactgcaacgtatagaggaaaccaagcgacacaaggagcaacaggtaagccttgccgagcaggaactcaaacaggtaaaagcagagatacgcaccgacaaactcaaaagtgtagccactgatgcagccacagccatagcaagcggtgtcggttctcttttcggcagcggtaaattgaaagatttggaacaagccaatgagaatttacgtcatgaaattgccaagcgtgacaagggtattgatgaattaaaagccaagatgcaacaaatgcaggaacagcacggcaagcagattcgtaacctacaaggaatacataatcaagagcttgaaaccaaagacaaggaaatatcacgattgaacaccattcttgaaaaagcgttcaactggtttccattactcaaagaaatgttgagaatggaaaaactatgctataccatcggatttaccaaagatatggtaaacagccttttggcaaaaaaagaagctatcagatgcaatggaaaaatctattccgaagaacataaacgaagatttgaaatcaagaacgatattttcaagatagagaagagttcggttgatgaaaacaaattagtgctaactataaacaggcagccgataggtgaatggttcaaagagcaatgggaaaaattaaggcatggtttgcgacaatcagcagaagaaccaagaaaaagtagaggattcagaatgtaatcttgatagtatttgattgtacctcaataaaattgcatatctttgtaagcggattgaggctactctttccaagacatattagaatttagaagaagcgttatgcttatttcttgcgaatgaaaacctgagaaactttcaaacgtgtacaagaatagcatagtggttctcacgctatagcgtgggctgctattgttacatctgtacacaaaggttttctcaggaccttcattcaaagaggtggcattacagttccacgcttcgtgatattataaagtccttgtggcagctggaggtgtataattaaaacagttagttgatatgaaacagaatatatgcgtggtaatatttttattgctttcaaccatatgtaaagcccaaacattcatatacccccaaaacgattctattctgacagaatataatgatggaaaattttgggcttatttaaacaaaaatgattttgttgtaggtctttcatgctttgaggaaaaagatgattatggaaaatactatcacttggatatttttatcaagaatttaagtgaaaccccaattgtattccaacctgatagcgtacactctaatctactaacaaaaaaagatgatactttaaaacttgaagtatatacaaatgaagaatatcaaaaaaaaataaaacgctcacaagcatgggctatggcattatatggaatctctgccggcattaatgcaggaacagcaggatattcaacatcctattctacgtcttattcttctaatggttatgcttacactaccataaccaatcattatgacgctaatgcagcataccaagcaaatgtcgcatctaccaatcaaatgcttacattaggacaaatgatggataatgaccgaactatacgtgaacaaggatatttaaaaaccacaactatttatcccgatgaagctattattggctatatgaatattaaaaggaaaaaaggtaagattttgattgtaaacattcc

SEQ ID NO: 139 - DNA, 20392 bp, Bacteroides thetaiotaomicron
atataatatagtatcttcatggggagtttatttttatatatatgcaaagatacatgattattggtaaaaaaagcagtaggatacaacataatctttgcgattatgttatttttgtcttctgttatagacagataatgatatgatacgtatactacatactgccgattggcatttaggacagacattttttggttacgaccgcgcggaagaacataaggcttttcttgattggctggccgaagaaatccgacaaaacgagattgatgcattggttatagccggagacgtgtttgatgtttccaatccttctgctgcgtctcagcgcatatattatgagtttatttatcgggtgactgcggagaatccgaaactgcaaattgtgattgttgccggtaatcatgactctgcggcgcgtttggaagctcctctgcctttgttgcaggcgatgcggacggaagtcagaggggtagtgcgcaaattggagggcggagagattgactatgatcatttgacaatagaattgaagaatagagaaggggaagtagaagtactttgtatggctgttccttttttgcggcagggagattatccggtagtggagacagaagggaacccatatatggaaggagttcgcgaactttacgcgcgacttttacaaaggttgtgggcacgccggaaaacgaatcaggctattctcgctgtcggtcatttacaggctaccggatcagagattgccgagaaggattatagcgaacggacagtgattggtggtttggaatgtgtatcacccgatactttttcggaaaagatagcgtatacggctttaggacatatccataaagcacagcgggtatccggcagggagaatgtaagatatgccggaagtccgattcctatgtcttttgccgagaagcattatcatcacggggtggtgatggtgattttagatgaaggctgtgcggttgatatcagaaggatagagtgtccacaatccatacctcttatcagtgtgccgggtggagaggctgcttcaccggaaaaaataatagaaatattaagagatttaccggaggtggatggagaagctccttatctggaagtcaaggttttgcttgaagaaccggaacctatgcttcgtcaggaaatagaagaggcattggctggtaagaaatatcgtctggcacgtatcgtttctgcttatcgtcaggaagaaagagtggaaaaggaggttgatggctggaaaaagggattgcaggaaatgtctccgttgcagattgcgcaatctgcattcgaaaaggtttatcaggcggaaatgcctgccgacctgactgatttattccaggaagcatatatttccgcaactcgtaaagaagaggaggagggagaatgaaaattatagcaataagattgaagaatctgacttcgatagaaggcagtgttgaaatagattttacgatggaaccgttatcttcggctggtatatttgcaatttccggtgctacaggagcgggaaagtcgactttgttggatgctctgtgtctggcattatatgacaaggctcctcgttttgcggcttcggtggagagtatcaatctggcagatgtgggagataaccagatcaatcagtcggatgtgagaaatctgcttcgtcgggggacgagtgacggatatgcggaggtcgattttcaaggagtggacggacatcgatatcgttcccggtggtcggtcagacggacaaggaataaggcgagcggttctttacagcctcaagtgctggaggtgaaagatttggatacggaaaaagaatttcagggaacgaagaaagaattgctggcacagttggtagagttggtcggtttgacgtatgagcaatttacccgtaccgtattgctggcacaaaacgactttgcaacttttctgaaatccagaggggcggcgaaagcggaactactggagaagttgacgggaacaggtgtttattcccgcatctctcaggagatttttgcccggaataaggctgcacaagaagaggtgacgatgattcaaagtaagatgagtgtgattgagttgttgccggaggaagaacttttaaccttgcagaatgagaaagaacagttggttgagaaacgtgcggcagggattaaattgctggcagaactgaatgcgcaattgaatgtggtccgttcattgaaaatgcaggaagctctttgggtgaaaaagcagcaggaagagcaggaggaactgaataaacaaaagaatctacaggatgctttggttgttcaggaagaaggactgattcattttaaagcgcagtgggaagcgatacagccggatttgaaaaaggcacgtcagctagatgtacaaatacagtcgcagcaggcggggtatatacagtctcaacaaattttgcaggctgcccgtcagcaggtggcggatcaggagaagaaatctgcatctgcgatagagcagttacggatctcctatcattctttgagtcgtctgttgaatcgtacagatgtggagtcactgcagctggaacagattgaagtcatccttaacgaggaaaaggatacattggaaacatggacaaaagtgaatgaagaacgccttggccggttaaattctttcggttatccttctttggtagatgagcagggtaagattcaaaaagaactgacgcgcttgcagaatataaagaaattgactgaagaacaatcgaagtcgaagcaggatatagagaaactggaaaaggaagtgactgtttgtacacagcagttggcagagcaggatactgtagttaaagccttgcagcggctttatgaaaatgcccgtatggcggtaggaaaggatgtgaaagcattgcgtcagcagttgcaggaaggggaggcttgtccggtttgtggaagtacgacacatccttatcatcgggaacaagaggtagtggatactctttaccggaatatggaacaggaatataataccgcagtgtctgcttatcagcagataaataatcgcagcattgccctgcaacgagacttaacccatcaaagagcaactgaggtacagataaaagaacagttgtccgttttgcaacaagaaggattgccggctggagaggaagatcagatacagaatcggttaaatgagttggcggaacgtatttcagcttatcagcatctgtatgcggaatggcagcagaacgatgagaaaataaagaaattgcggacatactgtgatgctctgcgtgagaatgtctcgcagtgtcgtttggctgcgcaaaaggtatcagccgctaaagaacagtcggctattttacagaaagcagctattgatgagcaacaaagattcgaagtgatcgctaaagcgttggatgcactccgacaggaacgttctttgttattaaaagggaagagtgcggacgaagctgaggctgctgttgcccgaagagaaaaagaattgaatgaggcgttggaaaaggctcgtaaacaagtggagggagtacaaaatcatctttccggtctgcagggagaaatgaaacaattgtccgttgtcattgaagaacttcgggagcaacagaaaggtatcgaacttccggatcagcttcctcagactatagcgaaacaacaggaagataatcttaatacggaacgtgcgctgtcgattgcggaggcacgtctgttgcagcaggcaaagaataaaacaatctttgagcagataaccaaggagcttaccgaaaagcaggcagttgccgtacgttgggctaaattgaataaattgattggtagtgccgacggtgcgaaatttaaagtcatagcccaaagttatactttaaatctgttattgctccatgccaacaaacatttggcttatctttccaagcggtataagttacagcaagtccccgatacactggcgcttcaggtgattgattgcgatatgtgtgatgagatacgtacggtatattcgctttcgggaggtgaatctttcctgatttcactggcacttgcattgggcttatcttcgctttcgagcaataatctgaaagtagaatccctgtttatcgacgaaggattcggctcgttggatgctgacagtctgagaacagccatggaagctttggagcagctacagatgcagggacggaaaatcggagtcatttcccatgtacaggaaatgagtgaacgtatttcagttcaggtgcaggtacataagaagatcaatggaaaaagcgtgcttactgtcgtagggtaagcaccgttatttccggccatgcaccgaagcggaaaggaagtccgacatagccgatgccttcatttacgtacaaaccacgtgttccttccagatacatcccgctccattcgggatagatgtaagaggaaggagaatgattaccgaattttaactgcatggcgtgggtatgccctgccagcattaaatcgatgtatgtttgtggaagtacttcccgtctccagtgggtagggttatggcttaaaagtatctggaacattccttcggttccccgcatcgcttcggggagatcagcatattgggagaaaggcggttctccttcgttttcaactccaataagggcgatactgtcgctgccctgaatcagaatcgtatgagaattattcaataacttccagcccatagcggcttgtctttgcagaagatcgttcagattatcatcttgctcatctttgcttttccagtggaaataaggaccgtaatcatgattccctaaaatggagtagactccatctttggctttcagtccggccagtatatcttgaaaatcattcagttcgactgcacgatgattaaccagatcaccggtaaagacgataagatcggcctgttgctcattcaccagttttactaacttctgaatagcggaagcatttccctgccaacttccgatgtgaatatccgacagctgaacaatacggtatccatcgaaagccgatggaagcttgggcgaggaataagttacctctttgacgtcaaactgcgtgcgtccgataaaagacccgtagatgatcattacgatagaaatcacggctaatgtcagtccggtacagataaagggagttcggggccaccgtagccatttgtggaaaggtaccccgataatcgtgcagagagacagcaatagtttaggagccgtaaacaggaagaaaaagatggaaaaccatccaatagcctgtgtatggcgttcggcaaaggcgttattggagaagtaaaccagataaagtaatcctgcggatagcaggaaagcaggcagccagtagaggattctcagccagcgttttgccgtcagatgaacgataaatctgagatacagataaatgtccggtagaataaggaaaataagtaaaaatataaataggcgttgcaacataacagcacggatattaaatttttagttgaaataggcgaagcagctgactctggtcaactgtctatgattttaagttcgtccaggttcttcttgatttcctgaatacggttcaggaatttcttgcgataaatccacaagatcagccccaggccagctccccaaagcaggataaaaaatagaatgatggctatcccatattgccatatctgccaataaataaatgagagtaccgccagtataaggaggaaagcagtggcaatcagacgttcccggatcatccaccgatggatacggttgacacggctgatcacttctatcagaggcatttcgtccactttcgtctgttgtagaaaacgggtggtggtgatgtcccagtatagtgcgggaatccacgatagaatgataatgatatagatcggattcagtctgccgtgcaacaggacttccagcaggaataagaccaataccggcaaagaaatcaggatgagtttgatattcagccgggcaatggcatggatacctttgtctgcatgtcctatcagtttgccaagttcttcctctttgatcagctccttatcttttaagtgctcatccagggcattccatgattttttcagttcttccagttccatatatgattactcctttttcattttttttagtttgtctttgatacggctcagtttggtagccacatttgtcaccgtcagtccggtgatctccgcaatatcttcgtaacttttatcttcaagataaagcaggataattgatttgtcgagttgtcccagttgattgatcatttgataaagttgcctcagcatttcgtggatcgggtcatgttcctctattatccagtccgcttcgcgggtgagggtaacgatttccggtacattcttttctttgcggaaaaagctgatacacgtgttcagggcgatgcggtaaatccatgtggacattttgcattctcttctgaacttgggataggctttccagaggttgagtatcacatcctgatagaggtcattgagcggggcgttaggattggtatataagtaacataccttgtagatcacccgttcatattcgcggatgaccgataagaactcctgttcaatagggttggttgcctctgttgttcgttctctcatgaattaaatgggttacttttctggttagttagtcgtgcgaaaaggagaaaaatcacaagtaaacgaaagttattgcagattggcagccaggaattttcgcatttcctccgtactttttccccgacggcgggcatagtcttcgagctggtcttctcctatctttccgacagagaagtattcggcagccggatgggcaaacatcagtccgcagaccgaagcatgagggtacatggcaccattctcggtcagcgtgattcctatctgtttcatatccagcagttcgtccaacaggaaattgatggattgatcgggcagggacgggtagcctacggcagggcgaatcccttgatatttctcgaccaacagatcgggcattgacagaatttcatctttggcgtatccccacgcttctttgcgtacatattcgtgcatcttttccgtagcagcttctgccagacggtcggaaagagtctggacgagtaaatgcttgtagggatcttgctcgtacaggccttccatatctgcatctatgcaagaagcaaaggcacctattgtatccggaatgccggaagaaagaggacggataaagtcactcagacaaaagaacggacttccgtcccgtttaggcgtctgctggcggagcaaagggaaaactaggaattgatcggtttctttttcaatcaccaggttatctccgtccgagtttgctttgcaaagtttgaagatagttctcacttcataatccttgtcaagtaaatccagcatccggttggcttccttaaacagttgcatagcttcggaagccttgttgcggtcttcttccggaaaagtagtcagccacgaggcacgacagacatcgcaaccgtgaatgttggcgatcgctgcgaaacgaggttggaatccccatgcatggaaaaagtaaatccaattgatgtagggggcgacgttatgtatcttataagataaaatcatatgtttataagtgacgagttgctgtttatctgaatcttaactcctgtccacgataattctcgtcaatggttccgttgttatataacagatgaccgttcacaaatgttttttctaccttccagtggaaagtatgaccttccagcgggctccatttacatttgctcaggatgcagtctgtggtaacagtccactcactgtcggggcgaaccagaaccagatccgcttgatatcctttccggataaatccgcgattgcgtatctcgtacatttgtgcaggggcatgggacatcttctctactaccttttcgatgctgaaagcacccttgtctgccaattcgagcatactgaccaaagagaattgtatggtcggcatgccggacatgacttttaatgcgcccccttctttttcgctcaaggagtgcggagcatggtcggtcgcaatagcgtcgatcagaccgctgttgactgcctcctgcaaagccttccggtcttctgccgttttgatggcaggattacatttgatgcgcgctcctaaggtctgataatcttcttcggtaaaaattagatgagacacacacgcttcggcggtaatacgcttctctgccaaaggtgctttggagaataaactcagttctttggcagtagaaatatgcataatatgcagacgcgcattggtctcgcgtgccaattgtaccgccaaagcggaagaacggtagcaagcctcttccgagcggatgaccggatgaagtgccaaaggtacatcgtcaccatattcttttttatatttatccgtattctctttgatgattccctgatcttcacagtgtgctgcaatcagtaaatccgtacctccaaagatgttgcgcagacttgccatccggtctaccagcatatttcccgtactggaacccataaataacttcactccacatacccggtttttgtccagctgactgaataacggataattattgttagtcgctccgaaataacaggagaagttgacagatgatttttccgccagcaaagccagtttgtcattcagtgcctccaaagttgtggtctgaggatttgtgttcggcatatccataatcgaggtaactcctccggctgccgcggcatggctttccgttgtgatatctgctttatgagtcagccccggatcgcggaaatgtacgtgctcgtcaatagcccccggcaaaagataacagccggatgcgtcaatcgtttcgtcacaaggcatggcagcctcttgtccgtcaactaagatctcagcaatcttctcaccttcaataacaacagatcccggaacttttcttccttcgttgacaattacggcgttttttatcagtatacgtttcatttcttttgcgggaatttatggaaccaactatttatttttaacttgatcactccgaatatggcttctccaaagatactgctgttcatcttggaggttcccaactcacggttaatgaagatgacggggacttctatgatcttgaatccgcatttgtaagcagtgaacttcatctcgatctgaaaagcgtagcctttgaagcgaacatgatccagatcgattgtttccagcacctgacggcggtagcatacaaatccggcagtcgtatcatgcaccggaataccggtaatgaagcggacatacttggaggcaaaataagacatcagcacccgtcccatcggccagttgactacattcacgccgcttacataacgggagccgacagatacgtctcctccttcttttgcacaagccgcatacaaacggggcagatcattcgggttatggctgaaatcggcatccatctcgaagatatattcgtatgcgtgctccaacgcccacttgaatcctgcgatgtaagcagtacccaatcctagcttccctttgcgctcgatcataaagaggcgttcggggaattcctgttgcaaagttttcacaatgcttgcagtgccgtccggagatccgtcttctataaccagtatatggaatactttgtctaagccgaaaacggcacggataatattttctatgttctcccgttcattataggtcgggataataacgatgctatctgataattgcatagaagtcctatttttaagacaaatgtagtgcttttcctttagttataaagggactaaggataatttaacgtgttggcatttgttccccggtgtgaaactattggtttcatgccttgaaacttttagtttcaacctttgaaaccaatagtttcaaggcttgaaacaatcttgaagaagaaaacttcggtgtgactatatcaatcccggttcttttttcgtacttttgcggtgaaattttatagctatgacaataactgagttgcaacaacaatatgccgctcatcctaatacggcagtcatggaacgactgctgaaggatgcgtccgttcaaactattttttgcgggggcttatgtgcttcttccgcttctcttttctcttctgtattggtgaaacaagatgtgtgtccgtttgtctttgtactgggagacctggaagaggcgggctatttttatcatgacctgacacaagtgctgggaacagagaaagtgtttttcttcccgtcttcattccgccgttccatcaagtacggacaaaaggatgcggccaacgagattctgcgtacagaagtactgagccggttgcagaaaggagaagaaggcttgtgcatcgttacttatccggatgcgctggcagagaaagtggtatcccgcaaggagttgagcgataagaccttgaaactgaatgtgggagagaagctggacacgacctttatcacagacgtgctgcatagctacggtttcgaatatgtggattatgtgtacgagccgggacaatatgccgttcggggtagtatcattgacgtcttttcgtttgcttcggaatatccttatcgtattgactttttcggagacgaagtagagagtatccgtacatttgaagtagagtcgcagttgtcccgtgagaggaaagagggagtggctatagtccctgacctggcagtgacgggagatgtgacaacttcttttcttgatttcattcctaaagaaaccgttttggcgatgcgtgactttctttggttgcgcgagcgtatccaggtagtgcacgatgaggctttgacgccacaggctattgccgtgcaggaagccgaagaaaatggaggtattacgctggaaggcaagctgattgacggtagtgaatttacggtacgtgctcttgatttccgccggatggaatttgggaataagccgaccggtacgccggatgcaaagatctctttccatacttccgtacaacctatttttcataagaactttgatctggtggccggttctttcaaggactaccttgaacagggatattcactttatatctgtagcgacagtaccaagcagaccgaccgtatcagagccatttttgaagaccggggagataagattcagtttactcctgtagtacgtacgatacatgaaggctttgtggatcatacgctgcatctgtgtatttttacggatcatcagctgttcgaccgtttccataagtacaacttgaaaagtgacaaggcccgttcgggtaaggtcgctctgtccctcaaagaattgaatcagtttactccgggtgattatgtggttcacacggatcatggtatcggtcgtttctccggtttggtacgcattccgaatggagatactacgcaggaagtgctgaaacttgtctttcagaatgaggatgtcgtgttcgtttccattcattcccttcataaagtttccaaatataaaggtaaggacggagaagctccgcgactgaacaaactgggtaccggtgcctgggagaaactgaaagaccgtacgaaggcgaaaattaaagatattgcccgcgacctcattaaactatattcgcagcgccgtcaggaaaagggtttctcttacagccccgacagcttcttgcagcgtgaactggaagcctcctttatctatgaagatacgcccgaccaaagtaaggcaacgatggaggtgaaggccgatatggaaagcgaccgtccgatggatcgcttggtgtgcggagatgtgggttttggaaagacagaagtagcaatccgtgcagcgttcaaagccgtagccgataataaacaggtggcggtccttgtgccgacgaccgtccttgcctatcagcatttccagacattccgcgaacgtttgaagggtctgccctgccgggtagaatatttgagccgtgcccgtacggcagctcagtccaaagccgtattgaaaggactgaaggaaggagaagtcagtattcttatcggcacccaccgtattttaggaaaagatgttcagtttaaagatttaggcttgctgatcattgatgaagagcagaaattcggagtctctgtgaaggagaagctgcgacagctaaaggtgaatgtggatacattgaccatgactgccacaccgattccacgtacgcttcagttctcgctgatgggagcccgcgacttgagtgtaatctctacgcctccgcctaaccgctatccgattcagacagaagtacataccttcaatgaggaagtgattacggacgcgattaattttgagatgagccgcaacggtcaggttttctttgtcaacaaccggattgcgaaccttccggaactgaaagtgatgatcgaacgtcatattcccgattgccgtgttgccatcgggcatggacagatggaacccacacaactggaacagatcatttttgactttgtcaattatgactatgatgtgcttttggcgactactatcatagagagcggtatcgatattccgaatgccaatacgatcattatcaaccaagcgcagaactttggtctgagtgacctccatcagatgcgtggacgggtaggacgcagtaacaaaaaggctttctgctatctgctggcgcctccgttgagcagtctgacggcagaaggaaaacgacgcttgcaggcgattgagaacttcagtgatttggggagtggcatccatatcgctatgcaggatttggatatacgtggagccggaaacctgcttggagcagaacagagtggcttcattgccgatctggggtacgaaacgtatcagaagatacttgccgaagcagttcatgaactgaggaatgatgagtttgcagaattgtatgcagatgaaataaagggagaaggtcagatcagtggagaagaatttgtagacgaatgtcagatagaaagcgatcttgaacttctgttgccggccacctatgtgacgggcagcagcgagcgtatgttgctttaccgcgaactggacggactgacgctggataaagacgtggatgccttccgtttccgcctggaagaccgcttcggacctgttccgccggaaacgcaggaattgcttcgcatcgttcccctccgtcgcttggcggcgcgactgggagtggagaaggttttcttgaagggcggacgtatgacgctattctttgtttccaatgcggatagtccgttctatcagagtcaggcgtttggcaaaatgatagattacatgatgaaatatacccgtcgctgtgacctgcgtgagcagaacggccgacggagtatgctgataaaggatgtgactaatgtggaaactgccgttagtgtgttgcaggagattgtagcgttgccggtgaaagaactggatgatcattaattgataaataataagagcaatgtttgttttttatattcaaaaatgcttatctttgatctaaagacacagataagaacaagtaagagccatttaaaatctaaaaaataatgaatatgaaaaacatgctgacattgatcgtcctattatcatcgtggttaacggtgtattcgcaagagagttatacggaagctgaactaaaacagaaatgtgattctattgtagaagaagctaatactttgtacagatatgaaacggctgcctggaatttcactgatatgatctttgccaaaccggggttaattgaaacaattcagaatattctgacttaccaccagggcgattctattaaatgtgttgctattgataagcagtcttattgtatctatgaggcaacttttcttaatgaatcagctccatgttcggaagtaactacccgcaggaacttaacagaacaggaaatacttttggctaagataaaagaaaagatacggagtgaacttgctgaccatgaaaaatatccaatttatcgctacgataattatcctctgaattgggatctcataccatttgcagatggatataaattctatgctatttcaggagtatctaaagggcgtgccatacctttcggcaatgattacttatttattgctaataaagaaggagaaattcaatcgtggaagaaatttcattccagacttattccggtggaagctacagaacaaatgccgatgattgcttttcctgttcactcgcatttgaaatatgaaccattcatttcagctactgatatttgtacatttagattatattataataaaaccggtagtactaagttcgctgtatattctacagctctttccatgtatttcatttatgagttagctaccaataccatcactccgacaaaggatataaattttaattcggctcctctttctgaaaaggttgccccatgatttatttatcatgattggaaagagaacaggaaggcattagtaaaagtatattgttctttgtaaatgtgtgaatatatttgcgtctgatgcttttcttctgtcgtctgtgatttttgttttctctttcttatacaagttgctttataaacccgcatcacgtttataataaatagtgaggacgtttattataaacgggtcccaagtttattataaactatattttgccaaattcctcggaatgagaggaattaattaaacaaaatggggtgaaatccttgtggacttcaccccattcttattccttacaatgtactctcatacatgtaaattatatctttatgtctttatatttgtacatttcatgcttttgattccagatttgtttctacaaatatacgaaatttaaaaggcaaagtcaatagggaagccatcttaatggtttcatttgtttctctttccgtataacttgtctatcagatcctgtcggccgatacgtcttaactcattcagaatattctttcgttcttccggcttataccagaagaagaattgtcgttgtgccagtttctcccgttgtgttttggcactgaatacaggttccagtgtatagggatgaaatccgctgtaccatgcttcggtggctacagtcatcggagtaggggtaaagtcctgcacttgctccagatgaaagtccagccgcttggtgataacagccagttccgccatgtcttcttccttgcagccggggtgcgaagagataaagtacggtataagttgctgacgtagattctcttcccggttgatacggtcgaatatttttttgaaagtttcaaactgttcgaatgaaggtttgcgcatgatggataacacccggtcgctggtatgctctggagctactttcaatcgtccgctcacatgattgacaatcaactcgcgtgtgtattcagccgtgctgcgattggtggcggcgtctttactctgatggagcaataagtcgtagcgcactccactgccgataaatgatttttttatgccggggatggcatctaccgctttatatatatccaataacgggcagtggtctgaattaagattcgggcacactttgggatgaatacatgacgggcgtttgcactttttgcatattgcttcatctttacccttcatctgatacatattggcggaagggcctccaaggtcacttaaataccctttgaagtcgggcaactgcatcacctcctttacttcattcaagatagacttcttgctgcggctgacgataaacttcccctgatgtgcggaaatggtgcagaatgcacaaccgccgaagcatccccgatggatgttgacggagaactttatcatatcatatgcgggaatccgctttcctttgtatttaggatggggaaggcgggtatagggcagatcgtacgaatggtcaagctcttcctggctcatcggaggataaggaggattgacaacgaccactttattatctacctcttgtgtgatacgggaagccgcatatttattggattcttcttcgatgtgccggaaattgctggcctgtttctttttgtcagccagacactcttcatgtgagtaaagctgaatatcgtctgcggcaggagtccactctgtcgcacggcagagataggctgtctgagggatagttcccgctattttcttgagttcaccggctgtcaatgaagcatcctccgcaggaagcagttccttcattttccgggttagttctacaatcggcttttctcccataccatagatcagcaagtctgcgccactatcgcataagatacttttctgaactttatcctgccagtaatcataatgactcagacggcgcaaactcgcttcaatacttcctaatataacaggaacgtccggatagagtctttttagaatctgactgtatacgatggaaggatactccggacgcatatccggacggccgtccggagtgtacgcatcctcactgcgcagacgcttgttggcagtgtatttgttaaccatcgagtccatacttccggcagagatgccgaagaataatcggggacgacccagctttctgaagtcacgcaggtcatcacgccagttgggctgggggatgatcgcaactttcaaaccttccgcttcgaggatacgtccgatgacggcagcgccaaatgagggatggtctacgtaagcatcaccgctgaaaagaatgacatccagttcatcccatccgcggagttccacttctttcttggtggtaggtaaccaatcggtcaatcgatattctttcatgccgcaaagatacggataataaaaaacatcccaatgatttttttattcattgggatgtttaacttcaatcattaagatgtttttttaaaacttctcattgattgtaaattgcaatgtcatttgctctccgtcatagatttcacgaaaaccgatgctttgctcggaaagatattcctttaagtcttggaaagcatctgcatgattcatgataatttcgagcgtttcaccgaaaggagcctcgcatatagctttgattgcaggaatcaaaggactgtaagctgttgttccgcaggtatctaccgtaatcattattcttcctcctcttccgcatcctgagtggaaagccaggtgagatagagcttgatgagttgttgcaggccgaatgctttcatgttattgtgataaataacatctatgcaaagatccagcaattctttactgtcctcttcctgactggcaatcagggaacgaatatttagtttcagtttatccagtacgggttcgtctacaattccggtactatcgatgagatggcggaataaggcatatttctcgattgttttcagattttcgctggacacctctatgctgcgtgtaccgctggggtttgcttgtatagtatacatcgttttttagttttaagggttattactaggagcaaagatagaatttaaaatgaaaaacgaattaaaaaagcccggatatttttatccgggctttcagaaaataaatcttatatccgtgagtactttatttctgagtaaagaaacctagtatcccggccataatgctggcgcgatctgtttccgactgaatgctttcgaaaggaaagccgagtacgaaggtgcgatagtctgctcctttgtaagcaatgcctgccgactgattgccacgtgcataagtaaatactggaaatgcgggagctaccggaacgatgcagtccggtgccgtaacagcataactggtctcattgggcaggcgggggatcgtgatgctgcgtcctaatccattgatttgaccggaacttttgtctgtcagactgttctgataaccgtatttcaaaactttctctgtaaactcccggttcccttgtgttccgctcatgtcacttcccacatacgcaccgctgacgaacaaatgacctcctgactggcaatagcttgtaatcagtctttgcatcggtgaagagaatgttttgtaatatgctttggctatcgggtcttccttttcaagtccgagtatatagtctacgatcgggtaatcttctaaagtgacgattccattctctaccgcttcgtcgctgcacgagacaaagctgtatttccctgctgcctgaatggctttcccatgaatgaaaggataatcaaacgtatttcctgctatctccatgccttccagctctctgccgctatgtcccaggctgccttctccttcttttccagcttgtgaacggttgaatccgctttgtgccccgcaaaaagagatattggataaataaggcactcccggatcctgttccagatcaaatccggctttgtccggtgtgttaatgacagccggaccgctgattctgtcgaatccattgataatcaagattctctctcgttcacgttttgccttataagccgaaaggatttcagaaggaaaactttctcctccccggtttacggctgtcactttgaacgaatagacaagtcccggttctactttgacactgtaatagggtttgctgaccagagttccgttgtcgaatcctccgtatccgatgcgtgtatataccatatattcccgtggacgggctgtcggttccagcggatcgtcttcccctttccaggtaagttccagtgtgtttttcttttttccgaaatggatagcgaagttgctgaccggaagaggttgcactacatagtctttgccatgctgactgtttataaattgcaggatacctttgtagatagcacgtcctacggtaaacttgaaattcggattatgaccaagctgcatatctgcaaagttctgatgagagagcaattcgataatcgtggaaggagtagcaggaagtcgtgtttcactgtaattccggttccacatactgcggcgtgtccatggtagattgtagttcgtacgaatatctttctgaatttgagtcagcaggatatccgcaagatcacgtgaagcatatctgtccattcccgaatttagtttgccattattgaaatcggtggtatagatgccgagcgaaccgatgatttcatcgtctttactgcatccagcgtcactatgaagtgccatagtcatttccagaggtacacctaaacccgtttgtcccggattatagacagagcctcccgacagatagttgattgtattggaacgtgtattgatatcgtctgtataatcgttttctcctttacgcccggcatatacatcgtatggcataccggcccactgggatgaatatcgtgctccttccagataacgggggagtccgcttatttttcctccgcgtgagatattacccattcctcctccgaagcgtacggcatctgcacacactacgccatgctcgctactttcattactcagtacaaccatgccgtagtcattatttcctttgtcaaactcaaaagttccgagatatacccaagtaccgccgcctattttttgattgaccttaaattccgtgacacccccattatgaaagacgaggtatttggcatcgctcacgctattgggtagtgtctgatatgaaacatagaccgcatattttccggttgccggcagggtaggtacccattcggcaaaagcctgatccttattcttcttttttttcttttctgtttgaatataccggctggtaccgtcagtgaaagggttttccccatctttgtaaatggcttttttctgggcgaatcctttcacggaagtagtcgtccagcgtgctttcttactgcctacttccaaataaagggaagcattcggagtatcgttgtcaacaatgatttcattcttttgtgtgtcccgttcgcgaggagtatacacaatggcaccggcattttccaacatcggaatgacgtatggaagaatgaaggattgagtgaacatatcttctgtggtgcagaataatcgggggcgctgccatccccattcgcctttgtcattcttataataattaccgtgactttgccagagggcaatatgccggtcctgcaatcctcgggatatctcattggggcgggaagtgtttttcacccatggagcacctttgtattcggtgttcagcgccattcgttctttatcctttttcttgcttctgtacaagttgggaactaattcttcaatgggctttccatctgcataaatggtgatctgataatagtttaccggaccggggagcagttctttcatctgattgtagatggtttctaccgtttccggcagaaagggctggtaggcgaagctttccgaagcataaatctgaatggttctgcggtcataatcaatatcgaaactgttcagtttcggtgtactgattttagctgtcgctgtgtatttggcaaagtaatccgttaaccgctcttttatatttctctcaatgtcctgagcgaagagaagactggtgcccattgtcaggcacagaagaaagactattatttttttcatcgttccactctttaggttgcatcctatgattatctatgtccgccactttccccttgatggcatttccccttttggaaggagaatacgaaatgaatctcgcgttcatgtaagtccattgtattctgtggcaaaatctcctgcaaaaataaacaaaaaaagagtgggaagtatcgaactgcccactcttctttgattgttttatattctattaatt

SEQ ID NO: 140 - DNA, 20323 bp, Bacteroides thetaiotaomicron
aaattcgaacgatagaaatcgccaagaagttcaagctgataaggactaaaggtcatgtcactctttttcatcttttattcattttagttgatacttatagtagtcaaccaaatccagggtaagacaacatctgtcgattggattcactttgaccgtatgtttggattgactcgaccatgttagttatttcaattgaccagttcttttaggagaagcattgaatcatttattggctaataatgtatggggtatcagtcattaatagctgagatgtcagatattaacatcctgtaaatcaaaagatagcaatgtagaaacgatactagtcaggacgaaacagagtgagagcaaccgtttgctctcatacctgccaccacagttgctaccacaccgaaaactacgatgaataaagggatacagacagtttgttagggcatgagagcaaaactgctgtcaaattactatggaggctattgtggaaattctgattaataaatctacagatattccatacttatatttgaaaaatagtatctttgcagtgactaacattttataatgggacgcagggaatcctgcttttgataagttgcaggcattttttgcttgtagctttcctcataggcggtttcgtacccccgtggggagtatgtaatgtacctccagcgtcctaagatgtgttagtcaacgggaaaggcgaaaccgttcttttttgcccctttattaaacttttatcttatggatactgaaaacgctttgactaacgcgaaagaaagtcccaatgaaattttttttgaagaagaagcccgtctatgggcagaggtgtatggcaagcaatctgataagccggaccttgagtctcttcaacgtatgctggagaatatgaaccatttgttgcttagcttagaacttccgtgggaacgctttattcctatcttgtaccgaagttttgccctttatatgcgtcgtccggacgaaaatacaaataatcggaaagcctaccaactgtctgcccaacttatggactctgtcgtttacttgtcacagcatactaacttgattcatcacatacaccttttctgtaatatgcagattgccgctcttgaaaagctaaagaatgaaaaagtagaaattgagcaaactgaagattaaacaaacagaaagtcaaccaatctaaaggttacttcgttttaaaagaatcatacaaagactgaaaagccgagtgcgatctcccatcgtacccggctttaatcttatatgtttaacctaaaacctatgaaacttttcttttattaatcacacgcattgctgctgtataatattcgcatggaacagaaatgagtatactgttcaatccattgtctttcattgatgcctcgatatacgctgctttcaataaactctttacgctggctacttcccagggactaccagcaaaaacattgacctgagaaacctttctacttgtaatcatattctttttgtgttttaattgttatggctgcaaatataggaagttggatttatagattagagcaattttgagtcataatagtatagaaatgatgcaatgatctgattttagcataaattggtcagtttttagcattggaaaaaagtggagagaaaggagtgaaagctatatgctagtcgtcagccttctgatgatttaccggcttatgtcccattttctcttcaaaaagttcttttattcaattaaaatatatttctttgcaatcattaaagacctttggatatacttaaactatacgcataagcgccattaatatagatcgaaatgactgcaattaattttaattcgatatatactacctattataggagagcattcctgtttaccttatcatacgtccataatgatttggtagctgaagatattgtatcggaagcaatcatttatttgtgggaattaagtaaaaaacaggaaattccgagtatcgaagctgtattaatcacttatatacgtagcaagtcactcaattacctgaaacatttgcaggttcaggaaaacgtctaccaaaacctgacagataagggacaacgggaattggaaatccgtatttcaaccttggaagcctgtgatccgaaggaagttatgtccgaagaattacgctcaaaggtgaaaacattgttggctggtatgccggaaaagacgcgcattgcatttatatccgatcgtctggatggaaaatctcataaagaaatagctgaagaattgggtatcagtgtcaaaggagtggagtatcatataagcaaagctgtgaagctgctgcgtgataatctgaaagagtatgctcctttcctgatattttttatttgatgatcttgaaaatatctttttctcctctttttttaataacagcaaaaaaagttgtatttctcactagggattatttttagtgagtggtattctatatgaaagggggagcaaatatactcctgtttattacttataaagtaactcaacttataatatgaatcagaatttacttttaaaatatatatccggaaaagcctctcaaagggagaaagaagaagttgcagcatggattgatgccgatgccgctaatctcaaagaatttatgtcactccgcaaaagttatgatgcacttgtttggcaggatgcggatgagttgaaaacggggcgtgacaagctgctttcactacgcacttttacgatgaaggcgatgcggattgcggttatatttgttttggctttcggattaagttatatactgatacaaactctgcaaaaggaaaatgtagaaatgcagaccgtatatgtgcctgccggacaacgtacgcaagtgacgcttgctgacggaacaatggtatgggtaaacggaaaaagtacgctgacttttcccagtcagttcgcttcccgtacccgtaaagtggaactggacggggaggcctatttcgaagttcagaaagacccggagaaacagttcattgtttccacagcccatcagtctgcgattaaagtgttgggcacaaagttcaatgtaaaggcgtatagggattccgaagagattactaccactctgatagaagggaaagtgcatttcgaatttaataataccgcacagaagcctcagtacattactatggcacccggtcagaagctgatctattattcgcagagtggaaaaacggagctctatactacttccggtgagggagaactggcatggaaggatggtattatcgtctttaagcagacatctttgcaggatgctctggagattttggcagacagatatgatgtggaatttatcgttcgacgcaatgtgcccgatgatgacctgttctccgggacattcacgagcaggagcctggagcagatactgaattatatagaagcttcttcgaaaatacgctggcgttatctgaacagtgtacaaggaagtaaagagaagatgaagatagaaatttttatttagtgttattaataaccttatttcaaaaaagcttattgccatgaaaaacaaagacccttgaaactaaaaaagatacgggatgatattggtcgtatcttcccgtattgagcccagtaatcgtgaatctacttgtttcccgacaagtataactactagttttttaattaaactcgttacaaatttatgcaaaattattgtatcgtccaatttcttggaggattaaaccttcttaggcggtcttcaaggaaaatatcactatctatgaagttactatttatactcattgtctgctcattcggactggcatatgcgtccgatggatatgcgcaaaagacttccatcacattgaaggcaaacgattgtaccatagaggaagtgcttcacaaaatcgaacttgagtccggattcggcttttttgtaaacagtaagaatctcgatttgaaacgcaaggtgtcggtgtcagtgtctaataagaatatattccaggttctggagcaagtctttaaaggtgtgggcatcgaatataaagtcttggataataaaatagtactggctgcaaaagaaaaagacgttgcacagcagagaaaagaaagacttattgccggcacggtaaaagataagaatggagagccgttgattggtgtctctatccgggagaagagttccggtgagggaaccatcaccgatatggatggaaactataagctttccacttcatcggcgaatcctgttcttgtattttcctatgtaggttatcagtcaaaagaagtacccgtaaaaggaaatgttgccaatgtggtgctagaggatgcgacgcaggaactgaatgaggtggtagtgacggcattgggtatcaaacgctcggagaaggcattgtcatacaacgtgcagcagctgagcggtgatgaactgactactgtgaaagatgcgaacttcatctcttctctgaatggtaaggtggccggtgttaatattaattcgtccaataccacgggaggtgcttcgcgtgtcgtgatgcgtggtgtcaaatctatcacttcttccaatctggcgctttatgtgatcgacggtgtaccgatgtataacatgatgaatggaggtggcggtggtatctatgaccagcagggtacggatggcgctgccgacattaacccggaagacatcgaatctatctctatgctgaccggaccttctgccgcagctctgtatggtaatgctgccgctgccggtgttgtgctgataaccaccaagaaggggtctgcggacaagacttctgtcacggtctccaataatactactttctcgaaggtgtcaatgatgcctgagatgcagagcaaatatggtaacctgcccaacagcctggatagctggggaccgattgtaaacagtgactacgatccgcgtgacttcttccagaccggagcgaatgtcattaactcatttgctttgtcaaccggtaacaagaagaatcaggcgtatttgtcggcttctactaccaacaccaccaatatattgcccaacagtggatacaaccgctataatttcactgtccgtaacacgaccagtttcctgaaagacaagatgacactcgatgccggtgccagttatattcttcagaatgacaagaatatgatgtcgcagggttattactataatcctctgccgggactttaccgtttccctcgtagtgagaatttcgatgatgtacgtatgttcgaacgttataattccggtatggacctgatggagcaatactggccttacggcggtacttcaagtggtcttgccaacccctactggatacagaatcgccagttgcgggagaataagaagacccgttatatgatcaacgcttccctcaaatatcagttgttcgactggctggatgtggtaggacgtgtgaaaatagataattatgataatcgtagtacttataaggcatacgcttctaccggcacactggtgtcgggtgaccgtggaacgtacagtgacacctctacacaatcaaagaacacgtatgcggatgcgattgctacactgaataagagttttaacgactggtcggtcaatgtcaaccttggtgtgtcactgagtgacagccgttatgaaatgatcggatatgaaggcggattgaaacttatcaatttctttgccgtccacaatatcgatttcaataaagcatggaaagcaaaacagtccggctggcatgatcagacacgcgctatctttgccaatgcggaaattggttggaaatcgatgatctatctgactgctaccggacgtaacgactgggattcaagactggctttctccgattacaagtctttcttctacccgtcaataggactttccgccattctgacgagtatgtttaatgctcctgattggctgacatacctgaaagttcgcggttcgtacactgaggtaggtaactcttacggccgcttcatgactaccgttacttacccttacgatgaacagacacagagctggaccagtacctcttcttatccgaacacgaaactgaaaccggaacgtaccaagtcatgggaagtaggtttggacgcacgtatcctcaatgacatcagtcttaacttgacttattatcgttccaatacttataatcagacattctatgcggacttgtcgctttcttcgggatattctaatattcctatccaaagtggaaacatcatgaacgaaggtctggaaatgtcattgggttataacaagcagtggaaagatttctctttcaatacgaactatacattgacatggaataagaaccgggtaaaacggttggctgacggtgtgtacaactatgccaccggacaacctatccagatgccggaactgtctccgcttacttatggacatacggatgcccgcctgattttgcgtgtcggaggatcaatgggagacgtatacggacaacgcttgctcaaacgtgacttgaatggctacattcttaatgaagaaggtgtcggactggctatggagaacaaagaaacctacttaggttctattctgcctaagatgaatatgggctggagtttaggattcggttataagggagttaatcttggcatgactttcaccggacgtttcggaggtattgttatcagtgagacgcagtccgtacttgacgctgccggtgtttccaaagtcagcgcggacgtacgtgacgcaggaggcgtgcagattaatcagagcaaagtctctgcacagacttactatcagaccattcagggaactgcggcttactacacgtatagcgctaccaatgtacgactcggcgaactttcacttagctatacattgcctaaaaaatggtttgacaataaggtcggaatgactgttgggctggtaggaaagaatttatggatgatttattgcaaggctcctttcgatccggaactgaccacttcagctgcatctaacttctatcagggatttgatgcctatatgcttccgagtacaagaaatttcggattcaatgttaaatttcagttttaaataataaataggtatgaacaagataataaaatatatcggagcaagcgcagtcgtatgtatgatggcggggtgtactactaactttgaagattttaataccaacccttatcagccttcaaaagtaccggcaagtaacttactgtctacgatgtttaacgtgtatgcttgtccgcaacagaatgcttgtcaggagattaattgtatgtgggccagctttagcggtcaagtgactgcgacagctaactggagctttggaaagaatatctttgcttattataatgcgtccgaagggcacaatgacagttcatggggaagactctacggctatatctatccttctttctttctggtcgagaactctacggaaaagaaaggtgtcatttatgccatggctcagttaacccgtgtttatggtatgcagttgctcgcatctttgcaaggtcccattccttacacacagatgaaggccggcgaaacggaagccccttatgataatgagcagactgtatggcatgccatgtttgacgatctggataatgcgatcaccattctgaagtcggcggcaacgttcggcgtaaatcaagatttggctgtggtagaccagttctataaaggtgactgctcgaagtggctgaagtttgccaatacgctgaaacttcggatggctatccgcatctcgggagtagaaccggaatatgctcagaccaaggctcaggaagctgtacttggaggtgtgatggaaagtgtgggcgacagttcttatgatacgactaatggcggaatcaatgaaaatggatatgctattgtcagcggatggcccgaagtaagagccaatgcctgcctcgtgtcgtacatgaacggatataacgatcctcgccgtcctgcttattttactccgcagactcagactgctgccggtgggtatgtaggtgtccgttcgggttcggcagaaatacctgaacctacggtatacgccaactatagcaaactctttatcgctaccgacaaaacattgccacaaccggtaatgtacgctgccgaagctgctttcctgcgtgcggaaggagcactgaaaggctggaatatgggtggagatgccaagactttctatgaaaagggagttcgattgtcttttgaggaatttggggtatcgggtgccgatgattatttggctgacgctacatctataccgggaaattatgtggataatttaattgccggacataccggaaacaattatacgaaccagtcgtccattacgatcaagtgggaggatggagctgatgacgcgaagaaactggaaagagtacttacccagaaatggattgcctgttatcccgacccgatgaacggatgggcagatttccgtcggacaggctatcctagaatcttcccggcaactgaatctatgaatgccgattgtaatacggggcgcggacaacgccgtcttcgttttacacgaagtgaatacaataacaataaggcgaatgtggaagcggccgtcagtatgcttagcaatggaaaagattctaatggaactgatctttggtgggcaatgaaagaaaatggtacttattaatagcttaaattaggaataacaatatgaagaaattattatatatcatatttggagtaatgggtgcactgatgtttatacagtgcagcgactggactgaaatggaaccgaagttcaccgaaccggtgaatatcaatggtgaagactattataaggcactgagagagtataagaaatccgatcatccgattgttttcggctggtacagtgaatggaccggaaccggaacgaatatgaacaaccagttgagaggtattcccgattcaatggatatcgtctctctttggggaggggctttcaacctgactgaagcacaaaaaagtgaccttaaggaagtgagagagaagaaaggtctcagagttttgtattgtcagcatatcacagatataggcagaagtcatacgcctgcttctgttgagaatgatttcatcgtggatggcgtacagtacaactctaaggatgaagcgatggctgcttattgggggtggtatggcaattatggtgacacttcggaagaaggacaagaaaaagctatccgtaaatatgcgcgggtgattattgattcaatcaataagtataactatgatggattcgatatcgactttgaaccgaattttggctattccggaaatctgagtggaaattcggaccgtatgcatatttttttggatgaattatcgaaagaattcggaccgaaatcgggaactggacgtatattgatggtcgacggagaaccgcagacactgaacaaggagtcgggccctttattagattattatgtggttcaagcctattactgtaggtcggatgagggatatagtgatgctttggatggtcgttttgacagattattaaataaattcggttcgatagaggatgaagctacgattcttagtaaaacagtttggtgtgaggactttgaaaagcataaaggggatggcggaccggaatttacaactcgtgatggtattgtgacttattcattgaagggaatggcgatgtactatcgtccgggagtagatgcccgcattggcggagtgggtgcctaccgttttaatctttgtcgtccggtgaatgactatttctttatgcgtgaggttattcaggttctgaatcccgctaatcattaattgcaagaacataactaaaaaaggataattatgaagatgattaaattttcaagatatgttgtgctgggggcagctttggctgttgtcaccggatgcaacgatgcaaaactgtcaactatcgataatggagtatatattgcggaagcggctccttctaatacgtttagtcagcagatagaggcacaattggtggacgagggagatgtgataaaaacattgaccgtccgtttggttcgtgctattgatcaagatgtaactgtaacactggatattgatcagcaactcattgatgagtataatcaacagcatgaagcgtcttacgaacttttgccggaagaattcagaagttttgaacgcacagttacgattcccgcaggtgaagtgtctgcaccagtcattaatcttactataaagccgtttaccacccccaataacgaggcttatgcgattccggtacggatcacttccgtagccggaccgataggacttgttggtaacgcaaaccatattctttatctgcttacttcccctaataaacagaaagcggtggttttgaaatcagcaaataaaaccagtctgaactttaaaaacgaaatacctgttactcagtggactatagagtattggatcaagttcgataatacaacgggcagaccgacaggagattgggtgggtcctgccaatattgctttcagacgattaattttcgcagacaattcggctcctatttctttcaatggcgttttattgcgttattgggcggatggagcaaaaaagattgcgccatgtttgcagtgtcagttggatggaaactattttgatagtgaggaattttggtatccggatatatggtatcacattgcttatacttatgacggatctactatttccctctataaagatggtacattgaataatagtaaagccgattcaagagactttacattcaataatatttctttagcacagagtttcggctggaatatgcaggtagaattagctcagattcgtctttggagcaaatgcctgacagagaacgctattcaggaaggaatgtcacgccagatatccggagattcggatggtttgattgggtattggaagtgtgatgaaggaaaaggaaatgtattgaaggataatagcccgaacggtaatgatataacgcttaccggaattcctgcatggagtgaacaatacaatttctatcatcctaatgattaagcggatggttggagctttatcaattgattagagaatccgatacttacagatagtgaaaagaaaagccggctgcaatcctttgcagccggcttttttataaatgggttttatgccttatttctcatcgttctcgcgaatttccacgcgacgaatcttgccgctgatagtcttgggcagttcgtcaacgaactcaatcacacgcggatatttataaggagcagtcaccttcttgacgtggttctgcaattccttgatcagttcttctccggcacgtgctttatagtctttggacaatacgatagtagctttaactacctgtccgcgaatctcatcgggtactccggtgatggcacattctatgacggcagggtgcgtcatcaaagcgctttccacttcgaacgggccgatacggtaaccggaactcttgattacgtcgtctgcacgtcctacaaaccaaaggtatccgtcttcgtctttccacgctacatcacctgtgtagtaaatgccgtcgtgccaagcctcgtgtgtacgttccgcatcccgatagtactctttgaaaagtccgagaggtttgcctttgctggtacggatcacaatttgtccttgctctccggcttccacggagcgaccttcactgtcgatcaggtctacgtcatactgcggattgggcagtcccatgcttcccggtttcggttccatccaaggcatggtggcaactgtcagtgtcgtttccgtctgtccgaaaccttccatcagcttgatgcctgtcagtttcttgaaggtttcgaatacggcagggttcagtgcttctccggcaatggtgcaataccgcagtgaagacaagtcatatttagtcaggtcttcatgaatcagaaagcggaagatggttggaggtgcgcaaagggaagtcacctgatactcctgtatcttttccagaatagctgcgggcgtgaacttttcgtggtcatagacgaaaatgttggctccggcgatccattgtccgtagagttttccccatacggcttttccccagccggtatcggcgatggtgaggtggaggctgttctcatccagattgtgccagaaactacccgtaacgatatggcctaacggatacgtaaagtcatgtgctaccattttaggttcgccggtagtgccggaagtgaagtacatcagtgagatgtcgtcattcgtattggcatgtctcgggcggatgaaaggggcagcgttatcgattccctgatggaaatcttcgaatccttccggaacttccggacctacactgaccagcttttccacgctcggacactcgggaagagcatctttgatgtgttgcagtatgattccttcgccggcagccacaatcattttgatgtcggcagcgttgcagcgatagatgatatctttctttgtcagcaggtgagtggcggggatcaccgttgctcccagcttatgcagggcgatggtgctgtaccagaactcatagcggcgcttcagaatcagcatcaccatgtctccgcgaccgatgccgaggctctggaagtaagaggccgtcatgtccgtatagcgtttcatgtcggcgaaggagaactgacggctttcgccttggtcattggtccagagcagagcgttcttgtcgggttgttcggcagcccaggcatctactacgtcgtagccgaagttgaaattctccggtacgtttattttcaggttcttgatgaaatcctcttgtgaggcaaagctagtctgtgctaaaaatctttctaccataacgttattacataattacggccagaaaacgtaccgttttgccatcgagcgctttcatgccatgtggaagttttgaattaaaataaatactgtctccttggttcaggatgatttccttgccctcgatgttgataagcatacggccttcaaccaccagattgaattcctgtccgttgtggtggttataatggatcggctcatcgtctcccttcggttcgaccgtgacgatgaaaggatcggcggtgcggttcatgaagcccgacgccagtgactggtatttgtaagccctggtacgttcgatgctgactcctttgccggcacgggtcacgaagtagctgctcattttcggctcttcgccaaacatcaaagtatccagtgcgatgttataggtacgggctatcttttgtagcatactaacggaaatgtcgtattgtcctgtctctgcgagccggtattcttcggcagatatgtcgcagtcgcgggcgatatcttcagacgttagttccagtacgtcacgtaatccgcgaaggcgttctgcgatctgtttaatttggtcattcatacaagtggttgttttttgattattaataattttgcggtattatttggatgctttcatcgctttgatgacggcggaggtaaatccgttgtgttccagttcgttgattcccttgatcgtaattccgcccggagtagtcactttgtcgatttccacgctggggtgggtgtcattgttcagaattaatgcggcggctcccttgacggactgggctaccatttccatcgcatctttgggacggatgcccatttcgatgccggcctgcatggctgcctggatgtatttcaatacgtaagcgatgccgcaggaagtcagtgccgtggtggcggctatcttatcttcggggatgagcatggccattcccatttcgttgaacaggcggagcataaacaggttctgttcatcgttcgtgttgcgtgccgcgataagcgtcatactttccagttcgctgatggcagtgttcggaatcaggcggaacatcggcatctccggtgctatcacaaagtgtgcgagttcttcaaaactgatacctgccgctacggatacgagcgtctgtttgctcttcagcttcaactcgcgcatgacggactccacaaaccaaggcttcacggcgagaatgacaacatctgctcccgttgccgcttccgtattgctcagagtggtggaaatgcccggaaattcttctttcagtttctccagtttgcctgcgctggggttggatacaatgatatctgagtctgctatcagacttccttttgccaggccgcgggctatagaaccacccatgtttcctgcaccgataatagctattttcatatgcgcttcttttttaatgtattcttacagacaaaggtaacggtaaattgcgaaaaaacaaaaagcagcctgaataagaactgtttttctgttcgaggctgcttttttgttcgctgtttattaatcaaatatcagttagagtactcttttgaaacgggcaaggaactcgtccgcttcctccatgctgaggcagagagggggcaataagcggagtacattcgtcccgctggctcccgtaaatacgtgttcgtcgtagatgaggcggctgcgcaattccttgatcggttcttcaaattcgagtccgatcatcagtccgcgtccgcgcacctctttgatttgcgggaatttcttgagttcttccagcaggtagtcgccgactgcttttgcattttctaccagattgtcctgttcgatgacgtccattacggcaagagctgccgagcaggccaggtgatttccgccgaatgtagttcccagttgtccgtagacgggcttgaacatcgggctgatcagtacacctgccatcgggaatccgtttccgatgcctttggctacggtgatgatgtctggctggatatggttgtattgatgggcaaagaattttccgctacggccgtatccactctggatttcgtccagaatcagaatcgttccggtttcggtacaaaccttgcgaagttcctgcataaattcggtagtcggtattttgataccgcccactccttgtattccttcgatgataacagcgcatacgtcacctttcgccagttcctgcttcatcgcttcgatgtcattcagagggagataggtcacatgaccgttgttgttgatcggagcaatgatggtggggttgttcgtagcctccactgcaagggatgtacgtccgtggaaggctttgctgaaagaaatgactttggtgcgtccgttatagaaagaagccagcttcagcgcgttttcattggcttcggctccgctgttgatcagaaacagcgagtagtcttcataaccggaaatctttcccaatcgttcggctacttgttgctgcagcttattgatcaccgagtttgaatagaaaccaagggttgctacctgattgctgatcatctccacatagtggggatgcgcgtgtccgatggagatgacggcatggcctccgtagaggtccagatattccgtaccgttctcatcccataccttacagccttgtcctttgactatattgatgtcatataaaggatatacgtcgaataatttcataattcttctgtttttagaaagcggaaggtttcagccgtaatcctacggtttcttccaggttgaacatcaggttcatgttatgaactgcttgtccgctggcacccttcagcaagttgtcgatacaggagataatcagtaatttgtcaccatgtttctccagatgtatcagacatttattggtatttacgacttgtttcaagtctatattcttatctacaatatgcacgaaggagtcttttgcataatattcctcatacatgcgaacgatttcttcgagtgcaactttcgtttttacgacaagagtggcaaagatgccgcgcgggaaatctccccgataaggaataaagtcgatctctgaatcgaagctgttctgcaactgcttcagtgattgcttgatttccggtacgtgctgatgatcgaaggccttgtatatactgatgttattgttacgccaactgaaatgactggtagcaccgggcttcacgccggcaccggtacttccggtgatggcattgaccgaaacatcgcctgtcaacatcagattcttggctagcggaagcaaacctaactggatgcaggtagcaaaacaaccggggttggctacgtgcttcgccgtacaggtagcacgacggttcagttccggcagaccgtagatgaagtcatgatcgtcactcttgatgcgataatccatcgagaggtcgatgattttcaaatcttccggcacgttgtggctttccatgaatttcttcgtgtcaccgtgggcggtacagaagaatagtacatctattgcgtccagaggtaactggtcggtaaatctcaggtcggtttctccgtagagtccttcgtgtacgtcggtgattcggtttccggcattactgctgctgttgatgaatacgatttcagtttccggatggttgagcagcagacggattaattcgcctgctgtatatcctgcgccaccaatgattcctgctttaatcatatctcttcgtctttatggttattgtagtaaacacgtagcggagtagaagttaccttaataaagcccttagcatcttcggctgtccagcccttctgcatttcaccatattcgccgaacttcgttttcacgaggtcgtcttccgattctacaccgacggtagagaaagaaagcgggcggagctcgaggattgccgtaccgttaacgttacgctggctttcctgaagcatggcttcgatgtcacgcatcaccggttcgagatactggctttcgtggaggaacattccgtaccagttggccacctgatctttccagtattgctgccatttgctcaatgtgtatttttcgaggaagcggtgagcaccgataatcaacatcggagcggcagcctcgaaacccacacggcctttgatgccgataatcgtatcgcccacgtgcatatcacgtccgataccgtatgcggcaccgatctcttctaccttctggatagcttggatcggatcatcgaatgtttcgtcattgacagctttcagttctcccttttcgaaagtgagacggagttgttcgctgccttctttttccacatgtttcaggtaggctgtttccggtaatccctgtgcggagtcgaggatttcgccaccacagatggatgtaccccacaaacctacgttataagagtatttcagtttggtgaagtccgcgctgaaaccatgtttgttcagatagtcgatttcttcctgacggcttaatgccatatcacgggtcagcgtgatgatttctacattcggagccagtacaaggaaagtcatgtcaaaacgaatctggtcgttacctgctccggtagaaccgtgggcaatggcatccgcaccgatttcgttggcataacgtgcgatggccaatgcctggaagatacgttccgagctgacagagatcgggtaagtaccattacgcagcacatttccgaaaaccatatatttcagactcttttcgtagtattcctgagtaacgtccaatgttacatatttcactgctcccagtttgtaggcgttttcttcgtttgtcttcagctgttcttcgctgaaaccgcccgtattggcacaagctgcatatacttcgtaacctttttctttagcgaggtacatgacggtgaacgatgtgtccagtccgccgctgaatgccaccactacttttttcttcttttcttccatagtgctgtatatattaaatgttatttctttcttgttctttttttatgttccgtgggtctgtcggatcgtacagcatggctgtgcagatgcagaacttacggtttttagctaccagtatatcgtggttggtgcagccttcgcatcctttccagaaagcttcgtcgtctgtcagttcattgaaagtgacagggacatatcctagttcggtgttcattttcatcactgcggctccggatgtcagactgaaaatcttagctttcggccatcggagacgtgccagttggaaagatgcttgtttgatgcgctttgccaatcctaatccgcgaaaatcgggatgtacaatcagaccggaggttgctacgtattgcttgtttccccatgattcgatataggtgaaacctgcgaatgtgtcgccacagagcgcgattattgctttgccctctttcattttagtcgctacgtattcgtgtgtgcgctctgcgattccggttcctcgtacggcagcagcatttctgatagtttccaaaatagtgtcaacgtaaacctcatgtgaggcgtcggctaccataacatctatttgttgagtgtccatttctttatatataatataagtatagttattcgatattcggaatgatgagcgacaaaagctgacgtactttgcttgtggctactccttcacgcagaaccagcatgatggtatcgtcgccggcaatggttcccagaatctcgctgaactcattgttgtcgatatcataagccatgctgctggcgtaaccgggacgggtacggatgacagctatattgccggaaaactgtagggagataaatccattgttgcgcaacatctcaccggcactctggtcagtggaacgtttatacatgatgttattcggcaatacatatacatacttgccgttcatacttgcagctttggctactttcagttgtttcaagtcgcgggagagggtggcttgtgtcagttcgaagccttcacggttcagctcttgcagtagttcttcctgcgagcctacctccttgcttgagataatcattttgatggcgtctaaccgatttgctttcttcttcattgtataattattctaagaatggcgcaaaattatgcattatttcggagaaaacatgcataaatcatgctttttttgcataaaaagtaaaatttatactgatgtaaggtttggctatgcagatttgtgtcaaaatgcacatcctttctatcaaaatgcgtaaggaaaaggaggaaggaaccgcctatctttgcaatgtaggtaaatggataccttaaatatatagacaaaataccatgaaacagaacttttttgcagtcgacctgggcgcaacaagcggccgtacaatcttaggctcttttattgaaggcggattaaatctggaggagattaatcgttttcctaaccacttgatcgaggtgggtggacatttctattgggatatttatgcattataccgtcacattatcgacggattgaaattggtagctcaccgtggcgaatctattgcctctatcggtatagatacatggggagtagatttcgtcctccttggaaaagatggaaacctgcttcgccagccttatgcatatcgtgatccgcatacggtaggagcaccggaagcctttttctctcgtatctctcgtagcgaggtatatggtaaaactggtattcaggtaatgaattttaattcacttttccaattagatactttgcgtcgcaatcatgacagtgcattggaggcagcagacaaagttctgtttatgccggatgcgttgagctatatgctgaccgggaagatggtaactgaatataccattgcttccactgcccaattagtgaatgcacatacgcaacgtctggaaccggagttgctgaaagcagtcggactgcaagaagagaatttcggtcgttttgtcttcccaggtgagaagataggaacattgactgaagaagtgcaaaagataacaggattgggggcaattcctgtgattgcggtggccggacatgataccggatctgctgtagcagctgttcccgcacttgatcgtaatttcgcatatttgagtagcggtacttggtcgctgatgggggtggaaacagatgcaccggtaatcactgctgaaacagaggctttgaactttacgaatgaaggtggcgtagaaggcacaattcgccttttgaagaatatttgtggaatgtggttgctggaacgttgccgtctgaattggggagatacaagctatccggaattaataaccgaagcggattcgtgtgaaccattccgtagtttaatcaatccggatgacgactgttttgcaaatcctgcggatatggaacaggccattcgtgaatattgccggactactgggcagccggttcctgagcaacgtggacaaatagtacgttgtatctttgagagtctggctttgcgttaccgtcaggtgttggaaaacttgcgtgcgctttctcctcgtcctatcgaaactctgcatgtgattggtggaggtagccgtaatgacttgttgaatcagtttactgctaatgctatcggcatcccggttgtggcaggaccgtctgaggcaacagctatcggtaatgtcatgattcaggcaatgacggtgggagaggcgacggatgttgccggtatgcgtcagttgataagccgttcaattccgttgaagacttatcacccacaggatatggcagcttgggatgcggcttatatccattttaaaaactgcgttcgataaattccggagaatcaaaaaataatcgacagaataatattaacttttaat

SEQ ID NO: 141 - DNA, 20206 bp, Bacteroides thetaiotaomicron
accttatataaatgatatatataaagaagtggggaaaactctctcatgagaaatagggaaattttaaattcttaatagcctttgtgtgccatatttactcagcaatacagatacttacccgattttcttcaggagtattatatggctgaacagtatcacctttataagcaactgtaattctatcggcagcaataccttttgctttcaaagcttccactacattattcgcacgtttttccgataatttgctgttgattctggcattaccagttcctttgtctgcatatcctgtcacgctcactttagcagtagcattcttctctaaatattctactagagaagcaatcttggcttgctgatcgtcctgaatctttgcagagtttatggcaaagaaaatattctgcttcaacggttcaatcaccacttcctttttgggttgcggttgttctactacaggagccggtttgggttgttccgtcactaccggttccggttcgtaatagaccggagcggttttagtgtagcttttacccagtctgatacttacaccgacaagggcattcagttgccagtcacagttaccggccttcttggagttgaacttatcagacaaggcgttggcattcgcttcgatgttaatagacaagcggtcattcaaacgaaggtcgcaaccaagaccgaaacgtccggcaacgagaaacttaccttcctgccagagatattccatctcataagtacgggtatcgagcgcatttgcttcatcgttgtcaaaaccacggttcagccctgctccggcaaaaagatagccattgaacacacgcttcggattgaaaccacagaacaaagtactgagatccgccatgatgtctacatttccttgcagatatttatattggtaggtctgttgcggattcacccatcccccctttgcctgccagccacttacaccaacacgtgcgccgaatgcgggagcaaacttataaccgacattaagagctgctgccggagaaataagatcagtgaattttgcttcacctacggtatgggctgctcctatttgtgcttgaatgaaccaatgaggtttgaaagaaatcttttcaggttccttgatacgctgttcctgggcggaaattggcaatacactgatagccattatacctatcaacagttttcttctaatgctcataattgattaatttacattaaacataaagcgcctctcattagagagaagcgcttcattatatttaagttcaaaaagaattagttacctaatgtcttttcaaccgggataatcacataagacttaactgtaccccacttgtaagtgacagtaacaggtaatctcaagttgaatgcaccgacagcgttaccattgtttgtatatgtaacggtaccataagtatccttagcaggagctgcaggaataggattaaccgtagtaccagtttgagtaattaccagttgtgaagtaacctcagacaacttcttagaattgatatcgttaccattcaagtcagtagtaatattaggtatatcaactgtaattagctcgattccataataaccgaagtagttagcttttactgttgtgctgaatgcttggtttctccaatcagagaagctcaacaggtcgagcatattaactgtagaaccattatcaacagcatcttggaacttaccttcaccggcaattacatcaatcggacgcaagaagtaagccatatattcaccgttagtgataggcaactctaatgcacattcaccggtagttgctttaatgttaatccaagcatagaatccggcagatggaactgagttgtgacttgcaatattcaacaggtcttttgcaaagtctgtattttgataagtgactacaccatcagcatcaatcactgctacattttgagtcgcagcaccggcagtagctttcaatgtcaagccatcatcactaactgataatgtatattcagtaccgctcaaacctttctctttacgatttacgttcttagatgcaaaaatatacttgtaagcagtagcacctgtgataataggtttgtttccttcaaatgtgttatccaagtcaactgcaaatgcacagtcatcagtcagagtacccggaacaactacattcagacgaacgtaagtcttattagcatcccagtattcagcgatcttgttagaagcaggaattgtaacagcggcaattgcattaaccttagtagacaatgtgatagttacatcgctgtaagaatcttcataaccagctttcggtttgtaagttacaacagccttcaatgagccaacatcagaagtcttcgccaaagctaacttcatatcggcctgagaaatagtccacttcaacaagtcagtttgtgtaacttctccagcatcggcaacctcagtaaccacaccatcgccggtatacaacggattggcagcttcatagatagtcttgaacatcttatagtccatacccaacttgttataaaccttcacattcatttgttcaactgtcaatgcgaatactttatcatcacattggttagtgaatggatcaaatgtgaacggagcgtcaatagcaggagccttatctttagtgatcatcactttaatccaacctgtgctgaccactttattattagctttcgtatccaacagctgaacacgtaccaatggctgacgacctacggcagcatacggagtagctgtttcattaaacaatttcggatacaaaaccgaacctgtcaatctagcgaaatcactttggttagtctgattagtaccatcaatataagcacacaaatggaaatcatacttcaagcctaattttgccagttccgcagcagacatagtcaaatctgttttattagcagccacgtcatcataacaagtgataactttgtcagcaagatcgataccggtagttgagttataagcaacttcatagtctgcgtcagccttgatagcatcatctgccttaccagaggttgttccatacaagtgatgttgtgcagcagctgcagcttttttagccttgtcacccaaaatcacgttttcataatctgttgcgtagatagctctatactcatcagtaattgtattaccagcttctgtttctacacggatagccaaaacagtaatcttagaacttgagatagcttcaatcaactcagtagtagccttgaagtaaacagtcaaaacaccgtcttttacttcatagctttcaacttccggattagaagcagctgctctagttttattaatatactctttatctgcagaaagtacagtgatcttcttaatctgttctttagttgcacttgacggattcagataataagtacccgcaataaccggacgaacataagaatttgtagtagctttttcccatacttcaccagtagcagtagccggattacagctagtggtttcaccccaagctttgtaaacgactttcaaagccttcattgaaggaacgcctcccagataagcatccggttcgaagccaaagcttgtaataggcaacacatcacagatcatcaaattaacaggttctgcattaccatatttaatagcccagccataagttacgccatctgtagtcatttctgtgatagtcagcgtaccttgcttaggtattgtaaccccggtagcaacaccgtcatattttacaacgccatcttcaccaacagtcaatttggtagcatcaaacttggtatcagtgtcagtatctgtaaaagtaatagtcttagtctgtttattacctttgtcatcggtcaaagtaatagtagctttattaccatcctgagatacatccaaagtgtacgtagtattcgtatcgttatcagggatcgtataagtagtaggagtccccgattgatctgttactgtcaatacaccattagcaaaggataccgatttcacataagccaatgctccgaacttggtattcaagtcagctaatgttttttcgactgcatccacacgttcgctcagaccattgatgtcgtcatcgtagtctttacaagatgtaaatgtgcccgtcgaagacgctaataacgctccaaacaggactgcatttaaaaactttttgttcataataaaaaaacttttaatttataaattaaataataaaaatataatctctcgatgtcgattcaataatcccatgtgttgtccccattcatttttagtgtaacctccttttctttttttgttttacctgtgtccatgctccatagaggatgaacaagaaacttactcccaatactttttgcccgttacttcataggtaacgggcaaacctttgtcctggctctcatgaagccttctttatgaaaaactgtatgatttagtaatgaaacttatttacccctgcttcaaagaggaggcagaggggagggaaatctttgaatataattagaaggttataaaggtctaataaaaagaaatccgccgttttatcgtgttatttctctttttttagtagtttatcagaaaaaatatcttttttgtttgcatgttttccaaaatatctccatctttgcaacgctgtttagctccgttacctatgaagtaacaggcttaaattcaacacattgctattggaattgagcgctttataaaatccaccacctttttattggcttcatctattttcttattccgaaaaggtttgagatacgtctcggtcactgtgatcgaagagtgtcccatagcttcagaaataacgcccgggtgaatttcacaatagtaagctgtcgttgcccatgtatggcgggcagtatacgaactaagtttatcccccagtcctaacatttcacctagcaacatcagttgtctattgaaattgcggagtgccaactggtattcatgataagcctccttcgtcccttcccgactatttaataacggaaataaataaggagatgacgtatcacgattcatatacctctttaatatagccatcgcttccggagtcaaagtcactgacaaagggcgcccggtcttccgcctgcggtaagtaatcacattgtcgtgcaaatcacttttacgcaaataagcaagatcgacaaaaggcagaccacgaagcagaaacatcaaaacgaacaattcctgcgtacgacgcatgtcagatgtcacagcggacgactgcggcaatttggtgaatactttctgtatgtcttcggtatccaatgcacgcttacggtccgcacgggtgccggtatatacagaacgaaacaaatgcggtacataaacagccccacgacaatctaccgcacgattatagaccgcacgaaatgtgcgtaaataggtggaaacagtgttccagctacatccccggccacgaaggtgaatctcgaagccttttatccactctggggttacttcattgaacgtaaaatcccctttcccacgataagcaatgatggcattgagactgctacgataaacgtgcgcagtaccaaagtttccccccatctgtagtcccttggctacttgcttcataaatgctactacttttaacattttaatcactattaaataaattacgcgataaatataagagtattttcgtaaccgaagccacccaatacacatatattcattgattttagagctgtatggacagtatgttaatcaatgttcgatctgtataataacaaaaagaaggtgtgtcaaaagtaactaaatttccctccttcaggaaggaggggtggctgaaagccggggtggtaggtgtacttcacagctgaagatcaatagcttatatattcacctaccacctccccctacgggtactcctccttcctgaaggaggagagtttagttacttttaacttttgatacacgtaccttcagatacaaaaaaacaaaagaggatgcctccagggaaaaaagggcaggcatcctccttggggcagaataaggtacactttcacaagtataatcttatactgttaccccctgatacaatttcttcacattcaagtgaagaaaggggtctattgtggaaacacagactttcacaagcccgcacttcctattcatctcatgtgaggattctcgtacgaatacgaaaaatgtgggaaaaaacacctcacatgagaatagggaatatcttttttaagaaaagagagttataatcacaaatattattccgctatacagatacatacacggttttcttcaggtttctgataaggctgcaccgtatctcccttataaccaataacaattctatcagctaccactcctttagctttcaacatctcaatcacattctttgcacgtttttccgacaaagtcatattgatattcgggttaccggtttccttatcagcatatcctgtcacacttaccttggcggcagaatgtttctccagatattctactaaagaactaatcttggcttgctgatcgtcctgaatctttgcagagtttaaggcaaagaagatattctgcttcaacggttcaatcaccacttcctttttgggttgcggttgttctactacaggagccggtttgggttgttccgtcactaccggttccggttcgtaatagaccggggcggttttagtgtagcttttacccagtctgatacttacaccgacaagggcattcagttgccagtcacagttaccggccttcttggagttgaacttatcagacaaggcgttggcattcgcttcgatattgatagacaggcggtcgtttaggcgaaagtcgcaaccaaggccgaaacgtccggcaacgaggaacttaccttcctgccagagatattccatctcataagtacgggtatcgagcgcatttgcttcgtcattgtcaaaaccacggttcagtcctactccaccaaaaagatagccgttgaacacacgcttcggatggaagccacagaacaaagtactgagatccgccatgatgtctacattcccttgcaggtatttatactgatagttctgacgtggattgacccatcccccctttgcctgccagccacttacaccgacacgtgcgccgaatgcgggagcaaacttgtaaccgacattaagagcagctgccggagaaataagatcagtaaattctccttcacctacagtatgtgcagctcctatttgtgcttgaataaaccaatgaggtttaaatatcgttttactttcttctttgatacgttgctcctgcgcaaatgctattgtagtactcaacgcatatacagcaactaatattttttttatattcataatcaaaacctgtttaaaagtctaaaaaccaatgacaacagtactcgtcaccattcatctactacttatcagtagcttccttggtagcctctttaacggcaagataccaaactccgtctattttcaccggattaaacataaatccaattgtatttggcgtatgatcatccgaactagtgtgcttgaaaaactctatctgaaacttcacatcgttattatccgtacttgaaaaagaataataatccaatttataatctacaacaggaaaatacttgaattttttcctcagttgttgttccttctcagcgggaagaggtatcgcttttccatcgcgcaagataaaaagcatcttcagcgcttcatctatatttccggctttcaatgtatccatgcaactgcgtgatatggtaagtacttgcaccgtatcttcagctgtcaaccccattaagaattcttctttgggagtgagctgcttctttttttctccgcatgagaacaagaaacaagaaacggcaaccaacacacatatatataacagatctttctttttcattccgccttcaattcttattgtgaaggagggtgcaccaatgatcggcgcaccctccttatcagtgtttagtaatgaaacctttactattagttacccattgtactcttaactgtacaatctactgtagtcttcacagtaccccaagtataggtgaactcaaccgggatgcgcagttcaaatgtctgaacgttgttaccgttgtttacatacttgatcttacccatagctgcaacaattgcatcatatgtagcttgagtaccacttgcttcagtattataagaagaaagatttaaagtagcagaagtaactttattaccatctttatctgtctgagtcaatacgattttctctgttttgcttgacaataaagtctctcctagcttaccaccacttaaggtagttgtagcatctgctattttcacttctaccttattcaatccgtagaatgcatacaaccagctgtttgaatagtcagttccatctacgaacttaacattacgccaatcctggaagttgaacaacttagcgatatccagagtagaaccattagcatgagcatcaacgaattctccaccatctgtacctactgcgtcgataggacggaggaagtatgcattgtatgtattgttcgtcaaagacattgcaatgttgcaaggactgtatgcacaaataccgatcttagcaaaatgcttagcagcactatggctatatgcattcaacaacttcttagaagtatcattgttttcataagtaatcttaccggtgttctgatcgattgttgcaataacagttccattagcatacaacttcgtattagtgaatacacctgcatctactttcaaagcatgatcgatcatgttctgagctgtagctttatatgaaccgcctgtaatacaaggtgctgtagcattatctactgacaatgtatacttagttccatcaacagtcaatacattctgatcagcgtcgaagtaatacttataacctccggcagcgccgttttgatttgcaaatattacatcagtataagaagcaaagtttgcaggaggagtaaatgtaggcatacccttttcccatacctggttcaagtcaactacataattcaatgtattgccgttatcttgcggataaggaacattcagacgagtattctgaccatccttagcaacgtcaccgtcactgtaccagtagttagtcaacttagtaacaacagttccctgaggtttagcgacagctatctgcaaaggcatgtagataggagcatgagatgtagtattcagcttgctgacatatcttacataaatagtagctgtatgacctgccatttcataaataccagactgttctgcagtagtcaaagtccagtgaagaactgtatttgttgtaccagtttcatccaccttttctttcactgttccaataacctgtgcaatcgcagccggaacgaatgacttaccatcggctgatttagcaaactgtttggctacaccactatcatctacatcgaattcatataaagcatcgaattcatccttagactgaacagctgctttttcaagcaattgataagaaatctcagaccatgtcaagatagcatcagcctcatcacatccaaagttgtgagtgcctttgtcgaatacacttgtaacgatatcatcaacctgttttgcaatttcaattttaatgaatccagccaagacaacgcggccatccgcatctgtcacacgtactctaaccaacgggcgttttcctacagaagatacaccttgctcgttaagagtctcaccggcagagtttacaatacgcggagtaagtacaccttctttaatagtgtttgcatctgcatatttactgtcagaagttacattttgacctgatgtatattgaatgaacgcgaagtcatacttcaaaccatacttagcttcatctccataagcccaaactttatgagtaccatcattttttgttgcttcaggctgaccttcacgattatagtgaattgtcaacagattcttcaaatcaataaagctattataagcaactgtcaaagtaggagcatgtgtgatagcaccttctacagtcttgaacaactcgtccggattagcagattcccggcaatcttcagcagctaaagtagcatcattaaatgcaatagcctgaggagtaaccttagaagcataaagcaatgcgtaatcagatgttacagttgtatctgcctgagcatcactttttgctttaacaattgcctgcaaagccaagatagaaccttcgcctccttgtttgatgtcttttcctattgctctgagtcctaccggaaggataccttcatcagcaggtttcatgtcagcgacttcaggaagagccactgaagcacgagaagaaatcacttcaacatctctggatacaaaagacaaatcttccttacttacttttgcactagacggattcaagtgataattaatatattcaatcggattatattgagctccggtaccacctgtatagttccattctttcgaatcagtaattactttacacagaactttctctgcttgctcatcttcccattgagtagtagctgcagtgcttcctgccttatatgtataatccaaataaggatattcgatagcttcgataccgtctacaaacaaatcagatttgaaaacaagacctttcagagtcaatacgtcattcaaagcaaatgtaacagcctgatctttgtacttaatcgtatagccgataacaacgccctcagcgtttttcttatcttcaatactaagaactccgtcaccaggtatagttacaccagtttccttaccatcatacattactttgcctgtcgtaggatccactgtcaatttagaaggatcaaaagcatcaggaatggttggagttgtaggagcatccgggaatgtaatagtaccggacgaaacaacttcaccgtctttcaacagcgaaattttaccttccttatccacactaattgaataagtcggcaaattctgtccgatagtataagacacactgttgttctctccatctaccacagtcaattttcccgtagccggatcataagtaacagactttacaaaagacccaactttggcctgcaaatctgaaagactttttgcgagttcatcgattctgccgtttactgcatcgatgtcgtcgtcatagtctttacaagacgtaaatgtacctgcagaagacgccaacagcgccccaaacacgactacacttaaaaactttttgttcataataaaaaaacttttaatttataaattaaataataaaaatatagtctcgcattgttgatttaaaactctcatgtgttgtccccattcattttcagtataacctccttttcttttttgttttacttgtgttcatactccacagggggatgaacaagaaacttactcccaatactttttacccgttactttgtaggtaacgggaaaacctttgtacctgccctgagagggtagataatactgaaaaatcatttgttgaatgctgaaacatctttacccctgcttctaagaggcggcagaggggagggaaatctattatctaaaattaaaagctacaaaagtttaatgctaagaaatccgctgttttatcgtgttatttgtctttttttagttgtttatcagaaaaaatatcatttttgtttgcatgttttccaaaatatatccatctttgcaacgctattcagctccgttacctacaaagtaacagcactaataatcaagctattaatccagtaactatccgtttcacaaaatccgttaccagttgattggcttcatcaattttcttatttctaaaaggtttcaaatacgtctccgttaccgtaatggacgaatgccccattgcttcggaaataatacccggatgaatttcgcaataataagctgttgttgcccacgtatggcgtgccgtgtatgagctcagcctgtcgcccagccctaataattgccccagcaacaacagttgctgattgaagctgcgcaatgccaactggtattcacgatacgcctccttcgtcccttcacggctctccaaaagagagaacagataaggagaagaactgtcacggttcatatacctctttaataagaccatcgcttcccgagtcaacgttactgacaggggacgaccggtcttccgcctgcgataagtgatcacattgtcgtgcaaatcacttttacgcaaataagcaagatcgacaaaaggcagaccacggagaagaaacatcaggacaaacagttcctgtgtacgacgcatagcaggagtcacggcaggagacgaaggtaatttggcaaaaaccttctgcatatcctcatcacacaacgcccgcttacggtccgcacgcgtgccggtatatacagaacgaaacagatgcggtacataaacagccccacgacaatctaccgcacgattatagaccgcacgaaatgtgcgtaaataagtagatacagtattccaactgcatccccggccacgaaggtgaatctcgaagccctttaaccactcaggggttacctcatgaaatgtaaaatcccctttcccacgataagcaatgatggcattgagactgctacggtagacgtgcgcagtaccaaagtttccctccatctgtagtcccttggctacttgcttcataaatgctactacttttaacattttaatcactattaaataaattacgcgataaatataagggtattttcgtaaccaaagctatccgatacacatatattcattcattttagagttgtccggacggtatgtgaatcaatgaccggcatatgaaactaacaaaaaagaaagctggtatgtttcagtaggattccccacaaaatataattgcagacagataaaatcatcattatcgtaacaagcagacagaagattcattatctttgtggagtcgcaaacaactaataaacagaaataatgacgaaatttattaatccatttaccgatgtaggatttaaaaaaatcttcgggcaggaaatgaccaaagacttgttaattgatttcctgaacgacctgctggtagatgaaaaacatataatagacataacctttctcgataaggaaatactgcccgagtatatgggcgaccgaggggtgatctatgatatatattgcactgccgaaaatggagagcaattcattgtagagatgcaaaacaagcagcatgtacactttcgtgaacgtgccttgtattacctttcaaagactgttgcccggcagggtgagaaaggagccgaatggaagtttgacctgaaagccgtatatggtgtgttctttatgaacttccggttggacaatttgccgcataagcttcgtacggatattgtgcttacagatcgtgacacgcacgaacaattttccgacaagcttcgttttatttttatcgagttgcctgctttttcgaaggaggagcaagagtgtgaaactgactttgaacgatggatttatgtactgaagaatatggaaacgttgaaaagattgccattcaaagcccgtaaatcggtttttgagaaattagagaagatcgtagatatcgcttcgctttcaaaagaggagcggatgaagtatgatgaaagcatcaaagtgtaccgggataatctcgtgacgctggaatttgcagaacagaagggacgtgcagaaggcaaagaagaaactgcccgaaacctgaaaaagatgggagtttcactggaaatcatctccaaagctaccggattgagcatagagaaaatagaagcattatagttgttaccgtctacctgtagaggagtgctcggtaaatatcccatattgtaagatgaagatcaaaggttaactttaagtttgctttgatcttcatctttcttatttaatgtaagtttgatatcccccctcttcctttatcggaaacaaaattgtatagtaaaaacaaaaaaagaggatgccactagggaaaaagggcgggcatcctcttaaggggacagaataagatgcactttcacaagtacggtcttacgctgctactctccccgatacaatttcttcacatttaagtgaagaaaggggtctattgcggaaatacagactttcgcaagcatatatttcctaatgctctcacacggaggttctcgtacaagtacgaaaaaaaatgtggggaacaaacactccgcatgagaatagggaatatcttttttaagaaaaggatcttcttaatgtagacatcattctgctatacagatacaaacacgattttcttccggtttctgataaggctgtaccgtatctcctttataactagtaataattctatctgctgctattcctttagctttcaaggcttctacaacatttttggcacgtttttccgacaaagtcatattaattttcgggttaccggtttctttgtcggcatatccggttacagcaactttactggttgggtttttctccatatatttaatcatagcatcaatctttgccaactgatcattttgcagaagtgcagagtttaacgcaaagaatatattctgtttcatcggctcaacaactactacaggtttcggttctggctcttttgcaacaacaggttccggtttaggctgttctacgactgcaggttccggttcgtaatatacgggagctgttttggtatagctttttcccagtttaatggtcaagccaacgagtgcgttcagctgccagtcacagttaccggctttctttgagttgaacttgtcggataaagcgttggcgttagcttcgatattgatggccaagcggtcattcaggcgaaggtcacaacccaagccaaaacgtccggcgacaagaaacttgccttcttgccagagatattccagttcataggtgcgggtgtcgagtgcattcgcttcatcgttatcgaaaccacgattgagccctacaccaccaaaaaggtagccattgaaaacacgtttcgggttgaagccacagaacaaagtgctgagatcagccataatatcaatgtttccctgaagatatttgtactggtaggtttgttccggagttacccatccaccctttgcctgccatccactaccaccgatacgtgctccgaatgcaggggcaaacttatatcctatattgatggcggcggcaggagacatcagatcggtaaacttggcttcgcctacggtatgtgcggctcctacttgtgcctggataaaccaatgaggtttgaatacggttttaccttcttccttgatttgtcgttgctcctgagcaaatactactgtaccactcattgcaagtatggctactaataaatttcttattttcataatgttatgtatttaatgtcttgttacagaaatctcatacgatatgtcacaactatatatcaggcaaatcttatcacccaatatatgctttgttatatgaaaagggtgctctgactagagcagagcacccttcctgaaataatatgtgtctaaaaattgatagacaacattttgatcttttagttcttcggattaactgtaatagtcaatgtggaagaaagtgttccccaaccgtagtttacagtagcaggaataaagatcttgtaagcgtattcaatcggtgaatccacatttacatacttaacggtattaccaacttgttctaaagtagtcttagcaggcagcttaccaccattgtatttcaagtctgtagtaactttagtaatatcaagtttcacatcgctgaattctccataatagaaccagtattgtccgagattaataactgagctaccgaatgtagtcttagtccattcccaacatcctgatttctgaccataagattctccatcaaatgtaggcataggtgtatgttcatgctttttagcaacgtagtcaccaggaacaacgactatttcagccggaacataatcaatatttgctacataggtatattctacatgagaaccctttatcacaggaatttccgtaaaattataagttgaaccgaagtttacatatccttcaggagttccctcacgttcttgtacttccagcatagccatcgcttcagcctgagtcaacattgcacctacagaataggttttttctatcacatcctcggtagaagttcccggtttccaataattaaccttagatgttccactatacatagtaagatctgatgcagtaacgaagtcaacttttccataagtaacattcagactagccggagttttcacatagctatgttctggaacccattcatattctgttgtacaaacttgtttccagtatgaagaaatatcttcagtttctactacactcggagatacaatagcattaccgctccaatccatcaacaagccattccactggaagttagcaacatcaccacctgttatagcgtctgtcagagtaactccactaggcatattcaagcttacaggacggatgaaattaaccataaattcattgacagtaatctgatcaccgctttccaatgtatagatatgtgcaacagaagcttgcagaccgcctgcgctattcaaagcaagcttaacatcagcatcattcttatccaatgagatcgtttttccactgatcttaacacctgctaagactttgcttgtagcaactccgttagaataagtcttagttacaacataacggtctgttacacaatttggaagtccttttacgttatatttatcgtaagcaagattcagttcttgatggatctggcatccgtctgcaggatcttccggagtattaggtactacagcattcaccttaaagaacttcatatcaccatcaatagtctgccaatacagttcgttcttcactgcatctaagctagctttcggcaatttcacatttacagcaaacttgaatgtgattgcatcaggatatttagaagattgcagtttattctgaacagtgatagtagcaacaaattcagaaccagtagcactaatagcaccaagctgaccgtgtttgaatgaccagacaaccttcttagttgctgtacctactgaagtagcaccagctacaattttcgggaaatcaacaccagttaccagtttgccattcttcttaacagatgcaacagcagtagaaacatcgtatgtattccagaatgtctcatgactcataccaatattagtaccatcagttatcttacgataaacattctcacggatatattcttctgtaatagtatatgttgcttctgtatcagcacatttgaataccaattcttcagccggattacctaccgtgaaatcaggttgtttttctgcagtgaatttaattttcacaaatccgcgacgtaccacgttgccattttcgtctaccaattcaactttcaagatcggagtacgaccaaatgcttccggattgaaaccttctgcctggaacaaacctttctcaacatcattacacttaacccatttctgctgattagtttcagttttaccttcttcaagattaaaatccgtagtagctacagcaaatctgtatgacagtttataggcttcaatcgggaattcatcatgaccagtagatacattttcattattgagacaagttgcaaccagttttttcaagtcgaatacttgatcataaggagtctcgtagcgaggttcttctttcgtacaagcatcgaatgtagttgcataatgagcagcattaccaccttcaaacaaagtttccttatcagcgatacgaacatcttcagcagccaaaatattatcatatacagctacatacggagaagtaatgacggcatttttctcatcttgatcaattgcatcacctttcagagtagcttgcaaagcgatcagattcgttctgtcaagttccggctgagtagtgtgagaattaagacgaagaagttggaagtcaacagttcctgttgcggggttagcaaccggttcgccaacaatctcaaccaacttacttgcagcaattgcacgagttgtttcaacaacttctgcagtgcggtcgatatagctatagtcagcatttgccaacttaaagcttgccggattgaaatgatagctagcagtcgccaaagcagctgtagagaattgatagctctttgctgggatgctggcattttcatctttcacatccattggagaatattgcaaggaagtgaatcttacagcttcaataccgtcaacgaacaagtcgggagcaagcgagatgcttgacagacggcaagttaccaatgtatgcagaccagtcaggttcgtattgatatttccaatcttagtattgatttctttaatagaagcctgaatgtcttttacattcttcttaatagcatccaattcatctgttatctttgtttccagatcactgatagcggttttatttgcaccgatcaaatctttcagaccgcctttaccatcaatttccttccacaaagcagccaaatcatcctgtgcagctttgatatcatcctgtgctgctttaatatcctctgcattagcatcaattttagcctccagcgttatcttaacatactcatcgagttctttcaatgttgtagcaaagtttgcgtctgctgtctgcaatgtttcgataaggtccatagcagttttgatagcctctgtattttctttcacagcaccattttccaatgtactcagaccagcttcgataccatcgatacgagcaccaagaagttttgacgcttcttcgaatgcagtaacatcaagtttcttgtcgatagcttcctgcattgagtttctcaaagcttccactaattttgtagcctctgcgatagcttcagtttttgctgtagcagcagcagcttcggcagctttcgctttagccaaggcatcagcagcatcagctttggcctgatcaccggcagcttttgcagcatcagcagctgttttagcttctacagcagcagctttagcagcatcagcagtagcctgagcagcttcagcagcagctttcaaagtagtcagctgagtctgaagatcagtaatagtgcttccgcttttgtcaatttgttcttgcaaccccttgatgtcatcatcgtagtctttacaagaagtaaatgtacccgctgaagccgctaatagcgctccaaacaggacgacacttaaatactttttgttcatgataaaaaaacttttaatttataaattaaaaaaataataaaaatattgtttctcgttttggattatgaattcccttactacatctcatgttttattcctttcatttcttgtgcaaacctccttttcttaatttgttttccactttcaattaccttacacaatatactttgaagcatacagactatattaggttttcccgttactctgtaggtaacgggaaaacctttgtacctgccccaggagggtagttaatactgaaaaatcatttattgaatgctgaaacatctttacccctgcttctgagaggcggcagaggggagggaaatctattatctaaaattaaaggctacaaagtctaatgctaagaaatccgctgttttattgtgttatttgtctttttttagttgtttatcagaaaaaatatcatttttgtttgcatgttttccaaaatatctccatctttgcaacgctatttagctccgttacctacagagtaacaggttaaaaatcaataaattgcaaaagacattgagcgctttataaaatccaccacctttttattggcttcatctattttcttattccgaaagggcttgagatatgtctcggtcactgtgatcgaagagtgtcccatagcttcagaaataacgcccggatgaatttcgcaatagtaagctgtcgttgcccaagtgtgacgcgctgtatatgaactaagtttatcccccagtcctaacatttcacctagcaacatcagctgtctattaaagttgcggagagccaactggtattcgtgataagcctcctttgtcccttcccggctatttaataacggaaatagataaggagaagaactgtcacggttcatatacctctttaatatggccatcgcttccggagttaaagtcactgacaaaggacgcccggtcttccgcctgcggtaagtgatcacattgtcgtgcaaatcacttttacgtaaataggcaagatcgacaaaaggcagaccacggagcagaaacatcaaaacgaacagttcctgcgtacgacgcatgtcagatgtcacgacggacgactgcggcaatttggtgaatactttctgcatgtcttcagtatccaatgcacgcttacggtccgcacgcgtgccagtatatacagaacgaaacagatgcggtacataaacagccccacgacaatctaccgcacgattatagaccgcacgaaatgtgcgtaaataagtagatacagtattccaactgcatccccggccacgaa

SEQ ID NO: 142 - DNA, 20184 bp, Bacteroides thetaiotaomicron
ctatagtatttattgggtggcattattagttattatatgggtttaagacaatccagtcttgatagaacatttctaccaagactggaatatcattattctagaaggatattattctgttaatctgtagatggttacgtctacttgagttcctttataacaagcaaatcgatattgattgttattattattccattgtaaattacgggcagcgtattttactggaataattttagtaccatcaaatttccattggaatccatcttttatagaactatcgaagtgtaaattattaccatcttttgtcaatcccaaataggttgatccaagtagaatagtatattgatcttcactaccttctaccttagctatagtacatgcatattgattggtctcatcatttgccgctatagtttcattagatgaattataggctgataaaatatctacatatccggcataatcacctgcgccttttcctgataaaacattgactgtcgttccatcctccttagtatatgtaatcaaatacttcccactccaatcagaaggagccgatgttactttttcatatacttttgttacggctcccttagcatcttgttttacaactacatttactttgctatttccaagagcaattaccagggtctgttcaacggctccaccgttattctctattgcagtaactgtaacaacattgccttcaacggatgaggataagttaccgcttaagcctgtagctgtaataacatttgctccttgatttgcagtggtaactgtaattgttttagtaccaccagttgaaaggaagcttaatgaagatggatctacttcaacaattgttggttcagtgactttgaatccgctcacgtcttcaagattacgaggtgctaattgtcctgcactttggtagatggaagcaatacccgtcattgatgcagttgttgctgcatatggctgattatcgaacggagttgcgttcttgtttatattgacagtgaatgatgtccctgcaacattgaatgtgtgatttttgccagcatcagcatctttccacactcctcctgttgcaatattgacattttcaactgtaacaggcatacatacaaatgctgctagttgggataaagtgacttttacaggtgttacggcattgtttgcagaaataacctcaatattatctgcgctgaatccttcaacttgaggtacatcataacgtttatatattttggctacatctttttgtaatgttactttgatctcttgacctaatgcatattgagttacatctatttggttgttatataaagaaagtgcattacccgctgtggtagctcctttgctcatcagataaagagtaccataagagtagttcttgcctgcagggtcaccacaaataataccttgaattacatagttttcatctacagctgtggaagtacttgtcatttttgttactaagtctgctatagaaataggagttgcagtagactcgatagcgacaaatgttttaggctcaccgtaaatagtactagaagcagttgttgcataagcacggaatgcatattgattgtctttagtcagattagtaacagctactgtccaaggattttcttttaccgatgcggctgttttagtcgcttttgtccaatcaatatctgttacagttccagtactgaattcaatatactgtacaccaacttcggtggcttcagaaatctcaatattagcaactgaaccacctaatgttgcagtggtagctgtgatggcttttgcatctgttgttgttactttaggttctcctgctgttccaaaatcaatttcagtaccaccagcacctgttgccaaagtgatatcatctaaacgaatagctgaagcatctaaagctgtgaatctgatatataggttttcaggaacttgttttaatgtgaagtttgctgttgcaaaaacccaataaggataatcggcatcgccattattcttagtatatgtaattggtacccaagccgtaccatcagcacttaatgcaacttcaaatttggaaacatcgaaggtgttgtcgtatgttccgttattgttcacagaacggctggctccaaatgtcaattgcagattcttttgttcggaagtaagcgtgatcgtattaacattgaagtttgtaggagttttgccgaaaaatacaacgttaggtcctgatgcacctgcataagcatctgtatttgctaatccactattacggactgaagcatttacgcctgtataagtaacggattctgaaccgacccctgttttattccatccttcgtatttatcaacaaaaggccaattcgttttatcaagctcaattgtaccaacattgtcgttatagattactacagatggctctacgcttccactgctaatcttaacagtctctgacatcaacacacccactttatttgaaatctcaataacaacgctggcttcatcattaacgttttccggaatgctaacctgaatagtagcagaaccttcaccttcatattttgatagagtaacccatgatttgtcatcctttactgtagctttccaactacggttggttgaaatgtcaaaagaagcttggcttccgttggctggttgaccgtctaagccgaaaatcaaggttgtaggcgaaacttcgaggtatggagcctcggtatcatcattgtcgtcaacgcaacttacgaaagctgtgctaaccattacaagcataagcccgtagaataacttcagaaagttcaaatttctcattttgttgctttgttaattaattaataaaatttttgtgaatcatttatcattttgttctctctcgataataatagtttagcaaagttatttttttctatgaaacgtgcaaagtttctaacgtctttttcatattacaactgtgttaaattttagtgacttaagaaccggcaatgaggtgattttcgacattgacgaatagattgattctttttatcttcaatatataacattgtgaaagaatttagagatgtttgttacttttttgaaagatttgcattatgcctttattggacttggccttgttagcaattgcactgtttacggagtattaatagaaatatttttgaatggacttcatttataatttgatagatagaatcctaatggtgtaaatttattttaatatttggatgctgaaataccgtattgggaatgaatgcgtctttttactttcatcttgatggtggaatcttattgtataaactatttatttcttcttttgtgctctgattgccgaatgttttgtgatgatcttgttgctttgatcttcatccacaatttctcccaccatccactttcagctttacttagcgtatcagaagttatcgtgattatcttttctctcaacttgttctgttcggttgccatcgcatactgcttttccaacactgaaattctacgctttttgcattgaaggtcttgctcttgtagctcaatgacttcaagataaactttgcatacttcggattggttattgcagagttgttccagcgtatgaatgtagtctttggtgggaagggtttcgtgccaacacaagaatttctgaaggctcttttcgtcaatgataagagtagtctctgtgaaatatgcggtgattgcttccatttctgcccacaaacagatgtcttcttctttgactccgtacttgtgcgccgcttcgtctatgctaatccatttcggcatagtgtttctttgtttatgcgtttaacaaaaaagagcgaataactcttgccaagcatggtgcaacaagcatccctgcattttgctttctagtcggagggttatggggtatggggattatgtaggggaaccgaccggatacaaaagaggcatggatgctgttgaaccattatctgatttcgaggcctagcaaaacccttgcaaaagataatgataacaacagacatccacgccaatcgtttatatataacacatctttaactgatatgttgatatacagccatccacgtggagtatctgttgtatcatctctctttgcatagaaaattgctagttttcgaaatcgagagacaatacattattaatactcctatttaaggaataaaaaacactacccgcttattacatctcgctgatgcgcagaaagtgtacagcaaagatatatgttttttcggaataaagtgggagaatgggaataaataaaagaagtctggtatttagaatgattttttgtgtttaggtgatgttatttcaaggtgttgttgccattaatatcacttagcacatttatctccttcgtaaagcaatgctttgtatcttcaaaagctatgctttatggttgctaaagcattgctttaaataaccatacagcagatgttacgagtgtcgccttcaccttcactttttcctctcaaccttttatttatcagtgatctcgggtgaagggacggctattcacctagtgagtggagaaaacattgtaagtgtttgaaataaactatcaatggtttgaaacaaacattgggaagaaaaaaataatctattagcatctttttattaggttatagctaatacgaatatcattatagcaaaaacaaattagcttatagcaaagtgaacgatgtctttatgattacatatgaaaattgggtgaaggatcggtgaagggcgatatgcttcacccgttatcacttatgaataaaaggtttcgaagaaaaggtgaaggctacccttctatttgaaaatttatagtatggcgtataaaagcatctggctttgatgggaagggggcgtttcagcgcaagaatttctgacattatacaactcatacctcatacaagttacttggtatatggttgatgcaagctcaagagaagggaaatcaaggtgatgcctgcatggaagtggatgtgcaataaaatgaaaaacgattctctgatatatcaggaattacttgatattaatggcaaataaaatatgggttctaaatataataccttttagtgtacaacttaatctcttttagtgaatgaattaattcgtccgcctataggcaaagttgcgtttgcctataggcaacctttcgtccggctataggcggacgaaaagatgcctatagccggacgaattaatttatgaatgcggtgacgttattttctacagagaaaacctttattcaattatgccgttgttcttaagattttgaagatgtatttataatgtgcagccaagaaagaactctgctattttatggcgtagaaatcagtttctcttttcgtataatcttttttatctcttcttttacgattcttaactccgaagatttcgtaaccataaagaaaccatctacttttaccccgtatttgtaagaaattgaaagaaacttcgtctaataaactaaaaactaaaacggttccaaacatgaaacacagattgttgctactattactattcgtgttcaccgcagtgatgacaggttgggcacaaaactccgctacgccgtcctatactgtcaaaggggtacttttggattcactgactcaggatggagaaccatacgctactattaagattactaaaaaaggagcaccggacaaggctgtcaagatggcggtgacgggtgccaatggtaggtttcaggagaaactgaatgtaggtgcgggagattacgtcattactatttcttcgataggcaaggcgcccgtcacgaaagagttcactttgaaaccatcggttagagtcattgatttggggacaatgctctccgctgaggctaataatgaattgaaaggagtggaagtcgtggcgcaaaagcctttggtcaaggtggatgtagacaagatagagtataatattgaggatgaccccgactcgaaatcgaacagtatattggagatgcttcgaaaagtgcctttagtgacagtagacggagaagacaacatacaggtgaatggtagcagcagctttaaaatacacgtcaacgggaagcccaacaatatgatgagcaacaacccgaaagaggtgttgaagagtatgcccgccaattccattaaatatatcgaggtgataacatcgcccggagctaaatatgacgctgaaggagtgggaggtattttgaatatcgtaacagtaggtggtggattcgaaggatatacggcaacattccgggcaaatgccagcaactacggtgccggtgccggcggctacgcaatggtgaagcaggggaaaatgactgtctctgccaattacaactttaattacaatgaccggccccgtggatattcggacagctaccgtgagaactatgagtcggatacggaaaaatatcttgaatcaaatagcagttccaagtcgaaaggcaacttccagtatggaaacctggaaggcagttatgagatcgacaccttaaggctgctgacggtggcttttggaatgtatggcagcaatagtaaaaattatggtgatggatttaccaccatgtatggtgctaaccatgaggacatagcctacagctatcggaccggcaatcatggagatggctcctggtattccatcaatggaaacatcgactatcagcgcacgtccagaaagaacaagcagcggatgatcactttctcctataagatcaatacgcagcctcagacaagcaattctaatactggctatgaagatattcacgccaaagaggaggtggacgacctcgtgaaacggttgctgttgaaaaacagccagtcggacggcaaaacgaataccatggaacagaccttccaagtggactatacaactccgataggcgagttgcataccgtggaggcaggtgcgaaatatatcttccgccgcaataccagtgacaacaaactatatgaagcagccggaggaagtgacgattatttatataacgaagaccgcagtagcgactatcgtcatttgaatcatattttagccgcttatctcggatatacattgaaatataaggatttcaccttcaagccgggagtgcgctatgaacagactgtgcagcgggtgaaatatatcgttggaccgggtgagaattttcacacgaacttcagcgatctggtgccatccgtttctcttggcatgaagctcggcaagactcaaaacatgcgtgtcggttataatatgcgtatctggcgtccgggcatctggaatctgaatccttattttaataatctgaatccgatgtttatcacccaaggtaactcgaacctgaaaagtgaaaaaagccatgcgttcgacttgtcttatagcaattttagtgcgaagttcaatatcaatgtgtcgctgcgccattctttcaacaataacagtattgagaatataagccggttgattacggcgcccgaaggggagatgtttgacaatgatcctacacacatagcaccggaaggagctttgtacagcacttatgccaatataggaaagagccggaacacaggaatgagcttgtatctgaactggaacgcgtctcctaaaacgcgcctgtacgtcaatggccgtggaaactacagcgacttgaaaagtgaagcgcagggattgcacaattatggatggaacggttctttctatggtggcgtccagcatactcttccgttgaaaatacggttaagtctgaatggtggtggtagtactccttatattaatctacagggaaaaggttctggctattattattatagtttgggtgcgagccgttctttcctgaaagatgagcgtttgagcctgaatgtgtattgcagtaatatatttgagaaatacagaagctataacaatcatacggaaggcgtaaacttcctgtcgaagagcagcagcaagtggccgagtcgtagctttggagtcagcatcagctaccggattggtgaactgaaagctagtgtgaagaaagctgcccgaagcatcaataatgacgatgtgaaaggtggtggcggcgaaggtgggaatacaggtggaggaggtggtcagtagaccacttccacgcacgctgtgatttctttatttctgccttacatcctgcttattggtattgaaacctaacttggtaagtcctgcttgtacatcgggatgactcatgaagagtttccataacagccctgtccggtaattctcgatcatgactgcaattggtccctggtcgatggcaaggtaacgttgcggataccagttgtctgtttcgctgaaagcatcgtagaatccgaaaggaccgaagactgtgtcccccatattatacaggtggcgcatcacttgcatcgaatattccggtgtatagacgatggatgaaagggcggcggtgggagagatgacccctttgtcatcctgttcattcggtgaatgagcagcgtatccatcgacggaatagctggcagtcagtccccagcagtccggtccgaaacctttgtagtgtttggggttgcggatgcagtaagcacggttcactaatgtcagattgcgcatttcgtggaagtagctgggacagtattcgtctttcagaccgacggggtcgagtccgaggaaggagtattgtgcccagaaaagcggtccggcttccgtgccctgatagcggagatgcagttcgatgccttccactttatgtggggagacgatagctccgttctgcgcccagccatcgtgatagacagctgccggtactccgtgggtaggagaggctgcggcaaggatatacataatcatacattcgttgtacccatgtatggggaagtccatttcccagccataggtggggctccagtgccagtatagcacattttggtcaccgttgcggtaccagttccagtcaacgtctttccatatttggtcaatgcgtgctgccagtgctttttctttctcattaccgttgatgtaatactggtgtacggcgagcagtccttgcatcaggaaggcagtttctaccaagtcacctccgttatccttctgtccgaaaggtttcacctttcccgtatcgccataccaccagtgcggatatgctccgtgaaaacggtccgctttttcgaggaaggagacgatgcgctccattcgtgccagaccttcttcgcgggtgacgtacccccggtctattccggcaaggatagccatgatgccgaagccgctgccgccggaagtgactacattggcatcattctgcggatataccccgtctacatgataccgttcgggggcaagtccgctgttgggctcggcaccttcccaaaagtagagaaaggtgcggcgctgaacggtgtccatcaaggcatcgtccgtgagctcggaactggcggtggctggtccgccggtcttgtttttgcaggctcctgctgtcagtatcaggcagaggagcgaaatatagagagatagttttttcattgattgtggatttaaatgagagaataaaatttaggcatggattacacggatttcacggttttaagagatttcgcagttaaagaccgtgtgaatccgtgtaatccatgcctattgtacgatttttattttagcgtgaatcgtgcggatttcacgtcccggctgtttgttccgatcattacttcaaattcacccggttctgctactagttgcaggtcgtagttgtaatatctcagcatttccggtgcaatcttgaaccgtacaatttccgactgtcccggttcaaggaatatcttctggaagcctttcagctctttcaccggacgggtagtgctgccgacgaggtcacggatatagagttgtactacttccgatcccggccatgtgccggtattggtgaccattactgctgccgtcagttctcccgtcatgtcgatggtagaacggctcaggtcgatatcaccgtaagagaaggtagtataagacagtccgtatccgaacgggtaaagcggctcattgtccacatccagataattgctgcggaacttttcgaaccacttgccttgtgccagcgggcgtcccgtattcttatgtgcataatacagcggaatctgaccgacattcttcgggaaactcattgtcagttttccacccggattgacatatccgaagagtgcgtcaccgatggcataagcagcttcgctgcctccgaaccatacgttcagaatagcaggtacgtgttcctgttcccaagtcagcgtcagcgggcgacctgtgaataataccagtacgacaggttttccggttttcagcaactccttcagcaggttttgctgtacatccggaatgttcaggtctgtacggctgctgctttctccgctcatctcggaagattctccgagagccgcaatgataatatccgactgattggctaccgtcaatgcttcgttcagcaattgctcgtctgtccggttgtcacggtttagtgaacgtccgaacatcgtggcacgttcttcgtaagaggcgtcgctgatcagattgctccctttggcatataggatgtttgcttttccggcagtcatctctttcaagccttctaccagtgacggacagcggtcgagtacggcagctacgctccatgtacccggcatgtttgtccggctgtcggctaacggacctatcacggcgatgttacctttcgggttaaaaggaagaagaggttcggcaggagttcccggacgcagggtcacgttgtcattctttaaaagaacaaagctttctgcggcaattctgcgggcagcgtctcggtgcgctttcgtaaagatatcacgtgccggacgttttaagtcgcagtacttgtagggattgtcaaacaatcccagtttatattttgcttccaggatacggcggcaggcagtattcagtgtttccatagaaactttgccttcctgaatggatttcttgagtgtgctgacaaagccttcgctcaccatatccatgtctactccggcattgatggcacgtgcggaaaccgtttgcaggtcgccgataccgtggtcgatcatttcggagattccggtatagtcggttaccacaaatccgttgaacccccactgaccacgcagtacatccgtcatcagccacttgttggcggtagcgggcacaccgtctacttcgttgaacgaagccattacactacctacaccggcttctacagccgcttcgtaaggcagcatatattcattgaacatccgctggcggctcatgtctaccgtattgtagtcacgtccgccttctcctgcgccatacagtgcaaagtgttttacgcatgccataatttcgtcattccgttgcatgttctttccctgataaccgagtaccatcgcttcggcaatcatggctccaaggaagggatcttcaccgctgccttcggaaacacgtccccaacgagggtcgcgtgagatgtccaccatcggactgaatgtccatgagataccgtcggcactggcttctatggctgcgatacgtgccgattcttctatggcggtcatatcccaggtgcaggataatcccagcgggatagggaacatggtttcgtatccgtgaatgacatccataccgaatagcaaggggatgcccagacgggattgttctaccgcctgtttctgcacatcgcgtattttttctactcctttcagattgaacaagcctcctacttcgccccgtttgattttggcggcgatgtcgctgcttttggcttgtcccgtagtgatttctccggtgacaggtaggttcaactgacctatcttttcttccaccgtcatctttttcatcaatgcgtcgatgaagcggtccatgtcttgtggcgacttctgcgctgccgcactcaggaagccggcagcgagcagcagaagtgaaaaaaatatcttcttatttatcatatcgttctatcagtttgatttgaatattaattaataatccggattctgtaccagtactcctttggacttgtcaatttctgactgaggcaaaggcaataatgcgttcttatcctggtagtttactttcccggcagcgtgcaatacttccgaggcgattccccaacggacaagatcgtagaaacggtcgggctccagcccgagttccacgcggcgttcgtggcggatggcttcccgcaattctccctgatcgttggtcgttattttgggcagtatattcgtattggtgcctctggcacgtgcacgtaccatttccagataatccaccgcttctccggggatattcttttcgttggcagcttcggcagccatcaatactacatccgaataccggatcaggcggatattcacccaaaagcctttgttggtgtattccttacgcagtgcggggtcggtataagcttttttgttgaagtaagctcccatagccggagagacgggggattcaccataaggttcgttggtgttttccggggtgatcggttcatcgtccgttttgcggaagtagagcagggtggcgtttttacgcgggtcacctgtctcgtaggcgtctgccatcaactgggttgccatgtgccatccccagcctaagtcccactgaccggctccgcgaacgccttgcacttcgcagaattggctgccgataacgtcactctgtggaagggcggcagtggcggtacattgcagttcgaatatagaaccgccgctgttctctccgtcgtcggtgaatatttcgttatacggagttttcagattatataaacctttgttgataacgtctgtagaggctttgtacatgttgtcccagtcactgcgcatcatataggtgcgggcatgaagtgaacgggcagctccccaagtcaggcgtccggtatattcggtgctccatgtttcgggcaatgactcttccgcagttttcaggtcggtatcgatctgctcgtagattttatcggcggtagtcttcgggatgttggcttccgaggcatcgttgatcttgtaagtcaccaaaggtacttcgccaaaagctctcactagattgaagtaacaataagcacggaagaaagaagcttcccctttgttgatgatatcttcggtttctgtttgtccggcagtctctttctcggcaatggcgtcgaggatatcattacactggtagatgatggcgtaattctttccccagtatgaacctagcaaaccgttggtcggggtgtataagaagtcatcgtacatttcggctacatccgatccgtcactcggaatacttcctttctcggagtcttcggagcgtagataatggatagcaatggcgggagtaccggcggtgatgtcgaaacttcgcatcatggtatagacattgtagattttaccgttgaccagcgcattgggattatcgtcttcggtgaattgtccctgcggactccggtccagaaagtcgctgcaactgcttatcagcagagcggaagcggcaataaaggtggaaaaaagatatttatttagtttcatacaattatagatttgattcattaaagttatattccgcatggaaacctggctgtggcaccttgccacccgcatggaaacttgggtgtggtaccttgccacgccactagaaggtcaggttgatgccgaaagtgtagacagcaggtacggggtagctgccgtcgtctactccgaaggtggtggcgctacctcccagttccggtgtgtagccggtgttgtgcttccatgtcttcaggttctgtatgttgacatagactttcagtgcctgcaagcgtattttagcaaggagggccttgtcgaacgagtaagcaagttgcacgttacggatacggaagaagctgccgtcttcgatataatactccgaattcaggttgttgatagaatgtttggagttcagcaacggctggctgttggaggtaccttctccgtgccagcggtccatgcgctgtgacagatagttgaactgtgcaaagttataattgtcccaggtacggaaaatttcgttaccgtgctgtcccatcatatcgatgcccaatgaccagttcttgtagtttactccgagagaaagaccataggtgaaatccggtgtcgggttacctatcattgtacggtcttccggggtaatcttaccgtctctgttcacgtcggcgaatttcaggtcaccgggagtgactgtggcaagggtattttcgggtgatgcatcgatgtcggcttgcgactggtatacgcctgccaccttgtaaccgtagaagaaaccgataggatagcccgccatcgtgtaactctgctgtttgtctccggcgataatggagtatccgtcctgaacgaggctcttcaccttattcttgatggtggtcaggttggcgctgacagagtatccccagtcaccgatctggtcacgccagctggctgccatttcaacacccatgttttcgatttctcccaagttgccgatgccgggtactgttccggagataccgggcacttcggcaagcaagtctttggtccttttcttataatatactccttcgaagtgcagacggttgcgcagcacgttcgtttcgaaacctgcttcccaagcttctactttttcccaacgcagattgggattgggcagataggagagctggtaaccgggatagataatggacggcttgccgaaaacagccgagtaagcatttgacaacagcggttcggcgggataggccctgtccagattctgattgcctaatgtaccgtaagatgctttgattttcaacatatcgagccatttgatatccttcatgaactcttcttcggtcatcaaccaaccgccgcctagtgagaagaagttctgccactcattgccagtgtatgagaaggcggaagaaccatcgcgacggaacgaaccgttgaacaggtattttcctttgtagttgtagatcacacgtgccagcatggataccgtagtccgttcccattgggtacttccgttggtagctgttgcggcatcaccgatgctgacaaaccatttgtccggatcgtcaggaatcaccagaccgacaccttgcttgcgtgctccgtccagtcggctcagtgaattgtaatacgtcgtaaagccggctgtagcggtcaggttatgattgccgtgatcaaaactattggtgtaagtcaatagatagtcactctgcactttcgtttcattttccttgaactggctgacttctgtcttgccggttcccaatgtaactacatctcctgcggcagtatcgtcatacaccttcatgacaggcaaatatgtccgtccgttgttggaagcatagtccatggagaacatcgctttgaagttgaaatgtttcaggaagtccacttcgccatagatattacccgatgcccggtagttttcggctttagtcgtattggctttcagatcgacgtctaccatcggattgttgatctgtgctttttgaaattcgggcagaacactgtataagccatattccttattatataccggtgcgataggggcagcacgaagagcgccgagcacctgtttggagtctgccggaagcgtgcgtgctccgttgaactggaaaccgactttcagaaagtccgtgatcttatagtcattacttgcattgatggtcactttactgaacttctcatgcttgatgtttccctgttcgtgagagtaacctacgcccagatagaaactgtgtttcggcgaagctccggtaatactgatattattgttggtgatgaatgcagtctggaaaatctcatcctgccagttggtgttcgcgttccagccgctgaagtcgaacggagtgtccttctgattggcaagctgttcgctgtatagctcctgaaattgcggaccgttgaccaaatcaaccttatctactactttcttgaaaccgaaagaggtattaatgttaaccagtgtctgtccttctttggctttcttggtggtgatgatgatgacaccattcgcaccgcgaacaccgaagatagccagtgatgacgggtctttcaggatctccatagattcgatgtcctccggattaaggaagttgatattgtcattgaatagtccgtctaccacgtacaacggtttgtagccattgatggagtttgtaccacggatacggatttcggggtcggcaccggcacgtccggagtttacgatttgtacacctgccacttttccttgtaaggaagataatgggttcgttgcaggtttgttggcaatttcttctcctttgacgttggtaatagaacctgtcaagtctcttttcttcgcgctaccgtatccgataacgactgtctcggctagtacctgcgaatcttctttcagggtgacgttgatcacattctgtgctcctaccttgacactctgtgtagtcattcctacataggagaataccagtacgtcttctggggtgacagagattgaatacttaccgtccatatcggtgatggttccggtggaagttccttgtacgagcaccgatgcaccgatcagcggttcattggcggcatctgttaccgtaccggtcactgtctttgtttgtgcaaaggcggatacggaggtcagcaacaagcaagtgagcgccactatgctcttaaacctgatggttttcttctgaagatcttgtaaaagtctagtcctcattgcattaaatttttccattcgttactatttaggttgaagtttattctgccgtcttccggcgaaagtaacaaagtgaacaaatgaaaggcaaaaaagattagggaaagagagagaaagggcaattttaacattgtaattatgatgtgtgaaaaaattatttgtctttttgttgcttgtttgttttattctatttacatttgtaaaacgaaacgaactatgaagctacttctttcttatattatagggttgttcctgattttgtctctctctgcttgtcatgatggaggtaatgcaactactcttttacatcaggcagactcactgatgcaagagttccccgatagtgccctgtctctcctcgaatccatttctcatcctgaaaagttatccggctctgaaagagctgattatgctatatttttgacacgggcaaggactaagttgtatgttcatgagtcaagtgattcattgattcggtttgcagtagattattataaaagaagttggaataatgagcgtaagatgcaagcctattattatcggggttgtgtgtatcgagacatgcggtgtatggatttggcggtaaaagatttcttgcaagcattaaaggtaattcctaaagagagcgagtatctttatttgggggccatttatgagaatctggcgggatgttatgcggaacaaaatctttataaggatgctatgcacgcccatcataaagcgcatgaaatttatattaagcaaaagaaagatgatggtctattttatgctgttagagggatagggtatgtttttatgcttcaacatcaattggatagtgctttggtctattatcaaaaagcattggatgttgcagagaatataggggaagattattataaatctataatattgagtgaattgggaattttgcataatgaaaaaggggaatttcaaaaggctaaccaatatctttctgcatctatatcttctgcaccaactggtactaatttattttctgaatatcttcgaaaaggttgtatcttacgtaatatccatcaaatggactctgcacggtattatttgaatttgagtaaatcttctccttatatatttaaccgtggaggaagttatggagaattatataaattggagaaagaagagaaaaattatccagcagctatagcggcagctgattcttttatttattatctagattcaatttatgatacaacaaaggcagctgagataactcgtttggctgatcaatatgaaatcgaattttatcagcaaaaaattgcgggaagatataaaattgaggtcttatcacttttgctgttatttattattggaggagcgatttctctttggattgataaacgtcgaaaaaagaagtatcttgagttacaaaatcaattaatgaagagtcgtacagatattctatctggggactttgaggatcagggtaatgctgaatctgattttatgaggatgttggagccgagtttagaactttgtcttcagttgtttcgaaggacggaaacccatgagaaacttctttctttggagaaaaagatgggcgttgctacctctttgagtattcatgaaggacagatgatttgtgaaagcatttatgaaacttttggcgacattatgcttaaattgaaaattcaatatgctgatttaactaaagaagacttgctccattgcgtatttttcttattgggttgctccaaagaaacaatcttattatgtacacgtgcttctgaaggagcatttaaaagtcggaaaagtcgcatgaagattaagttaggagaagaattctttgaatggatgactatacgccaatatcttgtctcataggtgtttatgttggattgtgacattcctgtaacttttctgtaacttgcagtcgagatccatagttatcttgtaactttattgtgaccaggcatctgaatttatttaaatcttatcccttacatttgtatcataaccaataaaaataagtattatgaaagcaaaactattattattactttgttgcttatttgcgattgaaggatgggcaaattcaaatgatattcatttactaaaagatagccgctctaatcctatgggaatacctattcaacctacttatgagaaatgtgctattctctctaatattcttaatgtaagcttcggtagagcaaaagattatgctatcattactgtaacgaataaagctacaggtgaaattgtacattccaaaacttatcacaacactagcattgtcatgattgatatgtcttcttgtgaaaaaggagaatatactattcatataattttgaatgattgtttgttggaaggtacatttactgtacagtgaaactgaactgaataaggtaatggataaatgtacttttagtcttagtgacaagaagtaactttttgtgttccttttctgtatagtcgatatttctaattgtaaaatattaagttagaggaaggaggtaatttcctttgggatctgttatttattattgttgtaacgtatttatcaacctttaaattcaatcggttatgaaagcaattttttttatgtttttattatgttgtatttgctgcttatcatgttcggatgagcaaaatactctttcagaagaacagaatgttattgagaataagacttttgaaaaagtgagtagtttagaattgaaacaacaactactggattacttgaataattcggtaaaaacaagaactacttttaataatgctgaaatgaattacgatttaggtatgcaagaaattttgcgtccacaaatccaaacctttggggaggaaatgatagttgtacgaagtaaaatggatgctaataatataatggcattttataaagagaatggtgttattgaaaactgtcttataattgaatgtgcacaaaatgctgaagatgcacttgaagaaactatgttcacatgttatgatagtaacaatattcctatttttaaagcaatggttaataaaagaaataatacatgtaatgttcttgaaatatatgatggacttgacgatctgacagcccgtggtggaaattgggggtgcaatgtatctcttggcttggctggtgctttatggtcaaccgcttttggaatggttacggctggtgcgggatttgttgtggcggttggttggtgtgtgttacaaacttggctatgtagctcccgtgtagtctctcgccctccaacggaaatacaaatagatacaatagaatttaagccgatggaaagagatgatgatagtatagcgagagacacaataggtaaactattgcccctgcgttgataattatttaatatgtacagtaaatgagaaataatatcaaattagcattgttttatattttaatattaggtctgttctccattcttttatgtacagaaaatagtatttggttttctgcttctattgcaatgatttgtacatcaacgggagtttgcataggacaacttattaagaaaagaaaacgatttcatgctagtactgacaaattatgggttctatcaggactgtttttattatctatcataatttcattatgcatttatttcttttttgataataaccccaataaagtgacatatattttactgatgaatctagttctagctttaggttctatat

SEQ ID NO: 143 - DNA, 19743 bp, Bacteroides thetaiotaomicron
atagagtatatagccaaaagcaaagggcaggccgaactcagtccattaacccatcaaaacgacatttttcagcgcctcatttctttggtcaacacctatagcaagacagagcggaatgtcagtttctatgcgaataaactttgtctcactccccgttatctgaacactgtaatccggcaaaccagccagcaaacagtaatggactggataaaccagtccattatactagaggctaaagtattgctaaaacatagcaaccgccttgtttatcagatatcagatgaattaaactttcccaatccgtctttcttcagcaagtttttcaaacgaatgaccggaatgacgcctcaggaatatcaaaagaattaaggattactttgaaaactcctttatccgctgttcttcatccagtttacaaatcaacagtgtattatctttctcagcaatgatatatccatccagaccctgaataacgacccgtttctcttcactggtatgtacgatgcagttcttgctttcgtacaaacggacatcggcccctaccgtagcatttccggatttatcttgtggcaacagtccgcggagcgctccccaggtccccaagtccgaccaaccgaaagaagccggaagtacatagatttcctgtgctttttccattacggcatagtctatggaaatagcttcgcaggtagggaacagctttttaatcgtttcattttccttctccgtatagaaatcggggaaaatacgatcgaagatttgcgctatgcccggagcatatacacgcatcacggaagtgatagtacgcacattccaaacaaaaattcctgcattccagaagtagttaccctcggccagatatctgtcggcagtctccctgtccggtttttccttgaatgcatctaccgtaaaaatctctttatcagtcatgatctgatctccggcagcaatatatccatatccggtttccgggcgagtcggtttgatacccagcgttacgatagcactgctgttgtcagtaaaacgaagtgctttctctactacccggcggaattcacctgtattgataaccaatgcatccgacggagtcaccaccacattggcgttcggatgttttttcttgattttccagcaagcataggcgatgcagggagcagtgtttcgtgcacaaggctctgcaaggatattgctttcaggaatctccggcaattgctcccggacgatatcaatatatttctcggacgtcactacccacacattttcccgtggacagacgccatcaaaacgatcagcagtcagttgaatcaacgtacgcccgcatcccattacatcaataaattgcttgggacattccggtgtactcatcggccaaaaacgactaccaatgccaccagccataattacgatatgattatccatgctcatattactcccctgttttagaatatttgtgaaataattgcgcaatttacaccaatttgtccaatcatgcaacttatagacattaaaaaaagatagtgacactatacaggaaggatagtgtaagcatactgacaggatagtgacactatcccatgcttatagtgacaccatcccaaaaacagaaattcataaaaaaaagccgcccccgaatgcacgggaacgacttttccaacttattatacaacaatttattatttcttacttatactcttcccagctcttgatggcaatatcatcaacggtcatcgtacagaaagcattgataaatgcacttgccagacgggcgttcgttatcaacggcacgttcaggtcgatagccgcgcgacggattttatatccattgtccagttctccggcagtcaggttcttcgggatattgactaccatgtcaatttccttattatgaagcatttccaatgcctgcggatgtccttcttcactcggccagtagacaagcgtactttcaatgccgttctcagcaaaggttttatgagtaccgccggttgcaaagagtttgtatcccttgtttaccaacatacgtgctgcatccatcatatcagccttctgcttcattgtacccgtagaaagcaggatgttctttttaggaatacggtagccgacagacagcatggctttcagtacggcacaggaagtgtcacttccgatacagccgacctcacctgtagaagccatatccactcccaatacagggtcagctttctgcaaacggttgaaagagaactgcgaagccttaattcccacatagtccagttcaaagagattcttttccggtttctccacaggaagacccagcatcactttggttgccagctcaatgaagtttatcttcagcactttgctgacaaacgggaaagaacggctggcacgcagattacattcgattaccttaatatcattatcttttgccaggtattggatgttgaacggaccggaaatattcaatgccttggcaatctcacggctgatgcgtttgatgcgacggacagtttccacatacaacttctgaggcggaaactgaatagtggcatcaccggagtgtacaccggcaaactcaatatgttcgctgattgcataggctatgatttcgccattctgcgccacagcatccatttctacctccttcgcatgttcgataaactggcttactaccaccggatgcttctttgatacattggcagccagtttcaggaagcgttcaagctcttcctgattggagcagacattcatcgcagcacccgaaagcacataagacggacgaacaagaaccgggaaaccaacttcatcgacaaactcattgatatcctccagcgatgtcaactcacgccagcgtggttgatccacgccaatacggtcgagcattgctgagaacttttcacggtcttcagcattgtcgatgctctgagcacttgttcccagtatgtgaatgttctgggcatccagacgcaaagcaagattattcggaatctgaccaccggtagatacgatgacaccatgcggattttccagctcaagaatatccattacccgttcgaatgtcagttcatcaaagtagagacggtcgcacatgtcatagtctgtagataccgtttccggattatagttgatcataacactgcgccaaccttccttgcgaatggtattcagagcctgcacaccgcaccagtcaaactctacagaagaaccgatacggtaggcaccggaacccaatacgacaatggatttatggtcacccagataatgtacatcgtttgccactccgctataggtcagatacagataattggtctgcgccggatattcggcagccagtgtatcgatctgttttaccaccggaaggataccggcagccttacgatacttgcggacatacaggcttccattttccatatcaccttcataaccgatagcacgggcaatctggaaatcggaaaagccctgaactttagccttgcgaagcagttccacaggcagatcggcaatctgtttatgattatttccccattcgtgcatttcttccgaagtcttcattatattcatcaacttctgaaggaaccatttgtcaatcttcgtcagttcatgcacctgatcgatggtgtatcctgcacggaaggcttttgagatcacaaaaatacgtttatcggtcggttcgcggagtgctttgtcaatatcagggattactagttctttgttttccacgaatccgtgcattccctgtccgatcatacggaggcccttctgaatagcttcttcaaaagtacgtccgattgccatcacttcacctaccgacttcatggaagaacccagttccttgtctacaccatggaattttcccaagtcccaacgtggaatcttacataccacatagtccaaagccggttcgaagaaagcagaagtagtctttgtcaccgagttcttcaagtcgaagagtccgtagccgagtcccagtttggcagccacgaatgccaacggatatccggttgccttagaggccagggccgaggaacgggaaagacgggcatttacttcgatgacgcgataatcttccgattcggggtcgaaagcatactgtacattacattcgccgacaataccgatgtggcggataatacggatagccagttcacgaagtttatgatattcactgttggtcagtgtttgagacggagcaataacgatagactcaccggtatgaatccccagtgggtcaaagttctccatattacaaactgtaatacagttgtcgaagcggtcgcggacgacttcgtattcgacttctttccacccccgaagcgatttttccaccaacacttgcggagaaaaagaaaaggctttttctaccagtacatccagttgctcttcattgtcacagaaaccggagcccaagccacccagcgcataagccgcacggacaatgaccggatatcccaattccttcgctgcacgacgggcatcttccgcattttctacagcttcacttttaatggtcttgacattgatttcgttcagtttctgtacaaagagttcacggtcttccgtatccataatggcttgtacgggagtaccgagtacttttacattatacttttcaaggattccttctttatataaagcaactccacaattcagcgcggtctgtccgccgaatgccagcataataccttccggcttttctttctggattactttctctacaaaatacggagtgaccggaaggaagtaaatttgatctgccactccttcggatgtctgtacggtagcaatattcggattgataagaatggtttcaatcccttcttctttcaaggctttgagtgcctgcgaaccggaatagtcaaactcaccggcttcaccgattttcaaggcaccggaacccagcagcaatactttctttatattttctttcatgatagtcggttatttaagcaggtttacaaattcatcgaacaggaattccgtatccgtaggaccacttgcagcttcgggatggaactgtgcagagaaccaaggatttttcttgtgtttgattccttcgttagaaccatcattcatattgatgaacagcggttcccaatctgcccccagcgtattattgtctaccgcataaccatgattctgcgaagtaataaaacaacgttccgtacccaccatgcgtaccggctggttgtggctacggtgtccatatttaagtttgtaaatctttgcccctccggctttcgagagcaactggttgcccatgcaaattccaaagatgggaagtttctcgttcgccattgccttgcggatattctgcacagctgcgtcgcaggtatccgggtcacccgggccgttggagataaacagcccgtcaaattcgagtccgttaaaatcataatcccaaggtacacggatcacttctacaccacgcctcaacaagcaacggataatattggtttttacaccacaatccaccaaaacaacttttttaagttgagaattgaaagttaaaagttgagagttaagttgcgcaatagaagtgctaagaggaaaacattgggaggttccatcagggagataggagattatttctttgcaggaaacacggtctacgtaattaacggcagcgtaattgtccattgtcaattgtccattgtcaatttccccgacaatttcatcgtcgaagacgatacgtcccatcatgactccgtgttcacgaagtattttggtcagttcgcgcgtatcgatgcctgtgatgcccggtactttctcacgtttcagccagtcgccgaggctttccactgcgttccagtggctgtactcagaagagtagtcacttacgataatcgcttcggcatgaatcttttcactttccatgaaagtggcgagtccgttgggttcgatggtaaaaggaggaactccgtaattacccaccaaaggataggtaagagtcatcaactgtccggcgtaggaagggtcagtaaggctctccggatatccggtcatggcggtgttgaaaactacttcgcccgccaccggcttctcgtagccaaacgacttaccggaaaaccggctcccgtcgtcaaggattaatgtcacatttctcattcttatttttgaatcgttgtatggttgttagaattgatacatctgctcaatgtagttgataaatgcctgattcaccattttcacaccacccggtgtgggatagtttccactgaagtaccagtctccctgatggttcggacaggcttcatggagtccttccaacggttggtagacgatttccactttcgctttcgttcccttcggtgtcaggagttctaccatcttggcagatatttcttcatcggtgaacggcgcatagatatccttcacgtaattcaccatttgttctttcggcaatcctacctgatctttcgatttccggtaggcggcagcaatcacatccttcatatcccgctctttcagaagctcgatggcagctttgaaagcgataaattcgctcatcttcgccatatcgatgccgtaatagtccggataacgaacttgtggagaagaagatacaatcacgatcttcttcggaccaagacggtcgagaatgccgatgatactttgcttcaaggtagtaccacgcacaatgctatcgtcgataatcacgagattgtcgacaccggaaaccagacttccgtacgtgatgtcatatacgtgggcagccaagtcattccgactgtttccctcggcaatgaatgtacggagcttaatatctttgatggcaactttttcactgcggatacggcgggaaagaatgacctccagctcttccatattgggatgatgccccaatgccgcaatctgccgtactttctcttcattcagatagtcatccagcccttgcaacattccgtagaaggcaacttcggccgtattcgggataaaggaaaatacagtatggtccaagtcgttattaatggctttcagaatattcggaaccagtttttctcccaagagtttccgttctttatagatatctacatcgctgccacgggagaagtaaatacgttcgaacgagcaggcgtgccgctcgcgaggcctgttgatttgtgaagtccgcagtctgccttctttgctgatcagcaatgcctgcccgggttgcagttccttgattttttctacgggaacattcaaagcagtctgaatcaccggacgctcagaagccagtacggctatttcatcatcctgataccagaaagcgggacgaataccccacggatcacggatagcaaaagattcgccgcttccggtgagaccgcagatcacatatcccccatcccactcacggctggaagtacgcaatacgttggccagttcgatatgttcttctatataatgggtgactcccatccctgtcagtccttcggcttcagcaaggttgaagaggcgttccacttcacggtcaagacgatgccccacctgttccaacatgatataggtatcggcatacttacgtggatgctgaccgatagcggtgatgcgggcaaagatttcatctacattcgtcatattgaagtttccgcagagagccagatttttagcacgccagttgtttcttcttaaaaacggatgtacgtacgagattccggattttccggtagtagaataacgcagatgccccatatatacttcacccgcaaagggcaaagtacgtttggcaaatgccgcatcatgcaactgttcgggagtgaggtccttgaagttactctgtacagcttcgaagatttcggtgatggcaccggaacctaacgcgcgttcgcgaaacatatattcctcacccggatttgcttccagcttcacgcatgccagtcctgccccttcctgcccccggttatgctgtttctccatcaacagatagagcttgttgagaccgtacatccatgttccgtactttttctcgtaatactccaggggttggagcaggcgtatcatggcaacgccacattcatgtttcaattgttccattaatctatctcttactatttgactatttacattttaaactactcgactgttaccgacttagccaaatttctaggttggtctacatccatccccttacataccgcaatatgataagcaagcaactggagaggtaccgtagtaattaacggatcaaggcactcgattgtttccggaagttcgatactgcaatcggctattttactgatcaccgtatcgcccttggttacaaatgcaatcacctttccttttcgtgccttgatttcctgaatattgctaagtactttctcatacaacccgttttgggtagcaatgactactaccggcatttcggcatcaatcagggctatcggtccgtgcttcatttcggcagccggataaccttcggcgtgaatatacgatatttctttcaatttcaatgcaccttccaaagcaaccggataactatatccgcgtccgaggtaaataaagttatgcgcataggtgaaagttttcgacagttccgccagcttatcattcagtttcaatacttccttcattttgccgggaatgctattcaattcccgtacaatgttcaggtattgtgtctcgtctatcgtacctttctcccgggcgagagtcaatgccagcatggtcagcacagtcacctgtccggtaaatgctttggtcgatgccactccgatttccggtccgacgtggatgtacgaccccgtatgcgtagcgcgggggatggaggaaccaatcgcattacagataccatatataaatgcaccccgactttttgccagttccactgccgccagcgtatccgccgtttctccactttgagaaatggcaatcaccacatcgtgctcatcgatcaccggatcacggtaacgaaattcggaggcatactccacttctaccggaatacggcaaaaactttcaatcagatgcttcccgatcaatcccgcatgccacgaagtaccgcaagccacaataataaagcgtttggcgttcagcaacttttctttatagtctattactgccgaaagcaccacgttattggcttccacattgatacgtccacgcatacaatcgtgaatacagtccggctgctcaaaaatctccttcaacatgaaatgcggataacctcctttttccagctggccaagcttcaattctacttttttcacttcgggagtcatttccacattactaaggtcgactaccttcagctcttttccccgattgatcaccgctatctcaccatcttcgaggtataccaccttatctgtatattctacaatcggtgtggcatccgaagcaaggaaaaactcatcttcaccaatacctaccaccagcggactgcttttgcgggccgcaatgatttcttccggatgctctttatcaagaatcgcaatcgcataagcaccaatcacttcattcaaagccaactgaacggcagtaagcagatcgacccgattggtaactttcatatattcgattaattgaacgagcacctcggtatcggtactacttttaaagacgtagcctttggcttggagtttttctttgagaacggcgtaattttcaatgataccgttatgaatgagagcgagtttttcggaagaagagtaatgaggatgagcattaacggaacaaggttccccgtgagtagcccaacgggtatgggcaattccgactgtaccggaaatatctttttgtgtgacgaaattttcaagttcggagactttccctttcgtcttgtacacatttaactgttggttatcactgatcaatgctacccctgcactgtcatatccacgatactccagtcgcttcagccctttaataaggatggggtaggcttttcttttaccaatatagcctactattccacacatattatgatatttttatttcgggtgcaaatatacacattccaaatgacacaaagataactttttcaatatttatttgacataagcacataaaaaagttgtaaacacatcaaaacgttaaataatatattattttaagctcaaaaagaaacaaattacaatcaggataaaataaaaccggacagactgataaattataagcaaatcagagcattttgattacaaattaaaagaataaagaaagaggttcttattttgtgtcacacaaaacaaacaatactctatcattatgaaattaaattcttaattttgccaaacaatttgatacatcaaataggtattatcatacaataaagctagaaagaatgaagaaacaagaactttttaacaacgcaacaggaaaattcccctaccaacgacagcctggacaaatgggcttgtatgacgcggcatatgaacacgatgcctgcggggttggtatgctggtgaacattcacggagaaaagtcacatgacattgttgagtcggctttaaaggtattagagaatatgcgtcaccgtggcgctgagggggcggataacaaaaccggcgacggtgcaggtattatgttacagattccacatgagtttattttactgcaaggcatccccgtacccgaaaagggacggtacggcaccggtctgctttttctaccgaaaaacgagaaagatcaggcagctatttttagtatcattattgaagaaatagaaaaagagggacttacattgatgcatctgcgcaatgtacccacctgtccggaaattctaggtgaagcggctctggctaacgaaccggatatcaagcaggtctttattaccggttttacggaaacggaaaccgccgaccgcaaactgtatctgattcgcaaacggatagagaataaagtcagattgtcagctattccgacgagaaacgatttttatgtcgtttcgctctcgaccaaaagtattatatataaaggtatgctctcgtcattgcagctacgcaactactatcctgatctgacgaatagctacttcaccagcggcttggctctggtacactcccgtttcagcaccaacacttttccgacatggggactggcacaacctttccgcctgctggcgcacaacggtgaaatcaataccattcgtggcaaccgcggatggatggaagcccgtgaaagcgtactctccactcctatgctgggagatatcaaagaaatacgcccgatcatacagccgggtatgagcgacagtgcttctctggacaatgtgctggaatttctggtcatgtcaggattaagtctgcctcatgcaatggctatgctcgtaccggaatctttcaacgagaagaatccgatcagtgaagacctgaaagcattctatgaataccattctatcctgatggaaccttgggacggaccggcagccttgcttttcagcgacggacgatttgcaggtggtatgctcgaccgtaacggcctgcgccctgcccgctatctgatcactaaaaacgatacgatggtagtggcatccgaagtgggcgtaatggactttgaaccgggagatatcaaggaaaaagggcgcctgcaaccgggcaagattctattgatcgatacagagaaaggagaaatctactatgacggcgaattgaagaaacaactggccgaagcgaagccttaccgtacatggctatcgactaaccgtatcgaactggatgaactgaaaagcggtcgtaaagtgcctcatcacgtagaaaactatgaccggatgctccgtactttcggctattcaaaagaagatatcgaacggctgattatgccaatggcgagcgcgggtgccgaacccatccactcaatgggtaatgatacgccactggctgtactttccgataaaccacagctactctacaactatttccgccaacaattcgcacaggttacgaatccgccgatcgacccgctacgcgaagaactggtaatgtctttgacggaatatatcggagcggtaggcatgaatatcctgactcccagcgagagtcattgtaaaatggtacgtctgaatcatccgattttaagcaatacacagctggatattctttgcaatatccgctacaagggctttaagactgtaaaactaccgatgctgtttgaagtatccaaagggaaagccggattacaggaatcactgaacaacctttgcaaaatggcggaggaatcagttacggacggagcaaactacattgtactgaccgaccgtgacgtggatgcaactcatgccgttatcccttcattactggcagtaagtgccgtgcatcaccatctgatatctgtcggcaaacgtgtgcagacagcattgattgtagagagcggagaaatgcgtgaagtaatgcacgccgctttactactcggttttggagccagtgcactgaacccgtatatggcatttgccatcctcgacaagctggtaaaagagaaagatattcaactggactatgctaccgctgagaaaaactatatcaaatctatctgcaaaggtctgttcaaaatcatgagtaagatggggatttccactatccgctcttatcgcggtgcaaagattttcgaagctgtcggactcagcgaagagttgagcaaggcttatttcggcggactcggttcccccatcggaggtatccgcctggaggaagtggcaagagacgcaatcgctttccacgatgaaggagttgaaggaatggaaaatggagaattgaaaatggaaaatgaagcaccgcacggcaactctcaattttcaactttcaattttccattattaaagaacaacggactgtatgccttccgaaaggacggagagaaacatgcgtggaacccggaaaccatcagtacattgcaacttgccacccgcttgggcagctacaagaaattcaaagagttcactcatttggtagacaataaggagaaacctattttcctgcgtgacttcttaggattccgtcgcaatcctatatccatcgaacaggtagaaccgatagagaatattctccgtcgttttgtgacgggtgccatgtctttcggatctatcagcaaggaagctcatgaagcaatggcgattgccatgaataccattcacggacgcagcaacacgggtgaaggtggcgaagatgcttcccgcttccacccgctgccggacggtacttccatgcgaagtgccatcaaacaggtagcttccggacgcttcggggtcaccgccgaatatctggtgaatgccgatgagatacaaataaaaatagcgcagggagctaaaccaggggaaggcggacagcttccgggattcaaagtgaacgacgtcatagccaaaacacgccattccattccgggaatctcactgatctctcctcctccccatcatgatatttattcgattgaggatttggcgcaattgatatttgacttgaaaaacgttaatccacaagccaaaatcagtgtcaaactggtagcagaaagtggcgtaggtaccattgccgcaggcgtggcaaaagcaaaagcggatttgattgtcatctccggtgccgagggtggtacgggagcctctcccgcttcatccatccgttacgccggcatttctccggaactgggactgagcgagacacagcaaaccttggttctgaacggtctgcggggacaagtcgtcctacaagccgatggccaattgaaaaccggacgcgacattatcataatggcattaatgggcgccgaagaatatggttttgccacttccgccctgatcgtgctgggatgtgtgatgatgcgcaaatgtcaccagaatacttgtccggtaggagtagccacgcagaatgaggaattacgcaaacgctttcatgggcgcagcgaatatcttatcaactttttcaccttcctggcacaggaagtccgtgaatatctggcggaaatgggattcaccaaaatggatgatattatcggacgcacggacttgattgaacgcaaatccgacgaaaacgatccgaatccgaagcacgctctgattgacttcaccaagctactggcacgcgtggataacagtgcagccatccgtcacgtcatcgatcaggatcatggtatttctacagtgaaggatgtggcaatcattgatgctgcccaagaagcgatagaacacgaaaaagaagtttcattggaatacacaattgccaatacggaccgtgcgacaggtgccatgctctccggtgtcattgccaaaaaacacggagaaaagggactgccggaacataccttgaatgtgaaattcaaaggctctgcgggacagtcgttcggtgccttcctcgtaccgggagtcaatttcaagctggaaggtgaagcgaatgattatctgggtaaaggattgagtggcggacgcattgccgtattaccgcctatccgcagcaacttcgaagccgaaaagaacacgattgcaggcaacaccctgctctatggtgcaaccagcggtgaagtttatatcaatggccgcgtaggcgaacgttttgccgtgcgcaactcaggagctgttgccgtagtggaaggtgtaggcgaccactgttgcgaatatatgaccggaggccgtgtagtggttctggggcaaaccggacgaaattttgccgccggtatgagtggcggtgtggcttacgtatggaacaaagacggcaattttgactacttctgcaacatggaaatggttgaactgtcactgatcgaagaagccggttaccgcaaagaactgcacgaactgattcgtcagcactacctgtacaccggttcgaaactggcacgtaccatgctcgatgactggaaccattacgtagatcagtttatccagatagtacctattgaatacaaaaaagtactacaggaagagcagatgagaaagttacagcaaaaaatagcagatatgcaaagagactattaattcaagtattaggtattaagtattaggtattaaccgtagcttcaaacatctttaatccatatagttaatacttattgcttaatacctattacctaatacttattacttaacaagatgggagatcctaaagcttttttaaatatacctcggcaagaggcgggataccgccccgttagcgagcgcatcactgactatagtcaggtagaacaaacattgaatacgaacagccgtaaattacaggcatcacggtgtatggattgcggagtacctttttgtcactgggcttgtccaataggcaataaacagccggaatggcaggacgctttattcaaaggaaaatggaaagaagcgtatgaagtgctgtcatccacttgcgactttccggaatttacaggacgtatctgccctgccctctgtgagaaatcctgtgtactgaaactatcctgtgaccaaccggtgactatccgtgaaaatgaagctgccattgtagaagccgccttccgtgaaggatatatacaggtgcagcatccccaaagaaacggcaaaaaagtagcagttgtcggtgccggtccggccggattggtagttgccaaccaactgaatctaaaaggatacaccgtaacgttattcgataaagatgaagctgcgggaggattattacgtttcggtattccaaacttcaaactggacaaaaacgtaatcgaccgccgcatgaaaatacttgccgcagaaggtattcagtttgaaatgggagtagaaatagacgttaaccatttgccggaaggattcgatgcatattgcatttgcacgggtacaccgactgcccgtgatttaagcattccgggacgggagttgaaaggaatccatttcgcactggaaatgctggcgcaacagaacaggattctggaaggacaaactttccccaaagacaaactggtgaatgccaaaggcaaaaaagtgcttgtgatcggcggtggagacaccggttcggactgtatcggaaccagtgtacgacagggagcaaccagcgtcacgcaaattgaaattatgcccaaacctcccgtcggccacaatccttctacgccctggccgcaatggccggtagttttcaaaacgacctccagccatgaagaaggttgtacccgtcgctggtgcctgacttccaatcagtttttgggtaagaacggtaaagtaaccggcgtcgaggtggaagaagtagaatggacaccggcaacagatggcggacgtccgaccatgaacctcacagggaagaaagaagtaatcgaagcagatatggtgctgctggccatgggattcctgaaaccggaacaaccgaaatttgcagaaaacgtattccttgccggagatgcagctaccggagcaagcctcgtagtacgggcgatggcaggaggacgaaaggctgctgcggacatagatcactatttggtgaagtaacccttacagcaaggaacaccatgaagtttatagactattatttattcgtttgacctaggttgaacgaaacaacaacctaggttgaactaaaagatgacccaggtcaaacgaaaggaaaagccagggaaaacgaataaatagtaacgaaccgacttttaaaaaacagagaatcaacaaattatattaacttccaaatactcaaagttatgtgtggaatagcaggtatactcaacataaaaactcaaaccaaagagctaagagacaaagcactgaaaatggcacagaaaatccgtcatcgcggaccggactggagcggtatctacgtaggtggaagcgccattctggcacacgaacgcctctcgatagttgacccgcaaagcggaggacagcccttatactcccccgaccggaaacaagcgctcgccgtgaacggtgaaatctacaaccatcgggatatccgcgcccgctatgccggacaatatgattttcagaccggaagcgactgtgaagtgattcttgccctttataaagataaaggcatccactttctggaagagatcagcggaattttcgcctttgtactttatgatgaagaaaaagacgagttcctcattgcacgtgatcctatcggagtcatacctttatatataggaaaagacaaggatggcaaaatctacttcggcagtgaactgaaagcactcgaaggattctgtaatgagtacgaaccatttcttccgggacattacttttacagtaaagaaggcaaaatgaagcgttggtatacacgcgaatggacagactatgagtctgtaaaagacaatgatgccaaagtcagtgatgtaaaagaagcattggaagatgccgttcatcgccagctgatgagtgacgttccctatggagtacttctttcaggtggtctggacagttctgtgatttcagctatcgccaaaaaatatgcagcaaaacgtattgaaacagacggagcaagtgacgcctggtggcctcaactacattcttttgccatcggtctgaagggggcgcccgatttgataaaggcacgtgaagtggcagaatatatcggtacggttcatcatgaaatcaattatacggttcaggaagggctggatgctattcgggatgttatctattttatcgagacgtatgatgtgactacggtacgtgcctccactcccatgtatttactggcacgtgtgatcaaatcgatggggatcaaaatggtattgagtggtgaaggtgccgatgaagttttcggcggttatctttactttcacaaagctcccactccgaaagatttccatgaggaaacggtacgtaagttatcaaaactgcatatgtatgattgccttcgtgccaataagagtttatcagcctggggtgtagagggacgtgtcccatttctggacaaggaatttctggatgtagcgatggcgttgaatccaaaagctaaaatgtgccccggaaaggagattgagaaacgaattgtacgtgaagcttttgccgatatgctaccggaaagcgtagcatggagacaaaaagagcagttcagtgatggtgtgggatattcgtggattgataccttaagagagattacagcggctgccgtcagtgatgaacagatggaacacgctgccgaacgtttcccgattaacactccgctcaacaaggaagaatattactaccggagtatctttgaagagcattttccgagtgaaagcgcagcccgcagcgtaccaagcgtaccaagtgtggcctgctctacagcagaagcgctggcatgggatgtagctttccgtaacctgaatgaaccaagcggcagagcagtgagaggagtgcatgaagaagcctatgccgaagaggtaaaataaatttgttgaaaaattttagatgtctgaaataaactcatatctttgaatatatattcatcagtttgtaaagtcaggaataaaaagtatagacttctatgcataaaaagctgtcaattaacgcagattagcataataacaggctgatctgtgttttattttttataattttggactcataaactttttaaatgtactatcaatgaagataaaaagaattattctaatggttgcccttatcatttcagtagctagtgcccaagcgcaaaagtcgcaagttatcgcccatcgtggctactggaaaacagcaggttctgcgcaaaatagtatcacagcacttcaaaaagccgattctatccattgctatggctccgaatttgatgtatggcttaccaaagacaataaactggttatcaatcatgaccctgtctataagatgaaatacatggagtattccaaaggtgacgctcttacaggattgaaactatcgaacggagagaacctgcccagcctggaacagtatctggaagccggtaaaaaatgcaataccaaacttatattggaactaaaagcacttaacagcaaaaagcgtgaaacgaaagccgtacaggaaattcttgccttggtaacaaagctgggactggaaaaccgtatggaatatatcactttctcactgcacgccatgaaagagtttatccgcctggcacctgccggaactccggtattctatctcaacggcgagctatctcccaaagagctgaaagacctcggtgcagccggactcgactatcacatgggagtaatcaagaaacatcccgaatggatcaaagaagcccatgatctcggactgaaagtcaatgtatggactgtagataaagcagaagacatgaagtggctcatagaccaaaaggtggatttcattacgaccaacgagccgactgtggcacaggaaatactaaaatagttactctcagaaaatgtaaaaagccgacagaaactttttgcaaatattcgatagatacaagaagcaccattatacatatttatttgctgtataatggtgcttcttacataaaattcaaacaggacttatttaaaatcttccaatacctctttcaactctcctatggtcaactctcctacctgcctccacaattcatgtcctttatgcaacagaaggaacgcaggcaccgtatctatattatgagaatcggctacagttttattttcctcgatattcacgttaatcaattcaatgactctccgttcataagtacggagcacaggccctatccattcataatgaggtgaccagtcggcataaaacacaatcaataccaaatgatcgctctgcgccgcaacttccaattgtttctctatatccatattgctacattattatatttattagtgactaaacaatgctataacaaaaaggttctgcaaaactgcaaacaagcaatatgatatataaaagcgaaaatcactagcatatcgacctattgtaaaagcgaaaattcacattttagatcgaatacaaggactgatttaccc

SEQ ID NO: 144 - DNA, 19614 bp, Bacteroides thetaiotaomicron
gggtgtagttcatacaaatagatatatttatattatatagaaaaattaaagattgtcaggcaacaacgttatcctacaattatcaaaccagactgggatatataattaatgacttcattggatttttccatcttatcgaagatgggggcaacggtttctttgctactttcttatccgccgacctgctcatgaaagaaagtagcgggcggcaagcctgccgcccgattttaccgctttatcctttgcagcacacgctcaagtgtgcgctcggcaatggggcgtgtgtccttgttccaaaggttatacccgtgtacggatattcccacgctccgcaaatctcggatataaccggacgcttcatcttgcgtgggcaggtaaacgaactgcacccatgcgtccctgccgtctgtcagtatgaaatagtatttcatttcgcttgttttttcagttgttacgaatggagtgtgggcggtgtttccaccgccacgcactcaaaattcctttatgtcggcgatagccgtgcagcgtgtgagccattcctttacgcagggcatgttgtattcggaagtgatgactgccgtatgcccgtttatctgcgtaaacctcgtactttcatagtcctccacccatcctttgaggctgtccgttccccatgcgtccgcatcggcgaacatattgtccaaaaccttgatagggtcgctgaacgtcactatcagcgtttcatatcctgcgctcatcgtctgccctccttcgctttaatccattcgtcacgcaaccgcctgcactcgtccaatgtgggtttcacgcaggagaacagttctcccgttgtggtgtcccgatagtcatattggtacatcgtgcggactttgcgcccgattttcagttggaatttctcgtatttctcacctgccgtgcaggtgcttactccgttaatagtcattcttgttgtcatagccttatcaattaaaattcaacaatcagtaatctgttctccaaacattggtcggggtcggatgcctttttctgtgtcacccacagatggtgtgcgccatacccgaatgcgaaaagggcgttgaaaagtttctttcgggcgaacacctccattaccccccttacatcctgctcgtcctttgtcagtacaagcgtgttcaacaattcgatgaacatttcaggcagtttctcgtgccacccgaaaatcatgttttctattctcacttccatatcaataagtattaagttgttaaacgattacgctgcttctttcatccgtttccgtatctgctcggcattgtcctccaccaatttgatgatgcggtcgtggtattcggtgttggagttgcatacgccacggctctgcaccacttttaatgtccgcaagtccacctccactgtctcgatgcgtcgctcgtctatccgtgcggaaagtatcagggagttctcattgttgtagtaggcgttggcatagacgcaatggtgcatggctttcccctcctcgtagaactcgtccacgctttgcagcaccttgacgatgattagaccgtccgtcagtacaaggttgaggaatgcggctttctttcggatatactcgtctttctctttcgccatttcttccagacgcttccgctcacgctccaaccgctcggcttcccactccctgtgttgctgctgccgttcacgctccaattggacttgccgtttccccatatacaggtcgtgagccgccttgaaatcgggcgggcatatgaaacgggggttgcgcaaatcttttcccaatctctctaagagatatacgaggtcgcaccacaatgagatgtcggttatggcatatttattccgcatggctatcttgtacgagttccaacatctgtcaagtacctgcggacgggagaggaaatagcgcaagtgttcgatgttgcccgacttcagcaatgtttccgcacggctgtccgaaaggatagccttgaagaagtcgtaaggcagtatgccgtgcaggttgccgtcaaagccatttcgcttaatttcggggataatccgtcggcgtggataggtgcatatcgggtcaatgtcatacaccttatgctggttgttcctgcggatttccatcgggctgtcctcgttccacaagtcgtagtagagaagtgaaaagccacgcaaccttgccactgtctcggacttgccgtcaggagcaatccaccgctgtgccacctcaaagatggaatactccgccttttgcccgactttctgacggctcctgacgaaaaagaaacgtattacctggtagcctttgcaggtggtgatgatggagaaatactcgttgtccacgaacaccctctttcgggtgtccgtgatttccaatgccgtgccgcagttcgggcaggtgcatccgcaaagcgtgtcggcaaggctgtgtccgcttttccatgcgtgtccgcactccgtgcaggtaatgacgccttttgcagtccgcctgccgtagtgcttgaaacaatggtggaaagcgtaggttctctgtgcgtttgtcagttcgggcagggttgcgctcagacggatgacttctttctgtatgggtgtcttgggtttcataggttcagaataatgaaagttcaacttgttgtgcgtttgtcttttggttcgccttagccttgttccggttttgcatcttgcgcagttcctcgtcttggtattggcggatggctctctgccttgcttccgccttttcctcgtccgtcagttcaactccgcataccatgacttggcacgggattggtttgccgatgtcgatgtcgtcctcgtcaaaatagtgtaccgcttgcgacaagacttcccctgcggtaacgcctatgccgttgcctccattgcattggcttttcgcccaatgcaacaaataggtgatgcaatcgtccatgttcttgttcggcttgctgtaacttgctgcaaacagcttgtcctccgccgcacggctgtccaaataggcttggatggtccgcttgaaatggtctgttccgttcatatctgtatgtattttagttatttgaaaaattctccgttggataaaaactcgtattcgttggcttcgcaatcacgctcaaaggcttcctcgttgctagcatattccacatcatccctgcaaaagcggaaaaagctgtcgatgcagtcattcatcaagtcatacaagttcgtatgcttgtcggggactttcagaaagtcgtatatgggtttcagtatgtccatgtccgcacaataacccgtcagcacacaatcattggttacggatatccgacttctgcgctgtttgtggaagtcctttttgtgccaataggtcttgggcttgaaaaggttgtgccaatagttgttcacgatgaatttcagcaaccgcacaccgcacagttcttcctcttccccgctgtaatttgagatgaattggaaattataggtacaggcatcataattccacctgcttacctttaccttgaaaatctcctcaaaggctttcaacgttgccctgttgtcggatgcgtcatattcaaagcctttcaaccacttccaataggcgttctctttcgccttgtccgaaagctcgtccaccttgtaaacttcgtatttcctcgtttccgttctcataactttgctctattgttcgtccaacatattgtgataaaacaactcgtcatcccgtccgtagatttccatcgtagggttgttgtcgttttccgcaggggacagtccttccaccgtttcggggttcaattcgtagtcgcaatagatgacgttctcgtccataccgatatggctgttcacgtctttatcttcccatgaaagaatgatggatttggcttcttcatagctgttcgctttgatggagaagcgggtacgttcccagcaagttaccttgcaatccatataaaagtcaaaagtttccattgtctgtaatttaagatggttatacggttttctgtaaaatctctatgtggtattggggcgggcattccaagatgagaaaggcgatgaagtcctttcttgcctccttgttcaactcgtggtacaacctcctgaatgaggaaaagttaccgttgatgcacacctctaccatatactcgaagatgttgtccacctcgtaatacctgcattgttgtgccactgtcttgctgtgtcttttcgccatatccgtatgaattaaagggttaataaccaaatgaaaattccgatagctgccactactgaaagcagggcggtgaggatgccgaacatgaagttcaacatacccagcaggatttcccctgcgatgcccaccgccaaacctcctgcgcaaagggtaatgccccatgctgctctcaccattgcggacaatacgctccgcatagcctttccgatgtcgttcaatgtcattctcatatcttccaatttttagattgttgttacttgtcttgctcggatggggaggtcgggtcgagtcctttttcttttcgcctctccgtatgtccgatgtctccttgtgacgtcttccgaccgcgcaccggtcgttttcgtttcaggggaaaaagcaaaggtcaggggagtaggttcagcaaattttttcgacagaatactacctgagcctgcgaagtgtggagattgtggctaaaaaatttgtgttcctaatcccgtctttacctttgcccctgcaacgaaaatgaccactgatgccgtctggaatggcggcatggggacattggcatacacttggagagacggaaaggaaaagggggaagtatgtgaaatggcgcaacgcgccacaggaaaatcgaaagggcggcgcaactgacaagggaaagcctcgctttcctgccgccgtgacggaagtcccgtgaccgtcattgtcatgcgggcatggcttgcggtcgcgggtgttcctccggcggcatctgtctgaaaatggtcttgcctgccattgctccgattggcaacggcagggcaagacggttggaagacaggccacacatgacagccgggaatagtcgcaggagcagattcacgcttgccgtgtcctgcatccggcggcatttccggctgacaacggaaacgaaaaaagaaaaacgaataagacggtcttggccgttcagcacaagcacataaaagaagtgtccgcgacgatggcagtgtcactggtgacattgtggtcgtcgtgggcttttctttgcttgtgctgcttctgaaatgggcttgcgcacatcaagccggaagccgttttcagaacaggaaaaatgatggaggataaaatttgcgggcgaaataaaattgcgggaaattttgcaaagacggggactgttttgtacctttgcaaaaagtaaggacgttctttcgcttgatgcaaaatgaggcagattatagaagttcgctggtttctaaaccgttaacaagtctgttttgtttctctgttaattatctcatagcttgaaagatacaatttttattgtgtcttagtccatggtaggtgatccgtttgttgatttggcaaattgcggctatctccgccaaatattcattcatcttctggttactgattaccggaagcaatcttccatctttcaacttgccctcgtatttggcgagaatatccaacggtatttgcagtaggggaatgaatgattccacgccggttttacccctgtctttcataatccacttcttgccgtccaccccgatctttatgtcctcgcttgaaagcgtatagatgtcacagtagggcaaaccggtataacagctaaagatgaaagcgtcacgcacgtgttccaaccgctttgatttgaactccttataatagatcgtgtcaatttcctcctgcgtgagataccctctgtcggtcttgtcaaaattgaacctgaaattcccgaagggatcaatgaagctcaatccgcttttctgggcaaacaacagtatcgtatggaaacgttgtacaaatttcatggcggtattgttgcttacctcacattcctgacgcaaataaaggtagaagttctcgatgtgggtgacggtgatttccttcacgggaatgtccgacaacttgtattccttttgcaagaactctatcatccgctgcttggtcagttcgtagcgggaataggtcttttgcgtggcagtcttgccgaccttctttgcatactgttcattgtgctgggtgaagtaactgatgagtgttttctccttttcctccaatcccaggaatgcgtttctgattttttccggcagtgcgtaaccgtccacgttcatcatgcgtgtgtagtgcatggtgatggccgaacgtatctcgtccagtgtcttgttaagtgaggataccctgaggttttctttcttgtccgcactctgtttgttgatgacggctcttcccgttttcgtgtcccagttatcggggtgtatatccaacttgctgctgaattgcacctgatcaccgtccaccgtgatacgtaccattattactacatgaccgtttttcttcggttcgttcttctttaaatagaagagtgtcttgaatgtcgatttcataccgtaactcctttcttgttgcaaagttaatttgttcattccgtaacggctatgactttcgactgccaatattcgacaaatgagcgacttagctataaattcgttacggtttttatcgtaacggaaaaccgtaacgaattagtaacgattcatcttcacagggtggctttttgaggttctttttctgtcgtaggcaggtaagaaaaaagccccttaaaccattggtttaaagagctttgtcttagattgtcggagtattttcatttctcctatgtgatccagctggggctcgaacccaggaccccaacattaaaagtgttgtgctctacctgctgagctactgaatcaatccttatttgcgaatcagttatttcctgattgcgggtgcaaaggtagttacttttatttaatttgcaagtgtttcgtagaaaaaagttccaattatttttcctctttatcgcttgtttcttgattatcagtagtttctacttcatcatattttattctttctttgttgataataaagcgttgatagtaggaaagcatcaaagtagtcagaggcaaggcaatgatcatgcccagcattcccattaatgaaccccatatagaaagggataaaaggatgatggcaggattcagccccgtaatctttcccatgattttggggacgaggaaagtatcctgtataatttggacgatggcgaagactgccagtgcgcatgcaatgataatccagaaattctctcccgtatcggcagctttaaggatcgccaataggaccgtagggaggaaaccgatgatttgcaggtaaggaaccatattaagcgctccaatgaaaagccctagagcgatagccatcggaaaatcgataataaggaagcctatactgaacagaatccccacacaaaaggcaaccagtgcctgaccacggaaataccgattcatgccgtcctgtacatcatgtacgaggttggatgcgaaggtacgatacttgttgggcagcagatgcagccatccttcggctatgacttcataatccagcaatataaagattacatatagtaatatgataaaggaggcgagaatgctgaacaggatattgagcgactccgcaagcagggcccaaactctgggcactgtatctttgatggctgcaagaatattctcttcgcttaatatacggttgagcgcctgaagatcaatattctcatgaatgaattcggaaagattcttgggcacattattcccggctccattggtgaggtaggttaccagtaagtcattcatcctgcctatttccgaaatcatgggaggtaccaacagataaaataaggatactccgacaagagtgatcagaaacaaggagcagaagatagaaacaatacggctctttaaccgtagcttatactggaaaaacttgactaacggataaaccatgtaggcgatcagccaggctataaagaaaggtaataacactccgctgagccgttccacaagcattagtatccctaccaccagtacacatccgatggaaccacgtataaaactgtcgaatgttatcttctttctttccatatatgttttaaatagagtttatatcttctgtccgtcctctccccgtgcacggaggtagcactccctgcaaagcggctcgtattcggctgtctctcctagaagtacctgcttgtcattcttgacggtacgatgagagaaagatgccagatcaccgcacttcacgcagatcgcatgaactttggaaacttcatcggcaatggcacataattgaggcatcggtccgaagggattccctttaaagtccatatccagtccggcgatgatgacacggatgccgttattggcaagctgcctgcatacgtcaatcagtccgtcatcaaagaactgtgcttcgtcgatgccgactacatctatttcagaagtgaacaacaggatactagccgatgaatcgataggggtggacgcgatggaatgactgtcgtgtgataccacgtcttcttccgaataacgggtgtcgatggccggtttgaatatctctacacgctggcgtgcgaacttggctctcttcatcctacgaatcaattcctccgtctttccggagaacattgaaccgcagattacctctattctacctcttcttctggtctcttgtatgtggtcttctgaaaataataccatgtgatttttgtgctttcttgattaaataaatgagtggacaaaggtaaacaattcgatgtacaagaactgttaaattatccattattttaagttattgcataaattattcctacattcgcaccataataacaatggatggaaatgaaacagaagctattaacagatattgagctggatgttcatgagctgaagctactcatgaatacgttttctaaagagccgactcagactttgtctgaactgttgaagcggagcatcctacgtatgcaggagcgtttggaacagttgtcggaagagataagtgctgtgccggtggaagcctcgccttctcctgtagcggaagcggaaagtgaagcccccattgttgaagaacaagcccctgtaatagaggaagttgaatgtccggtgatagaagagaaggtcgtggaagagaatgaagcgacagcaccgggagaagatgaacctgtgatagtacaggaaccgcagactgttgtggaagaagcagtaattgaggaacctgttgtcgaagacgaaatggaagagaaagaagcggaagatgagtcggaagacgacgaatcgcttctgatagaggagccgaaaactgccgtattgggcgaaagcataaagatggctgccggattacgtcattccatcagcctgaatgattctttccgtttctcgcgtgagatattcggcggagaccccgaactgatgaaccgtgttatcgagcagatatcagtcatgagttcttataagactgccgtggcatttcttgcctcgaaagtcagcgtaaacgaagagaatgaggcgatgatcgactttttggagttgctaaaaaagtattttaatcaatcagcataaaagtttatgggaaagttatatgtagtacctacgccggtaggaaatctagaggacatgacctttcgggcaatcagggtgctgaaagaggtcgatctgattttggcagaggatacacgtacttccggtattttgctgaaacactttgaaataaagaatgcaatgcaatctcatcacaaatttaatgaacataaaacggtggaaagtgttgttaatagaataaaggcaggtgaaaccgtggcattgatttcggatgccggaacacccgggatttctgatccgggatttttggtagtccgcgaatgtgtgcgcaacggtatcgaagtgcaatgtttgccgggagcgacagcttttgttccggcattggtagcatcgggactgccgaatgaaaagttctgcttcgaagggttcctccctcagaagaaaggacgacagacacgactgaaggcattggcagaagaacatcgtactatggtgttttatgaatcgcctcaccgcttgttgaaaacgttgacacagtttgccgaatatttcggcactgaacgtcaggcaaccgtgtctcgcgaaatttccaaactccacgaagaaaccgttcggggaagtttggcggaattgatagaacactttaccgctaccgagccccggggcgagattgtgatagtattagcaggaatagacgattaaaataacttcatttaaaaacgtaaaacgtaaacgtatgaaaaagttagcagttttatttatgtgcgcagccatgttggcttcgtgtgactttaaaggtggaagcaaagaccttaaggctgaaaatgactctcttttaatggaattgacacagcgtaacgctgaattggatgatatgatgggaactttcaatgaagtgcaggaaggattccgtaagatcaatgctgccgaaagccgtgtggacttgcagcgtggtactattaccgaaaattcagccagtgccaagcaacagattgcttctgacattgaattcatctccaagcaaatggaagaaaacaaagctcagattgcaaaactggaagctcagctgaaaaacagcaagtacaactctactcagatgaagaaagctgtagaagctctgactgctgaattaaaagcgaaacaacaacgtatcgaagaacttcagacagaactggcatctaagaacattcgtatccaggaactggatgcagctgtcagcgacctgtctgctgccaaagaatctttggctgccgaaaacgaagcgaaagctaaaaccgttgccgaacaggataagagtctgaatgccgcatggttcgtattcggaacaaaatcagagttgaaagcccagaagattcttcagagcggtgacgtgctgaagagcgctgatttcaacaaggattattttactcagatcgatatccgtacaacaaaagaaatcaagttgtactccaaacgtgctgagttgttgactactcatccgacaggttcttatgaactggtgaaagatgacaaaggtcagctgactttgaaaattactaatcctgccgaattctggagcgtatccagatacttggttattcaggtaaaataaggtagacatacctggttagaattgccaatgtgctgattcctgaattcaagaaattagcacattggcttttttatttctcatattatatatatcacggagccaatgaaatataaaaatctcttttttgacctggatgacaccatctgggctttctcacgaaatgcacgcgacacctttgaagaagtatatcagaaatattcatttgaccgctattttgattcattcgatcattattacacactgtatcaacgacgcaatactgaactctggcttgaatatggagagggaaaggtgacaaaggaggaactgaaccgccagcgttttttttatcccttacaggcagtaggagtggaggatgaggctttggcagaacgtttctcggaagatttctttgccattattcctaccaaaagcggcctgatgccccatgccaaagaagtgttggagtatcttgcgccgcaatataatctgtatatcctttccaatggtttccgcgaactgcagtcgcgcaagatgcgttcggcaggagtagatcgttattttaagaagatcattctttcggaggacctcggcgtattgaaaccccggcccgaaatctttcattttgctttatctgccacccagtccgagttacgcgaatcgttaatgatcggtgacagttgggaagccgatattaccggagcgcatggggtaggcatgcatcaggctttctataatgtgacggaacgaaccgtctttccttttcagcctacctatcatatccattcactgaaagaattaatgaatttattgtaggttttatggattaagtcgtatttttgttgcatctaataaatgtataaaatacgataacatcatggatagtacgcttctgccatttgccttactttgttttacttcgttctttacgctgaccaatcctttggggacaatgccggtctttctgaccatgacacacggaatgacagataaggagcgacagactattgtgcgccgtgccaccatcgtgtcgtttataacgttgatggtgtttgtctttgccgggcagttccttttcaaattcttcggtatctctaccaatggtttccgtattgccggcggagtaattatctttaagattggttttgatatgcttcaggcacggtatactccgatgaaacttaaagacgaagagattaaaacctatgccgatgacatctccattactcctcttggaattccgatgttgtgtggtcccggggctatcgctaacgctatcgttttgatgcaggactctcatacttacgccatgaaaggtatattgatcggaacaatcgctttgatttatctgttgacgttcttcattctccgtgcttccacccgactggtgaaagtactgggagagaccggaaataatgtgatgatgcgtttgatgggattgattctgatggtgattgcagtggaatgctttgtgagtggagcgaagccgatattggcggatattgtgagagaagggctgagcggtatctgcaagtagaagtctgtattgtggggaggaacagataagattacactcatgtgtaaattcggaaatggaaaataaaaagcgagcccgtttaactttaagcagttaaacgggcttgttattaaaatggtttcagtgtattagtagccttcgttttgtttcagcttaccgttagatacattgatctcggaaaccggaataggcattacggtacgatagtcgtcatagttgatcggaccggccggaacttgggcattcgttactgcctttttgtttctccatgtatcccaggcgttatgaccttcaccataaagttccagtctgcgttctgtcagaatatcatcgatagtaacagaagcaacgtcttcatagtcggctattctttgcttacgcaagtcattgatatagctggcaggatcagcaccacctgcttttaatgcagcttctgcggcgatcagatatacttcggacaggcggattactttcggattatttacatatatttctccgtcgcgtcccggatacttctggatataccagccttcgttatctccaccgtcgctttcttcagcaatcagagtgctgcgaacatcttccggacgttcttgaaggaaagttttgaatccctcggtgataccggcttctgcataaccttcggcatgtgtgtagaatccgagagagttacgttgtgcattgtagagtgaggtaatcaggaactcgaaaatgctttcactgcttccaactttggtccatactgtttcgtattcatctctggtgtacagcttgtatggagatttttcgattacatatttggcgtcctcaagtgctttactgttctcattcatgtagagatatgcacgggctctcagtgcacgggctccccaatagtcgatatgaccggcagttactaccttgctggtttctgggagattatccaatgcagtcttcaagtcatccagtatggtttcgtaagttttcgcaatagtagctctttctgctgtatatccggattcgaaaacttctgtagacaatacgatacccggatcgctggcctgtgcattacaaggaagtttagcgaacaagcgggccaagtcaaagtggaaaagtgcccgcaaagcatacaattcgcctacctgaacatcaacttcagctccttccagaccggatttcttaactccctccaaaactttgtttattcttgccagagaaagataaaagcgtttgtagaaatagtatgaatcagaactattcttagtagcctggtaggcatatacatcaactgtttgcttattgctaccgatggctttgaagtcgctgcctctttggtcggcgtacaagaagaaatcacctgcgtagctgccacgtggattagttcccgcgtctatagaagaagtctgagactcataaacaccgttaactgcaaactgtaaatcttcgagagtcttaatagcaccttctgaaggccattcactggaaggcactttgtcgaaagtatcgcatgaggatactgccaacgtcagtaatagaatgggtaaatatatttttttcattattcagtctgtttatagattataatttgatattaatgccgaatacacagcttctcaatgccggtgtatctgcctgacgataaccattgatcgctacatccgggtcaatgtttttagtcttcgaccacaacatagccagattgtttgctctgaagtagatgcggaagttggaaatgtgcttcttcaataccggcagagtatatcctactgtcatttctctcagacgaatattgtcagtcgatttgattgtgcggcttgagaatctgtcccagcgataagggttggcatagataggcatcgggttgtctactttatcacccggatttttccagtagtttccggctacatcttctgacaggttcatggaaccgattcttacgccatcatgatgagagaaatatcccggataatcgaacatgtcaccaccaaactgataagtgatcaggaatgacaggtcaaagtctttgtatgtgaaagtgttgctgaatccaccgataacatcaggcaatgcttttcctacaattcccttacctgcttcggagtagtcatttaccactccctttgagtgatcttcaggatctaaccagaattctcccaaacctgtttcaggatttacacctttccattcgggcagatagaatgtatacattgactctccctcacggtgcagatacatttctccgtctccatactggatatcttttccttcaggaagtttgtctaccaatgcacgttggtaagtcaggttgaagtttgaagtccatgtaaagttcttgttgctgatatttttagaattgagttccaattcgaaaccgtcgttcttcaatgcacccagattttcccaacgggagtcaaagccggtgattaatgaagtaggtacttcgaacagcaaatccgtagtcttcttattgtaatattccagagacagatttacgcggtcgtacatattccattcaattcccatattgaagttcttggatttttcccagcttaatttgtcgtttgccattcttgaccagtaaatagcaggagcacttccgtatccggaacctgtatacaggtccatgtaaccatagtaatctgagggcaagttaccgtttgtaccataagatgctttgatcttgaagtcggtaaataacggcatatcttgcataaatccttctttactcattctccatgcaccggatacagaccagaaactagcccaacgattgtcttcactcaaacgtgacgaaccatcacgacggaaactggcagaaagataatacttgttatcatagttataattgccacttgcgaaatatgacatcatgccggctcccaaggttgaacttgcagcttggtccggttgtccgttggccaattcgggatagtggcttgaataacgtttggcaacagttacaatctgtagcaggtctctgttttcaacttcgaaaccggccatcaagttcagattgtgcatatctttaaaagtatccgtgtagtttaatgtagaagagctggtagctacgcggctttcgaaggtataacgagaacccattccgctgacggaaccaccgttaacactgttgcgatcccaatattcaaagtgcttgttgtctacatagtcataaccaaagatagagttaagtgataacttatcacagaatttgattgttacatctgcattggtcatgctacggaacattttggtctgaatccactccagagctgtatcgctgtctttaccacctagcatcagatgcgggttggtaactttaccccatgctgcatttttattatatgaaccatcttcattctttaccggagcagtcgggtccattgcgaataaaatacctatcggagaagaagtacccattccttgagcctggtctccctgatcgcggaaaccatcttgcgatgtagcggctatcatttgcttgagagctacgttcagccagttatttactttgtgattaacgttcagacgaccggagatacgttcgaagtcactaccaagaacgataccctcgctcttattgtaaccaactccggcatagaactgagtctttgacgaaccgccgttgatagatatctggtgatcttgagtgaaagcagtacgatagatttctttcttccagttcgtatttactttaccggatgggtcatggataaagtcagcaacagtagccggtgagtcgagcagaggaatgaacatatcacctccgttatcgatgttgttcaatgctgcttgtttgctatctgttattccgtaagtaaccagacagttggctaatgattcgcgagtgtagtcaatcaagtcggctgatcccatcatattgaaagcatttacagccatcttgttccagcctacttcacctgaatagctgacattcgtttttccttctttacctttctttgtggtaatgatgataacaccgtttgcggcacgtgaaccgtacaatgaagcagcagcggcatctttcagaacagtcatgctctcaatgtcttcaggattcagtgtactcaatacgctttgagtcttaccgtagtagttcatgtcgtcatcagcctttgttacgacaccgtcaataacatacaacgggcttttagaagcactgatagaaccgacaccgcgaatgttgatttcggccatagatcctgggtcaccagttgctgaggctgtgcgcacacctgccattttaccggacaatgccttgtcaaaagattctttggaaccggaaacgattttatctgccttaatgacagcagctgatcctgtgaatgaagacttcttcgcagtaccataagccacaacaataacctcatcaagattttgtgcatctgatttcagtgtaactttcaccattggcttgattgccacttcttgtgtttgcataccaatatacgaaatctgcaaagtctttgcagaacttggtacgttcgccaaattaaaattaccatcgatgtctgtgattgtaccttgagtagtaccttttaccaacacagaggctccaacaactggttgcccatcttcttcagaaatcacaacgcctgtgactttctgagtctgagcagttactaggcttatgcccacaaaaaggcatgccaataacagcattaattttcttttcataaattctctcttaaagttcaactttacattaattgtctctatactctaacaagttgcaaaattattaataaatatgaaactaacaattaatttgataaaaaaaggttgtatatataacatattgttatttataacatcgaaaatatgctgataaacatctttatttgctataaatattgtgatttatcaagcatgaaatgtcactttgtgaatgcaaagtgtagtaattaacattctatttgcttgtttttggatataaaactaccctgcaaacgtttctttttgatttattatgaagaaatgacgataaaaaaatagcatttaaattaaagttatgtaaatacttaattattgaattttaatttttgcagaaattaatgcaggttcaaccttaattatagcacagaacttagtttattttgttcttagtattaactaaaagacaatagaatgaagaagattagttacagccttgtgtttaacagaaaaaagaagctgaacaaaaaaggaatggcattggtacaagtagaagcttacttaaacaggagaaaaatgtacttctcaaccagggtgtacctcaaaccagaccagtgggacgtaaaacgtagaatggtaaagaaccatcctaattcagatgcattaaatcgaatgctatatgattttatagctgacattgagcagaaagaactgggattatggcaacagagaagatcgatatccttggattcgttgaaagactctattgaaaaaccggaaaataatgggaattcatttctgaccttttttaaagaggaagtcagcaactcttctttaaaagagagcaccaggcagaatcatctttccactttagaattgctgcaagagtataaaaaggacattgtattcactgatttgacattcgaatttgtgtcttcatttgataattatctgcagtccaaggggtatcatctcaataccattgccaagcatatgaagcatttaaaacgatatgtgaatgtagctataaataaagagtatatggatattcagaagtatgctttcagaaaatataaaatcaaaagcatagaaggaagtcatacgcacttgtcgccggaagagctgaataaaatggaggaggtgaatctggaagggaagtttacgaagttacaaaagtcaaaagatgcctttttattttgttgttacgccggtttgcggtactctgattttataaatctgactgccgcgaatattgtcgaactccatcaggagacgtggctgatttacaaatctgttaaaacaggtattgatgtgcgccttcctttatatttattatttgaaggtaaaggactgcgggtgttggagacctacaaagacgatttaaacggattcttcaagctgaaagataactctaatgtgaataaagacttgaatgcattagccaagctggcagaaatagacaaacggatatcattccatacagcccgacatacaaacgccaccttattgatatatagtggtgcaaatataacgactgtacaaaagctgctgggacacaaaagtgtgaagacaactcaggtatatgcaaatatcatggacatgactattgtgcatgaccttgagaaagcagcctattcaaaattagctaatagaccaaaaagctaggcagtgattgtctggaaatgtcctgtttttaagattggtttcaacagagttgattcaaaatctaacaatatggcagaaataatgcataaatcaatgtaagaatatgcaatttacaaatgatttgtcgcatataaatgactgtaatatacataaaaagtgcaatgtcaggactctttccttttaaaggaacgatccgttcctttaaaaggaacagatcgttactcaccgaggaacatctaattgctttaaaaggaagagccaaaagtagttttaatttctaattctgttctaactgatagactttcctgtcacagggaaatatatcatatcgaaactaaatatttcttttatattcaaaggtgcaagctgatataagtaatcatatagcacaaggaaacaaaaaacggacagatgtatttcatccgtagatctgctgttttaaaatcctgccgatttttgtcattctcccaagcaggttctgcatattttgaattataccataactaaatatgcttttcttcagatttgatctttttctactatcacgccccaaaagtaatcattcattatgattggtggtgagaaatattcgggaaatataaaaatagtatccaataataatacctcatataaataaaataaagacataactttcttataa

SEQ ID NO: 145 - DNA, 19513 bp, Bacteroides thetaiotaomicron
tacttgcatagtcattagtgtctaatcaaaatctaatatatatgactgtatcatttaacatcgaatatcgcaccagttggggagaagaagtcaggattgccgggctgctgccggagtcgatccccatgcataccacagacggcatatactggacggcagacgtggaactggaagttcccaaagaaggaatgactatcaattacagctatcagatagaacaaaaccaaattatcatccgcaaagaatgggacagctttccgagacgtctctttttatccggtaactctaaaaagaagtatcagattaaagactgctggaaaaatatccccgaacaattgtattactacagttcggccttcacggaagccttgttagcccatcccgacagagctgaaattccgccttgtcacagaaaagggctggtcatcaaggcatacgccccacgcatcaacaaagactattgcctggcaatttgcggaaatcagaaagcattgggaaactgggacccggacaaagcgattcccatgagcgatgccaactttccggaatggcagatcgagctggatgcaagtaagctgaaattcccgctggaatacaaattcatcctttaccataaagaagaaaagaaagcggactgctgggaaaataaccccaaccgctatcttgccgacccggaactgaaaacaaatgagacgctggtcatctccgaccgatatgcctatttcgatattccggtatggaaaggggccggtatagccatccctgtcttttcactgaaatcagagaacagtttcggagtaggagatttcggagatttgaaacgcatgattgactgggctgtaagtacccaacaaaaggttatacagatattaccgatcaatgatacgaccatgactcatgcgtggaccgattcttatccatataatagtatctccatttatgctttccacccgatgtatgcagatataaagcagatgggaacactgaaagacaagtcagccgcagcgaagttcaacaaaaaacagaaagaactcaacggcctgccggcgatggattatgaagctgtcaaccaaacgaaatgggaatacttccgactgatcttcaagcaggaaggagaaaaagtattagcctccggagagttcggcgaattctttaatgccaacaaggaatggctgcaaccttacgctgttttcagctatctgcgcgatgcctttcagacacctaatttccgtgaatggcccagacattccgtttataatgcacaagatatagagaagatgtgccggccagaatctgtagattacccgcatatcgcactttattattatatccagtttcacctgcacctgcaattggtagccgctacgaaatacgcccgcgaacacggtgtcgtactcaaaggagatatccctatcggcatcagccgcaacagtgtggaagcatggaccgaaccttattacttcaatctcaacgggcaggcgggcgcccctcccgatgatttctcggtgaacggacaaaactggggattccccacgtacaactgggacgtcatggaaaaggacggctaccgctggtggatgaagcgtttccaaaaaatgtcagagtacttcgacgcttaccggattgaccacatcctcggtttcttccgtatctgggaaatcccgatgcatgccgtacacggattactcggacagttcattccctccatccctatgagtcgggaggaaatcgaaagttacggactcccctttcgggaagaatatttgattccatatattcatgaatccttcctcgggcaagtattcggtccgcataccgattatgtgaaacagacttttctgcttcctgccgaaacacccggtgtttatcacatgaaaccggagttcaccacccaacgggaagtggagagtttctttgcaggaaagaatgatgaaaacagtctttggattcgggatggactatacactttgatcagtgatgttctttttgtaccggacacgaaagaaaaagataaatatcatccgcgcatcggaatacaacgcgatttcatcttccgttcactcaatgaacaggagcagaatgcgtttaacagactgtatgatcagtattattatcaccgccacaacgagttctggcgccaacaggctatgaagaaactaccgcaactgacacaatcgacacgtatgctggtttgcggagaagacctgggtatgattccggattgtgtttcgtccgtcatgaatgatcttcgtatcctcagtctggagattcagcggatgccaaagaatccgatgcacgagttcggatatttaaatgaatacccataccggtcggtttgtaccatctccactcatgatatgtctactttgcgaggctggtgggaagaagattacctgcagacacagcgttactacaacacgatgctggggcattacggaaccgcaccgacagtcgccactcccgaattgtgcgaagaagtggtgcgcaatcatctgaaaagcaattccatactttgtattctgtccctgcaagactggctgagcattgatggcaaatggagaaatccgaatgtgcaggaagaacggattaatgtaccatccaatccgcgcaattattggcgttaccggatgcacctcactctggaacagttgatgaaagcagaagaactcaatgacaagatacgtgagctaataaaatacaccggcagagctcccaagaaataaatatctttaggcacgggtgacacggattaacacgttttttagacctataatctcttaaaactgtaaatccgtgtcatctgtgcctgaataaaatcaactgatagttttgacacctccgtttctctcccatgcggcaattctttatcttccttcattccgttttttccaattaatcaagtatctttgcaacgcaaaaacgcaacgcaaaataaatgggagacaatcagcatcggcgtattgattttgtggacttaaccaagggagtctgcattattctggtagtgatggcgcatatcggaggcgctttcgaccaacttgacaagcattccatgctatcctgctttcgcatgcctctctatttctttatatcaggaattttcttcaagccttatgaaggattatacgggttcattatccgaaagaccaataagctaatcattccctttatcttcttctacgtcagcgcctttctactaaaatacattgtatggaagattgcaccggaaactttccatctccctgtgtcatggagagaattactgtttgtctttcacgggcacgacctcatcaagttcaatcctcccatctggtttctgcttgctctgttcaactgcaatatcctgttctatctgattcattatctgcgtgacaagcatttatctctgatgtttgcagcaacgttactgatcggatgcacaggattcttcctgggcaaatttcacatcgaacttcctttgtatatagacgttgccatgactgccctccccttctatgtggcaggtttctgggttcgccgatataatttcttcctgttccccagtcatcggttcgacaagattattccctcatttgtcctgctggcactggtcgtaatgtacttcaccgccaccacgccgggtatgcggaccaacaattatcccggcaacatattccaggtatacattgccgcatttgccggaatctttatgattatgctgatctgtaagaaaataaaaagaataagcatcgtttcttatctggggcgatattccattatcacactcagtattcatggaccgattatacactttgcaagaccggtcgtttcgcattatattcataacgactgggcagaagcaagcgcactgctcctgctgacattgaccatctgcattctctttacccctatcctgcttaagataattccacagttggtggcacaaaaggatttattaaaagtcaaataacaaaacattgtgcaagccaaacttttcttaactctaagtttaattatcaaataatttactacttttgttccaaagaactatagaccgagaacaaatgaatataacgattgtcttaggagataaaattccatctataaaatacggcggaactcaaagagtaatgtggtatctgggtaaagaactcaataagcgcggacacaaagtcaccttcatcgcaggaaaaggttcctcctgccctttcgctaaagtgatagaactggaccctagcgtaaatctgaacacccaaatccccacagatgcggacatcgtacatttcaacattcccgttcccgaaggaatcaccaagccgcacttactgaccatacacggcaatggaatcccggccaacgcagaccggaacatcgtttttgtctcacgtaatcatgcacaaagacttggaagcgaatcattcgtttacaatggactggactgggatgactacggtcccgccaacctcaccctttccagaaaaaactaccattttctaggcaaagcagcctggaaggtcaaaaatatcaaaggagctatcgccgttgtccaaagcatcaagaacgcacaactggacgttttaggcggttatcgcctcaatctcaaaatgggcttccgattcacatggaatccacggattcattttcatggaatggtagatgattcaaagaaaaaagttattattgagcagtcaaaagggcttattttccccgttacatggcacgaacctttcggacttgcaatcactgaatccttatacttcggagctcccgtattcggtactccctacggtgcgcttcccgaactcgtttcaccggaagtcggttttctgaccgcccacggacaggaaatggccgaacatatacagtcagcacaatattctccgaaagtctgccacgaatatgccagagatctattcaattcaagtgtcatggcagaagcctatttaaagaaatatgaaactgtactgaacggcgaacctttgaataaagaagtcccccatattatagatatcgcacgacgtcttccatgggactaaaaatggcagttgaattacatagctgatgagtacaatctcatttataaagcctttcattcatttaataagcgaacaaaaatgatcgaaaacactttataaaaagaaataaagccttacctttacttttttagaaaacaaaagatatgaagataaacaacagctatattttgctgaaagacatctgctgctttgcttatcatggagtagccccccaagagaatatcattggaaatgagtatattatcaacttgaagttgaaggtagatatcagtcaggctattcaaacagacgacgtggtggatacggtcaactatgccgaaatacacgaagccgtgaaagctgaaatgtccatcccgtcgaagttgctggaacacgtatgcggacgaatagctaaaagactactggcagaatttcctgccattgaagaaatagaacttcgtctttccaaacggaatccgcctatgggagcagacatcgactcagccggagtagaactgcattgcagcagataagtacctttgctttatcagtttgtgttattatcaagaagcacattggtctgtcatcctatcatccggactgccacatccggtcaacttatttacaacaccctatcattccgcttgtgccaagtaatgggcacagttatgccaaaggagtatcacggttgtgacaagggtgtggcacagttgtgacaaaggcttggaaacagttgtgacaagggcatggcacagttgtgccaaaggcgtggcatcgtcgtgccaaaggcatggcacaagtaaggctgcctcatttctacttgaagcagcctcacactatcatattttcagtctataacgacctatctcttctttctttttcttttatttaccgattctacagcttccgttaccacggatttgttttcgaaccgtttcgtataactggaatagtccggatgggtacgttcgtaatcgggatccataaacagagggctggaaatgatatgatccgccgtagaacggttacaacagaaaacgatgttctcaacaccggccagtcgggttaatgctttaacatccgtatcatgtggctgcaaagtcatagggtcagtgaaaaagaatagataatcaatctgaccgtccacaatacgcgatcccatctgctggtcacctcccaaaggaccggatttcagaattgtgaagtcccactccacttcaggatgcttctccttcagtgcttccagaatcagagtacctgtagtacctgtacaatagaatttatttcccatcaacagttccgagttccacagcacccattcgatgaggtcttttttcatggcatcatgtgctaccagcccgatgcctctccttacttttggttccattttgttatccttttaaatccgacaattgagagaatcttttgcaccctcccacataaaactgccacaagatactactttttatccgttcagggattggattcaaagaagtttttcttaagttttctttacgggaagaagaaaatgaaggacaaatctgtttatattctttccgggcacgcatcaccgcacgggcgttgtctaactgccccttcagcagaaatgtgaatgcagccacgtaatcgagacaagtccggatacgcatcactttatttaactcttcgtccgaaagattcttatagagcatgacaagattattacgaaaattcaaaaaagtcttgcggggattctcctttttcagagttgcaccaccgacgtgatagaccgtactttgaggaatgcaaacgatttcccgaccacgggaacgtagtcgccagcataaatcaatctcttccatgtgggcaaagaaacgtccgtccagtccgcccgcctcacgataatccgcatgacggataaacagggcggctcccgttgcccagaaaactggcaggatcgtatcatactgtccctcatccttttcaaccactcccattatacgcccacgacagaacggatagccgtacttatctataaatcctccggctgctccggcatattcaaaatactctttttgccgctggctacggattttcggctgacaggcagctacctccggatggccatcaagataggagatcatcggttcaagccaatgttcggtcacctcaacatcagaattcagaagtaccacatactccgcttctacctgctgcaaagccaggttatatccatctgcgaatccatgattctgatccagcacaatgatccggacacaaggaaattcctcccgaagcatttccacagaagcatccgtagagccattgtcggccacacagacttctacttcttcgctcttcgaatagcggatcacggacggaagaaaagtacgaagcatatcgcacccgttccaattcaaaataaccactgacactttcatccttaccccctttcacattcagccttagaagctttccaacgtttatgagaccacagccaataagccggttccctgcgaatcgtctgttccagataatcagcaaacatttccgtaatttctccttcacccgtctccttcggtttctctgtcatcagcttaaactcagctacacaataccctctgccgggttttgtcagatcacaatagaacacagggaagttcatcattttcgcaatgcgctccgcaccattcagaaaggcggtttcctgccccaaaaaagtagtccagtatttttcgtttccgctgggccactggtcagtaatcagaccgacaaccatctttttgccttcacgcttcaacttgataatttcgcgtgccgtagaatgtttcggaacgttatatcctccgaagcgggaacggatgcgctggaacaattcgttcaagtatttatctttcagaggtttatagacttgcatcggtacatcacccggtttcataatagatcccatcccgatcagccattcataattggcataatgaggaatcattacgatgattccgccatatttctcggtcagttccagatattgttccgtattcttataagtcatccgcttataaaggtcttcgggtgacatatgaagcattttcaagtcttcaagcatatagtcggaaaggtaacgatagaaacggcgttcgatctgcagcctttctttcttgtctttttcgggaaatgatttcttcagattctcccgtactactttccggcgatacctccctatacggtacatcaacaggtaattgaaatccgaaagtaagtacaatatccggaagggaagcgccgaaaacagccacatcccgctatataccagccaatagataaatctagacttcataattcatcagaattgtgcctttaagcgctgtcatgtcttcattaaattctcccagtcggacgttaatcatctgattgtccaatgattcgtcattctccacttctacgcggatatagttagcggtaaacccgtgcatcggtgtacctgcttttgatttttccatcaatacctgcatggtctgcccgatatgacgggtatagaaagcccgtgtcttttcatcagaaagtgtcagcaagcgctggctgcgctgatgtttctcttccggcgaaaccacataatctatcttcaaggcctgcgtccccggacgttcggagtagctgaacacatgcaactgtgtcacatccagtccggaaataaactgataagcctgttcaaaatactcttccgtctctccgcgagtacctacaatcacatcgactccgataaaggcatccggcatcacttccttgattttctttactttagaggcaaaaagagccgtatcataacgacggcgcatcaatttcagcacttcatcgcaaccggattgcaacgggatatgaaaatgaggcataaatctacgggaacgggaaacgaactcgatgatttcatcagtcagcagattgggctcgatagaagaaatgcggtaacgttcgatgccttccacctgatccagcgctttcaccagatcaaagaaagtctcaccggtagtcttaccaaaatcgccgatattcacgcctgtcagtacgatctcttttccgccttcggcagcggcctgccttgcctgctccaccatagaggcaacagtaccgttacggctgcgtccacgggcaaaaggaatggtacaataagaacagaaataatcgcatccgtcttgtactttcaggaagaaacgagtacggtcgccccgtgaacacgaaggcgaaaacgaacggatatctttggtggtggtagtaaatgcctctccctcttcatgcttatggaggtcgccgagatactgcaacaagtctcctttctgctcggcacccagcactacatctactccttttatctttgccacgtcaccgggcttcaactgtgcgtagcatccggtcactaccacaaaagctccgggatgctgcttgaccaaccgatgaatagcctgacggcatttcttgtctgccatctccgtcaccgaacaagtatttaccacacagatatctgctttttcccctttgcgtgcagtccggactcctgcctcccgcaggattttaccgatagttgaagtctctgaaaagttcaatttgcagcctaacgtataataaacggctgtcttattttgaaatacagtggtatctatcataatctgttataacgcatatttcctgcaaagttacacattattattagtaaaacactttaggatacgaaagtttattcctatttttgcacaattcactaaaaaacgtgcaatgattaaagagaatttcattaaactatacgaaaatagttttcgggaaaattgggatttaccttgctataccgattatggtgaatccgttcattatacttatggccaggtagccggagaaatcgcccgtatgcacctgcttttcaaacattgcagcctgcgcagaggagataaaatagccgttatcggcaaaaataatgcccactggtgcatcgcctacatggcaaccatcacctacggagccatcatcgtccctatcctgcaagactttacgcccaacgatgtgcatcatatcgtcaaccattccgagtccgttttcctctttaccagtgacagcatctgggaaagcctggaagaagaaaagctgaccggactgcgcggagttttttcgctcaccgacttccgctgcctctatcagcgggacggagaaactattcagaagtttctggtacacctcaatgatgaaatgtacgccgcctatccgaaaggattcacgcgcgaggacattcaatacactacgttatccaatgataaggtaatgctgctgaactacacatcgggaactaccggcttcagcaaaggggtaatgctgacgggcaacaatcttgccggcaatgtcactttcggcatccgcaccgagttacttaaaaaaggagataaagtgctttctttcctgccactggcacacgcctacggttgcgctttcgactttctgactgcaactgctgtcggaactcatgtcaccctgctcggtaaaacgccttctcccaaaattatcatgaaggcttttgaggaagtaaaaccgaacctgatcatcactgttccgctggtcatcgagaaaatatataaaaatgtcattcagccgctcattaataagaaaggtatgaaatgggcattaaacattcctttgctcgacacccagatttataatcagatacggaaaaagctgatagacgccttaggcggacgtttcaaagaaatcatcatcggaggcgctgccatgaatcaggaagtggaagagttcttctacaaaataaagttccctttcaccatcggttatggtatgaccgagtgcggaccactgatcagctatgctccctggaatgaatttattttaggctcttccggcaaagtgctggatatcatggaggcacgcatctataaagaaaatccggaagcggaaaccggagagattcaggtacgtggtgaaaacgtgatggtgggatattataagaatccggaagccacgcaggaagtgtttaccgaagacggctggctgcgcaccggcgaccttggtactatggacgccagcggaaatatcttcatccgcggacgactcaaaagcatgattctgagttcgagcggacagaacatcttccccgaagagctggaagccaaactcaataacctgccattcattcttgaaagcctcgtcatcgaacgcaacaagaaactggtggcactggtctatgcggattacgaagcgctggattctctcggattgaacaatccggataacctgaaaaccatcatggatgaaaatctgaagaacttaaataataatgtagctgcgtatgaaaaagtcagcaagattcagctttatcctacggaatttgagaaaaccccgaaaagaagcatcaaaaggtatctatataacagtatagctgtcgattagtatgttttaaaacatggattgaaggcgtaatataacaagcttctaaaaaaaattataaaaatagttggcttttcgagaacaacatattgaaaaagtacataactttgcagcgttttaataaagcaattgattgtattacgtttttaaaaagcaaagaaaatgaaaaaattagttttgatggccgtagctatcgtagcagtatcattcgcatcttgtggtaacaaagcagctgacgcagcaaaagctcaacaagattctatccgcatcgctgactcaatcgcagctgtagaagcagcagcagctgaagcagaacaagcagcagctcaggcagctgactctttgaatgcagatagcactgcaactgaagctgtagctgaataattcagaacagcctagagagaattgaaagtctgacatgctaaaagcatgcacagacttttttttatgccttatttagcgtatgagcttttaacaaaaggagcatccagcaaataatccagacttacctcgacacttttctctacgggcatgctgtagctttctatctctgcaacaagatgcttcacaccagccgtctttgcattcttgaaaatagcgtcgaaaccaaccattccgctctgcccgatttctctgtgatccttgatatggaacattttaaaacgaccggggtatttattaaaataatctaccggactgttttgcccgcgaactacccaataaacatccatctggaagaaaacatattcaggattggtatgctcaatcatgtagtcatacatcactttatcttctaccttctgaaattcatgagcatgattatggtatccgaacgacatcccctgctgtttacaacgtttgcctatttcattgtaataagcacaatatgtatccaactccttaagtgttttaggcacatccatccaaggagctacaatgtaactcataccggcagctttatgatcagcaatacactggtcccaccattgaagtgaacttgaaaaatcaccggaagctaattcttctttcgacaatcctcttgtgcaatgtgaggataaaaccttcagcccggcagattcaacatcttttttaaattgatcgggagttctgtcgtaaaactttccattattataattggcggcttccacactggtatatcccattttcgccaagttcttcagaagagtaatataagcggcgtcacatttgccgtccttattgtccaccttattcaatatatccctgacagaatagagttgaatcgctacttcttttttagctttcgcttttgttttagactgtgccatggccgtaaacggaatcattaaaagaagagccagcgcacatagatttatttggagtttcatgtttgtagataaaggggttcatgtattaaaataaaaaagctgtgtcagaagttcgtcgggcatatcattctgtcattcagaactaaatgccatgttgatgttacttttgacacagcctatctttgaattatttatgtgatcagtccagaactttcacgcggatattgcggaaccaaacgtcatcaccgtgatcctgcattccgataaatccttcgtggttttcgccaccgcaattattcagcagttcgaaagccaacggccatttgtcctggctgaatttgctggcttgcaaaaggtcagtccattgtttggtccacaagtggtattcgagtacattctcgtcattctgtccgtgaacaacagtacctttataaaccatgatcttagccttgttccattcgccgaaaggtttcgcattctgaggaactgccggaatcatgtcatataaagaagccgactgccggttattgtctttccccaatttagcatccggatgattgtcgttgtccaatacctgatattcaggtgcggaaatataaataggttcgagcacgtcgttgccgtccttatctttagaagtcacttcctgagctaaatagaagataccggagttaccgcctttggaaactttccattccatttccagttcgaagtttttgaatttgtgagcaaagatcaggtctccgccatcaccatcctgtgcttcaccgccaccggaaccgttgaacttgatgcaaccgtcctcgatagtccacttggaaggaactctgtccttgccataaccacgccatccattaaatgttttgccgtcaaagatagtgatgtaaccatccgcatctaccggtaattgcaagctatccatctccgctgcttttaatgattttgaatatgatactgctacttcgtttgccgattgctcttcctgagcactcccggctttcttctgaccgctgcaggaaactaaaactcccgctgcaagacaacaagctaatggataaaatactttcttcataataataactatttaatttttaatctttaattcttaacttacttttatcgtgttatcgtggcatatcaggcaacttccatccttcacgataattatgtttcaccagttcggctgcaaattgtttcgcgttgatcggatctgtccaggtcttattgaatgacgggtgaccatcatgaatcgtaaatccgtccttaatgcaggttctgagtgtttcgttatcaccaatattagtgaagcacatattagcgccgtcccattccagtgtcttgttcaatccttgcagacggatagccaatacacccattaccaccatttcattcatcggtcccgattcggagaaatccgctttcggcatcacgcggttggatttgtcttccttacaagcgcgtacccagtccatttcatgagaacaagtaacacggcggcatactttcggtgcattgggcacacggcctgacaacaagaaaggttgttctccgtagcagccgcaaatcaatgtatcttttgttccgtggaagatagtcagaccaccaccggggcccatcagttgttttccttccgggaaacctttcggacgttccggcatcataccgccgtcataccagtgtacctcaacttccggcaaggcaactttcggcatattgtcgcgggcggggaaaatcatcttcacgtgttgggcctgaggagcgcaggcactcagtaataaagtagaagaaccttccaccttggtaggataacccagcttcagagctctgaacggctggtgcagaatatgacaggccatatcacccagtgcacctgtaccgtaatcccaccatccacgccagttccagggatgataaacgttgttgtacgggttcagtttggcaggtccggtgaaaagatcccagttcaatgtgttggggatgcggtccgccttttcgggtgcattcagtccttgcggccagataggacggtcggtggcgcattccactttggttacttcgccgatttctccattccatatccattcgcaaaccaggtcggtaccttcgcccgatgctccctgattacccatttgagtaactactccggtagaggcggccagcttggtcagcaaacgggattcgtaaacggagtgagtcaacggtttctggcagtatacgtgcttgcccattgtcatggcgtctgccgtgatgatggcatgagtatggtcggcggtagcaatgattacgccgtcaatggatttgcccatttcatcgtacatcttgcgataatcccagtatttcttcgcattcgggaattcatcgaatacgcctttggcatatttccagtctacgtcacaaagggctacgatgttttcggtgcccttcacgttgttgatgttggcatgacccataccgccgatacctacggctgcaaggttcagtttgtcggttggggaaacgtgcccgtggctcatacctaaaatagagctgggagcaatggtgattcctgctaaagcagcggctcccgttttaagaaattttcttcttgaaaagtctgacatggttttattattttaaggagttagttatttgtggtggattactatgcagcaacccatatccatttttcatgttttttctgcgttcgcgtatttgttcaagagtctgcaaattaccgatagccggcaagtcattcatacgagcatcctgcaggaatttccacgcatactcggatgcaatagtcgagtcatacattaaaggcaaacgagggtttcgcttaccggtcaatatggaatcggcgaacaaatcgcacagcacatcaatattcttaccaccaaaaggtttttccacacgaagtgtctgatgtactccgtgtaaatcgacaacagctgttttgaaatcatgcgtcatacgcacgataccttccgtacctataatatctacataagaattgtgcgtctgatctttcgataattgtccatagacaaaaccctgggttatatcaaagactacgccattttgaaaagttccgtgacattgtacccaccagggatctttataattccacatgttcacgccttgtgcattccatgttctatattcactttcggcataccagcgaacgatgtcaacataatgcattccacaatcatggaaagcggggccttcatattcatgtccttcacccggtgccagtcccggagtcatgtggcaaatacggataatggctaactcacctatttctcccttctggatatattccttcatcagattatgataccaggaatttcgcagatataagtttaccgtagaaagtacattggagttttctatcatatccaccaccttccactccttttccatcgtatctgcaacaggtttttccgcgatgatatgttttccgtaccgaatagccttttctatttgttcgagccttgagtctgccaatgtgaagagcccgacaacctgtacactctcgtcttcaaagattttttgatcattctctactacaagagattcaggagatatttttttagcaagttcgcgcgtggtaggatctgtatcgcaaatataggcaatctcccatcgcccgcttttccgcatcgcctcccaatagaatcttcccattctaccgaaaccgattattcctacttttatttttgtgtcaagtgaaaattgtgcatccataaaaaattgcgaatttaagtacaaacaacataaaaggtatcaattttcatctgtaggcagattgttcgaaaactgatatcgcaaaactagccaaataaataacgctttatttagtctacacaactttatgtagattataaaatcatattacatattataaatcaacactttagatatacacaaggatataaaaaatgtagattgtttggaaagtattttatttatcgaatggcacaaattcgtttatattggtcagattttcataatttcattttcaaattcatcccgatctactgcagccttgttacgcattttagtacgataattataaacagtacttgtagagcaacgaaggaaattggcaatctttccgctatccgtaatgcccaaacgtaacagcgcatagatacgaagttccctattcaacaaagcgtcctgtttaagaatgatcttctcgtcatctttcagtaaagcattgaaatctgaaacaaaagtcggatataaattcagaaagactctatcgaagcgagtatacagagcatcaagttcatcatcaatcaatgcggaagatttcagctttttaatcagttcctcatagcacttattaatggctattttatacagcatattctgatacttctccattttatgaatatagctgaagcacacgtcgaaaaactgagcgatataatgctcctttatattattaatctcgcacagttcatcattcttatcattcaactcactattcatgctgttcagtttgtcgttcagtctcaaaagttcctcgttactttgtgccagcgcccgtttcatccgcaacgtttttttcatctgaatataaataaatacgaccaacacgattaaaagaaaaagagaaacgctggttgagataagaaaagtaatcagattcgatttagacctagcttcttccgtctgataagccgtattaataatagaatagaatttatagatttccattgcccggaaatgaatgccggaggaaacgacatcatcaatagccgactgagtaaatttgaaagcatccgctaaattattttcctcatattgtatcagtgcaagtgcctgcagggaggctgtttcgcgtgtggcattctgaatatcagcaatggcggacatcataagatatttcttcgcatcatcctctcttttcaaatagcggctcagcatggcatacgaatgagtaatcatcgcatagttaggagtgcctacctcctcagcattcagcaactcatccaaaatcttgatcgcctttgttgaatcgtgtcctgcataagaataagcccgtgacaatttatagtcaaaggaagtatgatccataagagcatacagtgaatcctgataggcttcccgtttttttccgtactgattattggtagcagaaatcgaataatactcccaaaaacgggcatatgtatcataataagtagctaataatgaacgaggaaattctgatggcttcattttttcgagaagtaattctgcatctctatatctgccgcacatggaatatacaaggctgagttgcaaagaagactggtatttcaaatagtttctatttaactgacgagcgatttcaaggttccggtcgacataatggatggcagagtctatattaaatttcttatactcattgtataattggagattcaccttatattcccgatcgggagtcaacccagagtccttcagtaaacatttaatccgagcgattcgctgctctttcttctggacgaagagcggcttcgcatctatcattttatgcagagagtcagccagtattttcaattcgttatttgcataaagagcattgccaattcccagagcaaccaggaacagcaaaacgattctcttcagataacaacggttgaatttcatattattagcaaagatgataaaaaaaagcgatttatccatcagaacaaatcgcttttttaatatatgaagtaaatttgctcttattcagcaactacttcgaaaggaatttctacagaaacttccttgtgaagtttaacgatagctttgtagttaccaacttctttcacagcgtcttttacaacgatgatctttctgtcaatttcgtgacccagttttgccaatgcttcagcaatctggatattgctaacagaaccgaagatagtacctgttgaactaacttttgttgcaatagtcaaagaaacgccttccaacttagcagccaatgcttcagcatccttcttgattttctcaagtttgtgagcacgttgtttcaagtcttcagccaacattttctttgcagaaggagaagcgatgatagcttttccagtcgggatcagataattacgaccgtatccggatttcacgtttacgatatcgttcttataacccaagtttacgatgtcttctttcaatataatttccatacttttcctccttcttatttcatcatgtcagttacataaggcaacaatgccaagtgacgagctctcttcacagcctgtgcgatacgacgttggaacttcaaagaagtaccagtgatacgacgtggaagaatctttccttgttcgttcaagaatttcttcaagaattcaggatctttgtagtcgatataacggataccgctctttttgaaacgacagtattttttcttcttaacgtctactgagggcggagttaaatatctgatttctgattgagtctgttgtgccatgattaatcctcctttttgtttgatttaacacttcttcttttagcagcatattccgcagcatacttgtccattttgaaagtcaagaagcggataacgcgttcatcacgacggaagttaagttccaacttgtcaatgacagtaggatctgcattgaactcaaccaattgataaaaacctgttgacttcttctgaattggataagccaatttcttcagtccccagttttcttcattgataatctcagcaccttcagcttgaagaatacctttgaatttttctaccgcttccttcatctgaacatcagacaaaacgggagttaaaatgaaaacggtttcgtattgattcatactcgtttaatt

SEQ ID NO: 146 - DNA, 19363 bp, Bacteroides thetaiotaomicron
cgggacttgataaatactcacgaatataagacattcgttcatcatcactgtaatagttgtacttctttttcgaatatttcatctttattttcgatttttgaagtgtcaacttattcagtacactacaaaaccaacgcttgccccatatgatactgatacttgatttatatggactaacaatttagcgtataactgattcggatatgaagctttccgtagtttggagttgatgtctttattttaaaagggacgaccccttccttataaaaagaaagaggccgtggggataaaaaaagactggtggggtatttatatatagattaggatttattgtttttgcttagatgttgggtgaatatctcttttgactgatattcttctgctatctgttttattctttcatcagtttgatctaatatgtaatttagttctgtttcgtcgaaacaatctcctaagtgtatgggagtatgtagtaaatctgaattctgatttgtttctgttgctaattgttgtctatgaactgtgacttcaatttctcccttttcatctgtagtgaaaagtaagttgtatttttctatcagggcaatgaattcttttaagaacttgtattctgtttcggtcaatacttttatcatatttgttcgtttggtgtttattttatacttggcaaagttctaatttctttttgaactttagaatgaaagtaatatgatttttattccatttgctaagttggaatattccttttattcatattaccacatctattcgtttttttcgtatatttgcttcgaacgaaacttttcatttgtatatttgttggattttaaaaagaaaaaagaatcatggaagcagaagaattaactgttgggagagttcatcatggacataacatacgtcgttttcgtatagaaaagaatatgaatcaggaggttttaagccaattagtacatttatcacaatcagcagtatctaaatatgagcagatgagagtgattgatgatgaaatgttacaccgcttttcacgggcattgggagtccctttcgagtatctgaagagtttggaagaggatgcgcagacggtggtgtttgaaaataatacggtgaataataatgatcaggcttctgctaatattggtggctatgtggaggaaaataatagagtgaataattataatcctatcgaaaaaatcactgaactctacgaacgtctgctgaaagagaaggatgaaaagtacgcagcactggaacgtcgtttgcaaaatatagagcagagcttgcagaaataaagaacaaatataatgaaaggaatcgtgatatgatgaaacaaataccctatggattgacggactttgcccgaattcaaaaggacaattattactatgtagataagaccatgttcatcgagagaatcgagatgcaaccggcttatcttttcctgattcgtcctcgtcggtttggaaagagtttgactttggctatgttggaggcttattacgatgtagtatatgctaatgactttgatgagctattcgggcatctttatataggtcaacatccaaccccgaagcataattgttatctcattatgcggttcaacttttcggaagtaagttctaatgtcaatgaagtagagcgatcatttaaattgcattgctgtagtaagcttagggattttgtgttcaaatatgaagatcttttgggaaaagaaatttgggatgttctcgatgaagagatacagcaagatccgggtgcttttttatcagctatcaattcttatgcttcccgtaaaggaaatctccctatttatctccttattgatgaatatgataattttacgaatacgattctttcgacctatggtacagagtattatcaaaaggcgactcatggtgaaggctttgttcgtggattctttaatgtgataaaggctgctaccaccggtacggggtccgctcttcagcgtatgtttatcacaggagtgagtcctgtcacgatggatgacgtcaccagtggttttaatatcggaaccaatattacgactgatccttggtttaatgatttagtaggtttcagtgaagcggaactgcgtgaaatgcttacttattataaagaacagggagtgctcatgcaaacggtagatgagacaattgtcatgatgaaacccaactatgacaattactgctttagtgaggaaaaattggcccaatgtatgttcaactcggatatggcgctttattttatgaaatcttttgttcttcatcatgtaaagcctaaagaaatagttgaccccaacattcgtactgactttaataaattagcttacttgattcgacttgaccacggattgggggagaacttctctgttattaaagaaatagccgagcagggagaaataactacggacattgctacacacttttccgcattggaaatgacggatgtacgcaatttcaagtctttgttattctatttcggacttctttctattaaaggagtcgatatggtgggaagacccattctgcatgtcccgaatctggtggtcagagaacagctttttagctttttgatccgaggatatatcaaacatgatattttcaagattgatatgaaccggatgacgatgttatttgagaacatggctttcagaggagactggaaaccgttgtttaattttatagcagaggctatccgtgagcaaagccgtattcgcgaatatatagagggcgaagcacatattaaaggctttttgttggcttatttaggtatgtaccgttattatcaactgtatccggaatacgaactgaataaaggttttgccgacttccttttcaaacctagtccgtcggttcctgtaatgccgccattaacttatctgctcgaagtgaagtatgcaaaggctggcacttcggagaaagaaataagggcacttgccgatgaggcgcgggagcagttacttcgttacagtcaggatgaattggtagcggaggctaaagcgaaaggcggactaaaactaattacgatagtgtggtgtagttgggaacttgtgctactggaagaagtactttagattcctactgcctttatccccttcaagtagttccagcattagtttcaagcgaatgaaactttcagtgagagcaaacgtttgctctcactctgctaccacagttgctcccattgctgtaaccctcatgaataaagggatatagataaactgttagagcatgagagcaaaactgctatcaaatcactgtggaggctatataatgtatctgcccgaatcatttatactgtacacgaagaaacagtaacaattgaggtgattgccgtgcggagctaagagccttacaggtaaaaataggaatggctaagttagttatttatagatttgtacaggaagttcccctcttaatgcccctaaagcattaaatgctaatgactccatttccccttcaccgggatagacatgtataggggctaagaaagagattcttttcttcagtcttgaaatgatatagtccgagtaagcaatacctcctgtcagcagaatggcatctactttcccgtagagtacggtggcggctccgccaatggctttcgcaacattatatatcatggcatccagtatcagttcagcttttttgtcaccttcttctatggctttgataatggcgggaacatcggtagtgcccagatgggccgtcagtccggcacgtccggagatacgcttctttaattcatctttcgtgaactgtccgctataacaaatatcgatcaactgaccggcaggaagggtgccagccctttccggcgagaaaggcccttcgccgtctaaagcattattggcgtcaatggctttgccatgctgatgaacggctatagagataccgccacctaagtgacagattatcaagtccagttcttcatatttcgttccctgctcttttgcgaagcggcgggcgattgctttctgattcaaggcgtgccagatggtgatcttaggcatcagcggagaacccgaaatacgcgctacatcttccagttcatccaccactcccgggtctgcgatgaaagccgggcaatcaggaagggaagcggccagttcggctgcaatcagtccacctaagttgcaggcatgggtacgcatggcgtgcaaagtatcttgcttcatggcttcgttgactgcgtagactcctcccggaatgggtttgacgaggccgccgcgtccgatgacagcatcgaatgcaaagggtattccatttgcctctaattcctgaagaaccagattcttacgaaattcaaactggtctatcacctgcggataaacggataattcttcgaccgtatgcttgatgttacggacgagcaacggagtttcgttctcgtagactgctatcttcgtagaagtggagccggggttgatgaccagaatcttcatatctttggagttataaggtttgaattatgattaacggttcaggttgagcttctctctgcattcgcagccggccacttgcaggcaggccattgcgatgctgtaatatttcgataagccggaatcactgcgggaagggagcactaccggacagataggcccttgcaacaatcccgccatatccgcattggcaaacagggagacggacttgtagaacgcatttcccgattctatattggggaaaatcagcacatccgcctgtccgttgataggcgaaacaattcctttgatgtccccgctcgcctgctcacaggcagtgcgtacatccagcggaccgtcgatgattacatttccgaactctcccgcttcggcaagttccacgatgtttacataatccagcgaatgcgggaatttggcgctcactttttcggtgcagtgtatcagtgcgacgcgaggctgctcgataccgaaatggcggcaagtgcagatggcataccagatcatttcaatccgttgttgcagcgtggggcgtggaatcactgcggcatcggagaagaacagcagtttatggtaagtcggaatctccatcaccgccaagtgcgtgaggattttccctttgggtagcagtcctttctctttgtcgaggatggcgtgcagcagattgtccgtgttgatgatacctttcattaaaatatccgctcccccttcacgcacgatgcggacagcttcgcgtgccgcttcgtccgaatcttcgatgtgaatggtcttcacatagtcgggatattgcttcaaggcaggatatttttccagaatagccgaatccccgatcatgagaaactctgcaattccttcttccaaagcacgggtaatggcatattccgtattagggtcgttggcgcagactacggcaattcgtttcctacgattctgttgtttaagatgggctgttagctgggcaaagttctgaataggttccataacgttagatttttagcaaatatcagaaaaatcattgagaaaataatactcataacccgaaaaattgcgcctgttatgtaacattttgttatattttagttgttttagtgtgtagatatacaccgaaccgttttttcctgtatttttgcaaatgaatcccccttaaactttaaaacaaaatgaaacagttcagaaatctattatttattagcacattactcctttgttgggtactcgtttcctgcaaaacgacaagagtttcttcctccggctggtcgctggtatgggaagagaattttaatcagaaaaaaggctttgacccgcaggtctggagcaagattccgcgagggaaggccgactggaataattatatgacagactttgattcctgctttgccatgcgcaaaggcaagctggtgttaagaggcattgccaatcagacgctgcccaatgatacggcaccttatctgacaggaggcgtttataccaaaggtaaaaaggcattccttgacggacgcatcgagatatgcgccaagctgaatgccgcaaaaggagcatggccggctatctggctgttgcccgaaaatgccaaatggccgtcgggaggcgaaatagatgtgatggagcgtctgaatgacgactctatcgcttatcagacagttcattctcattatacgtacactttgggcatcaaagagcaccccaagtcacacttcacaggagtcatccatcccgatcgctataacgttttcgctgtagaaatgtatccggacagtctttcgttctatgtcaacgacatacatacgtttacttatccccgcatacagacgcagaaggaaggacaattcccgttcgaccagccgttttatctgctgatcgatatgcagttgggcggttcgtgggtcggagtagtcgatcccaaagaccttccggtagaaatggaagtggactgggtgcgtttttatcagcgaaagtcactcaaataaaacattaaatatgaatattcaacttccttcttttttacagaaaggtgacaaagtagtgattgtgtcaccttccagcaagatagacaaagagtttctgaaacgtgcgaagaaacggcttgaatcatggggattgaaagtctctgtggggaaatatgccggtggctcttccggacgttatgccggaacggtccggcaacgtctgcaagacttgcagagtgcgatggatgatcctaaagtgaaagctattctttgtagcagaggaggatacggggccgtgcatctggtggacaagattgacttcaccgcctttcgtgaacatccgaagtggttgctgggattcagcgacatcactgccttgcataatttatttcagaagaatggatatgcctccctgcattcgctgatggcgcgtcatctgagcgtggagccggaagaagacccttgcgtggcctatctgaaagatattctcttcggtaatctgcccgtttatacttgcgaaaagcataaactgaacaggcaaggtacggccgaaggtatcctgcgtggcggaaatatggcggtagcttacgggctgcgcggcactccttatgatattcctgccgaaggaaccatcctgtttctcgaagatgtcagtgaacgtccccatgcgattgagcgcatgatgtacaatctgaaactgggcggtgtgcttgaaaaactctccggactcattatcggtcaatttaccgagtatgaagaagattgttcgttgggtaaggagttgtatcccgctctggccgacttggtgaaagaatatgactatccggtttgttttaatttcccggtaggtcatgtgacgcataatttaccgcttatcaatggcgcgaaagtggaattgaccgttggaaagaaaaatgtggagttaaagtttatttgttaataatccattctatctgaacgatactgtggtgaaaatgactaattttgaggcttcatatagataaaaggacgatgaaaaagaaatctatgatagtgttgacgagtgcctttgtattattatctgctttttcttgtggaggaggcggcaaggcaactggtacgaatgaacaaagtgaaaaagtggtggtaaatgtacctcagtttgatgcggacagtgcctatttgtatgtaaagaatcaggtagattttggtccccgtgtccccaatacgaaggagcacgtagcttgtggcaattatctggccggaaagctggaggctttcggtgcgaaggtaacgaatcagtatgccgatctgattgcctatgacggcacactgttgaaggcgcggaacatcatcggctcttacaaaccggaaagtaagaagagaatagcgttgtttgcacattgggatacccgtccgtgggcggataatgatgctgacgaaaagaatcaccatacccctattctgggagccaatgacggagcaagcggagtgggagctttgctggaaatcgcccggttggtcaaccagcaacagccggaactgggcattgatatcatctttctggatgcggaagactacggaactcctcaattctacgagggaaagcataaggaagaggcttggtgtctcggctcgcagtattggtcgcgcaatcctcacgtgcaagggtataatgcccgttttggtatcttgctcgatatggtgggtggtgagaacagcgtatttctgaaagaaggatattccgaagagtttgctccggatatcaacaagaaagtatggaaagcggctaaaaaagcaggttatgggaaaaccttcattgatgagagaggcgataccatcaccgacgaccatctgtttattaaccgtctggcccgtatcaagacaatcgatattattcccaatgatccggaaacaggcttccccccgacttggcataccattcatgataatatggaccatatcgacaagaatacgctgaaagccgtcggacagacagtgctggaagtgatttataatgaaaagtaaatagttaactagtaaaccgtaaataacttcatgtcaattaatgaattacaagacgaagtgattgctgaattcagcgacttcgatgactggatggaccgctaccagctgctcattgacttaggtaatgaacaggaaccgctcgacgaaaagtataagaccgaacagaatctgatcgaaggctgtcagagccgtgtatggcttcaggcggacgatgtggatggaaaaatcgtgtttaatgcggaaagtgacgctttgattgtgaaaggaatcattgctttattgatcaaagtcctttcggggcatacgcccgatgaaatactgaatgctgatctttattttatcgataagataggtttgagagatcatttgtctcctacccgtagcaatgggttgctgtcgatggtaaagcagatacgtatgtatgcgctggcatttaaggcaaaagaagggaaataaagataataaatttaggcacggattacgcggattacacggttttaagagatgcatctggcagaaaccgtgtaatccgcgtaatccgtgcctaaaaaaatataagcttttccccttgtttaatcgcaaatttcctcctgatattccagtatatctgccggctggcagtccagtactttgcagatagcctccagcgtagagaaacggattgccttagcttttccggtttttaatatagaaaggttggcgggggtgatatctattttctccgccagctcgcccagagatatttttctgcgcgccatcatgatgtcaaggtttactataattgccataattttattttctcggtttgggttaaatggtcagttcctgttcttctttcattttcagtccgatagcgaatgtttcggctacaatcaggcagccgagtcccaataataaatcagtcgtctgtagcgccaggggagcgatgatataatgttcaagcgcgaatacttctttcagtccccagtagttgacgacctgcggaatcaggtaaaacacgaaggacataatcagtagactacccagccagcgcaggcggcggacattcttccattcgaatatctgcgatttgttgatgctcagaatcagcatgacgaagataataagtgcggagatggtgagcagtgcattcatcagcgaacaggaactgctgataatcaggtaactgtaattcacttcttttccggtgcgtaccgccatttgcgtatacatgacgggcactttctcattgttttgggcattgatgatcgtatccggtttgatcatggcgatcgtaggtacgacatccacaaaacggaaatcgcctgcaagcataggtctgtcacatgctttcgattccttgtgctgttctttggccagactcattccggctttcatgcctgttccgaactggtatcctgtggtatacagagaaagtcccagaacaatgaataccaatatgctgagaatattcaaacgtcttttcatcgctgttattttttagtccgtgatatttgtttcttctttccagggataatggacggtcgtacgacgcatcgcccagataactcctgccagtatcaaaactgctacaaaaatagcaattagataggaggtagtgtccatcagatcgctcatattttcagcttccggatatttcgtgctgagaaatacggataacgaattattcagtatatgcatcagtgtgcaggggatgaggctggcagtcttgtaatacgtccatgcaaacaggataccgatcaggaatgccggaagtatctgggcaggattaatatggaaaacaccgaaaaaaagggctgaaagcagaatcgcctttgtcgggctgtactgctgtagcaatgctttggtgatggctccgcgaaatagcagttcttcgagtacgggacctatgacggctatggcaagaatgcctccccagccggactggaggatatcgaaggattgttccatgatgttgggaatccacttcatcagttctgccaatgcggatacgacgaagccacaggtgaggacagccaatgcgctgaagaacagatacgaggatgaaacgggcgaccaggttattttctttgtgctgatgtatccggctttccataaatagatacccatcatcagctgaccggccagttgtgccggaatcataagcatggtaatgagcgtgtctttgtctaagtttccggtagtggctaccagataaatcacacaggggatcatgactaaaatgggagcaatgatctgtgcgataagcagattcagtaatatcagtttaatagcagttctcatattcgtagtattcttagtattcttggatggatacaaagataatcgtttgttatttactggcaatgaagctgcacagaaacatggctatcattgagatggatactaccagcatcgatatactcattaatgactttttcataaagtgttatttttttatagatgattaaatagaaaatgtttgtttttcgatgattatttatcgtttatcgatatgcaaatgtagaggtaagttttgagttggcaaaggaaaaagagattttatttatcgaaaaacaataaaaaagatatgtttttcgatattaacggactcgttgcagccgaaaagaggcttattaatgtggttaatttagagaaaaaaagggatcatttctcctgtttggcggcgagtagaatggcttcagtttcttccgcatccttgtgaagctgtgcgattagttcgtcgatactatcgtatttcagttcggggcgtgtccgcttcacgaaagtaagccggataaatttgtcgtaaatgtcggagtggaaatgaaggatattcacttcgattgtgcggttgggaccatttccgatggtagggcggacgcctatattcagcattcccatataggtctttccgtcgaatgtgacccatacggcatagactccgtctgcgggaatcagtttgtcgggatcatccacgcttaaattggcagtcggaaaaccgatcttccggcctacctgatagccgcctactaccgttccgtccagaaagtattcgtagcccagacagcgggcagctgcgtctacatctccctgatgcagcaacttgcggattaaagaagaactgaccggagcactttggatggtatctatctgtatatcatctgtgtaagcctgtgcacggatgacctcaatgccgattgcctgcccgtaacgtacataatcgtcaaacccttcgctgcggttgtgaccgaaacggtgatcgtatcctatcaccagatactttacctgaaaacgttctttcagtatttgagtcatgaattctttggcggtcagacgggagatgtcgggtgtaaaatcgagcatcaggcaataatctactcccgtgcctgcgagcaggtttgttttttcttcgggagtagttaaaagttccggatggtaagcggcgttcatcactttgcgcggatgaacggggaatgtgactaatgcagaacgcagacctttggctgccgctatctccttcacctgttgaatcagatagcgatgtcccatgtgtactccgtcgaagaaaccgatggtagctacgcatggttcgggaatcatagccgatgtgtcatttataatctgcatacttacactctcatttttttctgaaaagatggctccagtcttcaccggctttcggtgtgtaggtcgagatacccagttcctgagctactttacagttaatttcggaatcgtcaataaaaaaagtctctttcgggtcaatacccgcatcttcggtcaccgccttgaatatttccggttcgggcttggccattttcatttcataagagagatacgtcttctcaaaatagtcctctactttgaacgtacggtaggggaaggcattcttgcatacccatttccagtggatgtcattggtgttgctgagcagatagactacgtatttctcgcgtagtttgagcagcaagtcgagcttgtaggtcgggatgtctaccagaaagctgttccaggctgcgtcgatctgcttgtcgcttaccatctttcccatcatctcccgaatgccgtcacggaattcggcaggagtgatcagtcctttctcctgctgcaaaaatattccgtccagctggtgggtgcagaacttttcttctatgttctggaacccgatctttttaaagttctcaatacaacgttcgcggtcgagatttatcagtacaccgcctaaatcaataagtaagtttttaattcctttacttttcattattttctcatttgtgaatactacgttgaacaaggcgaataagttctccaacccataacaccgtggacgaaacgcctataatcagaagccacgtctgccagtcgagcggctctgtgcggaatacagctccaccgaactgtacgatcagaaattgtccgaccagaatggccagaacgatcaactccatgccatacgatttggaaagtcccttgaatgccgagtcggtagtgccgaatacacgggcattgaacaggttccagaattgcagcatgacaaagaaagtgaagaaaatggtgaggttatgtacatccataccttgtgcgctgtggtcgaaataataaatcattccgagcaatacggcgaggaagatcgtacctacacctaatatattgttacgcatcgctttgctgatgataaagtcagtgctgcggcgcggcttttcctgcatgacggtttcgctgggagggatggaagcgagggccaaagcggcaaaagtatccatgatcaggttcacccacagcatttgtgtcactgtcagcggaagttccgttccgatcatcgatcccaataacacgatcagcaaggctacaaagttgattgtcagctggaatacgatgaaacgctggatattcttataaagagaacgtccccacatgacagcggtgccgatgctgttgaacgagtcgtcgagcagcgtgatgtcactggcttctttggctacggacgtacctgtacccattgacaaaccaacttgggcatgattcagggcgggtgcatcgttcgtaccgtctccggttacggcgactacggctcctttttgttgaagcaactgcacaagacgttgtttgtccgtcgggcgggcgcgagacatgattttgaggtccatcacacggtccagcgcctcttcatcactcagttcggcaaaggcaacaccggtgatacgattccggtcggtatctgtttccggttgccacagtccgatctgacgggcaatttccgtcgcagttcccggtgtgtcaccggtaacgatcttgataccgataccagccgactggcatttggccacggcggcgggtacatccggacgaatcgggtctgagatggctacgactcctaagaaattaaggtcgttggcagacaccagttccgtacagtcattcggttcgttttctcctactattttgaaggcaaagccgagtgtgcgcattgccatattctgataattcagtaactgagcttctactgtcgaacgatattcgacggcatctacccgtcggccgtccagcacgacttccttacatttgccaagcacgatttcgggtgctccttttatataaagtactttctttccgatgatcggagactcgacgagagtcgccataaatttacgttcggtcgagaaggtgagctggtcgaggatgcgggcgtgttcacggagttcgagataatttcttccctgactgttgagccataataacagggcgacttccgtagggttaccgacacctttcggtttttcgcccgttgccgcttcttcgaggaaagcggttgagttggcgctgatcccttctgcgacgagagcgctgatatcatcatcgcccaggttgccgccattcttgattccgtagaagttgggttcgtgtacctgcatcaggttttgagtcagtgtacccgttttgtccgtacagatcacggtgatagctcccatcgtttcgcaggcgtgcatctttcgtaccagattgttggtcgagagcatacggcgcatattcaaggccaggctgagcgttacgctcatgggcaacccttcggggacggctactacaatcaaagtaacagccatcatgaaatatttgagggtccgttcgaaaaccggaagccactcgtgccagccgttcagcgaaccgaaatcaaagaacaacagtacatcttttacaaagaagataaggaaggcaagtccggcaacggtaaaaccgattttaccgatcaggtttgcgagcttggtcaactgtatattcagaggggtcggttccagattttcttcggtgctttggcgtgctaccttgccgatttctgtggcatctcccacgtgcagtacgcgcatggtgccgtgtccgtccaccactgtcgttccgcgcatcactaagttggaggcataggttgcttcttcgtcaaagtccgcttcgattacagtcttgttgattaccggttctccggtcaggttggattcgttcacttgcagggagatcgcttccagcagttggccgtcggcaggaatctcttcgcctgtttccagtatgataatatcgtctacaacgacgtctttacgtgggatttcctgtacgtgtccgttgcgaatcacttttacgagtgtttcttcattgacggcattcagtaagtcgaattttttattggcatcatattcgaaaaagaagccgatgcctgtggccaacaagatggctgctatgattccgatagtttcggcatattcattttcgatgatggaaatgatcagtgaaaatacggcggctaccaacaatacccgcacaaccggatcttcaaacttttcgagatagagcttccataaggaaggacgcttggggggtgttaacagattgacaccgttcttttctctgctttgtaggacttcgtcatccgtaaggcctacatgataataatcgtctttttttgtagtactcatgcaaatacatgcgtttgattaggaccgcaaaaatacaacataaaattgtgataaaatgtttaattaaaactttttatgaagttactttattcgggacgtccgcaagtacgatagggaatggtaaaccagaacgttgatcccttgccttctacggagtctgcgccgatttgcccctccaatttgtttacgatggttttagagatggaaagtcccagccccgttcctttcttgtctttgttcagtttcacaaagcggccgaaaacttccggtagtttgtcggcagggattccggctccggtgtcggtgacataaaaataaagttcggtatctcttgcctcataaccgatgctgatcgttccctcctgcgtgaatttaatggcgttggtggtaaaattggagagcacctgcgcgacacggttccggtcggtctctatgctacaggagggaaggcttggttctgctattatttgaatatttcctcctgcatcgttgactttcatttggaaaagctgtcgcaggtcggatagtaacaggttgatatctacctttgtatatacaaattccagtgtgccggcttctattttcgacatatccagaatatcgtttaccagttgcagcagcagatcggcattcatttttatgatttcctgatattgtgccttttcttcttccgtattggcgctggcaagtatttctgcaaatcccgtgatggcgttgagaggcgtgcggatttcgtgactcatattggcgaggaaggtagacttcgaaaggtcggcattttctgctttctccttggcaagtgccagttgcttttctgcttgtttgagttgggtgatatcgtgcacggtgagtaccatattctcttcttcgttaaggagaaaataggaaccggatattacggcgtcacattctacggatttcttttcggaagtaagcacattcagagttgcattaaggtctgtgaagcctcttctttgttcgaaagcctgacggatggcgcaacgtatgggacaggaaccgcagtaagcatgagtaccgcaacctccttctgccgataatgcgttgcggcattgcaataagtcgcccactctcttttcttccagacctttctgagttccggtgagttgatagtagtttgtttttaatactttgaagtcattatctattaataagatataggcatggacatttttcagaatggcgctggcgatgtggttggtatgttccagttttctggactcccggaatagtcgcttttgcatccgaagacattttctccgttccaataagtaactgaggaggagaactgcgcataaaattagcagaatagaaagcaatgctattagcatgatgtaacttgttggttttgttctacaaatatgttgcaaagataacttttttacttgggataagaaagaagtttgaacaatttgcattttatttgcgttatattatttagtaaaccaataaaaaaacgaacgttatgaaaaagtacatttgcacagtctgtgaatacatttacgaccccgcacaaggagatcccgagagcggaattgaaccgggaacagcatttgaagacattccggatgattggacttgtccactttgcggagtcggaaaagaggactttgaaccgtacgaaggataaaaaaattaagagagagaagagattattaaaaaaatgaccggaaagcagtgcttccggtcatttttgcgtttcagctcatgcagagctttttttgttcctgttgttatactgtcgggtcaggtgcttcctcatcgccgccgtcaccaccgccgtcggggttgggaggagtaggagtgtttccgttgtcaacgatctcgctgccggttaccagtttttgaatacttgcctttttcagcatatccttaaacttgtatctcggagtaaatacgattttcacccgacgaatcgtgtcggaatccactgccgcttctgtctcctggctttcgctgctgatgccgggacggaattgaccgaaatcacccagttgtacggaaatacctttgtttaagtttatattcagcgtatcgatcagtgcatcgagtacaaacttgaccgctccgctgggaaccattcccacttttgaaatctcatcacacaaatccttgaaattaaccgtattggtaataaaattctgtgctacatacttttcggttttctctttaccgaaaccaatcattctttttttaacgacatacctaagtgccataatcttttttgttttttaatagttagtaaatctgtttcttttgttttgtgatcacgatgcaaatgtatgtgtttccaaatgaactgccaagcaaaaaactcaaagtgcgttaataagtttcttcaactaaagaaatggtcagatgtttttttgtttttctcctttcatctttttccgattgaagattgtccttttcatatcatatccatacctttgtagattcaagaacccaacgtggctccggtgactcaggagccgggatgtccggagaacgaccggctaggcgatggaaagggaatgaagaatatgaataaagaattaacggatgtagtataaatgatgatttcctgtttattaagaatacacagtttacgttttttcgacggaggcttgcatgaggttcctgtggaagaagtgatgacggttgcgcttattgcgatattcatctttgttccgtgcctgtggcttgtccggtatttaaaagataagaggctggactcggacgagaaagacaagtttatacaaatacatattatctcgaccattgtcctgactattgcgggcggtgtttttgcacggatgtccggacttgtcaataaatggatagacgaacagccgttgattatcgctgtttacatcgctttggcgcttagttccttcggcatcattgtcggaaaaatgatcgacttttgggtgtattgtctccgaaagaagatgttttaagtatctgtatatagatgcctgttgcctctgcccgaagaaggttggaaacaggctttgtccggtatttattgctaaagtatggttttgagggtcgtttcgataccatcacagggcgacaattgtccctatgatggtaagtgccaagtatgtacagttaatatagaatgttgccatcaatattcggggaatatattctgactttctgaacagggatgaaggttcgttgattaataaggagagaaggaggagtatgctaaaaatgacctgacacatcagtagccatacgggatattccgtaatggaaggtacagcccatgtttggagcagaggagtcatgttttgcagaaggagatgggctgcaaaatagctcaaaaaggaaacagcttcttttttctgccgtaagagtgcatttatggtgtaaatccccattcctgcttgccccagcaatatagaaatctggaaaaaatagaatatccaatatattgcattgggggtaataccgtcggtggaaaagtaatcatagaaacagagtgaggacacgcagcttatagcaatcagtcctgcgcagataaatgaaatgattcttttattcattgtttttattttaaagctaatgggttgtagatagctgaccgttagggctgcttatctacttgttagtaactttgttttgttgtgagttattgagacgttgaactaacatttctctgaactcaacactattacattcatttataagttctttgtatttaataaattctgtttccggatacacagactctatcaaatgtaacaatgtccattctatcccatataaagcagtaggtggaaagagcttgattaaaatatgcgcttcatccaaagtgataggcttagttatcttacctaataagtctgcatatttatcaatcaatacatctgttggttcgtctgtttcatcgggcattgcacccattaaagctaattgttcaacttcttttctcataattctattgttactaacattatactaacagcggtcatttaatattccgctgttattttctctaagtgtactgtttaaaagccttcctatcc

SEQ ID NO: 147 - DNA, 18881 bp, Bacteroides thetaiotaomicron
gcatggagtgcatacaagagccagtccattccaggatatattacctttaagaatggactggatagattttatacacagtttgaactgtatgagttaatcagctaagacttgtgtataaagggtagctgtatggcgcggagcaacatctgttgggtttccaacgcgaggtttcctacctcgtccagaaacagcgtgccgccttccgcctcatggaaatatcctttcttggcacaatctgctcctgtaaacgctcccttgacgtgtccgaagaaggccgagggcgcaagctctttggtgagtgaaccgcagtccaccgccacgaatggcttgactgcccgcttgctcttgtcgtgcaggtggtgggcaatatgttccttacccgtgccgttctctccgaatatcatcacgctcatatcggtagcggctaccagccttatacggtgcatgattttctgaaatgcggaaccgtcacgggcgaacacaggcatacggcgttgtcctgcctgacgttctttcagtatggaacggatcagggggacaagtttatcctccacaagctgtttgggaatatagtctatcgagccgagtttcatgctttccacggcggtattaacttcggcgtagtcggtcataatgatgaagggctgcatctttccctcctttcgcatccagcgcaaaaggtcaatgccgttaccgtcaggcaggcgcaggtcggcaaccacgatgtcattatctgtcgcctgttgtagatgtttcttcgcggttgagaggtggtaagccttcacggtgcggtagccctcccgcgccagcatgttgcagacaaactcgcagtacacgatattgtcttctaccacaattattgttgtcttatccatcttcgtattttctcctttcctcttctgccaaccggattatttccgctcccttatccagcacggcagtcacggcatggcttaacgcttcaccatccgggagtacatcgccatgaagcaatctgtaaagtacatttagcggttggtcggcacgtagcacctcccacgagctgcgcaggtggtgtgtcagggaatccagcttttgcaggtctttttctgttgccgcttcccgtattgtctgcatctctttttcagtttccgtcatcaacttttccagcataacggcttcattgccgtaagacagcaaagctgaaaaatccggtttcccgtccggtgtttcttttatggcacacctgtcggaaacctccatcaactccgatatggagaacggcttgaacaggcatccggcaaagccttttgccaatagttcccctttgttacaactgcccgaagcggttgccacaaccaccgggattgttggtgaattgcccacgttggacgaacgcaacagttccagtaattcgaaaccgtttataccgggcatattcaagtctgtcagcaacaggctgtattctttctggcgtatcatttccatcagttccgcagcatcggtgcaagtgtcgcagtgtattccttcttgggagtacatctctttcagcatcagaagtaatacctcatcattgtcaatggcgacaacatcatggaatttattgttatgataaacaggtgtattgcttgtatatccaagctgttcttcagcttcctgcatagaaatttcaactgtgaaacgactgcctttccctttcttgctgtccaaacggattgttccgccaagcatcgacacaatattacgcattatggcaagcccaagcccgaaaccctcctttgcggcggcatttgatagacgttcaaacgcaccgaacgcttgtttctgttcctcttctgtcatgcctgtacctgtatcttcaacgaccagtgtcagaactccattatcatattcagtaatcaaagaaacaccgccttcttctgtgaacttgactgcgtttgacagcaggttattcccgatttgtattattcgctctttgtcggtcaatacaatggcatcgtgtccagtcttcacggacaaggacaaccctttgttcactgcaacaggaatgaactccgtttcaagtgtgtgcgtgattgcagaaatccggcagggtgacagacggggctgttccttgccgttgtccaggcggaagaagtcaagcaaagtgttgagcatatcccgcatacggtcggaggattgcagtatatttcggatatattgcccattattaccgctattgcattctttccgcaaaagttcggtatagccagttattgccgtcagtggtgtacgcaactcatgggtaatagtatgtaccgctttctttcgggaggttatgagtacctcattttgttgcacggactgttccaattgctcgatcaaatccgttgtcttgcgtttgtatcgtttaatgttctttgcatcacggtgtatgatgatataggaaatgaccaacagcaaaagaacaaatcccatcaagccgcctatctgcataaatgattttttacgcatcgctgttatctcgctttctctattttgtaaatcagattgtaccttcttttcgatttggcaaatcaatccttgcagttgtctgttaagttctgcattacgggcagcaagactatcggcttgttctgacaatcgacggctctgcgctttctgttcgttgaccatgtttctattggatgaacggagcgtagtcgttgttgtcgttggcttcgttccctcttttttgccaaagatgcccaagaaaccttttcgttttggctttttggactgttcctgcacacttttctgcacaataaccggaatttgattggctatcttcttgttaatagattgttgttcatccattaaccggactatctggaacatctgtcgttccttatcctctaaaagactgcgcacactatcgatgcgctctgctggataggtggccttgaaacggcagagcatactgtccattgccatacgccgtgcatggtaatgctcgatatctttatcgttccattccagtattgtttcacccaatagagaaaattttatcatttgaatattgatattgtttatttcttttcggagctcgtctatttttttattgccaagttctaatgcttctatctcctgccattcatagaggctattatatgccatacatccgataagaatggagataagtatatatcccaactgtattgccttatagaaatttcctgaccgctccattattttgatgacattgatttttggaacatgaataaaagtttatctttttcgttcatgcggatattatcagaataatcgccttttgttatttgatacccgcatggcttgaccataaaaacgcctaagcccttagtgtatgaacttacttctgaggcgtagtctttacttgtatttaatggaactttccctttaatatgacaccactcattattgcaactgatgtcttcaatctcagacatcattttttgcaaatctgtaatagctttggaacttgccgcttggggtatctgcaactcaaaatagagcatcggttcgagaatgtccacacctgactgttgcaaggccagcctgaagacataaggggtcagctgtctgaaatcagcaggtgtacttaccgggctataatactcggcttgagtaaaagttactttcagatcagtcacttcccatccatgtaaaccagattggcaagacatacgaatcccttcaaaaacggcattttgaaaagaatggttcagataaccataggagatgtcactttcgatttgcaaccctgtccctaacggcaagggttcaagcgtcagccctattgtggcccagtaagggttgggtggcacttcgatctgaataatcttattgaccttttttacaggtcgttctttgtagatagtcttgatctcatcaaaatggacctttacggaaaatcgttcttccagcaatgtctgtatgatttccttttgtgtcaaaccatataacgagatttccaattcatcactatatgagtttatggaaaaggacaaagacgggtcttcaatccacaatgtattcagagcggatatcaccttgcttctctcttcggacctgtctggccggacggaggatttgagagcgggatgctgatgagataacccttgaatcaaacaaggtttagtacctaaataatctccgattcgaaaatcttccatatcttctacaatcgcgatatcattggcccccacttcatcaacatttatctctctgccctgataaatagtctttagatttttaatcttgatgaatttttccgaatcgttgattcttacaatgtctcgaagtctcagacttccgtcaattatttttagaaaacttcttttatgtcctttggggtcatgctctatcttatagagataagctgaaagtctgtttgagactgattctggaggaagtataaaagaagagatggcgtccaacaactcattgataccgatattgaacattgctgatccatgtagtaccggatagactttggcttttgccacaagatcgattatcgtattccaataatcagccggtgaaatttcgctatccgccaaatatcgttctaatatattgtcgtcatggttgcatacaaattctttgtattcttcctttatatatgtttgggagcaaatcggataaaccaatccatcgacaacagtttgcataaacaggacatcttgagacagatttgtttttatatccagatacaaacgctctaaattcacaccgtcacggtcaattttattgataaatataattgtcgggatttgcagtttttgtaaagtattgaacagcaactttgtttgcgcttgtatgccttcctttgcggataagatgaggactgctccatcaagcattttgaatgtccgctccacttccgcaataaaatccatgtgtcccggagtgtcaatgatattgcatttcactccattccagataatagatgtcgtagaagcccgaacagtaattcctctacgtttctctatatccatagagtctgttatggtgtcaccattatccacacggccgcacttttccgttgctccactggcaaacagcagattctcggttacggaagtttttcctgcatcaatgtgagcaagaattcctaaatttataatattcatttggattaagcaataatatactacaatagatgcattgtcgaaacgcaccttttaatacctcctcgtagcatgtgagaactacaggattactaactcgtattaatatgtatattattactgccgcataacgattacaaaattacacaaaaaaatatatctaacaaaagtgggaggattttttaactttttaccatagacattttattagggaagcgtaggttcaactggtaagtacaaataagtagaaatgtttgaacaacaacgttttaggaagttgaaaaaaatcaagtttctctctcggtataacgtttattttggccaatatcttctttagtttggcatttgagtatttcccattcgtgttctatttagctccttattatgagtatgtagcaagttgcttatcaaattcagcctctttgagggtcaaatatggttttgcaaatggtgactgacaagacataaacaaggtcagcaggattttttacataaatggacatgaatgtatataacctaaaataagaataaattttaataagggctgcccaaaaagaaaaaaaatgcagttgccatcctacagatacttgcagaaaggataaaatttacttttagaccttttgggatagcccttattaatacttcagataaaattcctaaggttatattttcaatcctttggaccgggtttcctccttggcatacagccccggatgcccagttatggtgtgattggcgataatactttccgatggattgcgtatttgcggtgatgtatcttcgggatattgcctgataccgtttcgcacacctttcgcttccggtttgacctgttgcccttcatgctccttttcggtgatttcgggtgtaggcggcgcaagttccagctgtatcttgcggtcaagggcggcaagttcggacttcaactgtttcagttcttcctccttcttccacaccttgcctgctatctcctgcaactgcggtatctcacgttccaagacctcattcttcgctttatactggtcgatgatggaggggattctctcaatcgcgttgaggaagttgcgggcggcggccaacgggtcagccagcgccagatgcccgttgttgtaggtgtacttgtagttcccctcgaccacgaagcggttgtcggtaaactccaatccctctttgagtatcctttcgctgaccacctttatcgggaaaccgtaaaactctccaacctgcgtgtacaaccctccggtcgtggcattcttggctatctcctgcaaacgctttccgatgactttctcatcggcggaatccactccgtccacctttattatattaaggtgattgccctccttgtcggtctgcaccacagagaggaagcggttccagtcctccgtcatggcatctatgaaagctgtgttgttgcccagctcgcgggtcttcgattccagcttgaactccgaatcacgcttgcccttgttgaacgacttgcgttccccttcgagcgaggcgatacgtttttccagtttcgccttgtccagcaggtcggtgttgccggatagcaacgccatatattccgagaagttcatgcccgatttctcgtccattgccccctcgtcgatggtacgcgcttccatagcaccgcttttaagctggctgatgaaagtctgcttgcagtgcaggaggttgaacttgtaactgtccagtgatttttccaccgcgtagattattacgtccacgttgttcccggcgaaatgcttggctatctcgttgcctgctctaactccccgtccgtcacgctgttgcaggtcggacggtcgccacggcgtatcaagatgatgaattgccacacaccgtttctgtgcgttcacacccgttccgagcatggaggtggagccgaacagcacacgcaccgtcccggcgttcatggcatctatcaccgccttccgagccttgtcggtcttgcactcctgaatgaagcgcacctcgcttggcggtatgccgtagtcctccgtcagtttgcgcttgatttccgaatagacgttccacccatcgcccggctggtaagtccccaagtcagagaaaacgaactgcgtgcctttctgcgcgtcgtatttttgataatactccgcgattattttggcacagtggctcgccttgttgtcggggtggtcttcgtaatgcgggtctatcatgcgcatgtcgagtgccatcttccgggcatagtccgtggcgataagcatcttcgccttttcctccgtttccgaaagcggcagtctgcccaacagggtggcgtcgcccgtcttggcgaattgcatcagcttctgtatgaagtcctcctgctccggcgtgggcggtatgtggtgcagtatctcgtttttgttgggacggtccacgcccacatcctccgccgtgcggtagtccgtgatttcattatagaaggcggcaagctccggcactttgatgaagtagcggaaacgctccttctgcaccacgttgttcgtcacgttgaactcaaaatccgttgtcttcttggcaaatatcgccgaccacgcatcaaaacatcgaatgtcctgccgttccagctccttcgggcgcaggtacttgaacagcaggtacagctcagtcagcgagttgctgatagtcgtgccggagaggaaggtcgcccccaagtccttgcccgtgcgctcctgtatggtgcggatagcaaagagcatgttcagtgccttctggcttccctcgctgttccccaatcccgccacacggtcgtggcgcgtgttgaaagtcagattcttgaactggtgcgattcatcaatgaaaatgtggtcgatgcccatctgcttgaagtccaccacgtcgtccgtgcgtgactttatggcgtgttccaccttctccaatttcgcttcaaggttatgcttgcgcttctccagacctttcagcatcgcccgcgatacgttctttccctgctggcgcagcacttcgaggttttcctccaccgtgtcaagctccgcttgcaggatgcgctgctgcaactccggcgactgcggtatcttgccgaactggtcgtgcgacataatgacacaatcgtagtcgttgttcttgatgttgttgaagaaacgcacgcggttggcggtcgaaaagtctttctccgaagcgtacagaatcctcgcgttgggatatgccgcttgataggtggcggcaatctccgcaacattggctttcagcccgataatcatcggcttgtgcgccaagttcagacgcttcatttcatgcgcggcgatgcacattatcagcgtcttgccggttccaacctcgtggtcacaaattccgccgccgttctgtttcagcatccagacgcaatccatctgcgagggatagacgctcctgatgccccggcttgccagccctttcagattgaggtcgggaaaagtctgatgcgagccgtcatacttcgggcgcacgaaacagttgaacttgcggttatacatcgtcgtcagccgctccttgaactgtggcgactgctcttcgagccattcggagaagccgtttcgtatctcgtcaatcttggcgttggcgagctgtattccctcgctgtcgcgcaccttgatgtcgttgccatgctcgtccctgccgatggacttcatcatgtcgggacaggtgttgtgcagggcgtgtttcagaaggtgcatgccgtcatagttacggtaataccccttcaccagaaactcgtccgtgattttcatggtgcggtagccgcacgccaccgaaaactcgtccatgcttgcagagtaggcgattttcacctccgtgtcgaacagccggctcatgtaggcggcatagacacccgtcggaatccagcgttccccgaaattgaaatcaaggtcttcaaaagcgatgcgcggcggttcggcatctttcagagcctccaacgcctgcttcacctccggcatacgttcactttcggggttttcgcccatccaagcctctatgcgttccgctttctctatcacgtttccggcaataaagcggtccttaatctcgtaaccggttacgagcggattgtaatagatgcgcccttgcagggctgtgagcaaatcctccgccgtactgtcggttatctcccgcatatagtcgagatcgacagtgccgaacttgttgagcgacgcggacagtgcttcttcgggtgagccgacgttggcatggctctccacggagaaggaaacgggacgctcgaagatgtccgccttgacaaacttcccgttctccgcccgttccagcgaaaggatgtcacgcccgcccgcgtccatcatcactaacttcacgttctgcttggcgttgaggttgccgtagcgcatgacaaactcatcgtaacaggtgtttagatgctctcgccacgggacatttgcttcatgcaggttcgattcatagcggtacagccgctcgtaggcgtcacggagtaaaacatactgtaacgccttctccttctggtagcctttcaggtcgagcggctggaatgtcgccccgtatggcgtgatgtccttcaggtagccgatgttatgacgccccctgtcagccaccagcgacccttcgcgcaggtgcatctccggcgtgcggtggtaggcacgcggcgaaaggtccacgacttcttccttcggcttctccgcttcgatgtcggggaaaagggaggtcgccaccgcttccggtggggtatctgtaacggcaggtgcggtgactgcttccggctgtgtttcctcctgccgtggttgctcacggggagtgtccggcacggctttcacttccatcttttccgccgccgcttgtttctcgttatgctgccttgccagttcccgaagttccttcctgcgttccggcgtcaaatccatcatcatctcgtagaagccgttgatgggaggattggtatcccagtccaacgtggcatagatgtcgtccgggtcggcaggcttggcggtgttctccgttttagcctccttgttctctgttacagtcttaggggtggtagccgtcggcacagccgtaacattttgtgtgacatgcacctgtggcttgggtagaacgcgccttgccgagctttcctttttcgcctcctttttctttttggcggttttcggttgttggctgacttcttccgtcatcccccagagatcgagcaaggatagctgcacaccgtcagaatatttcggacgtggctctatctccggcttttcctctgtgggttgcggtttctccgtcggagtttccaccgcctgcatcgaagatgttgtttccatctttatggcagtacgctccacctccttttgaacggtaactttttcttccgttcccgactgccggattgaacccgaatacagacgcatggcgagcctgtaatggaaatcctcgtcgagcatacggtgcaaatccccggcgatgcctgctgccttgccctcgtgcagatagaccatagcgggcttcccgtatgggtcggtgtcaagtttcgccgtcgtatgcacgatgcgttccgggtggtggatgaaataggcgttgtcggtcaggtcggttttcgtgtccgtctgtattacggtcatcagccgctcgtcctgcgacatttccttcttgctgaggttcttttgcaggacaatcaggtcactgcccacttctgtccccgcgttgtccgtgaacaggttgttgggcaggcgtatcgcggataccagatcagccttactgaacagctcgttacgcacggaggtcttggtgctgttcaataccccttgcgaggtgatgaacgccacgataccgccgtcacgcacggcatccagtcctttgagaaagaaatagttgtggatggctttctgggcggagcgtctgccgaatgagtcgctccgctgaaactcagggtcgaacacggctatgtctccgaacggaatgttggacaccgccaagtcgaaataattgttgaacggtctttcgattttctcaaaaccgcaggtgcgcgttttcttgccgggatagagatgcctcaggattgtacccgtgagcagatccttctcgaaagccatcacatccgcattggggttgtgccgcagcatggaatccacgaacacgccaacccccgccgacggttcgagcatacgggcggggcggacgctgtaatctgccagcacgtccgcgatggtgtcggttatctctttgggggtgtagaaagcggtcagcacggacgctttcagcgaatccacaaaccgcttgtactctgtttcgtccttgctgttctcacggataagcctgtgcaactccactgtcggggcgaacagttcgaggtcggatttcgcccaccggacggcatccgtcagttcctttgcagggttgaggatacatttcagaccgccgaaaccgcagtacctttgaagtatggcacgctcttcggttgtcgctgtcctgttttccctgtcaaggatgaatgccgtccgtatcgcctcgatgttgtcccgcagtttctgtttgcggttaaacgccatattccccgatgtaaaggacggttgcccccgtcagctccgtgtagagcaggtcgtaatcggaagacagggcgaagttgtcgtccgaaaggtcatagacggagaacacgttgccgacaagcggcatgagtttcagaataaaggcttcttgtttctcttccggcacttcgtcgaaaaactcgctctccacgacttcacggagaatggcgtaccgggaatagcgcagcccgcgcagcagcgtgtccatcgcctgctcttgcgcgccatcggcgggatagccttcgagccgcgccttttcatacgtttcggcggcacggtcggcccgttcccgtatgaaagcggtgtcagtcgcctgttcaaacttgttcgtgcggaggtagtccagcaggtacagaccgtaataggaaaagtcggtctgaccctcgtttttcttcttgttgttcattactttggagtttagtggattgatatttaacgggataattgattggaaaaaggaagaaaaaggcactcggtatccctccgagtgccaccactaaatccaaagtatgagtgtaatccggtatcgaagaacaattcattactctgaacaagtggcaaagttagtgcaaatcgaagacaatacgaaaaaaacttgtttgtttctattgttgagatgcagcctaacttatcaaaagttagtgattatttcctttttttcggataggaagacttgcatttcttttccgggaacacgaacgtcgtgttatattccccgtcaaaggcgactatggcatcgaagttcttgccctgcttgctcttgaagcctttgagcggcttggtgtgcccgtcggtgagcaggtctttgatttcgtcgtcggacagggtgcgtcccgctttctgccggaacacgggcagtccgcactccgtgttgtcgcaacgtaccaccttgccgtagaaccgcatcctgcccgtgccgcacttgggacacgcgcagccggaatcacggctgccgaagagcttgtcgcacgagagcagttcggaggtgatttcccgtgtgtacgcctctatctccttgcggaaagtgtcggcgggcagttccccgcgctcgatacgtgccagttccttttcccattcgcccgtcatggctacatcggcgatgcgcatcgtcttcaccacggaattgagggcgagtcccttttcggtgggaacaagcgacttcttgcagcgttccatgtaaccgcgcttgaaaagcgtttcgatgatggacgctcgtgtggcgggagtgccgatgccgcagtccttcatcgcctgccgcagcgcgtcgtcctcaatttccttgcccgctgtttccattgccgagagcagggtggcttcggtatgcagcggcttgggtttggtctttccttcggtgatggaggtggctttcagcgtgagcgtgtcgccatcctgccagccggggatggtagtttcctccttttcctcgccatagacggcacgccatccggcttgcttcacgacactgcctttcacggtgaactccactccggcacattctgccgtgacagcagtcacgtccttgacgcatttttcggagaatgcctctatcattcgtccggcaatcatctgataaatggtgctgtcctctttggagaggaagagcggtttctctcccgtgacgagcagggcatggtggtctgttaccttgccgtcatccacgctacggcgtgtcgggatggcttttgcccgcaccttgtctttccattcgggctgcgtgccgataaaggcgagtagcttggggatttcagcgaacacgtcttcggggatgtagcggcttcccgttctcggataggttatcaacttcttctcgtagagcttctgcgcgatttcaagcgtctgttccgccgtgaagccgtgcttggcgttggcttctttttggagcgtggtcaggtcgtacagcaagggagtttcctccgtcttctccttacgctctgctttcgttaccgttgcgctgcctgccgcctttaccttattatatagctccgttgccggttctttcgacttccatttctcggaggatgagagtttcacgacctcgccgtcgcaaccgtctgttgcgatatggagctgccagaatgcttcggacgtaaaacggcggttctcccaatagcgttcacacaccatcgccagcgtgggtgtctgcacacgccccaccgaatacgtgccatgtccggcggctatggataacgcctgagtgccgttgatgcccacgagccagtcggattcgctccgcgctttggcggcgaggtataggttgtcgtacctgctgccgtcttcgaggttgcgcagtccctcacggatagccttgtcggtgagcgagctgatccacagacgcacgaaaggagtggtgcaacccgtatagtggtagaggtagcggaagataagctctccctcgcgtccggcatcggtcgccacgatgatttgttcgcttgtgtcgaacagtcttttgatgacttttatctgcgacaccacgccgctgtcgggcttgtaacctttctccgtcctgacctgacgggggacgagcgtgaatgtgtcgggaataatcgggaggttgtcacggacaaatccgcgcacgccgtagccgtcgggcatggcaagctgaacgaggtgtccgaatgcccatgtcacggcatagccgcctccttcgaaatatccttcctctctctttgtcgcgcccacgatgcgggcgatttcacgtgccacggagggcttttctgcaatgattgtcttcatgttttcttgcttttttgttgatactttggattttattttggattcagtggcggacacgggattacattttcatgcctttgttgttcttctttttcggcttctcctgctgctgttgctggcggtcgtcctttggggcggtctgacctttctgcaaaggctctttcaggttctttgtcgcctcgttggttttgccctcgttgttcaccgccacctgtgtgcggctctcgttggacggggcgacctgctgggcgttgtcggggttcgtttcgtagcggtacgggcggcccttctccgggttgaacttgatatacatcgtggcatggaagccctgcttgtcggtcacgttctccagtttcacggctttacccgccacgtagtcggctttctgcttgtcggtgaagttcacgccgctccatttgctgatggggcggatgctgccgtcctcgttcatccacgtgttgcggcgttgctccttcttggtctgtgcggcattttccccgccttgcgcctgacttttcgaggtgtcacctttggcttcctgcgtctgtgcggtacggggcgaccttccggttcccggcacgaactccacgccgcgctgctccacgttcacttgaagggtggtgacgaacttcctgccgtcgttgcgctcgatgagcttgtcgcgcacgggcagtccggcgcggagcatgtcctgctcctgtttggtgatttccgtcttgccgatgcgctccgggatgcgcaccttgtttgccggaatgtccgtgatttcattcgtcttgcggtcgatgctgatgtaggaggggatgatttcgcccgtttccctgtccacaatgtccacgaccctgccgaggttgcccgtttcgcgcaggttcttccggtcatcgtcggagaatttgtgttccttgtactcatctaacttctgctccttgcggatgaagtgcggcacgaggctgacatttccctcgccgtccttcttgaaggagaggcgggcgtccagctcgaatgattcgccgccgaaggtgggcttgacctttaccaagtcggacttgccgtagtggagcatcttcgtaaggtctccggacttttcaaggtcgtcacgcttcacgccccatctgtcctccagctcctgccagttgattttgctctcgttgatgggttggtagccctgtctgccctgcgtctgttgcgggctttcctgctgttctttctgttgttccatgttttcctgtttttgaggttcttgtttctctgtcttttgtgccgccatctcttcctgcacctgctgttgataagggaaggtgtcgattttgtgcggtgcaaggatttgtttgttctggtacggatgctgaagcaggtctttcatcacgccaagcatggaatccacttggtctgccgcgatgcggtagaaaccgaagcggctgggttccttgcactgccggaagaagttcttgaagaagttgtccagcacgtcgccgtgtcggtcgaattgcaggaaactctgcgcgttctcagctttcgcaggggtacgcttgggtgtgtcgtctgcattcagcccggctaccacgctgatctcgcccgtcttctcgtcacggactaccagcacgtccttttcgtcttttttctttgccatttgaaaaatgttttaatgggttatttatgaaagaaattatggatacgagccttgtagaaggctatatcttcttttttgaagtccttgatatggttggaaaggaatgtcagcacatcctcctcgctgtaataggttttcttgcccagtgtcttgtagggcaatgcgccgacactgcggtagcgttgcagtgtgcgcttgcttatctggagcagcatgcacaaatcctgattgtcgaaaaggcggatgctttccgtgatagtaggctgtttcccctcagccttcatcgccagcagcagttcgtcctgacggtcgagccgttccatcagcttctgcatccagccctcgaagttgtttcgtgtgagcagttccatgacctatgtcctccttccttttggtttgccgccagtgcgcagcgtgtggttgcgtttcaattcctgcggtgtcgccgcgtcctcgttgacggcacacgcttcaagcaggcggtctatttccgactgccggtagcggcatttaccgcgaagcacgacataaccgatgcgttgctcgctgcgcatacgctggagggtgcgggtactcacgttaagcaggtgcgccgcctcgcgtgtggtgagcaacctgtcgggcgatgccgctttcttgtcgccggaggcggcacggacgtgtgccgcaatctccgctatctgttccgtcaatgaccggaaggcagaactttccatcgttatcactttcatattcagtcctttatttttgtttattttcatgaacataggctgcgcctcggcataccgttcaagcaagtttgacgctctacactcggcttgctctatgtttctgcgacaaaattcggcaataaacaaaaggggctttaacaactcactacgtgactcacgtaagatttttacggaagatggctccgtaacccggtcaaacggtgcaacaggcagcctttcagcggaaaacggtacgtgttaagggctgcatcgttacctttgcgggcaaaccgataattgcatgaatatggaaatagtatctatcgagaaaaagactttcgagatgatggtggcggcattcggcgcactctcggagaaggtcgccgccctaaggcgcaaaagcgacacggggcgcatggaaagatggctcacgggcgaggaggtctgcgggcagttgagaataagcccgcgcacgttgcagacgctgcgcgacaggcggcttatcggctactcgcagataaaccgcaggttctattacaagccggaggaggttaagaggttgataccgcttatcggcacgctctattcgcacggcagatgatttgatttattcacccactgaatccgaagttatgatgaacgagaccaacgatgtttttacgatggaagacgagccgatagcctctgtgatgcaggatatgcgcaaaggctcgaaatggctgtctgtatttctggaaagttaccgccctccgctggacggggaacgttacctgactgacggtgaggtggcggaactgctccgtgtcagccgacgcaccttgcaggaataccgcaacaaccgcgtgttgtccttcatacttttgggagggaaggtgctttacccggaaacggggctgcgcgaggtgctggaagcgaactaccgcaagccgctggagtgaggcggccaacatgaaaaaggaaacgggcgacattttgtggtgctgcccgtttactttttatatacttgggtgttttaatgaccttaaaaccagttttttgattgatccaaccaatttctatcgttagaaattcatatagttaataaaaagttgtaactttgcatttaacgcaatctaaaaattaattgtaatggcaattttaaacaacattaaaaatgtactatcagaaaaaggagttatgagcaaatggttggcaaaacaattacagaaagatcctgcaacagtatctaaatggtgtaataatcattctcaacctgatttgtacacatttgttcgtattgcaaatttgcttgatgttgatgttcatgaacttatttgtcatacaaaaaaatagtatctaaaggaatatagatgtttcaccatttttaagcatgtaaataaagtgtatgagcaataaaatttggaattttgatatattagttgatgattgttttgttaattttaatacaaaaaagcaagaaataaatccagatcataatgacaggttattatcagttgctaatggctttgaagatggcagttggagatatcgtcaattcaaagaatttgttttcagtaatattgcagaaacagctttgtctgcacaagaacgagagaaattaatagataatgattacggtaggcttattgaggctgccaaacatttacgacttgttgacaaagagcagaatggaaagggaagtgaaatagcggaaattattctatatggcataatgaagaaccattataaagccttatctgcaatacctaaaattttttataaacagaatgataatgataatgcaaagggctctgattctgtacacattgtaattgacccaaatggaggctttcaactttggttaggagaagctaaattttataattctcttgaggatgcgcgattatacgaaccaataaattctgttgaacaaatgttgcgcaaacctattatgaaaaaggaatgcggaataatgaccaatctcaatgaacttgataaacaaattgaaaaccaaacattacttaaaaagataaaagaatgtttcgatgagaatacttccattgacgaaataaaacccaaactacatatacctattcttttattacatgaatgccagataacagcaagtactactgaaatgagtgatgagtataaaaatagtattatttcttttcatagagat

SEQ ID NO: 148 - DNA, 18835 bp, Bacteroides thetaiotaomicron
caaaatacgacgaatattaagccttattacctaattactgaaaaaatagtcgcatagacaaaaaaagaggaacgactattttatattaaaaaaagaaggggatgtgccttagttttgacacagccccattttttttatctttgtcggagaagacaaaacacactcgatatgaaaagactattcatattctcaacatttctgttatgcttgctatcgactaccttttcacagcagtccgataacacgatcaaaccgaatctgaagtacggaaaaccctccaaggaagagctcaccatgaccagctttgctcccgacaccaccgcaacggcgtatgccgacatccagataccttattactccaacggacgcaatccgacactgaaagaaaacgtcagccagcttgcgttattccttgatttccgaaaacaagtagcaaaacaatttaataacaaaattataataaagagaatatgaagatatacaaaaagaaagaacttcccagacatgaggaagaagagttttcagtcatagtactgacttgtgacgaacacggagaaaccaatcttgggttttataactttgacacggaagattggagttttctttcggaagctgaccaaagttatagagactctgaatttgtatggatatacccaccagccaatcagatgaaagagtttttgataaaatcaatcaaagctgaacgcgaatcagctccaccttcatcgaaggaaaactggtttagaaagaaaacccaacctattaaaaagaaaatcactctggctttcaagaaaaaataaaagtgtacctttgcggctctaaccaaagccgaaaggaaacattggaaaataaaagatacaataacgtcgaagaatgggcaaacacgctcagtcacggagcaggtatactgcttggagtcatagccggctatttcctgctcgcgaaagcggcggcgggtgccgaaccgaagtgggcggtagcttgtgtaaccgtctacctgtttggcatgctgtcttcttatgtcagctccacctggtatcacggcagccgtccgggtaagctgaaggaattgcttcgcaaattcgatcacggggctatctatctgcacattgcggggacgtacactccgtttacactgctcgtcatgaggcacgcaggcggttggggatggggaattttctcttttgtctggctgtcggctatcgtcggttttatactgagtttcaagaaactgaaagaacacagtaatctggaaaccgcttgttatatagctatgggagcctgcatcctcgtggctatgaagcctttgatggatcatttagcagagatgggagccggtccggctttttggtggctgataggcggaggagtttcgtatatcatcggggcagtgttctattcgctgcgcaagccatatatgcacgctacgttccatctgttctgtttgggaggaagcatagggcatatcatagcgatctggctgatattgtaagtaaaagaaagccgtcaggcagagttcatcatttcaatacgatgcttcatcattcaacacaaaaatttcttccaccggaaccccgaaataacgtgctatcctcagcgcaaggacagtagagggaataaactttccggtctctaccgtattgattgtctttcgggttactccaatggctacagccagttcttcctggctgatattcttcatcgccctgtagacctttattttattgagcagttctttattttccatctttatagggattatacagaagcaatcttcttatttctgagaaaagcatagctaccaccactataaccagagcacccatacgtaccgagagattaaaaaaatctccaaagcaataaactaataatcccatttgcatagccgcataaaagcctgctgtcaaagccttagaattatagtccgaatatatttcactatctaatgctcccattaatttcttatctttctttattctctccaaaatatcggaagctcttatcgctacaacgacatacagcaaaactgcaaatgcaaatatataccatgtctctcccaaaaatccctttctgccagtatcaagacaaaatgtctcccacattaatactcccataaacaacataccgacaatcgtccgcatcaaaagagcattaaaccttttaatctccattttctcaatcgtaatattttccataaccatagaatttagtccatattcttatttttaagtttcacccataggttccaaaaagaaacctttaggttacaaatatagatattaaaaactatattccaaccaatcatccatctattttttaattcttccgtttttgttgaaccaaacactccctttcattcgttatataaatagagactctaaaactgcaagaaccatgaactgggaaaatcacctgatcaaagacctccaatggtccaatgagattatcaacagagaagcgaaagaacgtgtagcacgtgagatcgccgccacagccaaaacaggcgatgtgataggggccggctccggttccaccgtctacctcactttgtttgagctggcaaagcggattcacgaagagcacctatatctggaagtgattcccgcctctcaggaaatctccatgacttgcatacaactgggcatcccgcagaccaccctttgggacaaacgccccgactggacattcgacggagcggatgaggtagaccccgaccgcaacctgataaaaggacgtggcggagccatgttcaaagaaaagctgctgatcagaagcagcggaaaaaccttcattatcgtcgatcccagcaaacttgtcaatatcttgggaagcaaattccccataccggtagaggtgttcccgcatgcactgtcatacgtcgaaaaagaactgcgccgactgggtgcctccgaaatatcactacgccccgcccacggaaaagacggtcctattttgacagaaaacggaaactttatccttgatacccgtttccattatattgacgcttcgctggaagaacagctgaaaacaatcacgggcgttattgaaagcggacttttcatcaattacgacattgaagtagttgtaaccagataaaaaccaagcatagcacataggaaaatcacctttttaacatttcacccttccttacacccggtctatctttgcagccgacttaaggaaccgactattctgcactcaataaaatagtgaaagcactattctcccttctttatctcatactatcatttatcaataaaaacaaaaaaacatagtatggaaaagcaaagcttaccacaaaccgaaaatttacaatttcaattttctttttttagaaatacttggagcaaggagtctaccataatcaccctgcacaacctttatctgcaaaccatcggaacactttggaaagcacagaccgaatgctaccgcaaactacaagaccgtcccgaccgcagcaatgaagccaaaatggtaaaagacgccatgcctgtcgtcatcatcgagggcatctgccgcccgcattgcagccatgccgcagccaatctggaaaagatgagccgactagccatgtacgacctcgaccacctgaacgaacggacatctgccgtcaaagcccttttccgtgctctcccctacgtggcctacacgcagaccagtatctccgacagaggcctcaaagtcgtcgtatttctcgatgcccgcaccccggaagagtatcctctcgcctacgccatctgccagcagacactggaacgcatcgccgggcatccgtgcgacgaacaatgcgcccgcatcacccagccctgttcttgcgtatgggatgccgacgcctactacaatcccactcccgaaccttatccgtggagggaagaactcgacaccgacccttcgttgaccaacctgatcaaggataaaagaaaccttccgggcagcaacggcaacccttatgccaccagtaacggctcctccttccctcccgctaccgaagcctgcggatacatcgaaaccttcgcccgtaacttcacccattaccacccctggcagaaaggcaaccgccacgagtctatgctagcaatgggaagaagcgcacgacgtaagggattttcaaaagaagaccttgaaaaattaacatctgttatgtcagtagagatcgtgagaaacggctacacgctgcaagaactcagaaaagacttatcagctggatatcaatacgttgacctatcctatgcaccccaagagaccaacaattcactgacaatactgacaactgacacctttaggcctgtttctgtggaaaatgaattggggaaagaagaagagttgtccataaaaaatgaagaattacgaggatctactccctgcattcctaaccaagtatacgaccatcttcccgactttctgaaaagagccatgaaaccggcacgcagcaaacgcgaacgcgatatactgcttctaggactgatcgccaacctgagcggatgcctgccacaagtccgcatcagtttcgaccagcgtccttacagtccgcagctctacaccctgatcattgctccccccgccaccggtaaaggacttctcacactggcaaacatgctcccacgagaaatcgagaattatctgaaaggagaaaacaaacggaaaaaggatgcctacgaccgtgaactcacggaatgggaacgaaccaaccaacaaatcaagaaagggacgaaatcttcagcagcctcccctgctcccatgcccgaaccaccggaatattaccacctctgcggtgcccccagcacttccagaaaccaaattatccgccggctgaaaatcaacggagacctcggactcattatctgtgctaccgaattggacatgatctccggcgccatcaagcaggattacggcaagcacgacgatgtgttccgtgccgcctaccatcatgaaccggtagccacggactataaggtagacggcgaactcatctgcgcagaagtaccgcgcctggcactctgcctgtccggcacccccagccaactggccaactttatccgctctttggaaaacggactttactgccgtttcagcatctacacctgcggagcacgatggaaataccgttcggcggcccccatcaaaggacaggaagattatatcacactctacaagggattcggcaaggaagtattggagatgtacttcttcttccaacaatctcctacggaagtcacgctgagcgacagacaatgggaggaacataccgcctacttcgactgtctgctcaacgaagtggccagcgaacaagcggacgcgccgggctctatcgtactccgtggcgcactgatggtggcacgcatagcttccatcttcaccgccctgcgcaagtatgaaggtgccatgcagatgaaggaatacatctgtacagacgaggattttcatgcctccatgcagatcgtacaaaccatcctcaaccacagcctgctggtcgcctcctcactgccgggagagaaaatgaaacctcagcctatgcagtcatacttccgaatccggtcggtcgtagagagcctacctaggatttttacttacaaacagattaaagagaaagcactgacagaaggtatcagcgaacgaagtacctgtagatatctaaaaagcctcatcgagctaaaatacattgagaaacaaacagataaatatatcagaataaaagaattcactgacaaataagcgctaagtggcagttggcagtggcagtaacggaaaacgcccgataaattggtatagaaaacgtacatcgaagtaacgacagagttcagaaacgtaccggaaacaagtacaagaaagaagcaaaggttgtacaagaaccgagaagtacaagtacttgaatcagggaaaagaagtactgaaactgcctccatcaagtactggaaagaagaaagacatatacatgaagagagaaagagaagtacaacaatctgctgaatgatatactggaaaccggaagtagacgtatgaacagcagcagagataaagaacttcattctctcttttttcaaggctcgcccaaatgacggacaatctgttccacctcctgacgcaggaaacgatgccgccgcacattatatccgatgccgcccaacgcctgcatcaacggctggcattgcttgatccatctcatcagtgttttaagagctgactctgccgaacgtcccggacaataaagcagagccagctctactttgtcataggctctcatttcaaactttttctcttcaattaattctttcataatctcattttattagcattttataatggtataaaggtactaataaaagttcgttttgtaaaataatcagtgctatttattgaagtaaatacggacttttggggataaaaaaggacatcggcggacacctgcggacaaatacagacaagcaaagaaaataattagaacagggggagcgattaaccaataataagtagtatctttagcggaacaaacgaaatcaaaatggaaaatcaaaaccatgcattcaactatgcatatctactcaaacaagtaaaagcaagagtactactagcacaaaaaaaggcgatttacacagccaatgaagaaatgctttcaatgtattgggatattggcaaactactgtccgagagtcaaaaacaaataggttggggaaacaatgccctggagaagctcgccaatgacttgaagaatgattatccggagatgaaaggattctctgtcaggaactgccagttcatgatacagttctataatgaatataatcagcaacttacaaatacgaaacgggccgtttcgtatttgaacaataatgaaatagtcctacctatcagcaaattaggctggtcacataatataaccttaatgcaacgcactaaagacataaaagcccgctactggtacatgatccaatgcctgaaaaacggttggagccgggatttccttatcgaggcaatcaagcaagactattaccattctcacggagcattggctagtaacttcgacaccactcttcccgaaatacaagccaagcaagtaaaagagacattaaaagacccctatatttttgatatgcttacgttcaccgaagagtacgacgaaagagatattgaactgggccttataaaacatatcgagaagtttctcgtcgaaatgggtgcaggcttcgcctttatgggcaggcaataccatatcgaagtatcagaaaaagatttctacattgacattcttatgtacaatgccttcatgcatagatatctggtcgtagaacttaagagaggagaatttcaacccgaatatatcggcaaactcaatttctattgctcggctgtagacgatatcctttgccgggagggagacaatccgaccatcggactgctactctgtcaaaacaaagaccagattatggcggaatatgccttacgggatgtacataaacctataggaatctccgattatgaacttggtcaagccctgccgaaagatatcaaatccggacttcccagtatcgaagagttggaaaacaaacttagccgggacctacaagacatagacaataaagaataagacatagcataacatagtcctaaaccccaatcaggaacgaatcgttccattccctgatgtgaactgaacagtattattcagctcgcatcagggaatttctttttaatcccggcctcaaaccaccacaagaacagacatccgcagacatttccagataaaaaaagacatctgcggacacctgcggacaaatacagacatcgcccatccccactaccgtacttttgtcatgtcacaagcaaggaaccacctgtgacgcaacactttattatcatttattcaagaacttaaaaccagtaaagaaatggcaaaagtattttcattcaccagcgtgctccgcaagaacatgatggaaaaagacaaaccggacctatattacgctctcgccaaatcgagcggagagatcgatatagatgaaatggcggaacgcatccagcgttcgagtaccgtaaactgggcagacgtagtgtgtgtgctgcgtgccctgcagacagaaatgatcgacagtttcaagaaaggagagatcgtccgcctggggaatatcggttcgttttatgtcactttgcgcagcaacggcgtactcgtccagaaggacgtgaaagaaggattgatcaaaggtgcccgtgtccgcttccgccccggaaaggagattaaagacgcactgaaaacgctggacttcagcaagtacaaaccggaaaacagcgaaggagacaagaccgatccggaaaaccccaaacccaaaccggatcccgatgacggtgacgaagaagctccggacccaaccgtataaggcaatcataaaccggggatttaccaaatctgacgaatcatgagaaagatcgatttaatcgtgatccactgttccgcaacacgggtggaccggacactgacggcctttgatctggagacgctgcaccgacgacggggattcaacggaacaggttatcactactatatccgcaaagacgggacaacactcctcactcgtcccatcgaacgcatcggggcacatgtgaaaggattcaatgcatcgagtatcggaatctgctatgaaggcggtctggactgccggggacgcccggcagatacacggacaccggaacagaaagcttcgctccggctgctggtgtatcaattgaaacaacgcttctccggctgccgggtgtgcggacaccgggatctcagtccggacctgaacggagacggggagatcgaaccggaagagtggatcaaggcgtgtccttgctttgaggtaaacgaaagcctgtgaggacaatatgaatgagcaaaggtataaagacgttttcaggaagtaattaatcttttaaagtatcggaaaggaggtgtgtaaattatggcaatgaagaaatccctttgggatatgattctgaaagtagtcatcgcggtggcttcggcagtagcaggcgtgttgggcgctaatgcgatgagtctgtaagaaagtcaaaaatgaggtccgccaccaagatatctgtttcagctgccacagcagtatacagaaatatttgtggcggacttagtatacaaaaatcaataaactaataatgaaaatgaaatatatattattcaccatagcttttctattggcaagtaattgcctgaaagcgcaagggcaatttgagaaagtaattgggttgacaggggcacaaggctttccacaaccgggtgtcagtaatgccaacactcaaggtaaaatacctgtcggactatataccggaactccgaatatctctatcccattgtacgaatttaagttaagagataatatccaacttccaatcaacctcaattatcatatttataatgtaaaacccaacaacctacccagtgaagtgggattgggatggagccttgaatgcggaggatgtattacccggataattaaaaatgagccagatatttcttatgaaagttctagcaatgaatacaagcctataaccaccgaagctgatttattaaccacagcagacattctagtaagagtatccggcaactatattaagacccaagacgagtatcaattaactttctcggttacaccggaagctttatgtatagtcaagaaaagagcaagtggatggttcaatcagattctgacatcaaaattgaatttacctcgaatacttacaataatacccgttctcaacttaccagtccactttctcaattttacaactattgcagatcagaaggaaccggatttaagaaccctttatcatgttggttgattgattcgtttacactgaccacgccagacggttataaatacatatttggaggaaccgataaaacagattacaatctacctttcaagggattcttaaaccttcctgctcccatcacctggcatctctccaaaatcataactcctgcaggacatgaaatagaattcacctacgaaattatgccgtttcaaataaatggaaatatgtctttctgtataagcttggatgctctattctggcaaacagcaatgagttatgattatgaattactagcccctgtacaacttgcaacagtcaaagatgtaacagacaataaaatacttgcccggtttcattactccccaagtacacaattaccctatgactcacagtatgcatgggaaacctgtatggaccatgggccagctacattttttacaaaagaaaagaatttcacgttaaacaagctaaactccgtggtaatattggataagataaactatcagtttacttacactaatagctccactgagcgattaaaactgaaaacactgactaaaacgactccatcaggaacccaatcgacctattcactaaattatttccccaatcacctacccggatataatacaggacactatgacaacctcggattcaataacggtgaaaatttctcatactatttcagcaaagagttctttgaaaatgcaatttttgctgacaagcagatagccgaaggcaaagagtataccaacaaaagaatgggagacaagggaggatttcgtgtgactgcagaaatgctaaaatccatcacataccccacacatggaagaacagaattcatttatgaacccaacgtcatatccagtatggtgtcagcagaccggaaaacagtacaaagtgcccatttaccttatccaggcactccagattatacatatccgggaggtctccgtatcaaagaaatcaacaactacgatagcaatgatgaactactgacaagaaagcactattactacacaaaagaattcacaccgacaacaaagggaggtgtctcttccggtattctatctttcactccacaatacctttggggttggcagctatacaatctcctcaaatcacaaaacggaggacccgaatattataccttgaatgccatcatgtctcaagcatccaatccgctctggtacaacagtcggggagagtatatcggatattctaaagtcatagagtgcaatgaagacaaaaatgggaaactgatagacggatatactgtccatacatttagcaattttgggcaaggttatatggatgaagatcccatagctatactgaataataagttctctcgtgagtacccacctcattttggtactccttatagtccctataccccatgttcatcaaacgcactaaagcggggaatgctcttgagcaaagagcaattcgactatgccggccatgtgaaacaaaaagaactattcgaatatactcctatacagaaggattctatactcatcacagaaataaccacttctaatgtcattgactataattcagacgccccttcaaaaggattcctaaggtttgctttcggaggtacctactatcaaaagttctacagcaacctgcttactgaaaaacagactatcatttacgatgacaacggaaacacaattgagtataaagataaatacgaatataatcctgtcaacaaacagataaagctgaaaacgagtaaagacggaatgggaaacatatatgaagaaaagacgcgatacgtgccggacatgctgatatttccatttgtacctccctatagttctttctaccagatgaatcagctacacttcaccgactatccattggaagtgacaaagataaaaaacggaaaagtaactgagaatgagacatatttctataagttactgactgcagacagcaaaagcttagtgaaagacaaagtatccatactgggaaaacatgctgatgctgcaacataccaaggactccataatgtgggcaacgagttagtagccgatgtttctaatattcccgcaaccacatacctggcatacgactcttacagcaacccgactcatatccgtaacgaaaaagacaaaacagaaactgtctacctgtacggatacaaaggcaaatatgcaattgcggaaatcaagaacagcgattacgaatcagttacaggactgttggggaatgatcttatcaaaagactggcagacgcaacgaagcccagctattcagacatgcagaaagttgaagatttgagaacgcaattaccggcatcatttatcactacttatgaatatatcccatacataggtatcagtaaaattagagatcccaagaatgtttctacctattttaaatacgatgattctgggcgcctgataaaaaagaccgaccataagggtgaactgattagttcatataaatattcaaacaacctctaaagagataaatttatgaaaattattatttatattacagctttaatatgcagcttactcgccagtcctgcattggcgacagaaaccgggcaaatatccatgaccaacatggggctaaaagtcacatcttctcctgaaagcactctctacgaaggagatacttggatgataacagcaaggaacaactttagcttgaacgaagcagaaatcaaaaacttcgttccttcacgcatatcagaagaattgcgtccgtacgtgagactttccaaagttgagtttacttctaattcagacggtatatgcaacctttactttcacataacggccgatccgacagatacgatacggttcgttatcaaagaatcccctcaggattttccgatagaaataacgccagctgaaagtagacatggagagatatctttatccgatctgggattgagagtaacgacttctatagattcacatctcgaatacggaggtcagtggatagtaacgatggaaaacaaaaatcacttattcactgcagaaatcgaaaggctcgtgccttcaagaataacggaagatttaagaagatgtttaaggctcacaggggtaggaatttcagacatatcatccgagttcgtcgtactcttttttgatgtaacattcgaaacaacatttccagtacacttcattatcaaacagtcacctcaaaacattccaatagaaatattacctattggaagagacaactatatttccacaacgaattatctggataacacaagaagtgggggaagaaaagaaattacttactacaacggtctgggatatccatcgcagaaaatagaagtgggtacttccaataagaacaagagtatataccatccgatcgtttatgataacttgttaagagatgatgccaaatcgtatttgccatacgcacaaggttcgaacacagaaatgatagactggaagtttaccgaaagtctgcaagatttctatgcttttaactataaggaatatacttatcacttttcagaaaaagtctacgaagattcacctttgggaagagtacgggaagtatatggtcccggaagcgactggcgttcgcaaaaagcaagtaccaaattcagctacctgagtaacttcgccggaaatgatacgctcaactgccttcggtttgaaatgacagaaaaagataaccaaaacatggagctgaaagtagccggcaattgcaaatcttccgagctatccgtcacccggaccgaaaacgaagatcgtcaagtgacattggaattcaagaataaattcgaccaagtagtacttagccggcaaattgagcacaacaacggcagtaagacgaataacgacacttattatctttatgatgagttcgataatttaaaagcggtgcttccacctatggtatccgcccaacttgtaagcggtagcagttattcgagtcaaacttccgcatccttagctcaatacgcctatctctataaatatgatatgcgtaaccggtgcataggcaccaagttaccgggctgcagttgggagtacaaagtctatgacttggcagaccgccttatcttctcccaaacaggagaacaacgaaaaagaggtgaatggcaattcgcattgcccgacgcaatggggcgcgaatgtatcacggggatttgtaaaaacgccatagacccattcaacaacccgatactgaatacatgcgtcaaatgtgaacgtacgaacaacgcttctcttctcggttattccgtaaccggagtcgcactgaattcagccacagtgcttaccgccaaatattatgacgactatcagtttaagatgcagaacggcaccctgatttccaacagcagtttgaattatgaagcaaacagcgagttcggagaaagatatacgactagttcgcaaggcttgcagaccggaaacgcgacagctcgactggacaaaaacggatctgtgacaggatacgactataccgttacttactatgattataacggccgtgccattcagataaaatcgaccaatcatctgggaggatacgaaaagacatacactgcttacaactttacgggacagcctgtgcacaccaagcatatccactccaaaagtaactccgagctgatcgaagaaaccaaacacagctacaatcacgcaggacgtttgtctgaaactgtacaaatcgtaaatgaaaaggactctacgaaaatgagctatctctacgatgacttaggcaatattaaaagcttaacccgaatagacggcacttccacactgacaacgaccaatacgtataatatccgtaactggctaacgtctatcgaaagccctctcttctctcaaacgctacattatactgatggtcccggcactccccagtatggcggaaatatcagtagcatgacgtggaaagcaaacaaagagtcaatcacccgtaattaccaatattcatacgataagctcaacaggctgaccagtgccaattatagtgaaggaagcaattcgatgacgaatacaaatcacttcaatgaacaagtgaccggttatgacaaacatggcaacatcacaggactgaagcgttatgggcaaaccggacaaagcagttacggattaattgacgacctatctcttacttacacaggcaatcagctcaagaaagtgacagacagcgccacaagttcagcatacgcgaatggtttcgagttcaaggacggtgtgaatctggacacggaatattcctacgacgaagacggtaatttaacaaaagatttgaataaaaacatttctgatatccaatacaatttcttaaatttaccacgtcggatacagtttaaagacggtagtgaaatttcttacctatatagcgcagacggaactaaactccaaactacacatataatcgcaggaaacaccactacaaccgactactgcggcaatgtgatctatgaaaatggaagccgggacaagctattgaccgaacagggatatttctctatagcagataaaaagttccactactacatccaagaccatcaaggaaacaacagagtggttgccagccaagatggaatgatagaagaagtgaaccactattatccgttcggaggaatattcgcttcaaattcatctgttcaaccttttaagtataacggaaaggaactggatacaaagaacggattgaacttgtacgactacggagcaaggcagtatgacccggtattgggaagatggcatacgatggacctgatgacggaaaagtactataagattagtccatacacttactgtttgaacaatcctatcctattagtagatcccaatggaatgtggcccacatggggaggaataagcagaggattaagcaacgtctttaagggtactctaagttttaccaatggagctgcacgggctatggcagataacatactgcttggacaaacgtcactccgtgaaaccggaatatacagcaacgcatctgcctacaacgcaggacaggatgttggtgatatcataagtatttttgcaggagccgcagagattgttaatggtttcgaagaagctgcaggaggaatggcactcagtccggaaaccgcaggaatttctttgggggttaccgcgaaaggcgtgtatgatatcactcacggttcattgatgggaacaagtggattcatgaagctattctccaaaaaaggaagagttagcgaaggtagtaataacggaagcgggtattcaaagtctagcgggaagaatgaaaagcattcgaatattgataaaagacaacaagctgcaaatgattatagtacagcaaaagagaaatatgataatttaaaatctaaaacaaataaaactgcgaaagagaaaaaagaattagaaacattgaaaaaacaaagagatcactataaaaaacagatggattatgcaggagaccatgaccatcaaagaggtagaggaggtaattaaaatgaaactatttacatttattgctgactataaaggtgggacatacattagtcagtatgtagcaaagacattagaagaagccttgaacttatggataaataatgtcgatttttttacagataaacagttgaagtcatttaagaagaatatcaaatatggtgatatagatcctcctaccaaattaaatggtctaagtaatgtttggtgtacatgttttattgtatttagtactcttttgcttcttaatatagtagagacagtaaaaaaaacgactaataaaacatcctagcatagaacaatatattcctacattagggtagattcaagtctcagaaacaaccatgaaataaatgaaattatgaaaacatttactttcttagttaatgccaacgataagcattgctttgttcatcagtatcaatcagaaatgccgactaatgatttatttcgtgaattagttcatgacacgtctcatatatcttcaaaaatgaagtctttacttattcgtgaatctctggaatgctatcatgacaatggcccagtaaaattagactgcgtaaaaaacgtctggcgtgatttctttttaattgatgatctaatatctctttacaatgcgaatatagcaaaaaaataccacgagggatgtggcgataggaaatattacaagttaatgtacttatatgatgtaaacatgatagaaaccgacatgagcgatacagtgtttcctctatcagagaaagcaacctttactttcattacctatattcgtaattacaatgcctcatatcagtttgaagtgacaacgttggaagaaggacttatgctatgggctacaaacatagacattttgaatcgccaacaacggaaggttctgctgaaatacattcaaaagtctaaaaacaatccgatagcagtagaaggagtaaagaatgtatggagcacatcatatcggatattccgtccgttactgacattgcatattgttaaaacggtctcttgataaaagtcaccgactgaacaataactattagattattaccctggcatgaaactaaaacatttacatgtcagggtattttttcttggctaattctaaaacaaataagagcaggctcagcaaacgcaaggagggcgtaatctgaactctgtccccaaacaattatctttgtattatggatagaaacagtgaagagtatcagcagatgcgtgacaaagcgttatctcaactgcgtagtggcgaatcgctcacgggcaaagacggagcctttggtccgttgctaaaagagtttttagaggccgctttagatggcgagatgtcctcccaccttgatgattcagagcgtcttaaaggcaataagcggaatggtcgtggcagcaaacgtgtcaaaaccatggccggcgagattgatatcgtgactcctcaagatcgtcacagcagctttagtcctgagatccttaaaaagcgcgagacgattcttgcggacaacatgtcttccaagattatcagtctgtatggtatgggtttgagccttagggatatttcctcccatatcgaggagatgtatgatgttgagatctcccacaacaccctaagtgagattattgaacgcatagttcccaaggtgaaggagtggcaaagccgccccctggaatcaatgtataccattgtgtggcttgacgcaatgcactacaaggtgaaggatggtggtcgtaccgaaagtcgagctgtctataatgttctggcagtcaataaagatggccataaagaactgataggcatgtatgtatcagaaagcgaaggggctaatttctggctgagtgtcttgaccgacctgaaagcacgtggcatgaaagatgttctgatcgcttgcattgacaatctcacgggatttgctgaagcaatcagcactatttttcctgaggtaatcatccagaactgcgtcatacatcagattcgcaattcattgaaatacatagcctcaaaagatcaaaaagagtttatggcagatttgaaaacagtctatcaagcccctaataaagatttagcagagctcaaccttgataaactacaagataaatggggtaaaaaataccctgttgtcttggaatcatggcgacgaaactgggataatctatcggcctattttgcttatgatgagcatatccgaagactgatttacacaactaacgccgtcgagggcttccaccgtcaagtacgaaaggtgaccaaaaccaagggtgtctttcccaatgacatggcattgatgaagttgatctacctggctgtgatgaacatctccaagaaatggacgcaaccgctccagaattgggcgttaactgccgggcaactacgaatcaagtttggagagagaatgcctctggcgatataacccatttccccttttttgcttttcaaacgcaaagaaaaggtagttcccggatgtgagcaagggtatataaacggctcattcttcgccgcccttgcacacatccaaaaactaccttaagaagcatttgtaaatccaaaaagaaaaaattatatttgttgtgatttaaaagaaatagaaaccagacagagtttaaattacactccc

SEQ ID NO: 149 - DNA, 18717 bp, Bacteroides thetaiotaomicron
gtttgttaactacctaaaaactatttctaattaaaaagaataagatgaaagaaattataaaacacaagtttccatacttgttatttttccttttattgttttcgagttttgcctcagcttatgggcaggaacgaatgattacccttaatctatcgaaggtacctctaaatactgcattgaaagagatagagaaacaaacttcaatgtcagtagtatacaacacaaatgacgtcgatattaatcgtgtcatatctattaaagtttctaaagagtcgctgactaacgttatgggtcagctgtttaaaggaacaaatatcagttattcaatagtcgataagcatattgtactttctactaagaaagaagtagaacaacagaaaaaaacaccaatcgttgcaacgggaacagtaacagatgcacaaggtgaacctttaattggagttagcattctggtgaaaggaacagctactggtgcgattactgatatggatggaaatttcaaaatacaagctgccaaaggtgatgtgttagaaatctcctatatcggttatgcctcccaagcaatcacgttgaccaatgcccagccattgaaaataacaatgggggaagatacacaaaaattggatgaagttgttgttactgctttgggtatcaaacgttctgaaaaagcacttagctataatgtgcagaaagttaacaatgatgctttaacttccgtaaaggatgctaacttcgtcaatagtctaaacggaaaagtggctggtgtgaatatacaacgcagtgcttccggtgtaggaggtagtactcgtgttacaatgcgtggtaacaaatctattagcggagataacaatgttctatatgtagttgatggtgtaccaattggtaatcaagctgacagaactggcgacggaacaggattcggaagcggcagaacttcaggtgaaggtatcgccaatttcaatccggatgatattgaaagtgtgtcagtattgactggaccgtctgctgcagcattgtatggagcaagtgcagcaaatggagtaatcttaatcaatacgaagaaaggcgaagctggaaaaatgcgtatagatgtatcttcttcagtagagtttatgacaccgctcacaatgcctaaattccaaaatagatatggaatatcaggaaactattattcgtggggagataaactggaaaatcaatcatcgtatgatcctaaagacttctttgaattaggggcaacctttaataattcatttaatctttcaaccggaaacgataagaatcagacttatttttcgattgctgctgtaaattctgatggtattgtccccaataacaagtaccaccgttacaatgtgacattgagaaatactgctaaattcttgaatgataagttgacattagatgcatctgcaagttatatacgtgagtattataacaatatgatttcttatggaacttattttaatccaattgttggcgcatacttatatccgcgcggtgaagattttgagaaagagaagtattttgaacgctataatagtgaactcggatattctcaacagcaatggagtcccggagattttggcatggatatacaaaatccatattggattgcctatcgtaacattcgtccggaagtaaaagaccgttatatgttatatgcctctttaaagtacgatattaccaactatttgaatgtggcaggtcgtgtacgtttagataatacctatactgaaaaggaagataaacgttatgcatctaccataaacacatatgctagtacaaacggacgctatacatactctaacgagacgtttcgacagaaatatgcagatataatggtaaacttcgataaacagtttgctgaaatctatcatgctacgatcaatgcaggaacttctttcgaagaatatgatacaaaaggacgtggatatggagggcagttgctattagtaccgaataaatttgtatatagtaatatagacccgacgcagagcaccgcaagtcaaactggtggagacagccgcaggagaaattttgctgtatttgcttctgctgagttatcatggaattcggccttatacctaaccttgacagggagagccgataagccttctcaattggtaaacagtgatgatccgtggattttctatccttcggttggtttgtctgccatcgttactgaactgttacccaataatattaaagagaaattagagccaactttaggtttcctgaaagtcagagcttcctatacagaggtaggttcgccgatcccctatacagggttaactcctggaactctcactcacgaacttgaaggaggaacctttaaaccttttaaatattatccgatttccaatctgaaagctgaaagaactcgttcttatgaagtaggtcttgattccaaatggtttaataatacaataactttcggagttacgtattatcattcaaatacatataatcagttactgaaagctacattgggtagtaattttgaatatatgtttgtacaagccggtaatgttcagaatagaggacttgaattaagtttaggatttgacaagaaatttggtgattttaattataatacaacgttcactgcgacgacaaataaaaataaaataatccaattggcacgtgatgtcttgaatccggtaacaaataccttgatagatttaacggatattcaggttgggcgtttccgtttgagagaaggaggagaaattggtactgtatatgcaaatgaatggctaaaaagagatggtgataattatatagactatcagccaggtcaggcattaactacagaaaccacctcaccctacaagctaggtagcgtgaaccctaaatggaatttgggatggcagcatggatttagttacaaaggatttaatcttaacttgttgttcacagctcgtattggaggaatcgcaatatctaaaacacaagctatgttagacagatatggagtatctgaagcatcagcagatgcacgtgatgcaggtggtgtatcattaggatatttcaaagttgatccaaaaacttattatgatgcagtttctaatttggatgcctactatacatactcagcaactaatgtgagattgcaggaagccagactgacttatactttccccaataaatggtttaaaggaactgttaataatttgagcttgtcagtatacggtactaatttatggatgatatacaataaggccccttatgatcctgaactaacagcttccactggtacttttggtcaaggatacgattactttatgttacccagccagtctacttatggattgagtttgaaatttggattctaaaataaataaaggaattgaatatgaaaaaatatataattctgcttttggcactttgttctatgtcagcttgtgattatgaagctgtcaataccaatccttacggtgtctccgatggggaattaggtcctcttaaatatggtgcccgtttcatgaatatgcagcaaagagtgatccctataggttcacctagtttgacaactggacctggaaatgatttacaaaatactgatttgatatcttccggtaactatattggttattttggcaataataataattggggatttaataatgaggctaattggaattttacagatagtagaatgaattatgcatatcagaacttttactcgcaaatctttttgccctggaatgaaatatatgaaatcgctaaagattcggattccccatcagaacaagctatattggagattgctaatattgtcagaaatatagcatggttgcgagctacagacgttttcggtcctattgcttataactcagcaggtgatggaagtattgcgccaaaattcgacagccaggaagttgtttacagaagcatgctggctgatctgtcaaaatcagtagaattgctgaatacaatatcttatagtgtgatggctcagtacgatttgatatacaatggcaatgttcaaaactgggtaaaactggctaactcattaatgttgagaatagctgtcagagtacattttatagatgagactttggctaaagaatatattacgaaagcattagatcctaaaaatggcggtgttattgaagatatttcaagtgaagcaaagatcaaaagttctgataaaatgccattgctgaattcaatgttagcatctgtcaatgaatataacgaaacaagaatgggcgccactatttggggatatttggatggatataaagaccctaggttaagtgcatattttactgaaggaacatatggttctggcagttgggcgcaaacaggttattttccggttgcaccgacgaatagtaaatctaaatcggaaacctcatattctgcaaaatttgcatcgcgtccgaaagtagattccaattctcctttatattggttcagagcatccgaaacttattttctgaaagcagaagctgctctatacaatttgataggtggtgaccccaaaacgttctatgaacaaggaataaatatttcatttcaagagcaaggagtcagtggagttgccacatacctgtcaggaacaggtaaaccaaccggactcactggtagtaattacaaatatggcacttataaccatgatttaagcattggaaatacttcacccaaatgggatgattacacaggaaatttgagtaagcaagaagaacagttacagaaaattattacgcaaaaatatctggcactatatccgaacgctgtggaagcctggaccgaatatcgcagaaccggtttcccatatttaatgaaacctatggatgaagctgctcctggaagaattggcgcctcaatagaagattgcagagttcctgaacgctttagatttgctcctacagcctataattccaatcctaatatggctgaaattccaacattgctgggaggtggagatataggagctactaaattatggtgggtacgttcaaacaggcccaaacaacctaatcagtaataatgatattcatttttaagaaaagaaaattatgaaattattaaagtatttgtgtataggtatatctgccttaagtatactaagctgttctgactggacatctgaagaaagagaggtttttgagaatcaagaaggaatgcaccgtctgattcccctaatagaagcccaaaccgaagaagatcttacaccgaccatgcgtgaatatttcgctcaaataagagaatatagaaaaactcctcatgtgaaaggctttggttggtttggtaactggactggaaaaggaaacaacgctcaaaattatttgaagatgttacccgatagtgtagattttgtatctctctggggaacaagaggttacctttctgatgaacagaaagcagatttgaaattcttccaggaagtgaaaggaggaaaggcattattatgttggattattcaagatttgggagatcagctgactcctaaaggattgaatgcaacgcaatattgggtagaagaaaagggacaaggaaacttcattgaaggagtaaaagcatatgcaaatgctatttgtgatagtattgaaaagtacaatcttgatggttttgatattgactacgaacctggatatggacattccggaactttagcaaactaccagacaatcagtcctagcggtaataataagatgcaggttttcattgaaactttaagtgcccgcctacgtcctgctggaagaatgttagttatggatggtcagccggatctcttatctacagaaacttcaaaattggttgatcattacatctatcaggcatactgggaatcaagtactagttctgtaatttataaaataaataaaccgaatctggacgactgggagcgtaaaacaattattaccgttgaatttgaacaagggtggaaaactggtggcataacttattatacaagtgtgcgtcctgaattgaacagtatggaagggaatcagattcttgactatgcaacactcgatttgcccagtggtaagagaataggtggtataggtacttatcatatggagtatgactacccgaatgaccctccttacaaatggttgagaaaagccttgtattttggtaatcaggtatatcctggtaagttcgattaatattaaagaatgactattatgaaaaagaatatttatttagctgttctgttattcttaacaggttgtcaaaatgagttatataaaaatcctttggatgattttcaaagtgagcaaggagtatatatagctaataacggcgtattacaaagctttgtggaagaaggcaaagatgtggaaattaaagggctgcaagtagctttagctgttcaagatactaaagaaataaaagttacattggaggctggtaatcaagctcagttagatgcttataatgctaaaaatggaactaactatatagtacttcctaaagagatgtatgagatctcacagaaaataacatttatgcctctttatgcaatgatggatgttcctatttctttgaagaatgtaaaattctcactagaaggtaactatgctttgcctatacgtattacaggaggtgacgtgaatattatcagagggcaagaagagactttacttgtacttgagcaaagagtgaatacaaaagcgctccggataagtacaagtggaagtggttcggggagcgaggatgataaaatgttccctaacgatttcaaagttgatcaatggacaatggaagttatggtcaatagggctagttacaaaagtaacaatcgttctatttgtggaactaaattggttgccaatgctggtcctatggatgagatttatactcgtttcggtgatgtaactattaaccctaatcaattacaaattaagacgggaagctctcagattgatgttcccgctgacaaattctctgcacagcctgacacttggtatatgttagctttcgtatatgatggtcaaaagaattatgtatacgtgaacggagtgctggttgctgaccgggaaatcagaacaggtccttatggattgattggcttttggattggtggttcaaacgagctgattcgtgaggttcgtttttggaaaacggccagaacttcgcaagagatagcttcgaatatatggaagatggtaaatcctgacgatgacaatttactgctttattatccattgaatgggaagaagagggatagtgctaccggagaaattacagaggatgagactctgctttgggactggagtaagaatggtaagaatttacccaagccatcaagttattcttttgatgataacaaagggaacgggtttatattcccaccgcaagaatagcaacaaactacaataaattgtacatatagaaaaggctgcctttggaatgaggcagcctttgtttttactatacattgtaaataataacaacataaataaagagacagaactatccactcaacaattcatatatttacacaaatatacaaattatcaaatacaaatatcaatggttatatttagtatgagatgttcttctctcatactactccgcatatctcccaatcaatcacgcttgccaacgcccaacccctaaaagtcacaatgggtgaagacacgcaaaccttggacgaagtagtagttactgcgttgggtatcaaacgtgaacaaaaagcgttgagttataatgtacagcaagtaaagggagaagctttaacagcggtgaaagatgccaactttatcaattcgcttgcaggtaaagtagccggtgtgcagataagcagcggtgctacaggtgccggtggtgctacacgtgttgtaatgcgtggtatgaagtcattgaccaagaataacaatgctttatatgtgattgacggtgtacctatgtttaacaccggttcaagtggtggtgatggtcagtacggatcaatgggtggttctgatgcagtagcagacttaaacccggacgatatagaaagtataagtatgatgaccggaccgtcagctgctgccctttatggctctgccgcagccaatggagtagtcctggttaacacaaagaaagggaaaaaagaaaagatatcacttactgtttccaatagtacgaccttctccaaggcatatattatgcctgagatgcagaacagatacggaacaagttcaggcttgttcagctggggagatctgacagataaaagatatgatccgaaagacttcttcaataccggtagtaatatcataaactccattacattatcgacaggaagcgataaaaatcagacttacttctcagcttccacgacaaattcagatggtattttaccaaataacagctacaaccgctataactttaccgcacgcaatacaactaacttcctgaatgataagctgacactggatatcggtgcgcaatatatcatacagaataataccaatatggtatctcagggacaatattacaatcccctacccgctttgtatctgtttccacgcggagataattttgatgaaatccgcctgtacgaacgttacgatacaaattacggatttatgaaacaatactggccttatggcgacggcggactgtctttgcagaatccttactggactcaaaaccgcatcagacgtacctctgacaaaaaacgctatatgctgaatgcctctctgaaatggaaagttacagactggttaaatatcaccggacgtgtcaatttggacaactcggattatcgtaacaaaacagaaaaatacgcttcaacacttgccactttctgctctgtcaatggtggttttgaagatgctatgcgtcaggaacgttctttatataccgatttaatggctactgttgataaaacattcggagatttccgtctgaataccaatataggtatgtcactttatcacacttccatgcagacaatcggctttgctggtgacctaattatacctaacttctttgcactgaataatattaattacgctgcaaactataaaccactaccggacggatacgatgacgaagtacaaagtatattcgctaatgtcgaattaggatggagaagtcaactttacctcacgttgaccggacgtaatgactgggattccaaactggctttctccaatcagtcttcatatttctacccttctgtcggcttatcggctgtactgacggaaatgttcactctgcctaaaatcatatcttatgcaaaagtacgtggttcttacacagttgtagcctcttctttcgaccgttacctgactaacccgggatatgaatataacagccagactcacaactgggcaaacccgacagtttacccgatggacaatctgaaaccggagaaaaccaaatcatgggaaatcggtctgaacttgaagttctgggaaaaccgcttcaatctggacgcaacctattatcgttccaatactttaaaccagacatttaaagtagatattccctcttcctccggatataataaggcaatcgttcagactggtaatgtacaaaaccagggaatcgaactggcgctcggcttcaccgacgaatgggcaggattcagatgggcatcaaatgctactttcactctgaaccgcaacaaggtaaaacgtctggcaggcggtagcaccaaccctgtaacgggcgaactgatcgatatgccaaacatgcctgtaggatggcttggtaaagagaatgtagctccccgagtaatcttgacagaaggaggtacaatgaccgacatatacgtgtacaatgaattaaccaaagataataacggaaatataaaagtggatgctcaaaccggaggacttagtatgcatacggcagagactcctaccaaagtcggaaatttgaacgctaactataatttaggctggaccaacaatttcacttacaaaggaatcaatctgggagtcgtactttccgcacgtgtaggtggtctggcatactcagccacgcaaggtgttctggactactatggcgtatcaagtatcacggcaaatgcacgtgacaataaaggtgtaccaatgaataacggaaaagtagatacacagaaatactatcagaccatcggtaccggtgaaggcggttacggaagatactatttatacagtgccaccaatgtccgtcttcaggaactcagtcttagctatacacttcccaagaaatggctgaacaatgtagccaatgtaaccttcgggcttgtaggacgcaacctgtggatgatctattgcaaagcaccgtttgaccctgaattgtctgcttctacatccagtaactactatatgaatgtggactacttcatgcaaccgagcatgcgcaatataggatttaatgtaaaagtacaattctaaattaatgagaaaattattatgaagaaatatctaagaaatataacagtcggtactgctttggtattagttgccgggagttgtaccggtaattttgaagaatacaacaccaatcaattccagattcatgaagctgacccttctactttgatgaagtcaatgattgagacgattgtaaacattcaacagaatgactcgcagatgatggatcagatggtcggtcagttaggaggctatctgacatgtgcgaatgtatggagcggcactaacttcggcacattcaatcaaagtgatgcctggaatgcaggtccctggaatactaatttcgagaaaatatacggtaatttcttccagatacaggaagcaactaatgaaagcgggcactattatgcttttgcacgtatgatacgggccataaccatgctgcgtgttgccgattgttacggtccgatgccctacagtcaagtgaaaaaaggtaacttctatgtagcttatgacacagaagaacaagtctataagaatataatggaagattttgcaagcgctgccaacgtactctataactattacaaagataccaatggtaacgcaccgctcgccagcaacgaccctgtattcagcggcaattatgccaactgggcaagactcgcaaattccatgcgactgagggtggctatccgcatcagtacagcatatccggagatggcaaaagaaaatgcggaagctgccgcatctcatgaagccggactgatcgaagcaaataatgacaatgccatgatggattgcggctcgcagacaaacccttaccaattggcagctgtaagctggggtgatttgcgtgtcaatgccaatatcgttgattacatgaacggatacggtgatccgcgtatgtctaaatacttcaaccattcaacattcactggtcacactcaggaatatgtaggcatgcgctccggagaagatggttttgccaaaagtgacgttgcaggttattccataccggccatcacaggaacttcaaagctattggtattctgcgctgctgaaacagcattcctccgtgcggaaggcaaactgaagaactggtctgtcggcaataaatcggctaaagagtactatgaagaaggaatcaaactctccatggaacagtacggcacaacaatgcctgacaattatctgacaaataccgaaaaaccgacagtatcacataataatgatcccagaggccatgcatataccatctccaacaccgttgccgttgcatggaatgacaacaatgaagaagaaaatcttcagcgtatcattactcagaaatggatagccaactatccgttgggactggaagcatgggctgaatatcgccgtaccggttatccggaactctatccttgcatcgacaatctgtctccatcaggagtagacagcaagcgtggtatgcgtcgtctgagattcccttacacggaagtacagaacaaccattccaattatcagcaaggtgtttcgtatctgaaaaatggtggtccggataatgaagccacagatttgtcgtggggaaaaactaattaatataacctcctaactagaattaatatgaaaaagaattatttactatattttttattgttagcgttgagcaccccaatatgggtgagctgtaatgactggacagaatcagaagcaaaagattacttcgaaggtccttcagaagaatactatgcagccctgcgcgcatataaaaagtctgatcatcccaaagctttcggatggttcggcaactggacaggcgaaggcgcttcattagtaaacagcatggcaggaatcccggatagcgtggatgtcgtttccatctgggggaattggtcgaatattacagaagcgcaaaagaaggatctcaagttctgtcaagaagtaaaaggaactcgcttcaccatgtgctttatcatcacttcggtaggtacacagatcactccacaacatatatatgacaattgggagtcaatgggattcgcaagccaacaggaagctgttaatgatttctggggctggccttcggacgagtctgataaagaagccgtcgaagcatctatccgcaaatatgcaaatgctatcgctgatacgatcaacaaatacggctatgacggattcgatatcgactacgaaccaaactatggtaataaaggtaacattgtggacgacgatgacagaatgttcatattcgtagacgaacttggcaaacacttcggtcctaaatcgggaaccggcaagttattgatcattgacggcgaaccgcaaagtataaagaacagacccgatgtaggcccttactttgattactttatcattcaggcctataaacccggtaatgacaacaatctggacaaacgtctgatagacggtggtgtagcaggtccgggactcgttcagacttacggtagcgtaatgtccgaagagcaaatcacaaagatgaccatcatgaccgaaaactttgaggctgtagatgctgctatggatggcggatatccttataccgaccgttatggcaacagcatgaaatctttggaaggaatggcacgctggcaaccgaaaaatggtttccgtaaaggcggagtaggaagctatcatatggaagcagagtatccgacaaatccggaatacaagaatctacgcaaagctatccagattatgaatccttctaccaaaccgttaattaaatattaattcactatgaaacagattaaaaacataagaaacttcttgttgatatcgcttatcgcaggcggtacatggatcggctgtgacgatgcgaattatagtacattggacacgcacgtcttcttcgaagaagctttaactgcaacaagcaccaaagtgactgttatgggcagcggtgaaaccaatgtcacactgaacgcgcatatcagcaatacacaacagaaagacaacagctatagtctggcaatagatcaggctgctcttgacgcatacaacaaggctaatggtacaaactacatcgcattgccggaaacccattacacccttccggacaatattacgattaaggcaggtgcttataatgcagatcctatttccatacatatcaaagcattctccgaggaaatgaatgcatccggtgaatcatatgctttacccgtacgcctggtagccaaacaaggtagtattgatgtaatgcctgttaccggcagcttggtgattcttgccaatagtatcatggaattttccgccccgcaatttgtcggaagtacagaactcgtagccaagaaattctctgaagctcctgaaacctacaacgagtttactgtcgaagttcgtttccaggtaagcaatactgccaatcgtaaccgtgcagtattcagcacatccggcagcgacggcaagagcttgttattgcgtttcgaagatccgcaaagcgacaatagtgaccacaaagctcactcattagttcagattcagactcatgaaacctatctgaatccgacctactctttcgaacctaataagtggcaacatcttgctgtgacatacaacggttctaaatatcgtatctatattaacggtaaagacggaggttcaaaagacgttgccggcggaccttgtatatttggtaatatgagttggttcagtggcggtagctggtggagcggatgtaaaatcttggtaagtgaagcccgtatctggtctgtatgccggtcggaaattcagattcagaacaacatgactatcacaagtccaaaatctccgggattagaagcttattggagattcaatgaaggtaaaggtaatgtatttgaagatgctaccggtaaagggcatactattaccacaacagtcactcctgtgtggatagataagattctgtctacagatgaagctactccatggaaataaatgatggtacaattttaatatagttactatgaataaagtatttcaatcaataatcattacactcatgagtgcaatgatccctttcttctcatcttgcagcgatgatgattcggtcaacgaatgggatatgagctatgtttctttattgccggcagattatttgagaccgactccttcgtttacactaaagcatgtggaagaagaaggtattgaaggcagtgttgagtttcagtttatggctacaacacaaaaagctgttacccaggatataaatgtacactatagtgtcacctgtgatggtatagatgcaaacaaaatcaatctgtctgccaaaaatctgttgataaaagctggttctacagcttcagaaccgattactttgagcatcacagactggaagtatctagaaaataccaaagaagcgcttgagtatactctgaaaataaaaatcgcagatatcgaatcaacatcggcggaagttactaatgcagcatactatcaggaaatagttctgaaaatctctaaaaccgcagaaaagaaaaaggaaagtgtgctactgaccaacgtcaaagactggatattcacctttatgaccggagtagaaaattcggcatcaaactctgtcgcaggaacaggaacgaatgacgttgctacaaatggagtacctttctggttgacagttgacttcaaagaagttaaaaacgtcacaggcgttcaaacaacccattggggagccggatatgctccttcaaaagtggaaatattctcttcggagaatggagatgactgggtatccatcggacaatgggatactaaaggaagaactcagactatcacattcgacgagcgggttaagacacgttacctgaagtatcagatgattactgttcccagccgcgtagatatcacaaggttctatatttatgcatggtaataagcgtatggaataagttttccatcaattaaatatcggacaagagcagacttacaagaaaaatgtataagtttgctcttgtttttatatagagctacaatccacctttagcaaacataaattagataaaatgaaaaaacatcatctattaggagtcattcttttatgcagtggactattttcctgttcttcaggagttattcagcaggcaaactacgaagttattcctctgcctcaggaaatcaaaattacgaccggaagctttgtactaaatgaccgtacttccatcgtctatccgaaagataacaaagaaatgcagcaaaatgcaaatctgttggcgaaatacattcatcagatgtccggcaaaaagctgaaagtcattgacgagccagtcacttcaaacgcaataatcttagcaacaggtctgaatgcagacaatgccgaagcatatcaactaaaagtaacccaagacaacgtaaccatcacaggtacttcagaagcaggaactttttatggcatacagactttacggaagtcactcccaattacaaacaaaggagacataagccttcctgctgccgaaattaacgactatccacgtttctcctatcgcggagtacatttagatgtttcacgccatttcttcccggccgactctgtcaaacgctttattgatatgatggctttacacaatatcaaccgtcttcactggcatctgaccgatgatcagggatggagaattgaaatcaaaaaacgtccggagttgaccactatcggttccaaacgctcggagacagtcatcggacataattctggagaatatgacggcattccctatagcggtttttacacacaggatgaagctagggagattgtaaaatatgcacaggaacgccatatcacagtaataccggaaattgaccttccgggacatatgcaggctgcgcttgctgcttaccccgaattgggttgcacgggcggcccctatgaagtatggaaaatgtggggagtatcagaagatgtgctctgtgcaggaaatgacaagacactgacatttatagaagatgtcctgaatgaaattatagatattttcccatccgaatatattcatgtcggcggtgatgaatgcccgaaggtacgttgggagaaatgcccgaaatgtcaggcacgtatcaaggaactgggactaaaagccgataaaggtcacacagccgaacaaaggcttcagagttatatcattaattatgctgaacagtttcttaacggcaagggacgtcagatcattggttgggaagaaatactggaaggaggactggcacctaatgccactgtgatgtcatggagaggtatagaaggaggaattgaagcagtgaagcataaacatgacgcaatcatgacacccagttcattcctgtacttcgattactatcagaccatggatacagacaatgaaccgcctgctatcggagggtatgtacctttagaaaaggtatatagctacgaaccggttcctcagatactcactcctgaagaagctaagcatatcgtgggcgtacaagccaacttatggacggaatatacccctacttatagtcaggtagaatatatggaactaccccgtatggccgcattatcagaaatacagtggactatgccgaagaaaaaagaatatgcggatttcctgaaacgattgcccggactgatcgctgtctatgacatcaatcaatataactatgccaaacatatcttccaggtaaagtcccaatatatacctgataccgaagccaacgtattgaatgttgttttatctactattgataatactccggtctactatacacttgatggcagtgaacctacagccagttccaatatatacacggacacactgaaaatcggccaaagctgcacactgaaagcaatcactatccgtcccaacggcagtagtgcagtgttgaaagaggatatcaaattcaacaaagccaccatgcagccgatcaccatgcagcagcccattaatgaaaagtataaattcgaaggaaagaatacactcattgacggactggcaggaagcagaaattaccgtaccggacgatggattgccttctatcagaacgaccttgaagcagtgattgacctgcaacaggagactccgataagcaaagcatgggtacgcacctacgtagaaataggagaagaaattcttgatttacgcgaactttccgtagccgtatcaaacgatgggaaagagtataaagaagtaaaatccgaagtttaccccgccgtcagtaaggaagataagaatggcatctatacccatgaactttctttcgatacagtgcaggcacgttatgtaaaaatagcagcccgtccggaatataacataccggcatggcattggggtaaaggaagaccggcatttatattcgtagatgaaatagggctggaataaaacttaaaaaggtatgtcgctgggcgacatacctttttttaacattctctttatcctctttattttttagacaatcgaataatccgtccttccttcttatagctgaagtgatttgtatgcatcaatacattcaatatttcgtccggaagattatcagtagagaattcaccggtgaaccgttcggtcttcagactttcgtcatcatacacaaacttcaagtcatacagtttctccataatatttgtaatctccagcaatgaatgttgcttaaatttcaattttccgttaatccacagaagaacttcggtcggctcggcatattctattaattcagcctgataggtcgttgtattaatgttcaacgtttgtcccggtttcagcagatagccattattgacggttcgtggagattccattcgtacagaaccttgcaacagagtggtcactaccctgtcctcttcttcacgtgcccgtacattaaactttgtacccaatacacaagtcttaatatgcttcgtatttacaatgaatggagcatgcttgtcacgagccacttcaaagtaagcctcgcccgacaaatcaatctgtcgatccgtactccagaaagagttacggtaaataagcttcgtagatgcattcagccaaaccttactaccgtccggaagcactgtttgcgctctctgtccaccggtagtcatcactgtataatcagaaagtttattggaaagcaatccccacgcaattccgcctgcgaaaacaagacctgccagaaaagcggctgtcgcggacgcataacgtccccatcgaaccgatatacttcttcgcttggcttttttctccttttcacgtacgagcgacttaaacttcgtcagtgacgcttctgtgtctacagcatccatcactgccatacggtcgcctacaaaaagggtataatatagctgctctagtatttgtcggttttccggtgcttcttcacaccatagttctacctgctgacattcttcgtcattgcatcctcccctcaggtagttcatcaagatagattcatccatgttcaatcatccttttactataaaaaaatataatacctc

SEQ ID NO: 150 - DNA, 18684 bp, Bacteroides thetaiotaomicron
atttaatagcaatattttaagatattcagtgatcggttccgcaaacaatcaaaacaatcactatttatggaagcgcggataactcgaaaaacagcggcacttgcaatctttctgatcagtgcatttcagacttacatttatgccggccgcccctcttcttgtcaactattaattatcaattcttataccgaaaactgtctgtggagcgatgactttatggcccctgtctataaagagtttcgcgtccagaacagcccggttgacatatgtgccgagcacatggaactgatggcgaccgttgtcccggatatgcgcaaacaggtcttcatgtccgacaggcgctggatcagtgcgcaatgcaggaaagaagcggaggaagtgatgcctttcctgttgatcggcggctatttctggacagatagtgaaataaagaaacatctgctcccggtgatcaaaagccgcctggacggagcgtcgcatccgcacagagtggaaacgacagcgatggggacgcccccatccgtcatcaattatgccgactacgtagagagcggactgttgctcggcctgtgtcccgacgacactgtttttggtatgaagccccccacttttttcgagcggaacaaatattatctggccctgtttttctctttgatggcactggccgtcatctatgtgatatggctccggagggcgctgcatgagaggagcaggctgctggagatcatgaggagctatagcagtctggtcgaaaacatgcccgttctctatgcccgtgtcgagctcatattcgaccccggtggccggattatcgactatgtctaccgggaagtgaatcccactttcgagaaatacatcctgcccaaagaaaaaatactgggaaagaaatacagcgaactcaatccggattattcgccggaactgcccgacaggtacagcgaactgaatgacaacaggcaaataacctttcagtattatctggagaagacgaaaactcatctgaccgtcatctccatacattccaaaacgaaaggctgcgtcgatgtctttggtgtggacaataccgaactggtgctgacgcagcaaatgctgaaatccaccaaccataagttgtccgccgccctcgacgctgccgacatgaccccttggaaatgggatttgcggaccggcctcctctcgtgcaacgtcagccacgacttgtacgtcaccgaagaggaggtgacgcatgacggcaacctgattatcgtgcccacctccgcctgtttcgcgaaaatctgcgatgaagaccgcgaacgcgtgcgggacgccttcgagcacctcgccaatggcgaaacgcagaaaatgcgcgaggaatatcgggtaggcagacagtggcttccttccccgcaacagaatgaatgggtagaagtgcgcgcagccgtggacgagcgcgacgcgaacggaaaaccgctgagccttatcggcacttcgatgaccgtcacccaacgaaaggaaatggaggaagcgctcgtacaggcaaaggtgaaagccgaggaggcgaacacgctcaaatcttctttcctcgccaacatcagccacgaaatacgcactcccctcaacgccattgtcggcttttcctcgctgctggtgtcggcggaaagggggatttcggaagagaaacaggaatatatcaacatcattgaaaacaacaacacactcctgttgcagcttatcagcgatgtgctcgacctttcgaagatcgaagccggaacgatggagttcgactacgccccgatagatgtgcacggcctgtttatcgaactcgaagatacgttccggttgaggaataaaaagtccggcatctgtatctgctatcaccgccggacgaccgaatgtgtcgtaaaggcggaccgtaaccgtctggtacaggtgatgatgaatctgatgaataatgctgtgaagtttaccggggaaggcagcattgagttcgggtttgatgtgcgcgaagacggtttcctgcatttctatgtcaccgacaccggttgcgggataccggaggaacggttggaagaaatcttcgggaattttgtcaaactcaacagctttgtgcagggcacgggactcggactcaccatttgccgggcaatcgtcgaaaggatgggaggaaagatcggtgctgtctcacggctgggtcaggggagtactttttggttcacgctgccttatacggccaacgaagagaagatttgaaaaggacgtggcgtgacggaaatatacttgcttcccgaagaatggggcttgactaaaaagtcagccccttcccgaagggaggggaagccatgcggatagtcagctcgaatcaaggctcccccaagaaacggaagatgagccctacttgcgccggagtgagcaggatggctttctcggaatatcccgtgcgggcgagttcgttttgtagtgccgtgttcttggcgatccagctgcggagagtgcggcgtgcggaggcgggctgtatgtggggcaggtagagagtggccagttggcttttgctgtatgcctgtatgcggggcagggttgcattttcttcggaagttggtttcatgatttttgctttcattgtcttttgatactgcttttactatcttttctatatttctttctttcattttcgttgccaatgtaaaggtacgccttttttagtcgtttggtgttgctttgtacagaagtccttggaggcagtatttgtgcgaagccgtgccgactggtgctcttcagttacaagtcgttacatcgtgtatccggacttttttgccatcgcctacttttgtcaccgtaatcgattgcacatagaaaacttacatcaaccattaaaaaaagaaaggaaaacaaccttatgccattaatttacaaaccttaccaggcgaatatcgccaacaaagcgggacagaaactgtattacccccgcctcgtgaaattctcgaaaatggtcaacacgcagaagatggcggagctgatcgccgagaaggcttctctgacaccgggtgatgtccacaacgtgattcgaaacttgatgtccgtgatgcgtgaacagttgctcaacagccgcacagtacgtctcgaaggcttgggcacatttacgatgatcgccaaagccggaggaaagggagtcgtgttggaaagtaaagtcagcagttcgcagatcgtttcgctgcgctgtcagtttactcccgaatatacccgttctgccgatggcgtcactacccgtgcactgacttccggagtagaatttgtccacgtcaaggacgtagcgggcggctttgtggacgacgatgataaaaatcattcgggaggcggagacaaccccggcggaggaagcactcccggaggcgacgacgatgaggctccggacccaaccgtttaatgaggctgaatcgctgactcactaatgcatgatcggttcccttattaaattgctccattcactctgttttttaactctaaagaaggaagctatgaaattatttttagaaaagttattggatattttggaagcactcttgcgcttccgtcgtcggaaagctaaaaagacgggagattcataaaccgacctcctctcttaaaaactagagaatccccttttatttaaaaccgtatctgtctatgatatggggttgaataaaggggatttttgtatgggaaagtaataggtaattgtatagtaataggtagtggaatttaattcatttcatttcttgtgcgaaatgattcatacctgctctgagatgtaggatttatggaaaagtgtattatcaaaaaatggggtcacctatacccctgtttgctacattatgttttttgagcccgataatgcggtagttggagaattttgacatctataaaagaatatcccggcagattggataacagtcaaccgtccaatcataaaaagggctgccccaattctgcttgggagcagcccttcttgctttttccggtttatctctaatgcattttatttaatcagatagactttttgaagataaacccttttgttgtgtgcttttgggggatgagccaccttacggcatttctgtttccatttggaatttccggcttaccttcatcaggttaatgatgtaagtcactacattttgagcttcctgcaccatggtcagataaaccatacttacccggatactgcccgactggctttggatgcgctgcaactctttgcgtttcagttgcgatagctgtccgttgaggtcgttggcacggcggatttcctcttccatattctgataatcgttgttttccaacttcttgcggcattgctgaatcagataagtgatgtcctcggccacgtcgctgaattcacctttctgaatggcgtcgagcgggttgaagttattgtcgatgtgttcaagacacggttcgcagaggcgcgagatgctgtacaccagttcgctggcgaagtcgttgccttgatagtagtagagtcctttttcgagcacggtgttgttgtcgaggcggcacatggcaacggttccggtgcgtttcatctgcttgatgagctgcttttcgaatttcgtggaacccatggcacgacgcagtccgcgcaggttttcgtgtataaaggaggtgacggtcagttcgaaattcgtttcggcgtactccagcactttggcgagttcttcgcgggtatgtttacgcatcagttgcagcgcttcttcgctgtcggcggtctgcatgagttgtttcagcgtttcgttgcctttctctttcgccttgcgtttcttatacatcacctggctgcggatgaggatgaaaatcgctattccgatcagtgcgatgatggagatgttgccgccgtagtgcagcacgagggctacgaagaagcagatggtgaaggcggctccggcagtgatgaaccagccgccgatgacgcttagaacgcctgtgatgcggtagacggcggagtcacgtccccatgcacggtcggcgagcgacgtacccattgctaccatgaaggtgacgtaggtggtagagagcggcagtttcagcgacgttcccaaggcgatgagcagaccggcgaggacgaggttgacagaggcgcggacgaggtcgaaagcggctccgtcggctatgatggcttcgtttttgcggaaacgggagttgatccactgcttcgtgctttcgggcatgatgcgggaggtgccgttggcaagtgtcatgctgaaacgtaccagtgtgcgtgccatcggggtacttccgaagttctcttctccttcatcctgacgggagaggtctaccgaggttttgatgacggcgtgcgcctttttggaggtgcagagggcgtagaccatgatggcgccggcaccgataaggaagtaccacggtgtcttggcggggcctagcagcgaggtcatcaggaagctgtccggacttgctccggctccgttggtggtgtagtctatgaaggaggagtagcctgcgagggggactccgatgaagttgacgaggtcgttgccggcgaaggcgagggcgagagcaaaggtgcccatcagtaccactactttgaaaacattgactttgagccagtgaagcacttgcatcagtgccgtgaagaagacgaagaagctggcgatgagcagcagcgtgttgtcctgtatccactgtttgttttcgggggtcatgaaggagctgtctttcaaccctttgatcagcatgaagtagatgatggaggtggcggcgatcccaccgaaaaggccgatgctgtatttgatgtttttcgtgtaattgaacgtgaaaacgatgcgggcgagccactgtactaacataccgaagaagaaggcgatggctacggacacgaaaatggccatgatcacggaaagtgctttgtcggtgttgatcagatcgcccaacgcaagggtggcgtcattgtttactttgatcagggagagggcgaaagttcctccgagcagctcgaagaccagtgagacggtcgtggaggtgggcatgcccatagagttgaagacgtccagaaggactacgtcggtcagcatgacggcgagcagtatacacatgatttcggcaaagtagaaatgctcgggctgatagattccgtgacgggctatgtccatcatgccattggacagggatgcgccaatgaaaataccgatcccggctatgaaaagaatggttttgaacgaagcggccttggcgcctaccgccgaattcagaaagttgactgcatcattactgactccgacgatgagatcgaacacggccagcacgaacaggaaaatgataatgcataagtaaattgtctccataaagaaagttgtgtatgtttatttatggaggcaaagaacggagtttaacgttgcggaaaaatgtcatacgtgttacatttctgttacaatgtcttttttgagccattcataaaaatcgtattgggcacggacagcaggggtgccggacgctctttttttgaatacgttttgcagtttgtcgtctacccaacaggctttttggttgtcagcgagctggatatggagcatttcgatcagactggcgcgcaggtcagggtcgaggatgggggtgacggcttcgatacggcggtagaggttgcggcgcatccagtcgggcgagcccatgtatattttggggtgcccttcgttgccgaaataccagatgcgggcgtgctccagaaaactgtcgacaatgcgggtgacacggatgttacggctgtatgactgctccggtatgaggcagcagatgccgcggacgatgaggtcgatctgcacgccgtgttcggaggcctcgtagagtcggtcgatcattgcggggtcttggagggcgttcattttgaggatgatacgtccgcctttgccttggtcggcaagggatatttcacggtcgatgaggcggttcagttccggtatgaggttgaagcgggcgacgaggagagtggtgaatttcggatcttccttgccttgcagggtgcggaagaggttgtaaaggtcgttcactatttccttgcggcaggtgaaaagtccacagtcggcgtatagggtggcggtcttttcgttgaagttgcccgtgctgatgtaggcgtagctggggattttctctccattcagtccgcggcgacggacgagggccactttggcgtgtacttttagtccggggatgctgtaaatgattttgatgccggcggcttgcatcatttcggcggtggcgaggttgttctcttcgtcgaaacgggctttgagctcgacaaatacggtgactttcttgccgttctgcgcggcggctatcaaggtgttgatgacggccgagttttcggctacacggtattgggtgaccatgatttcgcgcgtctccggattgtgcactgcttcgtagaggaagtgggtgaagtgctcgaaggagtggtacgggtaatacagcagcagatccttttgggcgacgtagttgaagatcgattctttttcgtcgaggatgttcagcttcatcggttgcggcttttcgatgcggcgtagagacttgttcgggttgggcaggtggcgcaggtcttcgaggttcaggtgcttgtcgccggggacgagttcgtcacggtggatgcggaaggcgtcgaccagaaagtcgaggaagtcttgcggcatggcacggtcgtagacaaagcggcagacgtcgcctatcttgcgtttttttaccttctttttcagttgagctacgaggtcggcgctgctggcggtgtcgtctatcagaatgtcggcgtcacgggatattttgatgcagtagctcgaatcgacgtcgtagccggggaaaataaggttgaggttcgctttgatgatgtcctcggtgaacatgatgtaatagttgtctccacggggcggaagttcgatgaaacggggcactttggcgtacggctgcttcatgacgaaatagaaaggctgccggttggcggggttcctgttttccttcggatagaggcggatggcgaggtagagccggttgtctcgcagaaaagagacgattttgtctttcgatacgggcacgggttgcaggtaggggaagatttcttcccggaaaaagtccttgataaactgctggtgaaacggttccacatgtctgtcctggtagaagatgatgtggtttttgcgcagggcgggcagtatcttttcttcgtaaatgcgtacacggtcgtccagctggcggtttacttcgtggttgatttcttccacgagttcgcgggcggattgtacggtttcttcatcgctctccgttgcgccggatgccacggccttgtggtccgccacccggattttgtaaaactcttccagattggaggagtagatggagatgaaattgatgcgctcgtatagcggcaggtgctcatccagcgcttcgagcaacacccgatagttgaatgagagccagctgatatcacgtttgaaataattatatttgctttccatgtgctttaagattttcccaaatatagtatctttgcaggactaaacaaagaaaattatgacaagaattggattattgtccgatacccacgcttattgggacgaaaaatatctcgaatattttgaatcgtgcgacgaaatctggcatgccggagatatcggttcggtagaagtagccgagaagttggcggctttccggcccctgcgggcagtttacggcaacatagacgggcaagaaatacggaagatgttcccgcaggtgaaccgcttcacggtggacggagcggaagtgctgatcaagcatatcggcgggtatccgggcaagtacgacccttcggttatcggcagtttgatggcccgtccgccgaaacttttcatcagcggacactcccatatattaaaggtgaaatacgacaaaacgttggacatgctgcacatcaatcccggagccgcagggatgtccggtttccataaagtgcggacaatggtgcgctttgtcatcgacaacggaacgttcaaagacctcgaagttattgaactggcaggatagatttcttacaattcattttgtcacgtcagatttctttccgacctttgcacacagtaaaatgaataactcagacgacaatgaaaggaattattctggccggtggaagcgccactcgtctttatccgctttccaaagcgatttccaaacaaatcatgcctgtatacgacaagccgatgatctattatccgctgtctacgcttatgctggcagggatacgggaggtcttgatcatctctactccgcgtgatttgccgatgtttcgggacttgttgggctcaggtgaggagctcgggatgtctttctcttacaaaatacaggagcagcctaacggactggcacaagcctttgtgttgggagctgatttcttgaacggtgaggcaggttgtctgattcttggggacaatatgttttatggacaagggttttccgctatgctccggcgtgctgccggtgtggagaagggagcctgcatcttcggctattacgtgaaagatcctcgggcttacggtgtagtggagttcgacgaacaaggcaaagtgatttctctggaagaaaagccactggtgccgaaaagtaattatgccgttcccggactttatttctacgacgctaccgtgacggaaaaagcggcttctctccgcccttcggcacgtggagaatatgagataacggacctgaaccgcctgtacctcgaagaaggaacactgaacgtggaactgttcggacgcggattcgcatggctggatactggaaactgcgacagcctgctcgaagcctccaacttcgtggctaccattcagaaccggcaaggcttctacgtcagctgtatcgaagagatagcctggcggcaaggatggatttcgtccggacaattgctgctgctcggacagaaactcgaaaagaccgaatacggtaaatacctgatagaactgtctaaacaacccttgaaataaacataaataatcatatatgaaaacttatctggtgaccggtgccgcaggatttattggcgccaattatattaagtatatcttggccaagcacagcgatataaaagtggtggttcttgacgccctgacgtatgcgggtaatctgggaactattgccaaagatatcgacaacgaacgttgtttctttatcaaaggagacatttgcagccgcgaagtggtggacagcctttttgccgaataccgtttcgactatgtcgtgaacttcgccgccgaaagccatgtagaccgcagtatcgaaaacccgcaactgtttctgatcaccaacatcctcggtacgcagaatctgctggattgtgcccgccgtgcctgggtgatgggtaaggacgaacagggatatcctacctggagaaaaggagtgcgctaccatcaggtatctaccgacgaggtgtacggctcactcggtgcggaaggctacttcacggaagaaaccccgctttgtccgcacagcccgtacagcgcttcgaaaaccagtgccgacatggtagtcatggcttatcacgacacttataaaatgccggtaacgatcacccgctgttccaacaactacggcccctatcattttcccgaaaaactgattccgctgattatcaagaatatactcgaaggcaaacatctgcctgtctacggtgacggaagtaacgtgcgcgactggctttacgtagaagaccactgcaaagcgatcgacttggtagtgcgcgaaggcaaagagggcgaggtgtacaacgtaggtggtcacaacgaagaaaccaatcttgaaattgtgaagctgaccattgccactatccgtaaactaatgaccgagaaaccggaatatcgtcaggtccttaaaaagaaagtgaaaggtgaagacggagaaatctccgttgactggatcaacaacgatctgatcacttttgtcaaagaccgtctggggcacgaccagcgttatgccattgatcccacgaagatcacgaacgccttgggctggtatcccgaaacgaaatttgaagatggcatcgtgaagacaatcgtatggtatcttgaaaatcaagactgggtggaagaggtgaccagcggagactatcaaggttattacgaaaagatgtacggaaaataaatcaatgtcggatcaagaatcctattgatagcaaaatacccattaacagcatattacgtgaagtctcacctagtatgctgtttaattttttaccactgtgaatctgcaccatccgtctccatgtgaggacatgaggaatcaggtagagtaacggaagaagtgcggcaaacaagtgtccttcgaagaagaaccagaaacacagaagacttgctgccacccccagcatcaaataaagatagcgtccgaacttctcgccaaaacgaacgatgaccgtccgctttccgctccgtgcatccgcttcacggtctcggtaattgttgactaccagcaaggtatcaatcagcagtccgcagatcagagaagctaccgttgtgtccgaagtccatgtcagcgcctgcacgtagtacgttccgcccacggggacgaatccgaaaaatacgatgaccagaacatcgccccagccgttgtaggataatggataagggcctgtggtatagaggaaagcgaagagtacgcagagaagtcctactatgatcagctcccatccggcataaaacagcagcgcagatccgatcagacaggcgaacaggacggtgacgatgattccgtttcgcatggctctcggtgaaatccagccttgtgcgcaggctcgttccggtcccagccggtcttcgcggtcggttcctttgaggtagtcgaagaggtcgttgataaaattggcggcaatttgcatcagaccggcgaacaggcagcagataagggccggcaaccattgaaaatgtccatccatataagcaagtgcgctaccgatcatgaccggcgtaatggctcctgtcagagttttgggacgtgctgctaatatccacgcacgcagcgagttacgctttacttcttccatgctttaatatataataataagttttgacggacaaagatacatgatttttcctatctttgcgcctcaaatagtgggggaatgtgttatatgtagaagaaaataaaccaaagaagatgaaaaaaataaattacctgttcataatattcgtattattcctgttcgtatcttgtaagtcaaagaagaatgttgtatcgatcctgcctcgtcctgtgctcaatgtcgattccgtccgtccggacagttccgccgctatcgacggcttgtttgctccggatcattctcagcttgccgacttgaaagtttcgacgaaaaagcagaagaaaacagcgaagaaagaagctgcgaccgagcaggaagaacgtaatttggtacttcgcggaacgaagatcacgtcttctaccgtgaacgtccctgccacttatagcggcatagaccgtgtcgtggaatatgacttcacccaccgtgatgtccccgaagccttcgaaggcttccgcatcgccttcatttccgacttgcattacaagagtctgctgaaagagaaaggcttgaacaaccttgtcgatcttttgatcgcccagaaaccggacgtcttgctgatgggaggagactatcaggaaggctgtgaatacgtagaaccgttatttgccgcattggcccgtgtgaaaacaccgatgggaactttcggagtaatgggaaataatgactatgaacgctgccatgacgaaataatccgcacgatgaagcattacgggatgcgtccgctggaacacgaagtcgatacattacgcaaagacggtcagcagattatccttgccggagtacgcaatcctttcgacttgaaacaaaatggggtgtcgcccacactggcgctttctcccaacgacttcgttatcttgttggtgcatactcccgactacgtggaggatgtttcggtggccaacacggacatcgctttggcgggacatactcatggtggacaggtacgcgtattcggttacgccccgatacagaactcccactacggcacccgctttctgaccggactggcgtacaattcaactaaaatgccattgattgttactaatgggatcggtacttctcagatgcctgtacgaatcggtgctccggcagaaatcataatgattacgcttcatcgtctcaaagagtagatacacttttaggtacgactttctgatgaactccacacttttaggtacgactttttgtgttattagcacatttttatgcatgactttttgttcttttctattcagttgcttatatttgcagttcataaatcgttgattataaaagaataaatatgagaagagatgcaatgcaacagttatatgactggaaggagaagacaacacggaaacctttgattgttcgtggtgcccggcaggtggggaagacatggttgatgaaagaatttgcatcatcagcttacagacagtttgcttacatcaattttgaggataacgaagtgatgaaagatgtttttcagaaagactttgatgtcgagcgcattctgatggctattcaattagtgaccggcatcgtagtagatactgagacattaattatttttgatgaaattcaggaagcgcctcgcggattgacggcattgaagtattttcaagaaaaagctcctcagtatcatgtggttgcagcaggttccctccttggcattgccatgcatagcaatgattcttttcccgtcgggaaggtcgattttatggatttatatcctctttctttttcggagtttttggaggctgtcgggcaagaggcttttgcccgtttacttgcaaaaaaagactgggggctgatcgctgcttttcgttctaaattgatagatttgctcaaacagtattattatgtcggaggaatgcctgaagttgtgaatgcctttattaatcataaagactatgccgaagtgcgacagctacagcagacaattctggattcttatgatcgtgatttctccaaacatgctcctattgccgaagtgcctcggattcgtatgatttggcgttctgttccggctcaattggctaaggaaaataagaagtttatttatggtgtcgtgaaggaaggagccagagcgaaagattttgagttggctattgagtggctgattgatgcaggacttatttacaaggttagccgagtgaaaaaagccggaatcccattgtcggcttatgaggacttttcggcatttaaattatttttgttagataccggattaatgggagctatgagcgggcttccaccgcaagcgttattggaggggaatgtgttgtttagtgattataaaggagctattacagagcagtatgtattacaacaattgaagtcagtgaaaggactgagtatttactactggtcttcggatacatccagaggagaactggatttccttttacaaaaagatgttagcgtcatccctgttgaagtaaaagctgaggaaaatctgcaatcgaagagtttgcgtttcttcgtagagaaaaatgcgggattacacggagtacgattttctatgtcagattatcggaagcaagagtggatgattaattatccgttatactctgtcggatatattctctaatatactcccaaacctttggatgcaagaagtatcttacatctttcttctcatcaagtgcctgacggataaacgtcgaacttatttcaaaggtaggcgaatggaccagacggactgtttcgggcagcccgttttcatttaccggaaatccggggcggggatagataagaatacggttttctttgatgatgcgctccgattgataccagcggtcgaagcgggcccagttatccgagccgataattaagtagaagtcccgttccggataggtttcatgtagcttttccaacgtatgtacgctgtatgaagggcggggcagatgaaactcgaagtctgaagagcggaagcggggatattcttctgtggcaagttctactaaccggagacgcaggtcgtcaggccatagctccgtccctgctttcagcgggttttgcgggctgaccataaaccaaacttcatccagttcttcatattcgcaaagatagttggccaaggccagatgtccgatgtgtaccggattgaatgacccgctgaagattccggtttttagtttattgctctctgccattctcatcttctcgtttttacttttttcttcttgatgccttcttatctttctattctttgttctttttttgctcttttgggttctcttttagactttctttttcagccttgactttctgtcatcttcttggcttccctttccattctcagcttttttctccattttggaaaaacgatagcctgcctcacagcaattaagaaaaagatgccggcggcaatccaaaaatgcagataaagtgaaaggatgccgaacactatatctacaatgccgataatgccgcacagatacatgaatttttcggtcgatccctccttcttttctatgctctctattcgttttttcagagattctttcattccttattcagaaattctttgataacctccagcgtctcagcctttgccgcttccagatcatcattcacgatgacacgatcaaactggggagcaaaagtcatttcgtattccgcctttgcgatgcggcattcgattacttcgggctcatccgtgccccgacccgtcagccggcaacggagttcttcgatggagggcggctgtacaaagatggacaatgcacgctcaccgtaatactttttgatgttgcatccgcctactacatccaagtcgaatactacgttctgccccttctccaactgcttttccacttgttctttcagcgttccgtaataccgatccttgtatacttcttcgtattccaaaaactcgttgttctcaatgcgacaacggaactcttcgggagtaaggaagaaatattcgaccccgtgtttctccgtcccgcgcggtgggcggctggttgcagaaatggagaacgcgagatttaagttctgcgtcagcagatagttgataatagtcgatttgcccgaaccggacggggcagaaaaaataattaacttgccagtcatttgtttaattgagaattgaaagttgaaaactgaaaatgtcgacattttcaattttcaacttactattaaataattacattacgttcagcacctgttccttgatctgttccagttcatctttcatttgcacaacgattttctgcatttcggcatggttggacttgctgccaagcgtattgatttcccgtcccatttcctgagcgatgaaaccgagctttttgccttgtccgttgccgctttccagcgtgctgatgaaatatttcaggtggttggtgaggcgttgtttttcctcgttgacatccagcttttcgatgtagtagatcagctcttgttccagtcggttcttgtcatagtccgtgttcagcgtcttttcgagcgcgtcggtgatacgttccttgactttctccacccgttctttttcgtaaggagttatcttttcgagcaatagtgcgatgttagctatcttttcgcggaacttcttttccagtgcggcgccttcctgtttgcggaagtctaccagatgaccgattgcttcgagaacggtggcacgtaccatttcccattcttcttccgtcaactcttggatttcagtcttagacataacgtccggcatacggagcaacgtctgaaaccagtcggtggggacggggatgccgagattttccgagatcgcctgaatctgtttgtagtagccttccaccaacacttggttgataggagtcgcgctttccgcactctcttttttctctatccagaggctgaagtccacctttccacgctccagcactttggagatttcgttgcggatctcgatctctttttcacgataagccggagcgatgcgagtggaaagatccattgctttgctgttgagcgacttgatttctacgtttatctttttatctggaagttcggccgtagctttgccgtatcctgtcatcgactgtatcatatacttaaagttttgtgcaaaagtacacgaatattttaagaattggaaataatcatgtaaatttgcgacaatttaataagctgatttttatgtcgtgtatactgaatattgaaacctctaccactgtttgctcggtagcggcaagtcaagacggacagacgatttttgtgaaagaagacttgaagggcccttcacacgccgtgtctttgggagtatttgttgatgaagcgttgtcgttcattgatagtcatgccatacctttagatgcagttgcagtgagttgcggtccgggatcatacacaggattgcggattggagtttcgatggcaaaaggcatttgttacggacggaatgtacccttgatcggtcttcctacgctcgaagtgctgagtgtgcccgtgttgctgtatcacgatttgccggaagatgcgttgctctgcccgatgctcgatgcccgccgtatggaagtgtacgctgccgtttacgaccgtgccttgaacgtgaagcgtgctatcgccgccgatattgtcgatgagaattcctatctggagtttctgaacgaagcgcccgtttatttctacggaaatggagccgccaaatgtcgtgagaagattacgcatccgaatgcgcattttatcgatgacatccatccgttggcgaagatgatgtatccgctggcagaaaaagcagttgccagagaagactataaagatgtggcctacttcgaacctttctatctgaaagaatttgtagcctcgttgccgaagaagtcgcttcttgaataacgcacttcagtagaaaaaagtgcctcagtaagtgaaccgcctttggcgggaaacagtgattagtgagtgaccgtcgtcctccgacttttaatttttaatttcaaaacttttaatttaaaagatgcaatacaatacccagcagaaaagaatgccgcttcccgagtacggccgcagcatacagaacatggtagattatgcgttgaccattcaggaccgtgccgagcgtcagcgttgtgctaacacaattatcaacattatgggaaatatgttcccccatttgcgtgatgtgcccgatttcaagcataaactttgggatcacctggccatcatgtccggttttgagctggatattgactatccctacgaaatcatccgcgaagacaacctggtgaccaagccggaaccgatcccatattctactacccgcatgcgctaccgccactacggacacacgctggaagtgctgatcaagaaagcctgcgaacttcccgaaggaaacgacaaaagaaatctgacagccatgatctgcaaccacatgaagaaagactacatggcatggaacaaagataccgtagacgaccgcaaaattgcggaagacctctacgaactttccggcggcaaactacaactgacagacgacatcatccgactgatggcagaacgcctgaaccagaactaccgcccaaaggtgaactacaataataatcggaataataatccgcggagaagatattgaagtattaggtattaagtattaagtattagcgcggcgatgttgtttgctgtatgagattttgcacttgcggtctaatacctaatacttaatacctaatacc

SEQ ID NO: 151 - DNA, 18273 bp, Bacteroides thetaiotaomicron
gttaattggttaatagatcaataagattaaaacggaaaaagaaataattttatgaaatattcaataattacggtttcttttaatagtgaaaaaactatagaaagaacaataaaatctgttctgactcaaaacgagaacgattatgaatatataatagttgatggtgcgtcaaaagacagtacaattgatatcattaagcataatgagtctctttttgagggacgtttacgttggataagcgaacctgattctggcatctataatgctatgaataaaggaatcgcgatggctaagggtgatgttattggcatagtaaatagcgatgattggcttcagcccgatactttgcagaaggttagcaaatatatagaaaattataacttggaattgaagactccatttattataacgggaaatatggtctttcattatgaggatggaacatcggttgtaatgcatggctcatacaaaaagtatgagaaattcgcaaaagtttatcgtatgggactaaatcatcctgcaacatttgtttcgaagaaagtatatgaaacaattggagtatttgatgaaaatctgcgcctatttgcagacgcagatttgataacaagatattatcaagcagaattaccaatatattttgttgatgaaatattatccaacatgaaagatggaggtgctagcaattcgcattcaaaatatgctctacaagataacaagtatatactacataagtattgcaaatctgagactgagtattattggcttttatcaaaaagacgtgcattagctctgataaaaagaatatcgtatcgatgggtggtaaaatatcgtgagttattggggtgacactatggtaagctccaattaatatgtgcaatctgtcatctttaagtaaacgtccaaaaaagatatattgtggtaaatgttttccgtaaatgctcactagttcttatttttcttttatttctaccttgcttttcataaattaaaatatccaattatgagcatgaatgaatttcatagtgatttttgctttgttattaaatgaatgctaacaattagagaatgaaggaaaagttattttctgtattaatgtcagtttattacaacgataatcccaaatatttgagagctgcagtagagagtgtttctataaaacaaactctccagccaaaagaattaatattggtagtcgatggacctgttccagaacttgttaaaagtgagatcaaagctctttgtggagaaattccgtacataaaaacattatggaaacctctaaacgaaggcttaggaaaagcattgcgtgatggggtattaattgctacttatcatatcatcgctcgtatggatagtgatgatatttcttcgcctactcgttttgaacaacagataaaatgcatggagcaggatgacaatattgatattgtaggaggcagtattagcgaatttattgacactcccgataatatcgttggttacaggactgttcctgactcagatgctgaaattaaagattatatgaaatctcgttgcgcactgaaccatatgtctgttatgtttaagaaagagtcggtgttgaaagtgggaaactatcaagattggtattggaatgaggattattatttgtggattcgtatgcagttgaacggatgcaaattcgcaaacattactgaaaatcttgttaatgtgcgtgtagggaaagatatgtatgctcgaagaggcagtatgaaatatttcaaaagcgagaagggcattcaaaagtttatgcttgaaaataagctaattggttatcctcgttattgttttaatgtcttggttcgctttatggtccaagtcgttatgcccaattgcctacgtggttttttatttcaaaaaatttttagaaagtaattatgaaaacaacacaaaaaaaatacggaatagtaacgcactatatggtgcataatcatggcgcagttctacaacttacagcgttgatacgtactcttaagaaaaaaggaatagaagcatctgccttacagtttgaaaagagttatgactttatggggcatgcggttcgtgctaaatatgaaatatccattaagtcggtaggtatctatataaagtatttgatgagtgagggattcagaaaaacatggtataattttcgaaagagtagaaccctttctcattttaaaaaagagacaggaatcataggtccatattatacagatgcaaaagatttgaatggtgtaataatagggagtgatgaggtttttgctctacattcaggtcctacccctgttttttatgggcatgctgcaccttctaagaaagtctttgcttatgccggatgtttcggtccaactacatataaagatgtcgtagaattgcattgtaaagcttttgttgaaggtggtttgcaagctatgtgtggtatatctgtacgagacgaaaacagtcgtgaagttgttgaaaaattaacaggaataagccctaagttggtttgtgaccctgtgttgctttatggctatgaagaagaaattgctaagatggaaaagcccatcaaagataactatttactaatttatgcttatgatggacgtatggacactccggaagaagtagttgccattaaaaattatgcaaaaatacatgggctgaaaactctgtctcccggtttctatcatccgtgggtcgatataaatgcaaatgttgatccagtaaacctgcttggatactttaaatatgcatctgccgtgattactgatacattccatggcagcgtgatgagcattattacagatgtttcaatagctgttcgtactcgtgatagcaatcattttaaactttacaatttgcttgcggagtatgggttggaggatagaattgtgacatcttgggataagttggatacagtacttaatttaccgatagattttaattatgtacatgaacaagtgaaggcacgtagagctgattctatggcgtatcttgatgaaatgatagcaaaggaagtatgaacataacagacgatagtgcattaagggcgtgtacgagttgccaaatgtgcgcagcggtttgcaatcataatgcaatagaaatacacttgaatagggatggcttttatcgtccttttgtgaatgctgataagtgcaatgactgtggtttctgtatgaaagtctgttaccgatttgataaagatatccgcatgacaacggaggaaagattgtcagggatggaagtttattcggctcaggcaaaggaacaaactttgcttcctaaggttacttctggaggcgttgctgatgtgttggcaaagcaactaatacgagaaggttatacttgtataggtgtaatttataatgatgataggcatcgagcagaagacgtgttagcgactactatagaggaaacaaatgcatttaggggttctaagtacattcagacttatagtatggatgcttttaagaagttagttaagaatgctagaaccacgaagtttgctgtatttggattgccttgccatatctatgcggttcatcagtttctgacagtctataaactgcgtgaaaattgtgtactgatagacttactttgtcacggttgtccatctatgcattgttggacgaaatacgagaagaacattaagcaaaaagtaagccaaaagaagtttgatgaagtacagttccgcagtaaagtacgtaactggggaaattactatgtagtgatagtagtagagggggtaaaggtttttattagtaatcctaaacatgatgagttttattctttattcttctcggatcatgtgctgaatgatgcatgttctgattgtttgttaagaagtacaatggaatatactgatattaggttaggtgacttttggggtaagcaatatctctccgatagaaaaggcacatcagctgtggctgtggctacaaaacgagggagtgaacttttcaagacggtagcttcacagttcacaacacaaccacataaaatgagtgaggtgatagcttatcaaagttatggtaaatcatactctgtaaatagcgatcttcgtcgtcgaatgttaaatagcttatcaaatgaattgactccaattgaagaagctgttgatatatattatgccaatcagggaataacaagtaggattaagcgtgcaattaagtttatcaattggtacttgccttttgatttggtccgattcttaaagagattaaaataatagcttaacaataaagactcaatgcttttaaaatttcttttcgaccgtgtggttagcttcattggtctgttgctcttatggcctttgctgatagtagtggcaatccttattaagattaaaatgcctggtggtccagcttttttcacgcagaagcgtgtggggaaaaatggaaagttattcacttgccacaagttccgctccatgaccatgaagcatggcggttcgactgtaagtgtagctggcgatagtcgtatcactccattgggggctacattgcgccattataagattgatgaactgcctggattatgggacgtgatgattggcaatatgtcgtttgttggtcctcgtcccgatgttcccggatacgccgacagactagagggagaggatcgcattgtgctgaagcttcgccccggtatcacaggacctgctacactgaaatatcgtttagaggatgaaatgatttccgaatatgtggcgcagaaacagaaggagggagacatccgtactgctcaagagatagcggaggaatttaacgatagggtgatttatcccgataaggtacgcatcaacaagtattattatgagcactattcattcataaaggatattcaaatgattttctgtacagtattaggcaagaatatgaaatacaataacgaaataatataatgagttacgtacctgaaaagactatctacctctgtttggctcacatgagcgaggagggattggaacagaaatatgtaaaagaggcttttgataccaactgggtggttcctttgggtcctaatgtaaacggatttgaagcggatctgaaggagtttgtggggggacagagtgaagtagtggcactgagtgccggtacggctgctgtgcatcttgcccttattgcttgcggtgtgaaacagggggacgaggtattggtgcaaagtttcactttttgcgcatcatcgcatcccatcacttaccttggtgcaaagcccgtgtttgtaggatctgaatccgaaacttggaatatggatcccattattctagaagaagcgatcaaggatcgtattgctaagactggtaagaaaccgaaagcaattgttcctgtggcactctatggaatgccttatgactgcgaacgaatcatggaaattgctaaacgctatgagatacctgtggtagaggatgctgctgagggttttggttcgaagttcgctggtagggtattgggtactttcggtcgcttcggcgtgctgagcttcaatggtaacaaaatgattactacttcgggtggtggtgcgttaatatgccagaatgaggaagataagaatgccataatgtggtatgctacacaagcgcgcgatgcttatccttactatcagcatactgctattggttacaattaccgtatgtcgaatatctgtgcaggtataggtcgtggtcaaatgaatgtagcgcaggtgcacatcaatcatcataagcatgtacaagcgttgtatgaggagttgttcaaggaggtgaaaggcgtgtctatccataaacaacctgtggataaacgttacgactctaatttctggctgtgtactgcgaccatagatccttcggtcagaattgtgggacaagaaaatgcttacaaggaaattataaagactgctgtaggaggtgcagccggtgtgattaaggctgtggatagtgcagtgaccgactgtcagccgaatgagaacgtagaagccttgcgtgtgtttatgctctcgaagaagattgaggcacgtcccgtctggaagcctatgcacaagcaacctgtgtatacgaatgcgccattttataccaatggtgtggaggagactatctttaagataggtttctgtttgcctgcaggaccttatgtaacggatgatgatgtgcgttatattgtagaatcaattaaagatgctattgtagaatgatattgaaaaggctttttgaccgtatagtatcatttattaattttttatttctttgaccacttcttatggcatttctgccgatgaatattgtaacatattaacacatgaaaaaagtagcactaatatcaggaataacaggtcaggatggctcgttcctggctgaatttttaattgaaaagggatatgaagtccatggtatccttcgtcgctcttcttcttttaataccggacgtattgagcatctttatctggatgaatgggtacgcgacatgaaaaaagaccgtctggtcaatctccattatggagatatgacagattccagttctttgatccgtattatccaacaggtgcaaccggatgaaatttataacttggcagcacaaagtcatgtgaaagtatcttttgacgtacctgaatatacagccgaagcggatgccatcggtacacttcgcatgctggaagctgtccgcatccttggaatgaagaagacaaggatatatcaggcttctacttccgaactattcggtttggtacaggaagttccacaaaaggaaactactcctttctatccccgctccccatatggcgtagccaagcaatacggtttttggattaccaagaactatcgtgaaagctatggaatgtatgctgtaaacggaattctgtttaatcatgaaagtgagcggagaggagagacttttgtaacccgtaagattacgttagctgctgcccgtattgcacaagggcttcaggacaaactttatttgggtaatctgaactcacttcgtgactggggatatgccaaggactatgttgagtgcatgtggctgatccttcagcatgatactcctgaagattttgtaatagccacaggcgaatatcacactgtacgtgaatttacaacattagctttcaaagaagccggtattgaacttcgttgggaaggtgaaggagtggatgagaaaggcattgacgtattgactggaaaagtcttggttgaagttgatcctaagtatttccgtcctgctgaagtagaacagttactgggtgatcctacgaaagcaagagaattacttggctggaatccaagaaagacttcttttcctgaactggtgaaaatcatggttgatcatgatatgaagtttgtgaagaagcttcacatgaaagaactgatgaatgatgaatagagaagaagagtaagaatggataagaatacgaaaatctatgtagcgggacaccacggtttggtaggttccgctatctggaataatttgcagagtcgtggttacactaatcttgtaggacgctctcataaagaactggatcttcttgatggtgtggccgtaaaacaattctttgataaagaacagcctgatgcagttgtccttgccgctgcacatgtcggtggtatccttgcaaacttgcagtatcgtgccgattttatctatcagaatcttcagattcagcagaatgtgataggcgagagcttccgtcataacatacagaaactacttttcctgggtagtacctgtatctatcctcgtgatgccgcacaaccgatgaaggaagacgctttactgacttctcctttggaatatacgaacgaaccttatgccatagccaagattgcgggtttgaagatgtgtgaaagcttcaatcttcagtatggtacgaactatattgccgtgatgcctaccaacctttatggtccgaatgataatttccatttggagaacagtcatgttcttcctgctatgattcgcaagattcatctggctaaatgtctgaatgaaagtgactgggagtcagttcgtaaagatttagacttgcgtcctgtggaaggtgtgacaggtagtaactccaatactgaaatattagatgaactggctaagtttggtattactcctgaatcggtaactctttggggtactggtacacctatgcgtgagttcctttggagtgaagagatggctgatgcgagtgttcatgtattattgaatgttgatttcaaagatacttacacggaaggtagtaaagacattcgtaactgtcacatcaatgttggtacaggtaaggaaatcagtatccgtgaagttgcggggatgatcatgaaggaagttcaatttaagggtgaccttctttgggatagttctaaacctgacggtacgatgcgtaaactgacagatgtatcgaagttacacagtttaggctggcatcataaggttgagattgatgaaggtgttcatcgtttgtatgattggtatttaaaaggtatctaaatttataattttgtatgtatattatgagaaaactaaacggaaagtatgttttggtattattattgcctttgttacttgcagcttgtcagtcttacaagaaagtaccttatttgcaggatgcggaagtagtactgtatagtactcagaatgagcaactgtatgatgcaaagatcatgcctaaagacttattgactattgttgtgtcgtgtaccagtcctgaactggcagcacctttcaacctgacagtggctacacagagtaatgctgctttgaattatacgactactcagccagttctgcagcaatacctggtagataatgaaggtaatataaactttcctgtgttgggagaacttcatgtaggcggattaaccaagaaggcaaccgaacagatgattgtggaaaagctgaaaccttatataaaggaaacgcctattgtaacagtacgtatggtgaattataagatttcagtgatcggagaagttgcccgtccgggtacatttacgatttccaatgaaaaagtgaacattctggaagctttggctatggcgggtgatatgactgtatatggtctgcgtgatgatgttaagctgatacgggagaatgccaatggtaagcaggaaattattcctttggatctgaataaggcggagactattctttctccttattattatttgcaacagaatgatattatttacgtaactccgaataaggcgaaagctcgaaattcggatatcggaactagtacaagtttatggttctctgctacttcgatccttgtttctattgccagtttgttgtttaatattttgaaataagagggagagttatgaaagaagaaaatcaaaacgtgaaggaacgtgaaatagctgaggatcagatcgatttccgggcgttgctttttaaatatattattcactggccctggtttgtaggtgctgtgttgctatgtttggttggtgcttggttttatctgcactgggctaccccgatctataatatttccgccactgttctgataaaagatgagaagaagggcggaggtgcaggactttcatcggaactggaggatatggggttaagcggtctgatgacttcctccaagaatattgataacgagttggaagttctacgttcgaaaacactggtaaaagaggtcgttaatcagttgggactgtatataacctataaagatgaggatgaatttcctgctaaaggtttatataagacatctccggtacaagtgagtttgacacctcaggaggctgaaaaactgaaaacttcgatggtagtcgagatgaccttacagcctgaaggtagtatggatgtgaatgtgactgtaggtgaaaagggctatcagaagcattttgagaaattacctgccatttttccaacagatgaaggtacattggctttctttcaggaagttgattcggtaactttacaggatggaactaaagttcctcgtatagagaagaacgtacgtcatataactgcgacaataaataaaccgatgagagtggcaaaaggctattgtaacagtctgtctattgctcctacttctaagactacttccgtagctgtgatttccttgaagaactccagtttgcagcgtggacaggattttatcaaccagttgcttgaaatgtataatcgcaatacgaacaatgataagaacgaaatcgcccagaagacggcagagtttattgatgaacgtattggtattatctcaaaagaattaggtagtacggaagctaatctggagtccttcaagcgtgatgcgggtatcacggacttgacgagtgaagctcagatagctttggccggtaatgcggaatatgaaaagaagagtgtggagaatcgtactcaaatcagtctggtgaatgacttgcgtaaatacttgcgaggcaatgaatacgaagtcttaccgagtaatgtaggtttacaggatgctgccttgattggaaccattgaacgttataacgaaatgcttattgagcgtaaacgcctgttgcgtacatcaacagagaataaccctacgattgtgaatttggatacgagtatccgtgctatgaaagccaatgtacaggctacccttgaaggaaccttgcaggggttgatgattaccaaagagagccttgaccgtgaagcaagtcgctattcccgtcgtatcagcaacgctccgggtcaggaacgtgcttatgtaagcatcgcccgtcagcaggagattaaagccggattgtatctgatgttattacagaagcgcgaagagaatgcgattgcacttgctgctactgccaataatgcgaaaattatcgatgaagcaatagctgacgatattccggtatctcccaaacgtcctatgatctatttgatcgcattggtactgggcatcggaattccggttggcatcatctacttggttgaactgactaaattcaagatcgaaggtcgtgccgatgtggagaaactgacgagcgtaccagttgtcggtgatattccattaactgatgagaagaatgataagaatggttctatcgccgtcttcgagaacaagaataatctgatgagtgaaaccttccgtaatattcgaaccaatcttcagtttatgctcgataatgatcagaaggtgatccttgtgacctcaactgtcagtggtgaaggaaaatcattcgtatcgtcgaacctagctatcagtctttctcttttgggaaagaaagtagtgattgtcgggctcgatattcgtaaaccaggactgaataaagttttccaactctctaataaggagagaggtattactcagtatctttccaatcctgaaacggatttgatggaacttgttcagccttctgatgtaaataagaatctgtttattcttccgggtggtactgttcctcctaatccaacagaactgttagcccgtaacggtctggacagagcgatagaaaccttgaagaagaacttcgattatgtcatccttgatactgctcctatcggcatggtaacggataccttattaataggtcgtgtagcagacttgtcagtttacgtgtgccgtgctgactacactcataaggcggaatatacattgatcaatgaactgtcttttgagaagaagctgcctaatctttgtaccgtcatcaacggtgtagacctgaagaagcgaaaatatggttattactacggctacggtaagtatggcaagcattatggatatggtaaacgttatggttacggctatggatatggtcagaccaaaagtgaaagaaaagactagtaaatttgaaataaaatatgaaaaaagcgtaggaaatgggtgaataattttgtatctttattgcttataaaccaagtataaagagacaatgaatcaaccggattttgtagtgaaatgctacaataaacaagacttagcccaaatgtatttccctgatataactgttcgcgcttcagtaaataaacttcgtcgctggatgcgtagatgtcaaccattaatggatgagatactttctacggattttcatccgaaaacgaaagctttttctgtgcgggaagtaaggttaatcacctactatttgggtaagccgggagatttgtaaccccaaatcttttttattcattcaacaaaaaaactacgggaggcagcactttcgccatctcccgtagtttttttataatcctgaatattcttttctcggatcgtagcaaggacatgccttgtggatcgtagcgctcagctgataatgtcccgctatctgcgcctccggatactgatgcttgagaatcgtcaacagatcgagcagagcaaagcgttgtgccgtagttctcgtatccgccggtctgccattttcatccagcccgccttcataacaaatcccgatactatgcctgttaaatccacgcacatgggcaccgattttggagacgggacgacaatgatgaagaactccgtcccgggtgatataaaaatgatagccaatatcacgaaaaccccgttgcaaatgacattctcgaagccgttctacagggaaggaaacattgcagcgcgtagcgctgcaatgaatcaccaacaacttaatctctctcgggagatactcatctttagaactttccatgcggatgtattacagatgagccgtacaggacgttaccccgatagcagaaatgatagacgttgcaattgtcacaatgaactgaagaatattcttccaaacttgctttttcatacaattttaatctttaatagtaaataatgattgattaaacagtcgggtccggagcttcatcgccatcgtcacctgaaccaccgccgggctgatcgcccttaccatcgtccggcaacggttcgtctcccgaatcgggcttaccgtcactcttatacagtgcaaagtccagcgttttacacaacttgcggagatcacttcccggatagaaaagcactttacctttctcgatacacgatgccttgaattccttctccgttgcggtagccgttgccgtcttaagactcatgcggaaattccccagatcgcccatctgaacgatattcccttcatccagtacattgacgatttcgagcagaaactctccgatacaaccttccaactcgccttttgaataagacgaacgttcggtaatacgtttacagacctccttgacggtcactttccgtccgctacgtgccactgcataatacttgggagcttcactaggtttcaacaggttcttgcgagccataacaacataattctgtgccataatttttaatacttaatacttattacttaatatttattacctgtaaccgattacacaacaaagatactacatgggcaagtgcccgtgatgtgcagtgacgcacacagacgcactgataaaaggaaaaaacattgagaagattgtattgaatcttcccaatgtttgcatccgatcattgagaaggttttttcaaacttcccaatgttttcagagagtcttcaaaaggacaaaaggacaaaaggacaaaaatgacagataggactattttatgagatcttctgatactttccatgagatatcttattgattttgacgccaatgaacgattttatcagcctgctgatcttgcggtggctgaaatcgtattttacgccgatctgcattgcatcttcggtagtgaatgtttctggcaactcgccgatgaacttccgtgtactgttcggatctttcaacggatggagctgggaagacggcatggaagacaataatagcctgctatgctcataacagcagagaacgatctggagagaacgatcgaaatctacatcctcacaatagatatccggtgcgccatcattcgcctcgaactggcggatgcgtgcttggatcatgctgatgcgcatcacaagacaggcataccgcttgacaacggcctgaaggtcatcgttaccttccagaaccacttcggcaagcagcttagaaaacgtatgattcagataatcccattgagaacggctgaagtgaaacaatacaggatgattcttgcagaaatgataaagctcgaagacacgatgtgccagcggcttgaaagactcttcgagcgagatactgtcatctcccatgggcttccacttcggaatgctgcggaaagtgtagagcatgatacggctcggaagtcctttttccgaagtctctatcagtgaagccatctgactcggggtgccggtgaggaacatggcaagcatgggaaaacggatataaatgggggttaaaccattgatcttgaaagcggaatcgatattctcatgctcgaatgccttgcggagcatatcgtcaaagttaccgcaatccagatgattggctgtagccagcgtctgcacctcggtatcgaatatgatgcttccttgcggaccgttgtcccgcatttggatctgcatacggctgtagctggtagtggcagggagaaaaagcattttgtaagctggtttttccggctcttcgggacactcttcatgtgcctttttcttataagtacagtccagtttccattgggtgtacttatggttataaattttctgctgaagttcgctattggaaagtatccagtcgtggacttcttccagcagataacgtcctgtttgcgcaatgctcttgttgctcccggcgggggcaatgccgaaactgtagaaatggggagaatactttttgtgattatagatgccgaatgtgccgggcagtacggaactcaatgcggtgaggttggagagaaaggaaagatcctgttcacgatcaccttcctcttcgaggatacattcgttcagcagatcgggcagatatttgtacacgcttttgggaaaacagggcgtttcttttctgaattcttcgccttgccaatacgcttcatctgcttcatagatgttttcggatgggctatatgtcacttttgtcattttgtccttatgaagagaagagcaaagcggagaggcggagacggatggagtagaggtaactttttggtaaccagattgtaggatgctcctgatttcctgtgcgggaaagtcggagtgctcaaaataaaccgtaatcccgcgtaatatgctttcttgcgaatatcttctccggcaagcttcgcaggcgagtttaaacagattggtgtgtcgttgcccggcggtcaatggatttaagaaaatgtaggacgaaaggaacaagttgacttcctcttccgagaagttctcggagttttcgtttgcttttgcaggtagcggaggagaggggaggttttctgctgtcggctggaacggttgtgtttccacagctgcttccagaacgaatgactgatagagactggctacgtatccgtccggtgaataggtgaaatagcacaggcggctttcgtctttacaggcgggatcgctgatgaggccggtcagctggtcgtagtaacggctgaccagtaactgcccttcccggtgacggccttcgatgccttccacataggcgaagattttcacgccgtccgtagggctttccagagcagctacggtatgagggtcggcagcgcaaagacggatgatctccagccgattgggaacgtggtcgtagtcgagtccgataatgtgactgggcaactggaaatttcggatggcatgcgctccgtcgaaggtgccggcaggagtgaagcaggggagctggctttttagtttttgggcggcttcatgatcgccttcctgatgataccgccggatggattggatgatggaagcataaaccggatgaatacacataaagatgacttcgaggaaagacatgattttaggctttttggaatacacattttcgtaaacggaaactttaatttcttcgagtacttgcatttgattttgatgttttatgattgtatatcccactatcgggatagcgggtgcaaaggtaaaggagggggaattagaacttgtttcataggttgaaacagattgaataaccaaatatatatctattttttattaaattttaaacaaagagtaaacatgacaaaagaaaatcatggaccttatgaatttttgggaagtatggtagtgaacctgatgaatatcgacaaatcgatttcgtattcttttctggaagatgagttgcatatctccggaagggatgtgagtgccatgcggcaggggaaggatttacacgtttatcagtacgtgcgtgtcgtcagctgtatcatggatgagatacatctggaaattctgttgaatgcactgctgaaggaattgaagaatgtatttgcagcccattgtgatttagtgatcggtacgattccacatcggctttacggaaacggacagccggcagaatgggtggtagtgatgagatgggacggggtaggggtctgatccttcttgtcatacccggattgctatcttagtcttctaaagtacgtccgcatttttttcatgatcttgatacccaaaactactccgtcaaagatggccatgccggtattgaacgaacgcatgagcgaatccgctttgttggcggcgggtgcaagaggcgagaatatttcgcgggtggtggccgtcatagctcgtttttgagcctgaatttcattcaagagcttctttttgcgttgggtgatctcttctaatgtaattttggcaggtgtttgcgcactcataacttcatttattttgaatcggttaaaaacaagttagcgaggaagtttaccatcggggagatgataagctgtttgcggaaaataatgactaaagccataatcagtatattgatgccggcaatgatagcgaagcttgccataagtccgcctaccagaggttccaatacataagccaaggcaaataacagataaaacagggctaccatgccaaggatgataagtattacaatcatgattaacgttgaaagaagtatggtcagcttctccgtcaactctaacttggtgtattctttttgaagttccagatactttttgaactcaaaaaacaactgttgaaagttctcaatacttttatcgtctgcaaacatggtcgctctgttttagtcctttacttacttattctcctatttctcctttaatttcagctgcgatttcgtcaacgagattttccatttcgttgcggttcagcttgattccttttttacgaagaatttctgcgatcttattacgggtatcttctcccttttcaggagcaaacaaaataccaagggctgcacctacggctgcaccacccagaaaagctgctaatacatttaatcctttcataatttatactgtttaaaatgattatgatacaacaaatataacatttttctccaaaggttgttcgcaaaaacagaaaaaaagtacttcctttttatcattcttgatttcttttatggtttaatcttatttaactagacttttggactaacaaatgagacttaaggcgtacttttgtcattcaatattgtaattcaaaacataatgaaagcgaagattgtttttataaccggagcgagcagcggaatcggcgaaggatgcgcccgtaaatttgctaaggaaggatggaacctgattttgaatgcccgtacagtgtcgaagctggaagaactgaaggctgaactggaaaaagagtatggaatacaggtctgtgtgttgccttttgatgttcgcgaccggaaacaggctgccgccgcactggaagcgttgccggaagaatggaaatcgattgatgtattgattaacaatgccggactggtgatcggagtggacaaagagttcgaaggtagtctggacgagtgggatatcatgatcgatacgaatataagaggtttgctcgccatgacacgtctggtagttccgggcatggtggaacgggggtgcggacacattattaatataggttctatcgccggagatgccgcctatcccggaggcagtgtttactgcgccaccaaagctgctgtgaaggcactttcggacggacttcggatagacttggtggatacgccgctgcgggtgacgaatatcaaaccgggcatggtggaaacaaactttacagtggtccgttaccgtggtgacaagcaggcggctgacaatttttacaagggaatccgcccgctgaccggagacgatattgccgaaacggtatattatgctgcctcggctcctgcgcatattcagattgcagaggtgcttttgatgccgacttatcaggcaacgggcactatttcttataagaagaaggcagaatagacgttttttcgctcattttctttgccggatgataaaatttctattattttgttgcccgaaaactaaatgtgaacgaacaagattattgaattattaattaaatacagaatattggat

SEQ ID NO: 152 - DNA, 18268 bp, Bacteroides thetaiotaomicron
gcttaatattatctaacgtaagactaacatttatattttaagacgttttgatgtcgacttaaatatccaatattagtttctaaaataaatagtaatatacaggtatactatctcaaacgattgaattttgcttccgttaaatacatatatgtctcagtaccaagaaggggtagtacagttgtcggcaaatacgaatatccgatcgtttttgagtgcaataaagtttattgtatcgactggctgtattttgtcggcaatatgaaggaactacttaattattttgaactgatggactaaacgaatgaaagtatacttctgcatcacctgccattatatagtaagtcaggcatgtatcaaaaggtatagattttgtactgccattttttaagaagtggataggcctactgggtgaaggcttctttgatatacgaggaaaaatgggtaaaggcgtacattatcttatggataaatatacctcaaaatatattcctgaatgaaagttgtatattctggaatatattttgcttttaacagaaaacaagtttcgcaaagaaaatctatgaattgagacttctattctctcacgagttgtgaagcatccgatagtacaatggaaaatatccctgattgccgaagaaatgtgattctccctcattcatcgccaaataaaaacgggagaaccgaatgctctaggtattgctcatatcctttacgtactcaggtagtccgcctatgggttgggaaatgcccgtttggcaggatttttttcccttatatagaacacaacgggctcatgagtgacacattcttcggatgggtatagcggattcagatacccctttataaatatcttttcatctcctgacaattgctgactatccatgactattcctgccatcagtccggtccagtttggcaggtatcgttttttctcttacattcgcatcaacgaatatttaaaatcgatcatatggaaatatattacattgaagccggtatctttgacaggatgctgggatgtgtcgaaagtctatcgacacgcgtggacaggctgtatgagaaaaatgcgaataaaggggttggtgagtgactggacggtcaggatgtctgcctgcgccttgacatttcttcccgtaccctgcagacccttcgtgataccggacggttggcgttcacccaggttcagcgtaaattttattacaaaccggaagatgtggagaggctgatgacttatgtcggtatgaggcgcaaggagaaggcggtgagagacagaagaaaaagcaataacttttaaaaaagcaagaaatggaaggaattatcggtaaggagagtgagagtatcctgcgtttctttattctgctggagaatattcaggtaaaaatggatcagctaatggagggtaaccgcccgccttttaacggtgaacggttcctgactgacagggagttgtccgggctgttgaaaatcagtcgcagatgtctgcaggattatcgtgaccagggtcggctcccctatgtccaactgggtggaaaggtgctgtataaaacgtcggacattgaaaaattattggaaggtaactatcacagggcgctgatataatattgccctttttaggctttaatgggatgagtgttgggactgtcaaggattccgacactcatcccattttttatctggacatttttagctcttaacccagtccgtatccttccgctttcttcttttcatgagccaatccatgtccgaggatattttctggtcagtgacttgcgcatatacctgcgtgctattgatgtttgtgtgtcccatcatcttggcgatgctttctatcggaataccggaggtcatcattagagttccgaacgaatgcctagccatatgataggataaattttccttcatccccagtgctacacccagcccgtggacctcgtaccagaggatatcccggaccggtaacggaaagaccggcttctcgttatccgtggtgttgtaaagttctagtatttgttcggctaccgggtgtaacgggataaatgcttctgcgcccgtcttagcccggcggatgcggatgtatcttcttcctagggaactcttttcaatgtggcgtggatggagtctgcgcgtatccacataggcaagccctgtgaaaggatagaaaactatcaatgcgaccaacagaggaatccggcaaaagaactgcaattcgttgtaaagcagcaaaattgcgttggtttgcgcagttgggtaaatagcaaaaacaggtagaataacgaacctgttcagctaccaagtcattacctgttttcatttcatttagatgcagtcaatcaggggataaactgtcagttgaaaggtatttccatccgggaatcccccctttatccggcagattctgcccgtccggttttgattgcgccgttctgcctgattctcatatcattcgattggcgaagtatgagtaaaattgcaatcaaaaaagtaacgcatgaaaacagaaatgaaagtgctgctctacatcaagcgcggcgtacaggacaaggacggtttttctccgctcatgggcagaatatccgtcaggggaaaggtgaactccatcgcgcaattcgcgtgcaagttcaaaatcgatgtgcggttgtggaacgccaccgcacaacgctgcaccggcaaaagcaaagcggcgacaatggcaaacagggagattgaacgggtactgctattgttgcaaaagcggttcaacgaactttccgacatccgggatgtcgtgaaggcggaggaagtcagaaacgtgttccaaggtctggctgagacccaggacaccatcatgaagctctatgcggagcataacagcgactatgccctgcgtgtaggggtgaacagggcggcaagcacgttctaccagtaccggaacacctgccggatactcggtgagttcctgaaagagagataccatgtgtcggatatgcctgtcaagcagctggatgaaaactttatcgaggcgtttgatatgtatatgcgcacgacaaggcgtttcatgcccaggaccatactcggacatgtcaaccgcctgaaaagcgtgatgatgcttgccgtgttccgcggcatcgtccctttcagcccgttcaaaggctatgcgccgcagaaacctgttttcaaacagatgtacctgacagaagacgagcttgacaggtttgcgaacactacctatgacactcccaaccgtaatttcacgagggatatgttcctgttctcgtgctggacgggtatctgctactgcgacatgagaagcctgacagccgccaatctggtgagggcggacgacggcagcctatggattcacacggaaaggcagaagacgggcacgccagaatgtatccggctgatggagataccactgagcatcattgaaaagtacaaggggatggacagcaccgggaaactcctaccgatgctgaccaaggagagcatgaacagacatctgaaaaagatgtccgtgatgtgcggcatcaaccgtccggtctcattccatcaggcccggcacaccttcggaagcatcatttgtctgtcacatgggatcccgatagagaccgtcagcaaaatcatgggacaccggcatatcaccaccacccagcggtacgcaaaagtcacgcaggataaaatagaccgggacgtggactgtctgaacggtgttatcggaggcaagttttccttgtctggcatcgacaccgccccgtcaccgattctgaaagactacagccgccggaaagtcaatccgagcgtgaaacaaagggagtatataaccaaaataatggaagggtaagccatgcgaagcacattcaaactgttgttctatatcaaccgcctgaaaataaagaaaaacggcagatgccctattatgggacgggtcacccttgacgggaagataagccagtattccacaggtttggaaatagagcctgacttatgggatgcaaaagtgggaaaggcattcacggacggtcgtaagaccggaaacatcaccggcgaaaaaagaaatgagttgaacaggctgaactcattattggaggctttggaggagaaagcgaagtccgcctacaaaagaaacgtggactcttatggcttcgtctcggcggaaatcatcaagaatgcagtcaccgggaaatccgatgtcaaagagacattgctgtccctgtttgacgaacataacggggaatacgccaaacgtgtaggcattgaccggacacggcattcctatgtccgctatcttaccacgcgcaagcatatatacaatttcctgagatacaaatatgatttggaggacattccgctgcgttcactgacgatgaaattcatgaccgacttcacattctatttttcaaccgtactgcggttgaaagtttccgcctataatgactatctgatcctgctgcacaagatgacacggctggctttgaagaagcacatacttaagcgcgacccgtttgccgggcataaggttgaaaaagtgccggtaaaccaccgccacctgaccggggagcaattcgagaagctgctcaatgcccgactgccgacctaccgcctgtgccatacacgcgacctgtttgtcttttcggtgttcacgggcatcggcagggctgatctggcaaacctgacggaagacaacatcatcacgaaggaggacggttccaaatgggtccacatcgcgcggcagaagaccaaggcggagtgtcatatcaaacttcttgacatacctctccgcatcatcgaaaaatacaagggggaaggcaaggacggaagattgttttacgtcccgcagacctgtaacctgtgccgcaaccttaaaatcatagccgaacagtgcggtctgggctgtcacctgacattctatcaggcacgccacagttttgcgacccttatctgcctgagcaacggggttccgatagaaaccatcagcaagatgatgggacattattccatacgcaccacccagatatatgccgagataaccaaccacaaagtgagcagggatttggaaaccctgtctgaaaataccaaaggcaaatatgcgttgcccgatgacggtatgccgtcacgggtgttcaaatgcggaaattacagcggttggaaaaaggagtgtgcatcaaatgatgaaactaaaatcaagtgacaatgaatagaggaataataacaatcagtgaaacgggtgcggtcacaatgccgaccgtatccgtatggatgacgcaacaagagatagccgacctgttcggggtgttctcatgcgatgttcgcaaggcgattcatgccatttacaagaacaaggaactgaacgaatttgacacgatgaagtatctcaagcaaccggatggcatcagttacgatgtctataacattgaagtgattatagccgttgcattcaggatatgcagtagagagagtgtcttgttcagacggtttataataaatgaaatcagcaccattaagaaagctacaccgattacactatttgttgccagcgtcagaggtaataaccgatggtatagttgaggttcattccgtcagccactcgttcccgatgcacggatgcaaaggtagcgtatggcttgatggcagcggcaaggtcgggcggcagagccgtttcgggtagaatcttcctcctgcggagcgtattcaacccgaaaaccttgccattgcctgccatacgcttgaagagcatccggcaacggaaacaagcgactgacgggaaatcagaagacaggaaagaggaacggcttacagacgaagcgggattttgatgctccgtccgtaagccgttcctttctctttttgccgaaagtccattgccccgcaaccatagggcatccggcaaactgcgctccttcaaaaaaatcatgtgcctgtcatccgataggcagagcggtagctgtcagcaagcatcctttcgatgtcggattcacggtagaggattttaccgcccaactggatataggctatgcgcccttcgttccggtagtcctgaagtgtccggcggctcactttcagccgtgccgacacctccttgtcggtgaagaaacgctctccgttcagtgtcgggcggtgattggcggtcagatgctcgaagctatccatcagacgttcaagactgcccatgaagtggattatccactcgttgtccttgttaatcagttcattcatgttactttggatttagtgggtattgttagtttacttcgttcatttcatcaagtttatatagttcttcctttgaactttgcttccttgcgcctgtcctccacaacggaaacaatgcgctgtacgtcatcgggacggtagtaggtcttgtggtttatctgagagtaagccagcgtcccgttgtcccgaagcgtctgcaatgtgcgtgggctgatgttgagcatccggcaaacgtcctgattgtccatccactcgcccattgtcttctctccgtgccgccgacagatggcatccatgcgactgacgaaacggtcgaacttggcgaccatcgcctcaaaggtctttctttcaattgatacgatttccatatacatacttttattgttactatttcttttgccacaaaggaatatataatctactgccttgcaatggatttccaaaaagtggcagcgtgttgcgccgatacggcagccattgtctggggagattatacagaaacggttcttttcgtatgaatgccgtccaaacggaaaggttggctatttcataatccgcttatttaatagtgctctatatggttgtgtgttgaaacaaagttttggttgtttggagaatgacaacattacgtcatgaaatcattaaatcaaagtatcaccaaattgtcggacaaccattgttttattttcttcaatactcgttttggcaggtattcgataaatccttttgataagtgtttgaatttcttgtttttcatgtattccggtttttcattttttgaattattgtccacttgaataaaggaaatgattgaacctgcatttcgacaagtggcagcatattgcgctgatgggcagccattgtccgattcaaacctctgtccgatactgtattaagagcgtaactttgcacccaaacggtaagggtaccgcagatggagcaatccggagtttaaaaggtgtttttccaatccgacaggcggaggattcttgtgtcctcaaagacacagcaaggtatattttcagttactcgaatgattccgagtaactgaaaatcccagcactgccgtggacagaattatcctccgtagtcggataatttcggggttccttaatcaaagattaaacaatggacaagccataaaattaaaagaataagaagaatgaaaaagaagagcaagtacgggagaaatcccaagttgaatccgaagacgcactgcgtgatggtgcgcttcgacgatgtggaatggaacaggttcctgacgatgtacgaggaatcgaacgtgtatgcgaaagccgtctttctcaaagcgcatttcttcgggcagaagttcaaggtgctaaaggtggacaagacgctggtggactactacaccaaactgtcggacttccacgcccagttccgtgccatcggtacgaactacaatcaggtcgttaaagagttgcgcatccacttttcggagaagaaggcgatggcgttgctctacaagttggagaaacataccatcaatcttgtgaaactgagccgagaaattgtggaactttcaagggaaatgtatgccaagtgggaacaatggaaagaataattctgttacatacccaagatacacattacagatacgtaatttggtaaatgaacgcatttttactgacaatttcattgtcaatcatgttgtaattgtgcattcggaactttaggacaaagataagtatcacttgacaaacttgaacactaaattcttataattgaaacgactgtatcatttatgatggtgcagtcgttttatattcaagaggataaatggttgcagctgttcacttagctatcaatatgaaattagtatctttgtaaaatgattcaagagaagttcaaattttacaagccatgtaagttgctgcaaccttatgtaagatattattgggtattcaaaagtaaccagtttttgaataccctgacttttcctatcggttgctctcaaatcatcttccataagcaagcaccgttatatatccctgaactgaatgttacacaagacaaactgactgtgagcggacaagttaatttctcgtcacacctatatgcagacggcaatacagaaatgatagtggttgtattccaccctcatgccatgagtatgtttctgaacataccgacttcactcttttacaatcaagaagtgtccggttacagccttgaaaacaaaagtttgaatgaactggctacacgaatattcgactgtgagaataattctatttgcataagctatatagaaaaatggctgttgtcacaaattgccgataatttagctgataccacatacagaattaaaaggatagatgccgccatacagcaaatatatatcactccgcaaatctctgtaaacgaattatcttccattgcctgcctgagcaaaaagcagttcgagcggttgtttcattcatttgtaggcatcaatcccaaagaatatacccgtatcgtccgctttcaaaaggctttggcgcagatgcagcatcaagcgggcaaagaaattaatcaggcacaaatagcatacgccagcggctatgccgaccagtcgcactttatccgggagttcaagaaactctgcggatatacgcccgtgtctttgctgaaagtatcaaatccgtattccgatttgttcaccaatcccgtgtaaatgtcccgtttgttctatccggggtcaaacgcttctcctacttttgccgcctgattcattgaatgaaaatagcattaagtatgaaagaagtaaatccccaagaaaccagccgggcatacgcctttgagatgtggatgaacgcacctatgccgatggtgacgttctttaagacactcaacgtgtcacgccttgtgaaaatcagccggaaatcgggcatgaagtttaatatgttgatgtgctggtgcatcggcaaagccgcaagggacgtgaaagaattttatatgctgcccgttggcggtaaactgatgcagtacgataccattgcagtaaacaccattgtcgctaacagaaagggcgaggtaagttcgtgtgatattcctttctgtgataatttgtctctgttcaatcaacactatctgcgacttaccaaacaagtggctgaaagttgcgtcaatcacgacttgacggaaagcatggttatcggaacttccgccttggcacaatatgaaatagacggtgctgtcgggatgtatagcggcatctttaataatccgttcctcatttggggcaaatacaagcgccgcctgctgaaaacgacacttaccgtttctttccagttccaccacacgcaaatggacggggcacacgcttcccgatttttagacggggttcagaaagaaattgataatctgagaatataagtttagggaaaaacgctatctttgcagaactaacagaaaaagaaatagttattcaacaatatgaaatggcagttgtgcatatagctacgctcaacgaatagcacttccaattattgctattcagcaatagacaggcttatgtttttaagtttgcctgttattgttttgtcattatcccttatcccttattataaatctataagattgtcgtgctgcttaaagcggcaggatgtatcgtatcatattggtttgaacaaatgaattatacctataagaaaatctggctcatcgcttttcctgtaatgatgagcatccttatcgaacaactgataaatattaccgatgctttgtttttagggcatgtgggggatgtggaactgggcgcatctgcccttgctggaatttggttcttggcaatttatatgctcggcttcgggtttagtttggggttgcaagtggtaattgcccgccgaaacggagaacagcggtatgcagaaacgggaaaaacgttctttcagggattgtttttcttgctgatactggcggtactcctctgtctgctatccaagatattttctcccgttctgttgaaacatctgataatttcggatgatgtctataatgcggttatccgctatttggattggcgtatttggggattgttgttctctttcccgttccttgccttacgctcgtttttggtaggcattacacagacaaaagctctgaacatggcagctttcactgccgtactggtgaacattccgctgaactggctcctgatattcggcttcgatatgggtatatcgggggcggctatcgcatcttcatttgccgaaatgtgttcgctggctgtattggctgcatatatgtttcggcacattgataaaaaagcgtatggcttatactggcgtattgatataactatattgaaagaggtattttctatctcggtatggagtatgctccagttctttacaagtgtagccatttggtttctgttcttcgtggctatcgaacgtttgggagaaactgaattggctgtatcgaacattgtaagaagtgtttccgcactgttttccgttatcgtcaatgcattggcaggtgtcaccggttctttggttagtaacctgattggagcaggtgaaaagaaacaagtttttccgctttgccataagattatccgtttaggatatgcgacaggcattccactgattgcttttgcgttgttctttcaccagcacattataggggcttatacggaaaatcccgctatcgtacagcttgcatggccgccttttcttgtcatgctattgaattacttctttgcactacccggttacgtctatctgaatgctgcaacaggaacgggagcgacacggacggtattcatttttcaggtgacaactactattgcttatctgttctgcttatggggattaggttattgtaatgtcccgttagcggcatattgggcagtggaatacttatatgtaatgctgcttggtacacaatccgtcatttatcttaaatataaacaatactaagaactgaaagttatgatgaacaagatatatccccgtaaaggtgacacgcaaaccgtttatttgaatgctgtcgtaaaagacccgtctatcgaaataggcgactataccatttacaatgattttgtttcagacccgtgtctgtttgagcaaaacaacgtattgtatcattatcccattaaccatgaacggctgataattggaaagttctgttctattgcttgcggtgcaaaatttctgttcaattgcgccaaccataccctaaaatctttatccacttacacgtttccgctattctatgaagattgggaattggataaggcaaatgtggcttctgcttgggacaacaaaggcgacatcgtaataggcaatgacgtatggataggctatgaagccgttattatggctggtgtccatatcggtgacggggctattattggaacaagggcggttgtgacgaaagatgtgccgccctataccattgtaggtggtatccccgcaaaggagatacgaaagcggttcagtcctgatataatagaacagatgcaggctttgaaatggtgggactggtcggtagataagatacaggagtttttgccttatctgaaagatggacgttgggataaattacaggcaatatgaaatcaatcaagaatctaatttcgctcggatatttgctgatggcattattggttatcggcataatgtatatttggtataaagaatggtgcgatttagagaaattggaagttcaaaatcatcatataaatacttttcgccaagaatcgcacgaaatatttgtttttcttattgagctatctttatcgggcgagacagtattggaatgggaatatgcagattgggaacattaccattatcaacgaatggtaatggacagtatgctatgccgtttcaaaacgatttatccgacaaagcgcatagacagtgtacgccatcttcttgaagataaggaacgacaaatgcgtcaaatcgtgcaggtacttgaacagcaacaagccatcaacgataagatcactcgtcaagtacccataatcgtacagaaaagtgtgcaggaacagccgcaaaaaccgaagcggaaaggatttctcggcatattcggcaagaaagaaaagccaaagccaaccgtgaccacaacaatgctccgttcccttgactgggatatgatagccgagcaacaggcgcaaagccgccgtctgtcggaacacaccgacagccttgcggcacggaatgcagaacttaaccgtctgttacaaggtttgatttgccaaatagacaggaaagtacaagccgaccttcaaaagcgagaaacagagatagccgccatgagggaacagtcgtttatgcagataggtagcctgacaggattcgtcctcattctgctggtaatctcatatatcatcatacaccgtaatgccaaccgaatcaaacggtacaaacaaaaaacgactgatttaataggacagttgcaacagtcggtagagcaaaacgaggctctgatagcctcccgcaagaaagccgtgcataccatcacccatgaactgcgcacacctttaacggcaataatcggttataccgcgttgatggaaaaagggaatgatgcggataaaaaagagcaatatgtccgtaatatccggcaatcttccgaccggatgcgagaaatgctcaacaccctgctgagtttcttccgtctggataacggcaaggaacagccgaacatttctccttgccggatttcggcaatcacgcacattcttgaaacggagtttacacccatcgccatgaacaaggggctggctcttaccataatcaatcagacggatactattgtcttgaccgataaggaacgtatcctgcaaatcggcaacaacctgttgtcaaacgccatcaagttcacggagaacggtggcgtttctatgacaacggactacaatcacggtgtcctgaaacttatcgtcgaagatacgggcacgggaatgaccgagaaggaacagcaacgggtgttcggcgcgtttgaacgtctgtcaaacgccgccgcaaaagacggattcggactgggactttccatcgttcagcgtatcgtgtcaatgctcggcggcacaatacggttggagagcgagaaaggcaaaggcagccgtttcacggtggaaatacccatgcagacagccggggaactgccggaaaggataaatcagacacggattcatcatgaccgtacattccatgatgtcattgccatcgacaatgacgaggtattactcctgatgctgaaagaaatgtatgcacaggaagggacacactgcgacacctgtaccgatgctgcggagctgatggaaatgatacgccggaaagaatacagcctgcttctgacggatctgaatatgccggaaattaacggcttcgagctgttggaactgctgcgcacctccaacgttggcaattcaaaggctatcccggtagtcgtgacaaccgcttcgggcagttgcagcaaggaagagcttatggaacgtggattctccggttgcctgctcaaaccgttctccatatcggaactgatggatgtttcagacaaatgcgccatgaaaggcaaccggaatgaaaagccggatttcacctccttgctgtcatacggcaatgaagccgtcatgctggagaaactgataacagaaaccgaaaaggaaatgcaggcaatcagggaagcgggtctaaagaaagaccttcaggaactggacgccctgacacaccacctgcgaagttcatgggagatactccgtgccgaccaaccgttaagggaactttataaactgcttcatagcgatggcacgcctgacgataaaacaattggcaatgctgtaaaagctgtactggataagggttcggagataatccggctggcaaaagaagaaaggagaaaatacgaaaatggataagacaaaaatcatcgtggtggaggacaacatcgtgtattgcgagtttgtctgcaacctgctggcacacgagggattccgcaccgtgcaggctttccacctctcgaccgcgaagaaatatctgcaacaagccgcagacgggaacatcgtggtttccgacctacgcctgcccgacggcaacggtattgaccttttgcgctggatgcgcaaggagggcaggatgcaaccgttcattatcatgaccgactatgccgaagtgcatacggcggttgaaagcatgaaactcggctcgctggactacatacccaaacagcttgtggaggacaaactcgtccctctgctccgtaccatattgaaagaacggaatatcggacggacccgtatgcccctgttctctcgtgacggctcggcgttccaagccatcatgaagcggataaggctggtagcccccaccgacatgagtgtgctgatattcggggagaacggcacgggtaaggagcatatcgcccacctgctgcacgacaagagcaagcgggcaggaaagccgtttgtggctgtggactgcggttcgctcaccaaagagcttgcgccgtcggctttcttcggacacgtcagaggggcgttcactggtgcgggcagcagcaagaaaggctatttccatgaggcggaaggcggcacgctgttcttggatgaggttggtaatctcgcaatggaaacccagcagatgcttctgcgtgccatacaggaacggagataccgtccgataggtgacagaacggataagagtttcaatgtccgcatcatcgccgccaccaacgaggatctggaaaaggcggtccatgaaaagcgtttccggcaggacttgctgtaccgcctgcacgacttcgagataaccgttccgccgttgcgcgactgtcaggaggacatcatgccgctggctgagttcttccgtgaaattgcgaaccgggaactggaatgcgatgtcatcggctttgatggtgaagcccgcaagacattgctgacccatgcgtggccgggcaatgtccgtgagcttcgtcagaaaatcatgggcgcggtgttgaaggcacagacgggtcttgtcacgaaagagcatctggaacttgcctatccaaaacctaactcacccgtcagcttcgctctgcgtaatgatgcggaagacaaggagcgtgtcttacgcgcgttgaagcaggcgaacggtaaccgcaaggttgccgccgaactgctcgggataggacgtacgacgctgtacaacaaactggaagaatatggattgaagtataaatttcagcagccatagcccataattcactgaatttgtatgattttgattatcagaatttggttaattctcaaaataatattatcttcgcattgagctatttgaaatgattgggaatcatgcaaaatgatgaagacaggtggtttctaaaccattacccatacttctattattggtttgcaatttgttgataatcaagcatacattagttattgcaacaaatgtgtacaaggagaatatgaatgtcctgcgtgccagctccatcatcgggtcgggcatcggggtctccattatcagtttcaactcattgcgcccgatgtgcttcaatttcggactgtccttcttctcgtatgccacgtcctctatcggattggctctcaatacttcccggtccacagcgatatagatgagcctgttaagccagcacaggcagtggttcacatgtccgttcccatgtcccagctctttcttgagaaagattttgaaggattcggcgaactcctcggtgatgtctgaaaaggcgatgtccctcatccccctggattcgatgaactgcctcagattgagctgggttgtctttgactggcgataagttgaggtggagttaatctcgactgaacggattctaagccgttcccgttctgcctctccggtctgcagcaggaattccggaatggaaacggtatttgatacggtagctttgagtaattccgccgtgaccactccctggttcttcagcaggttcccgtatgcctcttccagtcggctgcggaaagcggtaaggcggttgttttctttgttcatcctgatttctcctttgttactgtcccagtcactgggcttgcaatagatgcctgtcgtgacagctgacttcctgccgtcgatgctgatccggcagaggatggctgtcgttccgtccgatttcaccttgttacggttgatgtagaacatgagtctgaatgtactgcgcatggtaatgacgtttttaggattaaagaattagtttgagatcacgtgtcgcctcaatgaacctgtccatgtcttcgaacagtctcttcggggttacacgggcgtagatttgggtggtctttatgttggagtgtcccagcatcttgctgatggtctcgatcggcactccctcctcgagtgtgatcagagaagcgaaggaatgccttgctgtatggtagacaaggtcctggctgagtcctgccatcaggcgcagggatttcatattggccctgagcgtatggtagtcctgcggtggaaagagggtcatgcgggcatcatcacggtacttttcgatcagcacgagggcttccggcagcagcttgacgcgcccgaggtagttggtcttcttcctccggtacttcagccagagattgttttcttcatccgtgaagaggttctcccgagtgatacttaccacatcagcataggctgtgccggtgtagcaggcgaagaggaagaggtcccgggtgatgacatgcgacctgcgtttctctggaatctccagatcacgcagtttctcgaaattctcccggctgagtgctttcggtgtactttccttctgtttgggtagtttgaagtggcagaaatggtatttctccgaatgtccctccttgtaggcgatacggcagatctttttcaggatggccaggtagccgcgaagcgtgtccacggcatgtcctttttccatgaggatgaaatcctgatagtcgcggatgaactgctcgttgagttgcccgaatgccaggtccgagaccttgaacttcgccttgatgaattcggaaagcgtgcggtaggtgaagaggtaggtcgagagtgtggtgggcgcacggtctacgccaacacgggccttcatttccccattgtgtcggtcgagaagcttgagcagggtcatctgtatgcccgcattaccctgaaacatgtccctgaccgcggcggcatcgaagtcctttttcctttccatgagggaattgaaggccgagtgtacggcaagcagtagcctctctattttttcattggtttccaccgctttccggcttttgccgttcagccgactctcacgtgcgttccatagctcaggggtacaggatagcttgcagctgaactgcgccatcgtgcggttgagggtgatccgtcccatgatcggggctttgccgttcttgtccggctcgctctttttcaggtagagcagtaccttaaatttttccactttcataacgctcttttttaggttgtaaaaatactcctttgaaaagcgccctttggcatgcaaaatattgatgaacagtgaatacaaatccgctttgttcttatcgataaaaatcggttacctgtcgtcgtttcagaaacaggcggctaacagcctggtaactgaaacgctgcaatattttgttttcttttgcaggccagcctattctgcaattctcgtaaagtgcttaattataaacgttttacgttttatactcgccattccgttttttactgcatttctaaatattacttatactgcccgtcatacatgggctacgatggcatattatagtgaagtgcatcccggtatcatttcagaagctatgggacattcatctatcacagtaacagagacttatctgaaaccttttaagaataagaaaattgatgaggctaatgcaacggttctctctccctttagaaaaacgtttttgaagataagttgctgataaatatggtgttacttcttaggtaacggcaagaaaacacgctgcaaatatggacatattttggaaaacatgcaaacaaaaaagatattatttctaataaacaactaaaaaaaggaaacacatcaaacaaaactgcggattttttgtgaagaacacaccttgctctctaatttttgcaaaagatttccctcccctctgccgtctctccaa

SEQ ID NO: 153 - DNA, 18078 bp, Bacteroides thetaiotaomicron
tttcagaacttaatattattggatttacttcttgtcaatatgtgcgattttatcagtttatgctaacgataagttaattgtatgcttactaactgattcaatctgaaagattaaaatgattgagatattagttgtatccggaacaaataatctgtttcacttgtgttttattcattccttttaagggagcagaacgttcctcaacgaccaatgtcccgttggtttaaaaccaaggagtcgttcctttaaaaggaaatagctcaaataacgttctttttctgtataatccgataatatatatgcaaaaatatattgaaattctgtatgttattacgcgtttttatgcataatttctgctgtttgatgaaatatgtatggggctattctttgtgtaatcttaaatatagaacatttttttaagattctttctctgtttgttaaagtgaacaaacccgtcctctcatctgttagaaagtctcaattttagatttaacctaaccagcatgaaaaaaaataagatactttttgtactatgggctttgtgttttttcgtcattcggacaaatgcacagacaccgctaagtttcgaagaatcgttgcacctgcttaatcagggaaatcagagtttgaagatagctgataaagggatagagattgccaaggcagaacgtgacaagctcaatgctttttggtatcctaccttgcagtctacaggtgcatttgtgcatatgtccgagaagatagaagtgaagcagccactgtctcagtttactgatccggcaaaagactttgtacattccattattccggatgaccagataatctcagctattctggataaaataggagccaatactcttgtctttccactaactccgagaaacttgacgactgttgatctgtcagcagaatgggtgctcttttccggaggaaaaagatttcgtgcaacaaatattggtcggacaatggtggatctggcgcgagagaatcgtgcacagactgctgcaagccagcaaaacctgttggcagaaagttattatggtctgcgactggcgcaacaggtcgtagcggtacgtgaagaaacttataaaggtctgcaaaagcattatgaaaatgctttgaaactggaagctgccggaatgatagacaaagcaggacgactgtttgcccaagtgaatatggatgaagcaaaacgggcattggaagctgcacgaaaggaagaaacagtggtgcaaagtgccttgaaagttttgttgaataaaaaagatacggatgagaatatcgttcctacttctccccttttcatgaatgattcgttaccacccaaaatgctttttgatatgtcggtcaatagtggaaactatatgcttaatcaactgcagctgcaagaacatatcgccaagcaggaagtacggattgcccaaagcggatacttgccgaatatagccctttttggaaaacagaccctctattcgcatggcattcaaagcaatttactgccgcgtaccatggtgggaatcggttttacatggaatctctttgacggactggatcgggaaaagaagatccggcaatcaaagctaacccagcaaacgttggctttagggaagatgaaagcacgcgatgatcttgctgtcggagtggataaactctatacacaattggagaaagctcaggataacgtaaaagcgctgaatgcgaccatcgaactgagtgaagaactggtacgtatccgaaagaaatcctttactgaagggatggcaacttctaccgaagtgattgatgctgaaactatgcttgccaacgtaaaagtggctcgtctggcagcatattatgaatatgatgtggcattgatgaatcttctttcactctgcggcacaccggaacaatttgtaaactatcaacctaaaccgtaacaaacaatgaaaccaactagtagaaccctttcatgggcattcgtcattattatgctggcagtcggtatttttactgctctgggaataatattgatgcacaaacaaccgctcgtcctgcaagggcaggcagaagcgacagaaatccgtattagcgggaaacttcccggacgtatcgatacctttttggttcaggaaggtgactgggtacgtcaaggagatactcttgttgtgatcaacagccccgaaatacatgccaagtatcagcaggtgaatgcattggagcaagtagccgtgcagcagaacaagaaaatagatgccggtacccgccgacagattgttgctaccgcgctgcaactatggaacaaaacaaaaagtgatcttacactggctaaaacaacttataaccgtattcttaccttatataaagacagtgttgtcacttcccagcggaaagatgaagtggaagctatgtataaagctgctgttgcagccgaacgggcagcctatgaacaatatcagatggcggtagacggtgcacagaaagaagataaagaatctgccgccagtatggtgaatgctgccagaagtacggtggaagaagtttcggcactattggtcgatgcccggctgacagcacccgaaaacggtcagatagctaccatctttcctaaacgtggggaattggttgcgccgggaactcctattatgaacttggttgtcatggacgatattcatgtagttctcaatgtgcgtgaggatttgatgccacaatttaagatggagggcacctttgttgcggatgtacctgccatcgataaaaaaggtattgagtttaaaatctattatatcagtccgttaggaagttttgctacttggaaatcaacgaagcagaccggaagttatgacttacgaaccttcgagattcatgcccgtcccactcagaaagtggatgacctgcgccccggtatgtccgtattactgacattaaatgaatgatagaatgagttcatcacaaacatattctccttttcgttccgtgctgctcagggagtggcgacggatgacttcacgacgcctttatctgtgtgtgtgtatcatcctgccgctatttacccttttcttcatggcaacaatcttcggcaacgggcagatggaaaacattcccatcggtattgtcgatcaggacaatactgcctcttcacgggcaatcacccgaaatatatctgctgtgccaacatttaaagtgacaaggcattttgtgaatgaggaagctgcccgaaaggccgtacagaagaaggaaatttatggttatctctccattcctcccaaatttgagcaagatgctatttcgggaaagaatgcgactctctcctattattatcattatgcgttgctttcggtaggtggcgaattgatggctgctttcgaaacgtcgctggctcctgtgtcgctctctcccattgtgatgcaagctgtcgctctcggagtggaacaagacaagatcactacattcctgttgcccgtacaagccagcaatcaccctatatacaatccgagtctggattattcggtttatctgagccaaccgtttttcttcgtcttgtttcaggtattgattttactcattactgtatatgcagtcggaattgagattaaatttcgcactgccgatgaatggctgtttgttgccaaaggaaatatggtaacggctgttttaggaaaactactcccctacaccattatctttattctgataggatggctggcaaattatgtgatgttcggcattctgcatattccttttcaaggaagctggttattgatgaatatgctgacagcgctttttgtcgtggcaacacaggcattgggattattcctgttttcactatttccggctatctctctgatcataagtattgtttccatggtcggctctttgggagctactttgtccggtgtcacttttccggtgcccaatatgtatcctttggtacgagatgcttcctatcttttccctgtccggcatttcacggaaatgatgcaaaatatgctctacggggggagtggttttattcacctttggccatcggctgtgatactatgtatctttccgctgctggctttagtgttacttcctcatctgaaacgtgccatagaaagtcataaatatgaaaaaattaaataagttacaacagttatcgttcatcatccgacgtgaatatctggctatcagtaccagctatgctgtattactggtattgatgggtggaatcttcgtgtacggattgctctataattatatgtatgcccccaatattgtgacggatgtcccggttgccgtagtcgataattcacatagcgagttgagccgtaacttcatccgctggctggatgctacgcctcaagcggaaatttatgatcaggctatggattatcacgaagctaaggaatggatgaaagctggaaaagtacaaggtattttatatctccctcatgattttgaggaacgggtatttcgtggagatgaagccgtgttttctctgtatgccactaccgatgcttttctctattttgaagccttacaaggagcttcttcacgtgtgatgctggctatcaatgacaaatatcgtccggatggagcagtctttctgcctccccagggattattggcggtagctatggcacagcctgtaaatatagcgggaaccgcactctataactatacggaaggatatggatcttatctgattccggccgttatggtcattatcatttttcagacattactgatggtcattggtatggtgaccggagaagagcatatgacaaaaggcatccttgcttatactcccttcggaaaaagctgggcagtcgctatacgtattgtatcagggaaaacgtttgtttactgtagtttgtatgctgttttttcattctttctattagggttgcttcctcatttctttagtattcccaatattggaaacggattgtatattgtattgatgatgatcccctacttgctggcgacatcttttctggggctggcagcctcccgatatttcactgattcggaagcaccattgcttatgattgcctttttctcggtaggactgatttttctttccggtgtttcctatccgatggagctgatgccttggtattggaaagctgctcattatatttttccggcagcacctgctacactcgcctttgtgaagttgaactcaatgggagcaagtatggctgatatccgacccgaatatattactttatggattcaggcagttatctattttatattaagtgcatgggtatataaaaagaaactcagctgaaagtagtattttagttgcatattttaaactgatatcgctcaaaagtataatatttcaaccaacgaataattaactatggaaataaaaaagttttgttgaacattttacttgattatctcgtccttttttatttattttgttaactattatttggagatagaccatagtactactttaaatacaactatttatatgaggaatattatactatttttattattactgccgttaatggcatatggacaaacatacaaacatattggagtagaggatggtttgagcaatcggagaatatacaatattcagaaggatcaccaaggatatatgtggtttcttactaatgagggtatggaccgatataacggtaaggatataaagcactataaacttatcgaagaaaacaaacaattgagttccgaaatacatctcggatggctatatgctgataaagaaggcgggatatgggtcattggaaaaaaaggacgtattttccagtatgaagaaaagtatgatcgttttacaatggtctataagtcaccgaaagtcactgatgccatcagttacggttatttggaccgtaacaacaatttatggttatgcggcaaagattctattttgttgtataatactaagactactcaggttatgcggcttcctaatttgttggaagataatattacggtagtagaacaggctgatgacactcatttctttatagcaacagaaatgggggtccggtatactcagtttgaaaacgaagctttgaaagtcattcctttagatatgcttgatcatgtctatacgcaaattaacagtctctatttccatcctcagcttcacagactttttgtaggaacttttagtgatggtacttttgcctatgatatgtctgctcatcaaattatcaaatcagatacgaagttgggtgatgtgagtattactcatatcagaccgttgaatcaaaaggaactactggttgctacggaaggaatgggagtacacaaaattgatgtaaatacttgtaatacctctccgttcattgtggcaaactacgaaagttataatgagatgaatggaaataatattaccgatatttatattgatgaagaaaaaagaatctggcttgctaattacccggcaggaatcacagtagtcgatttccgttataagaattatcgttggataaagcattctatcggtaataagcagtctatcgtcaatgatcaggtacatgcggttattgaagatagtgaaggagatttatggtttggaaccagtaatgggataagtttccaggattcaaaaaccggtcaatggcattcttttctgagttcttatgataagcagctgaaagataagaaccatattttcattactttatgcgaagtttctccgggtgttatctgggcaggaggatatacgtcgggtatttataagattaacaagaaaacattgtctgtagagtacttttcgccttttcttcttagctctgtcaacatacgtccggataagtatatcagggatatgattaaagattcaaaaggatatatatggtcgggagggtattacaatctaaaatgtattgatcctagaaaaaatactgtccggttgtatcccggagtcaatactgttacggcgattgaggaaaaagatactaatttcatgtgggtggggacagctactggactttttctgcttaaccggaattccggtgaatatcagtatatattaatgcctgtggagtcaacatatatcaatactctttatcaggccaatgacggattactgtatatcggtacaaacggctcgggagtacttatatatgatcctggaaacatgagttttgaacactattacgctgataattcggcacttgtatctaacagtatttatacgattcttccggaaatgaacggacagataatgatgagtacggaaaatggaattaccagcttttctatagaaaagagatcatttcataactggagtcgcgaacagggaatgatgtctgcttgttttaatgcaacttccggtgcgttacgtaagaataataattttgtttttggcagtgttgatggggcagttgaatttccggcaggtataaagttgccggattatgaatattcgaaaatgatattcagcgattttcatatttcctatcaaccgatttatccgggagaaaaagattctcctttagagaaagacattgataagactgatgtgttgagacttaaatatggtgagaatactttttcatttcgtgtttcttccatcaactatgattttccttctcattcagtttattattggaggttggaaggctcttcttataatgaatgggtacaactgagtggcaatagtttaattcgttttaccaatttaagtcccggcaaatataaactttatgtacgtgccatatcgaaggaagaacctagtatcgttttcgaagaacggcaagttggaattatcatatcgcaacctgtatggctaaatggctgggctatattcatatatatgcttctgatcgtctttgttttcagcattgctttccggataatgattctgaaaaagcagaaaaagatatcggatgagaaaacacatttctttattaatacagctcatgacatccgcactccgcttacgctgataaaggctcctttggaagagtttgttgaggaagaaacactgacagagatcggttcgcagcgtattaatacggcattgagaaatgtgaatgcccttttacggttgagcactaatttaatcaactttgaacgggccgatgtttattcttccgaattgcgtatctcagaatatgaactgaacacgtatatgaatgagatatgtaatagttttcgttcgtatgccaatatcaagcatattgattttacttataagagtgattttaattatctgaatgtatggtttgataaagataagatggattctatcttaaaaaatctgatttccaatgcgttaaaatatactccagaaaatgggatagtcagcgtatctatttctgagactaaagactcatggaagctggaagtcaaagatacgggaataggcattccggcaaacgaacagaataaactgcttaagatgcactttcggggtacaaatggcattaatgcaaaaataactggtagtggaatcggattaaagctggttgataaattggtgcaccttcatagtggtaagataaatatagagagtgttgagcaacaaggcactactatcactgttgttttcccgaagggtaataagcatttccgtcactcgaacctgatagatccggaaaaaaccggcagacaggaagctgtactggatgctccggttatatccgaagcggcggaaaagacaaacgatgagaatctgcaacgtattcttattgtcgaggataatgatgaactacgtgcttatctggtcaattcattatcaccgatgtataatgtacaggcttgcggtaatggtaaggaagcattgatcattgtaaaagaattctggccggagcttattctatccgatattatgatgccggaaatgcggggtgacgaactgtgttccactattaagaatgatattgaaacatcacatattcctgtcttgttacttactgctttgggtgaagaacagaatattctcgatggtttggatattggtgctgatgaatatattgtaaaaccgttcagcataagaatcctgaaagccagtattgccaatttattggcgaatcgggcattattgcgcagcaaatatgcgaatttggaaatagatatagaggttaagactcctttagcgaaatgtactaatagccttgactggcaatttttatcggctgtgaaaaaaacgatagaagacaacatcaataatcctgccttttctgttgaggttctcaacgatttgcataatatgagccgtacacgtttctattataaactgaaagcaataacaggactatctcctcaggaattgataaaaacaacccggctgaaacgtgctacgcaactattaaaagaaggtgagtataatattactgaaatctcggagatgtgtggattttcagaatccaaatatttccgggaagtattcaagaaagaatataagatgagtccgagtcaatatgctaagaaatatagtatttcttcttccggtattatagaagatgattcagatgaataaaataataagctgctttttctttgcagaaaaagcagcttattattttttaattagagacattacttgcgtatcaagtatttaataaacaaataacctcctaatacttgcaggcacattccgggaataccgatgcggaagtcctgaacagcattgtagaaatttcctatatacatccactctcccaatgttccgatgatctgataaaacaagactactcctgctaatacagggatagaaatgcgtccgaagcgttgcgcagcccatccggcggcgatagctaataatacggatttcaataggatggcaggcaatactgcgggcactggcataccaaagagcagagagtttatgactggagacaagatagcagttagcaaaccgaccttccagccatatttgtaagcaccgatcagagtgaagaaataaataggcagccaggttaatccacctagtggaatgagatgaaagagcctgggaaaaaggatattgccaacgatgaataacgaggctgccaaataggtcttcacattactgtaattcagtgaatagagttttactgttgtttccatatctttattcttttagaaattcaaattaataccacccatgaatgttgccttgggcatgggataccctgcatttatttcgtaacgttgtgccaacaggttttcacctttcacaaagatgttggcaaaattacaaacacgataacttcctcgcagattccataaaacaaaactatcctgttgctcggtgcctttattattaacgattacagaagtgtaaagtcccttaatatattgcattcctgtcgatacagtccagcgacctgcggtatagtctgctccgacatacaatttgtgttcaggagcggcgagaaccggattctccatgtgcaaccagctatagttggcattcacattccaatgagaattaaaccgataaccgatattcgcttcaattccccagttttctatttctccggaattgacgttcagcggaggcgtcaaaccgttgctcataattacattgtcaccattaatataatacaggttaagtccgtaatataaggcatcttccaataaccgttgggaataggaaagttcataactgaccagtttttccggattcagttccggattggcaggagcaaacatatacatttcccggatggtagggttgcgatatcctttgctcaccatcgctttaagttctgcacttttgggaagatgaaaagccagtcctccttgtggaatccattcagtacctacatgagagtgatgatctacacgaacacccgcatccaatgacaaccagctatttatatcctgacggaaatcgacatatcctgcaaattcatccatttgcttgtctactcccggtttccgctctccggtagccaagactttgttccatgattcccctccgaagtgctgatagtcaaatcctaccgtcagacgattgcctgtgaagaacgtagcactctgataccaggaaatgccgagcatcttgtctttagaattaaagtgtgatgtttgtggttgttctcctgttttatatccgtcattgattttatgccgtccccaattatagaaaaggctcaaagctcctgatgtcttctcataatggttttccaaggcaagcgaggtcataccacgtgtaatacgcgaatcattgtcgataagtggaacttgtatcgttcccggattggaagcattgaaatgggttacatttacatctccccagagtttccaggaagagctgaaatcatatcctaacttcgcgtatcctccatattgtttgaactccatatcgggacgatgtccgtccgtacgattgtaagaaccggtaacgatactgctgaaacgtcctttctttacacggttggaaaattccgtctgcaaagtgttgtatgagccataccctacctgcatattcgttcttactccctcatcctgctgtttgcgggtgactatattgattactccgcccattgcattcgagccatagagtacagaggcagggccgcgcaagacttccactttctctgtcaacatagactgatatgcatccgcaatcggatgtcccatcaatcccatatattgcggatgtccatcgatcaaaaccaataaacctgccgtcggactgcctccgataccacgcagactcatgccacctgccgcacctgtggacacaccatatcccataataccacggctggtagtaaagaatccgggaacctgttccgtcaatagcggcaaaagtgaaggttcatatcttttctctatttgttgccttcctactactgaaatagtcatgggaaggtgacgaatatccgtctcgttccgtgttccggtaactacgacttcgtcgatagtatagtttcttttgacttgtgtgctgtcttttccgggttgtgccattcctgaaatggaaagcaggctgccgaacaaaaacaaacaaactgtatttgttttcatattctgtttcgcgcttttatttctcctgcaactttttaccacttcttattttttcgaggaaatcacgaatcagcggcaatatggcttctgccgattcttcttcgctacacatcgtttctaccggacaccagcctgtgtgatcacgattccatataaaaggtacttcttgtacgaaatggacttttatatccgagcttcgtaataaatccaacgctttcgaactgatgatgtctgtatgaagttcccggatacctcccaaaatcatgagggcggcagcccccttccctactactttgtcggctatcgaagctcctttcaggaaatccggttcctgtgtcagcaaatcatataaatccgctacgccacgttgggtaaaggtacgtatgttgtctccattggcaatcacacaggaatatcctcccgagtgtaataagttgattaattcttccattataaggttccttgtttcagttgttctacaaattggtcaatccggtgcagttctttgggtatatctatgttttgaggacagtgaggtacgcattgattacatccgatgcaatgactagcctgacggagtttaggtacactgcggtcatatcctacaagaaatgcccggcgggctttgagataattctcatcctgtccgtttttaggaacattgccttcattgacacaacggttataatgtaataagacagccggaatatccagaccatacggacatggcatacaatatttgcagtcattgcaagggatggtaggatacttcagcattaactgtgccgtgtcttccagaaaatccatctcttcgtcagtcagcggttccaatggagaataagtacgcaggttatcctgcaaatgttccatatatgtcataccgcttaatacagtcaatatatcggggaacgttccggcaaagcggaaagcccatgaagctacgctgctttccggacggcgttgtttgaggcgtgccaccagattgtcattcagtttagacaagcgacctcccaaaagcggttccatgataatggatggaatcccccttttatgtagctcaccatacagatattcggcatcggtattccgggcatttgtctctttcgcatgcttccagtccacatagttaagctgtatttgtacgaaatcccactttatctcatcgtgtcgggaaagcagataatcatatacttcgatgtcgccatgataggagaatccgagattgcggatgcgacctgcttcacgttcttttatcaaaaagtcaagcattccattatccagatatcgtcctttaagggcgtccattccacccataccgatgccatgaagcagcatataatcgatatagtccacctgaaggtctgcaaaagatttatgatacattttgagggaagcttcgcgtgaccatgtatccggagagaagttggatagtttggtagcaatgaagtatttatcacgtggataacggcttagcgcaattcctgtggatttctcagaaaaaccttgcacgtaggccggagatgtatcgaaatagtttactccatgagcgatggcgtaatcgattaatccgttcactgcatcctgatcgatcacttcacccttaccgtcgggagccggtttgagaggccagcgcatacagccgtatcctaaaagtgacacgcggtcgcctgttgttggagacgtgcggtaagtcattttatcggtaggaatttccccttctgccgatgcactgcttgatgaagaagtgccttttgacgagcatccgtatagtatcgctgtcgatgtagccgcactgatacctacgattttgataaaatctcttctgtttatgtctttcttatttttttcttccataatcttgttctgatttaaatcatacaattctgtgcatctgatgtccggtcacgtaaatggcactgaaaggacgggatggacaaagattctcgcaagcaccacaaccaatacaccgttcgacattgattgccggaatcttcggtgagtccgctatttcgggatcggaagctaccatctgaatagcggctgccggacaatggcgggcacagttgccgcattccattccatcagtcagcggtacgcagttctccttgatccatacagcatgcccgatttggatagcggatttctctgccaggctggtcagatgaatggcatctgtagggcatacttccgcacatttggcacactccggacggcaataaccacgctcgtaggacatttccggctgcatgagagttgccagattaccggatggacgtaatacctgagtaggacaaacagagacacatagctgacaggcagtacaatgttgggcaaagttgcgtgcatttaatgatccgggaggataaatcggattctcccggttgggaatcttcttgtcttcaatggctgccaatcctccgtctacctttttctcctgtgctttcagtatggtagaagtagcgaaaatagtcgatgccgaaagaaaactacgacgggcattgtcaatctgttccgaggtcacggattttattttaaccgcttccgtattaaccccttctttcttttgaatacgtctggtatatttaatagctccttgcttacattttcccaggcaatccatacaagcgacacaacggctataatcaatttcatgggctttggcattaatacaggatgccttacaattacgtgcgcacaatccgcagctattacatttggaagtatcgatcacaggcttgaagatggagtatcgtgatatgaatcccaatacggtgccgacaggacaaatggtattgcaataagtacgtccgttacgccatgccaaaacaaaaagcacaataagggtaatcacagcaatgatcagtgttgaaagacttttcatccagacatccacttcatagaaagcatagctttctgcccgttcggcaaaatatgccaagagattatttccccattgccataccggagccagcagactggaaaccatccggccgtatgcactgtaaggtgccagtagaacgacaaaagcattcagtccggcaaccaaggcaaggatgaatacagccaatacaccatatctcagccattttaaagccggagaataacggaagcggttctttttctgtttgccggagaaccatgaaacagcatcctgaaatactcctaacgggcaaatgaccgaacaataaatacgcccgaatagtaatgtgagcacaataaggaatagcacgacacctatgttcaaggctaatactgccggcaggaactgaattttcgccagccatccgaaccatgtgtgcaatgtccctgtgaaatcaaggaacagcagggtaataagtgtgaaacacacgattgcggctgtaagtctgatagtacgcaacataaatttattagattttcaatttatagtagttatatcttaattattttcaattccatcagaatcgaatcttatgctttttaaccgatgcaaatttaagcagagtgattgatttttgcagtatataaattacagaaagttataccaatattactgattaggattttttttaattctggattgttatatcataattaccgaaagtcattgtacataagagtttctgtcattcagaacatttcccttggtaacgggaggtctgaatgacagagcataatgattactttaagacatttaggattttagtttgtctagaaataaatcttataacttatattgggaattaaccctgttccttctttttcttcaatttcaaaggtcttttcattgtattggtaaaagtgcattccggtgcgcatacctacattcagaatcttcaatgagaactcatgagatactcttttcttatttatccggaaactgacagaaacatcaccgtttatggaagggaaggattgaatcttttgctgtatgctttcgtttcatcaaaaaagatgtcatgctctgtctgacttctttcttcgtttacgggggtgtagcgttcccctccctgaaagaataaacgtccgttgagactcagtacgttttgtttaagtttgccgaccatccattcttttccggcaagtaagttcagcagatagttcttatccagtcttgtattacgccaaacgttatctcctcccctatatttcgatttaaacaaagaacctgtaatcatatagtagaagccatttttcatatattgttccagcgtgatgtctattccataatttctgccttgaccggtgttggtcaagattctgtccaaataaaattcctcatggttaatgaccgagaaggaggagttcttttcaaccggtatacgaaataaatattggaaataaggctctatctttaaatgcaggttttgattgatattccagtcgtatgtcatcccgacatgatgtgcccgggaaaaatccagatatcgatttgactggttcttgccgttgacgaccttttctacaaaataataatccagcttttccctgcgactatgtaatccataggccaacgccaaagaatgtttcggatttattttccattttagggcaacccgcggttcgatggataagttattgttcaaagtaaaatattgggctgttactcctaagctagtgtcccagttattattcagattgataaccgaactgctataggccgaaaagactgtgctttcaccatcaccttttgaaatctgttccataggtctgtttaatccgaaataacggctgacctgataatcaagatcatagtgaaggtttgtaatcgtaacccccgttctgttagtatgtctcggactgaacttcgtattcagataagaattaaaaacgaagtcccacctgctgttccggatatctcctactctgattagtttgtcatctgcttgttgatctaccactgtatgatctttggaataagtagcagacagggaagagcggatatacgtgttttcattcatcacatacttgtgtgcaagtcctcccaccattttttctagtctgttttctcctgcttgtcggtctcccagagtttcccatttggaacgctcttctattggagctttgtttctgtcaatcaatcctaatccccaaatagaaaaggtgccggctttggaggtcggaaagtttagcttgaatgctaaatcctgatatttaagattcaggtcattgccggtagccagtgatgtagtcgaaaaacgatagttaacgagataagaacttcctcgctttttactgattggtccctctgatgacagatcgatacccattagtccgacttgaaaagcgtgttcgtacttttgattatttccattgcgcaggtgcatatcgaaaacacccgataatacattgttatattctgcgggaaaagctccgttgtaaaaatccgaatttccgatcacctgtgtactcagagctgacaggaaacctccgcccaatcccgacaaatcggcaaaatgagtcggattgggtatctcaattccttccagcctccattgcgtgaattgcggggagtttccgcgaatggctacggcattggtgccgatgtctcccgctactcctgcgaaagcggcacttaatcgtgcagggtcatcgaagccgttggcaaatctgccggcttcttccatgctgatcatacggccgcctgtgatagccataggattgatcgtccggtttttctttatttccggcttcacgaggacttctgccagatattggatattctcgtccatcggaatttctacatatacttctttggatgaagttacggatacctcactgattatgcttatgtgatatcccgtaaaagacgcttgaatattgtagcgtccaataggaacattgctgattctgaagtttcccagactatctgtggagctattcaaggaaggttcctctaagacatagacagaggcatactctattggagcattagttttggaatcgactacaattcctcttatggtttgcgttagtttttgtgtcttttcgccgattgtttctgtttttggtgtcggcagagagataataatatgatatccctttattttgtatatgtatccggtacctttcaatatttgtgttagtgccttctcaatgcttgcggactttagcgacaatgcttgcctctttttcaggttcaggtttgactgttcgtaagctatgctatagtctgtttgtagt

SEQ ID NO: 154 - DNA, 17974 bp, Bacteroides thetaiotaomicron
attttaataagtttgtgttttttctgtttatagatagaactatgcgcattattcaaagtcactctgttgtttttcgacttctttcagtttcaggcggttcagttcctgttgtaattcaagtacacgtttctcacaatcggatggagcggcatttattttatttccggcatctttgcttgcggattgtgcttgtgtcagttcatctttgtctgctaccagcgtatgttctgatggaaaagtaggaataatcagttctgccggaaccggcgtatgtttgccttgccataccactgatgcacggattttaatttttcccggtgtagtggtggaccttaccagcaccggagcagttccccaaagtaccggacgtggattggtgaatgtttcttcattggcaactagttggccctgcccttcgatttcgaactttacttcataattattcaaacgcttgatgtttccgttttcatctgcgatggctgcaatgaccgtcacgatgtccgatccgtccgctttcatctgtactttctcgtcatctgcccaaagcaacagttttgacgggcggcgtgtgggtgttactttatgtgtcgcaaccacttttccgtccattaatccttctgccagaaggtaagaatctgcctgtttcttttggcgtgacagctttttatcatacatgacatcaaatacatccttgaatgtgatgacgggtgagggcattccgctttcatttgccggcttatgataagtatattctttgcctcccttgcaatacgtgaggcgaacttcgtcacagttgctatatatcgttacatctttcggagagaatggggtcatggcattggctatgtaaatcatcggtccattatctgcgatcaattctttgttgggttcggcaggacgctgggaacagaacatataataagatagtttaggttgtcggaaggcatccatgatacctccgtaaaacgggtcaggatgatatcctctctggtgatcgaacgagtgccacaggcaaccgcccatatgttgtcttgaagttctgtatagtccatcataactggtgagttggtaatcgtttttggcatatccctgtgcctgaatcagcatcggtacttctccccagccgcgattgacccggcttggtgagttgtgagagttccagtcatccacattatctccccattcgcgggtgaaataactgattttcggatccagattttcggtattaaaggctcctccacctccgttcatcggatgggtgaagtgtatcggaaagtattcgtgtccacgtgcggttacatcacatccggcatagcaataaggatacggatattcttcattgagaatgtccactacatttttagcaaagtcagccggataccatgtttcgttcagaatcggttcccacatccatacactggggtgattgcggtcgcggcgaaccatattgcggatatcactatatactctctgagcaaatatcggctgatcattccagaattgccatcccggtgtgttgacaataacaaacagtcctaattcatcacaagcatccataaacgccggatcttgcggataatgggcgttacggataacacgcattccggcatcacgcaacttcttcgcatcccgccaatgaaggctgttgggtaaggcgttaccaatcactgcaaaatcttgatgacggttggctcccatcagaggataggggtaaggtttgccatttagccagaatccgtcttttcctttaaattcaatgctgcgaatgccgatacggcggtaatatccgtcgatggtgttaccggctttgtcttttatataaatgtgtagtttgtaaagataggggctgtcgggtgaccataaatgaggtgtttctacggtcactttgcaagaaatttgtttcgcaagatccttgcttaccgacaaaccggtctccttagagagaacacgtttgtcgtcgcggtcatagagttcatagattattttaccactgaaggattttccggaagtgttgcgtatatgtgcatccagtttcaactgtgcggattgctcggaaactttgtcgaaagagacaaataatccgcctccggctgtctcattctcataattcggatcggtaatgaatactttgttgtgaactatcatccagcaatctcggtaaattcctccaaaatatgcaaagtccagtgcatcttgcggtttgccgggagggtaggagggatcgtcactgttgtctgcccatacggtgataacattgtcttctccatacttcagactggaagtgacatctacgatgacaggtagaaaaccaccgaaatgctctttcagcaactttccgttcacccatatttttgattttcccataatggcttcgaagtggaggaattgttgttttcctttccaactctccttgggagtgaagtgtttgcgataccagatttccccctgataattgatgcatccgctcgcttcggtggggagatattctatgccatcgggtaatgatacgatgttccagtctttatcattgaatctcggctgttccgctccttcgatattgcctttataaaatcgccaggcaggattcatgttatacactgtgcggcctgtgttggaaagctgataaaagcctgctgtggagtaagatggctggtaagtgtcggcgttagctaccagtgttccagccaataacagaccactgagtaagattttccaccatgttgaagtacttttcataattcttagatttgcttgattgatctatctttaatatattaatgtcagactgttttgttttgcattagaacttcgtcccgccaaggtacaaattttccaatagtttgaagcataggacgctgagctttattttttcttaaacattagcccggtgcgtcctacactttttaccatatccgaaatgacctatatctttatttaatacctatcgggccttcattggcttgaattggccatcctggattctggtaaataatagaagtactcagatcgttaggatttgaggctctaattctgaagtgcgtgatagcgataggattcagataatgcgcttcattttcgaagcggggcactactgttgcgaggaagtaattagcttcacgaatggcagagaaataccacggatcattacttgctggattatcataagcttccggaactttccattgaccgggaatccatttcttatcatagtcagtggcagcctgattatctgtagcattgtcgtttttccagattccggcattaaatccctcatgcgtcctgaagttgtaatgctttacagcataggcagccaagtcattttcagtaaagaaaaagttgtccggggtcacactgtctaaaggttccctgtccaaaaaaacattgcaagaagcgagtataaagcttccccctgtcagcaaaaataaatatttaattatctttttcatacgtcatcaattaaaagttaacactaaatcctgtggaaaaagtacgggacaacggataagtttttcctgaactgttcgatccgtctttcgctcaggttggaaacacctattttgcgtgtgatctgggcggggatggtatacccgatctgcaaattcttcaaccgtacataggcggcattctgaagatagcgggtttgcgtcttttgattttttgcgaagttatcaaccaagatacgcgggaaataagcgtctcgaaaagatcttgcagacttactaattactatgatcgtttgtgtattgtcagtcgttcgttaactattactcaggcttacctattgctgaaaaaaagcactttcttaaaaaaaggaatatttaatcagccaaggaatgctataaattacattacggataaataagaagtagaaaaacgcctgcatttgcttgaatgaaaatcttcctttcttttatttaagttgtatgctgaatagattgatatgatattacttcttatgttttcttttggatgatgtattggctgaaaggataactttttgtttaatcttgccttttcgctatttgtgattaaccagcgtgaaaacaagctccgggtagtctttttatctcttcctcaccgaggaaaaacaggttcctcggtgaggaagaatgcgttggttttaaaccaaggaggcgttcctttaataccaacgagtggtttagtgatagaaaaagatgcatatctcatgtgaatttatgcaataataatctgttattccgtatattattgcactaatttatgcgctttattctttgttttatcatttttatctcaactgtatttttgtttaatcttaaaaatagcacattgatgttgggctgcatgtacatatttctaagagaacgatgggtttatcaattttcttgtttcaatgattcgtctttctgaatatagacagtccgtgtcggaaaagcaaggttcaatcctgctttattaaaagcagccagtatttccatattcatatttgaggttacgcctaaaatatctccttgtttttctataaaatagatatacatgataaccaatgcggaatctgagtattctgtaaaaacagcgactatatcagaagggttagaagatacattttctactcttttggggatggatttcaatagttctaaagcttctttcatcttttcggaagtcgtatcatacgtcagtccaagattcaagactactcggcgcataggttcggatgaaatattaacgatagaagtatcggtaatcttataattggggaaagttataatacgtttgtcgtaattcattatttttgtgcttcggactcctacgtctactaccgttccttcataactatccacgcgaattgtgtctccgatgctgaaaggtttatccgtcagaatggtaaacgcaccgaaaacgttttttactgtatcttgtgctgccaaagcaaatgcgataccaccaatacccaaagttcccaacagagcgctgatgttaactcccacattactcaaagccatgacgatgccgatgagccagactataaccaagatggttcttttgatgattggcatcattttgttagcttgtccgttggactgctttccccagtaaacctgaagtaaactactgaacaaacggccgaaaaaccaagtaatatccagaacaatcaaaatgctgtaagcattgtcaactactttcacaaaactgtccggataaaccaaccgatggatagcgatccagattcccaacagaattatagcaaacttaacaggcgcttccaaagagtaaaaaatgacgtcgtccaggtgattgtcggttcccgtaacaaaaggtttgataactttcttgcctaatagcgataataatttcacaataataattgctcctaaaataataagaatggaaataccccagttttcaatagtatttccccataattcattttctaacatagtctaactgatttataattgtacttttatttaataatatcaagttgatctcctttttattgacgatacaagataagagctgaagatgctgtgatagaaatatcccctcccgataaatgctcctgactgtctagatcaatttgtccgttatggcagactataatccaatcttgttccgggatattgatatctgcctgattccggttaccgttgtatgcaaccagaatttctttccattcatcaccgttagcatactcgcctagagtataagcgatgacaccggaatcgcctgtatcaagaaaatgaagccatttctctaagccctctgctgtaggaatacggaaggcgggatgttttttgcggagtgcgattaatgttctgatataattgaatatatcacggtttttagcttttaacgcccagtctatttggttgacggcgtcagaagacttgtagctgtttggctctccctgtttgtcctgcatgatttcttcaccgccacgaataaaaggaataccttgcgaggttaaaagcacggtgtgtattaatttgtcaataggaaccagttcttcttcagaatgttcgccttgaacagataatttcagcttatctaccagcgtatatccgtcatgacaggaaacaaagttaatcatttgagagggagcagcggcatatggaccgtcacagtaaagtaacccgctataatctacctgtgggtgttgtgttccgccaacgattccatatttgacaggttcaaaatgcccgttgatatttccggaggcataccctggttcctgttcgtcaaaggtacttcctttcagaccgtcacgaaattcatcattaaatacggaaatacctttcatttttcgtacattctcctttacagcccgttgctcgaaaggtaatggagaatctgctgctacccaaccttctccgtatacaaaaatggtggggtcaatttttaataattcctctcttaactggttcatggtgtcgatgtcatgtatccccatcagatcgaatctaaaaccgtcaatgtgatattctttcgcccagaatttgaccgactcaatgatataatggcgaaccatttcgcgttctgaggctgtctcatttccacacccggaagcatttgaataggaaccgtcgggattctggcggtaaaaatatcccggaaccgttaggtcaaaattagaatgctcggttgaggctgtatggttataaaccacatcgagtacaatacgaaaaccattttgatggaggctttttaccatctctttaaattcgcggatacgggtggtgggggtgacaggatcggtggagtaacttccatctggtacattataattcttcgggtcatatccccaattgtatttgtttttctccaatttcctttcatcgattgtggcgaaatcgaatgaaggaaggatgtgtatatgcgttactcccaattcttttaaatgatccagtccggaagattctccttcgggagttttagttccggtctctgtcagagcaagaaacttccccttatgttcaattcctgagtttggatcaatactaaaatcgcggtgatgaagttcataaagaatgatatcggaatacattttcagttcgggtgactggtctgattcccaaccttcgggatttgtctcgttccagtcgattacagcagcgcgattgccattgatgccgactgcttttgcccagataccgggtgtttcgtccagccattttccatctttttctatctggaaggtgtagaaagaacctttcagatcacggtctatatggatacaccaggtcccattgtcggctatgtccatttccagttgttcttccggatctcccgcttcgccggatgaatacaggtttaaacggacattatcggcacttggtgcccatagcgtaaatatggattgctggggtgtatagactaattccaaatcgttctcataatagcacggatacttgtcatacgaatccaactggtccggggacggatgatttttcaactctctcatattttctaattttatattaatactatataaaaaaaataatcatgttgtggaataaatgaaccggattattccgttatggtatgactgaaaacaaatgtgaaatcaaaaattcctgttcacgctctgataaatatgaataataaaagaataattaaggtaattttacggtgttgtaaatcagctttttatcctttgcacttttttgtatttgttagcttataatttatagaaacgtaggaactttgttaacatcatctttgttttgtataaagttaattataaaaaaaaatgaagcgtatggaaaatggtgttatgatgcaatattttgaatggcatctcccgaatgacgggaagttatggaaacagataaaggaagatgcgttgcatcttcatgatataggtgtgactgctgtttggattccccctgcttataaggccgatgagcagcaagacgaaggatatgcgacttatgatctgtatgacttgggcgaatttgaccaaaagggaaccataagaactaaatatggtacgaaagatgaactgaagaaaatgattgacgaattgcacaaatatcatattgctgtttatctggacgttgtattgaatcataaagcgggtggtgattttactgaaaagtttatggtagtggaggtcgatcccaaggagagaaccaaggctttgggtgagccgtttgagatacaagggtggaccgggtatagctttcacggacgtaaggacaaacattcggattttaaatggcattggtatcatttttccgggacgggttttgatgatgcgcaaaagcgcagcggtgtttttcagatacagggagaaggaaaagcttggagtgagggcgtggatagtgagaacggtaattatgattttctgttatgtaacgatattgacttggaccatccggaagttgtatctgaattgaaccgttggggaaagtgggtttccaatgaattgaatctcgacggaatgcgtctggatgccattaaacatatgaaagatcaattcgtcgcacaattcctcgatgcggtgaggagtgaaagaggcaatgatttttatgccgtaggtgaatattggaatggtgacctggaagcattggatgcttatatagaagctgttgggcacaaagtaaacctatttgatgtcccgttacattataatatgttccaggcatcacaggaaggtaaagactatgatttgcgggatattttaaaagatactctggttgaacatcatcccgatctggctgtaaccattgttgacaatcatgatacgcaacgcggaagttctcttgaatccaatgtagaagattggtttaaaccgttggcttatggtttgattttgctgatgaaggaaggttatccatgtctgttttatggagattattatggtataaagggggagaagtctcctcatacccggattattgatatattgttggatgcgagacgaaagtacgcttacggtgatcagatagaatacttcgaccatccttcaacgattggctttatccgtacaggagatgaggaacataatggctccgggctggtcttccttatgtctaatgacgaggcgggaagtaaaataatgagcttgggtgagaaacataaaggcgaagtctggcacgaaataaccggaagtatatccgaagaaataactttagatgaagaaggaaatggagagttctctgtcgaatcccgtaacctggctgtttgggtgaagaaggattaggttatggtatttatataattaattatgaagatgcttgttacagttgtaatcaggtatcttcatgatttgtatgaaagtcatttgcagacagaaagattctctgtatctttgccgccatggcagaaagaagcgaactacatacgagaaataaacacaatggacaatatgatttttcattgttgacagagaattatccaccgctcagaaaatttgtacttctcaatcctttgggaatacaaacaatcgatttttttaatccacatgctgtgaaagcgctgaataaagcattgctgataagttattatggtatccgctactgggatattccaaggaattatttgtgtccgcctatccccgggagggcagactatgttcattatattgccgatttaattgatccggagagagtcagtaatacggcaaatgaagagaatggagataagccaaaacgacagtgcagatgcttggatatcggtgtaggtgcaaattgtatttatccgattattgggcacgttgagtatggatggatgtttgtgggttccgatattgatccggtatccatagaaaatgcgcgtaagatagtgacttgcaatcctgtattagcacataagattgatttgcggcttcagaaagacaatcggaggatttttgacggaatcatcgctcccgatgaatattttgatgtaacaatctgcaatcctccgtttcacagttcgaaaaaagaagcagaagaggggacattacgtaaattgagtagtctgaaaggggagaaagtaaagaaaaccaaattgaatttcggtggaaatgcgaatgaactttggtgtgagggtggagaattacgttttttgctgaatatgatttctgagagccggaaataccggaagaattgcggttggtttacaagtctggtttctaaggagaagaatctggataaactatatgctaaattaaaagccgtccatgtatcggaatataagataattcgaatgtgtcagggtacaaaaaatagcagaattttggcttggcgatttttggaatagctgattttgttttttttcgataaacggatatttttaaagaagattatctgtataatgaaaaaatattgatgattaagaccgttatttgttataatgtgcctggatttgttgttgttttcgataatagagtcgtttctctctctgtatattctatatgagtattaattcccctttctccttttctttgatatgccgatatttgtagtatgagattatagtgctaggaaatatcaaatcaagggaatatatgtttgttgttagattgagaaactatttacatttgtcgtttttggttatatttttattgttttcctcctgtattgatgagttttataaagatacacctaaagagggatatataacaattaccggtatcaatacacgtgcctatacaggagcctatccgggtgacgggctcgatgataaggttgaaactctgcgtattctggctttcaataagacaagtcgcatctgcgaaagtaatactttttattatggagatgtgctgggcggaaatacgctacggcatccgattaataagggtgaatatgattttgtctttttggccaatgaacctcataatacaattgtgaaggcggttcttgacaatataactgattatgatgcactaaagtcaatatcctatccggcggagttcttcgattcggaacgggttatacctatgattgcggaaaataatagtataaaagtgctggctgatggaaacttggaggtaaatggtgttgcatctaccaagttgacagtaggactcagacgcttggcggcacgtgtggatgtggttttgaaatcgaaagtcgattttggtgatgccagttcgagtgaatttgaaggaattactttttctaatataccggatagagtgcctttggtatatggcttgcctagtgattgtttacccagttcctgggcgtatgccgatccggttcttccttatggtggaacggccataaccagaaatgtggaacgtaaactcacattagctgataatgccgactgttttaaaatagatcccactttattgaccactgaggataaaaataacgatttagtctgggctgttaaagttaaaaaagtaattctgccatctagcttcttttcatcgaagtccgacgagacgaatgcgataaattttactgttaacctgattgacaagtatagtccttcctgcaaattgaagattctgtccgacccggattatacattaccggcaaatgcgaaacttgatttgacaggtatcataagagaacctttagaagtaaatatacagccttctccgtggattgacgatggagatgattgggaaatatcaggcgtccgtgttctgaatgtatcgcatatacaggctaagatgacggatatgaacggagtccggatttctttctggtccaatatgccggtagtgaaggtgttgggcatagtaaagaaagaaggtgaagcgaatgaaagagcaactaatacagtctttaactgtttggcagtagatgataataatcctgatccttatcgtttcttttatgattcggcttcgggcagcggatatatggatttactggttgacggaacaaataccaccggttttggtacgcatgacaggaccgagaatatgagtggtacatatacattgacattatctgcagcagaggatactaatggtaagaatgcattgcagaggaagataaaggttaccgtcacacaagaaggtttgcgatttgttcacaatcctacggcaaatcaacatggtttgttcaatgcagcattttttaaacataaccagaaaggagaacgtattataacaggacagcatcgattggatcaaacatggtctgttagtgtacctgttgcctatcaaaactggcttgttgtgagcgcgactcccagctttgatccgaatattggaacagaatcaccgggtgatgcggaacattatccggtgactctcaatccgtataggggagaagatggtactagtatctcaggtctcaccggtcgtatatatttccgtattggcgttaaggaaaatgccgattttgtaccaactaaagaatccgagcctaaatttggatatatcaatttgtcatattatccgggatggcggacaacaatgaaaatttatattcgtcaaggcgaagccggtgcttatatatatgcaccgggggatgctatttcgggaactgtatggggagcgtggaatggaggtacggatattactacacatgtgagagaagatatgcgtcttttatcgacgaatgcccgtaggggagcagctaagttctctgctttaaacctgacaagcgagaggttagcagggaatacgaatccggattatgagaatgtgaacgtaaaaggtgctcgttttgtagacttcccttcgcaggcgggtgcattctttcagtgggcggtcgatttgaaaggcactacttccggtatgactgattattaccgcagagcttttaatccctcgaagtcatatcttgtttcaggattcccttggggatatggggaatttccgatcatgtgggatggagatgtcagtgctaatattcctgcatataaagaacagtttgaagtttgccctccgggatatcgtcgtccgacggatggctatacggataaaatatcttataatggatattatgattatttgccggatgagggtactacgggtactgccacgaattataaagatcaaatagagtattcagaattaagggtttctttatttaatgtaccttttgcaggaaatgcggcttcaagtgcagactacgctacagcttttactactccttttggtggaactggtaatacaggtcctgggacatatccttacggagcaaacaaagatatgcttgcccggaaacaactaaaaggaacaacttatacattttattcggacggatttttcgacagacgtccgataaaagaggcttcgaatggaaactatggcgtatcattaggaaatagtaatgttgcttatcagggagtattgtattttaatcccgattccggaacgaatgcatctgtcttttttccgtcagccggtcgtctgaataacacaagtggtgctttggaaagtaggggtagtaccggatactattggtcggcaagtgtaggtcctccttatatgagatcggaattgcagaatccaccttatgacaggagaatacgttatggagcctggtcgcttgagtctgcatataattctcataatttcagattgtcatatcaaggttttgctcaaagtatacgttgtgtgaaagaataagaacttttcggcttacgataaaaataccggaatatcatccgttgaggggttggctttttagtcaaccccttatttgtgcgtactctctaacaacaaaactgctgttttaagaagaaatctttatttactctaataagattctaataggattctaactattctctaacaggctctccgaagggagccgtctatctttgtgcccggaaatccggttactaacttaacttatgtttaattatgatgatgaagagagagttacacacatttattattggcagtgtgttgttttttaccgcatgcggggataaacaggaatcagagcaaaaaagtggctatcgtatacaaggtgacacggtctatattgcagatcctcttttacttgaaaagatcaaagtatcagtgtctgaactgaaaccctattccaagaaggtgataacgtccggtgtggtgcgtcccattcctccccgttatgcttatgttgctcctccatttgcagggagagtcacaaaatcttatgtgcgtatcggacagtcggtacgtcagggaacacctttatttgaaatcagttcccccgactttacttctgcacaaaaggaatactttcaggcactttcgtccagggaacttgctaaaaaagatttgaaacgcaaagaagatctgataaggaatggtgtcagttcgcaaagagaactggaagaagcccagaatgctttattgatagcagataaggagtttgaaaacgcctctgccgcattgcgggtatatcaggtggacaatccggcggaaatgatattggggcaaccgatgattgttcgttctcctattcccggggaagtgataaaggataacatcgtaacagggcaatatctgaaagatgataccgaaccgatagctattgttgccgacctgtctaaggtatggattgcggctcaggtaaaggagaaagatatccggtttataaatgaaggcagtagtctggatattgaaatttcggcattgcccggtacggttattaaaggcaatgtgtatcatgtagaggaggaggtagacgaggaaacccggtccattcaggtactttcggtctgtgataatttgaacggacatctgaagctggggatgtacactactgtccactttctgagtgttccggtcggacaaattcaaatcccggagaaaacgttactacagggcgaaaaggatagctatgtatttgtgcagattgctccgttggttttcgtacggacgtcggtgacagtggagacaacagaaaacggaatagcggtgatcagcgaaggattgcgtcccggagataagataatcagtgaaggaggatattatttaaagtaagaaattatgaagaaggaattaatgctttcaattatacaaaaaagatgggtaatgctttgcctgtttgtgatgatgtgtatctttggatattactcatggaaacagctttcgatagaagcatatccggatattgcagatgtcacttcccaggtggtcactcaagttcccggactggctgcggaggaagtggaacagcagataaccattcctttggaacgcgctattaatgggctgcccggtatgcacgtcatgcggagtaagagtacattcgggctgtcaatgattaccattgtctttaaggacgggacagaggactactggagccgccagcgcgtacaggaaagattgaatgaagtagaactgccttatggagctgttccgggacttgatccgctgacatctcccgtaggagaagtgtaccgttatatcatagaaagtgaccagcactcattacgcgaattaaccgaccttcagaactgggtaattattccccgtatcaaggaagtgtcgggagtggctgatgtaaccaatttcggtgggatcactactcagttccaggttgaagtagatccgtccaaactggaacaatataatttatctctcagccaggttgttgaagccattgagaataacaatgccaatgtggggggaagcgtgttgaatcgtggtgacttgggttatgtggtacggggaattggattaatcggaaatttggacgatttgggacatattgtagtgagtactacttccggagttcctgtctttctgaatgatataggttctttgaagtatggaaatcttgaaagaaagggagtgctgggatatacggaccgtacccgcaactactctgagagtctggaaggaatcgtactccttctgaaacatgagaatccgtctaaagtactggaagatattcatgtggcagttgatgagttaaataatgagacattgccggaaggagtgaggatacatacttttctggatcgtaccaacttggtggatactactttgagtaccgtatcccataccttgctgatgggtatggctttggtgtttcttgtgcttattctgtttctaggcaactggcgtggtgcattattggtatctataacgattcctgtgtcattgcttatcgcttttattcttatgcatctgacggatattccggctaaccttctgtcgcttggtgctattgatttcggtattattgtggacggtgctatcgttatgctggaaacgatccttaagaaacgtgaggataatcccaaacaatatctcgaagaaaaaagcatggcgcaacgcgccaaagaagtgggtcggcctattcttttctcaaccattgtcattattacggcataccttccgctgtttgcctttgaacgtgttgaacgcaaactttttactccaatggcatttacgatgagctatgcaatgattggagcactgttggttgcgctcttattgattccgggacttgcctatgcaatctatcgtaaaccacataaaatatataagaataaatggctggacagactaaaggataaatacattcgtaccattacaagatttctggaagctcccttaaaagccatcattccatcaggactgattctgacagcggggatcgtgttgagtgttgtcgtaggaaaagacttccttccggagctagatgaaggttcgatatggttacaggttaatctgccacccggaatttccgtagaaaagtcacgggagttatccgatactttgcgtgcccgtacgatgaagtattccgaagtaacttatattatggtacaggcgggaaggaatgacgacggaactgatccgttcaccccttcacattttgaagtgtccatcggtattaagccttatgatgaatggccgaaaggaaaaactaaaaaggatttgattcatgaactggaagaagaatataagttacttcccggttttaaagtaggatttagccaacctatgatagacggggtgatggataagatagccggggcccatagtgaactggtggtgaaagtatatggcgaagattttcgtgaaacacgtcgtattgccgaagaaataaccagggcattaggaactgtgcgaggggctgttgatctggatattgatcaggaaccacccttgccacagttacagatcagtatgaatcgtgatgccatagcccgttacggattaaatgtatccgatgtagcggatctgattgaagtggctgtcggaggtaaagctatcgcacaactttatcagggtgaccgccagtatggcatcacctgtaagtataaagaggaagcgcggaatactccggagaaaatagccggacttatgttgacttcttccaccggtgcaaagatacctctttctcaggttgccgatgtcagattgagtgtcggcgaaagtacgattaccagggaaatgaacagacgccatttgacggtaaagctgaatttgcgcggtcgtgacctgacatcttttctgaatgaagcccagaatacgatcaatgagaaagtacattatgacaagaataaatataccatcaaatggggaggggccttcgaaaatcaaaaacgggcttatacacgtcttgctgtcattataccgctgacactgacagggatgtttatactgctttatgtcacgttcgggaagttccggcaggcaggactggtattggctattgttcctctggcacttttcggaggtatgcttgctcttaatgtgcgtggtatgacgctgaatgtatcttctgccgtaggatttatagcgatgttcgggctttccatacaaaatggaattatcatggtatcgcaggtcaatgggctgcgcaggggaggaatggaactccggaaatcggtcatagaaggggcacgccagcgtttccgacctattctgatgacttcgatcactacgatactcggacttttcccggcttcgttggcaaccggaatcggtagtgacgtacagcgtccgctggcaacagtgattgtgtatggattgatgttttcaacccttatctctatgtttctgcttccggctttctattatctggttgagaacaatgttttaaataaaaagaagaacgatgaaaaagaatatacgatataatat

SEQ ID NO: 155 - DNA, 17759 bp, Bacteroides thetaiotaomicron
taatagaatatcatgaaaaaagaagaaatgattcagaaagcgtatgagattgctgttgaacgctatgcagcagtaggtgtagatactgaaaaggtactgaaaaccatgcaggacttccacttgtcacttcattgctggcaggctgatgatgtaacgggatttgaagtgcaggcaggtgcactgagcggaggtattcaggcaaccggtaattatccgggcaaagctcgcaatattgatgaactgcgtgccgacattctgaaagccgcttcttatattccgggtacacaccgtttgaacctgcacgaaatctacggggattttcaaggtaaagtggtagaccgcgatcaggtagagcctgaacatttcaagagctggattgaatggggtaaagagcataacatgaaactcgattttaactctacttccttctcacatccgaaatctggtgatttgtcactgtctaatccggatgagggcatccgtcagttctggattgagcataccaaacgttgtcgtgccgttgccgaagaaatgggtaaggcgcagggtgacccgtgtatcatgaatctttgggtacatgacggaagcaaggatatcactgtaaaccgcatgaaatatcgtgcattgttgaaagattctctggatcagatatttgctactgaatataaaaacatgaaagactgtattgaatcaaaagtattcggtatcggtctggaaagctatacagtaggttccaatgacttctacatcggttatggcgcatcccgtaataagatggtaactttggataccggtcacttccatccgactgaaagtgttgccgacaaagtatcttctcttttgctttatgtgcccgaattgatgctgcacgtaagccgtccggttcgttgggattccgaccacgtaaccattatggatgatcctacaatggaactgttcagtgaaattgttcgttgcggtgcgttggaacgcgtacactacggtctcgactatttcgatgcttctatcaaccgtatcggtgcttacgttatcggtagccgtgctgctcagaaatgtatgacacgcgctttgctcgaaccgattgccaagctgcgtgaatacgaagctaacggacagggattccagcgtctggctctgctcgaagaagagaaagcgcttccatggaatgcagtatgggatatgttctgcttgaagaacaacgttccggtaggcgaagatttcattgcagaaatcgaaaagtacgaagcggaagtaacttctaaacgataagtgatggatattctaataggcttgttgattatagccatcggtagcttttgccagtccagttcctatgtacctattaaaaaggtgaaggaatggagctgggaaagcttctggttagtacaaggtgtgtttgcctggttagtgttcccgtttctgggatcactgctggggatacccgcaggaggcagtttgttcgacttgtggggagccggaggtgctggaatgagcatcttttatggtgtattatggggaataggcggattgactttcggactctccatgcgttatctgggtgttgcgcttggacaaagtatcgcattaggtacttgtgccggattcggaaccctttttcctgccatcttcgccggaaccaatctgttcgaaggtaacggactgattcttcttctaggagtttgtattacgctggcgggtattgctatcattggttatgccggtggcttgcgtgcacagaatatgagcgaagaagaaaaacgggctgccgtaaaagactttgcattgacaaaaggtttgctggtagcacttcttgcgggtgtgatgagtgcctgctttgctttgggactggatgccggaactcctatcaaggaagctgctttggcaggtggtgtggatggactttatgcaggtcttcctgttatcttcctcgtgactttaggcggattcatgacaaatgccgcttactgcctgcagcagaatatagctaataagtctgtcggtgactatgccaaaggaaaggtatggggtaacaatctcgtcttctgtgcgttggccggtgtgctgtggtatatgcagttcttcggattggaaatgggtaagagcttcctcacggaaagtcccgtgttgctggctttctcatggtgtatcctgatggcgctgaacgtaacctttagtaatgtatggggaatcatcctgaaagagtggaaaggagtatctgccaaaacaatcacagtgttgatctgtggtttggtagtcttgatcttctcactggtattcccgaacttgttttaataataaatagatatgaaatcaattttagaaaatcgtccggcacttgccaaagaagtaaacaaggtagctgaagttgccggatacttgtggcaaaaaggatgggctgaacgtaacggtggtaatatcactgtaaatatcacagagtttgtagacgatgaaatccgtcggatggaaccgattagcgaagtaaaatccattggcgttacattgccttatctgaaaggatgttacttttattgcaaaggaaccaacaaacgcatgcgtgatctggctcgctggccgatggaaaatggttcggtgattcgcattttagatgattgcgccagctatgtgatcattgccgacgaagcggtggcgccgacttcggaactgccttcccacctgagcgtacacaatgatttgctgagcaagaattctccttataaagcatctgtccatactcacccgatcgaactgattgccatgactcattgcgagaagttccttcagaaagatgtggcaaccaatctgttatggagtatgattcctgaaacgaaggcgttctgtccgagaggtctgggtatcattccttataaattgcctagttcggtagagttggcggaagccactatcaaggaattgcaggactatgatgtagtcatgtgggaaaaacacggtgtttttgccgtagactgcgatgctatgcaggcttttgatcagattgacgtgctgaataagtcggcgctgatctatattgctgcgaagaatatgggcttcgaaccggatggtatgagtcaggaacaaatgaaagaaatgtccgttgctttcaatcttcctaaataatacttgtattaatcactgaatttatctactttagcgaccgcagcattttctatcgatggagaatgttgcggtaactttaaaattatgacacaactatgaatcgcattattctgaatgagacctcttatttcggtgcaggatgccggagtgtaattgctgtggaagcagccagacgtggctttaagaaagcctttttcgtaacagataaagaccttatcaaatttggtgttgcagccgaaatcattaaagtatttgatgacaatcatattccgtatgaactttatagtgatgtaaaggctaaccctaccattgctaatgtgcagaatggtgtggctgcctataaggcttccggtgcagactttatcgtagctttgggtggtggttcttctatcgacacggcaaaggggattggtattgttgtgaataacccggattttgccgatgtgaaatctctggaaggtgtggctgataccaaacataaggctgttcctacctttgcattgcctactactgccggaactgctgctgaagtgactatcaattatgtgattatcgacgaagatgcacgcaagaaaatggtatgtgtagacccgaacgatatccctgctgtagctattgtagatccggaactgatgtattccatgccgaaaggactgactgccgctacaggtatggacgcgctgactcacgccatcgaaagttatataactccgggtgcatgggctatgagcgatatgttcgaactgaaagcgattgaaatgattgctcagaacttgaaagcagcggtagataacggtaaagacacagttgcccgcgaagcaatgtcgcaggctcaatatattgccggcatgggattctccaatgtaggtttgggaatcgtacattccatggctcacccgttgggcgctttctatgatactcctcacggcgttgccaatgcgctgttgttaccttatgtcatggagtacaatgctgagtctccggctgctccgaaatatatccatattgccaaggcgatgggcgtcaatacagacggtatgacagaaactgaaggtgtgaaggcggctatcgaggcagtgaaagcgctttctctgagtatcggtatcccacagaaattgcatgaaatcaatgtgaaggaagaggatattccggcattggcggtggctgcattcaatgacgtttgcacaggtggtaatccgcgtcctacgtcagtagcggagattgaagtattatatcggaaagcattctgattttaattgtataaggtttgttttttataagcatccggaggatctggacaggtgctctggatgtttttttactgtttagcgtgtgttttttgaaaataattcctacttttgttcaattcaattgtatgaaaacacgcctgtatgactgaggataataatttgggattagaatttaaatacttgatagttaatgacatggaccgcaaattcggtctgtgggtgaatacggttggctatcagtctatccctcccgattctccttatccgctgaaggagcatccgtccggttactatttcaatgccgaaaaaggaagagtattgcgggaatatcaattggtctatattacaaaagggcgcggtttgttttcttccgattctactcctgaaagacaagtttgtaaaggtcggctgatggtgttgtttcccggacagtggcatacttattatccattgcggcagaccggatggacggaatattacattggttttgaaggtccggcgattgatacgattgtgggcgatgcctttctttctcaggaaagacagatattggaagtcggtattaatgaagaactggtatctttgttttcccgcgctttggaagtggcagaagcggataaaatatctgcccagcaatacctttccggaatcgtacttcacatgattggtatgattctttcgatttccaagaataaggtcttcgagatgagtgatgtcgatcagaagatcgagcaggcaaagatacttatgaatgaaaatgtatccggcaatattgatccggaggaactggcgatgagactgaatatcagttactcatggttccgcagggtttttaaggaatataccggctatgcacccgccaaatattttcaggaactgaaacttcgtaaagccaagcaaatgttggtgggaacttcccagtcagtaaaagaaatttctttttttctgggcttccagtctaccgaatattttttctcctttttcaaaaaacgtaccgggcttactccgcttgaataccgctcgttcggtcgggaagaataaacataaagttatttattgttaatctcctcgatgtgatttaacctttccgttttaatctggtcaaatataatattgcaatgatgcaatcggtttattatcagattaactataaaagaaaaaagaaatgaaaagaatcgtattttggatggtagctttgctactgatgagtggtgtggcaatggcacaaggaaatcgccagggtggaagacaacagatggatccgaaaacccgtgcggaacgtatgacagagcgtatggtgaaagaatactctttgaatgaagatcaaaagcaacaattacaggatgtcaaccttacatgggtgcaaaagatggctgctaatcagggcggacgttcgaaagataataaagctgccaagatgactaaggaagagcgggaaaagaagatggcggaaatgaagaagtcccgtgaagattatgatgcccagttgaagaagattatgactaaagaacaatacgatagctatgtgaaaaaacaggctgaacgtgagaaacagatgaaagaagggcgtcagaaccggcaaaaaagacaagggtaatatagattgtaatgaatggatgtacttcctttcggaagaagaattaaggagatactactgatttttgaggtagtatcttttttgtattcgggtgattcttattttgctttttgaggttgtgaacaagtcacatcctgcttgtttaaaaatgagtctcttatatagttaatttgtttgttactaattaattaacctgttaataactttgttgataacgtggttaatataagattggggttgtgaataaaggaactgtaatcagtagaatcttaccggagagagataaaaaaagaaccacttaaaaagcgattctttagtaagttgcggagatccgactcgaacgaatgacctttgggttatgagcccaacgagctaccaactgctccactccgcgatgtttaacgggtgcaaaggtacggcttttcttgaataaaacaaattattctccaattattttttagaaaaaagatcgaattatctatattgtgctgaaaatgagagaggtattgatggaactttttttagtacctattaatatacaaatgttaatattctgtgcgttttcttgtgtggtctaaagaaaagaattacttttgctcaaaatattcagcaatgtgcaatttgtataacctatgaccgtatcaaaaacgaaagccaagttagtagacgttgcccgccagctttttgcaaagatgggggtggagaacactacgatgaatgatatcgccctcacttcgaaaaaaggtagaagaacgctttatacctattttaaaagtaaggatgaaatctatttggctgttgtagaatcggaattggatatcttgtcggatatgatgaagagggtggctgataaaaacatttcgccggacgacaaactgttggaactgatatatacccgattggatgcagtaaaggaggtcgtttatcggaatggaaccctgcgtgcttatttcttccgtgatatatggcgggtagaaaaagtgcgaaagaaatttgatgcgaaagaaatccagatttttaaagctgtgttgttggagggacaggcgaaaggagtgtttcacattgatgatgtggagatgactgccgatttgatacattactgtgtgaagggaattgaagttccttatatccgtgggcatataggagctcatctggacgaagaaacaagaaataaatatgtgtccaacattgtgtttggcgcactgcatagaacagaaatttaattaaataacttttagtatgggattattagacggaaaaacagccattgtaaccggtgccgcccgtggtattggcaaggctatcgctctgaagtttgctgccgaaggtgcaaacattgcatttactgacctggtcattgacgaaaatgcagaaaaaacaagggtagaactggaagcaatgggtgtgaaagccaaaggttatgcttctaacgctgctaactttgaagatactgcaaaggtcgtagaagaaatccataaggacttcggacgtatcgatattctggtgaacaatgccggtatcactcgtgacggtctgatgatgcgtatgagcgaacaacaatgggatatggtaatcaatgtgaacctgaagtctgcatttaacttcatccacgcttgtacacctgttatgatgcgtcagaaagctggtagcattatcaacatggcatctgtagtgggtgttcacggtaatgcgggacaggctaactatgctgcttccaaagccggcatgattgcattggccaagtctatcgcacaagaactgggctctcgtggcatccgtgccaacgccattgctccgggattcatcctgacagatatgactgctgctctttctgacgaagtgagagctgaatgggcaaagaaaattcctttgcgtcgtggcggtactcctgaagatgtggcaaacatcgctaccttcctggcatcagatatgtcttcttacgtatcaggtcaggtgattcaggtagatggtggtatgaatatgtaatcgaacagtatgactgtcgtatacgaagacaaccatataattgtagtcaacaagaccgcttccgagattgtccaggcagacaagacgggcgatacaccgctttcggaaactgtgaagcagtacctgaaagagaagtatcagaaacccggaaatgttttcatcggtgtgacacaccggctggaccgccccgtaagcggccttgttatttttgccaaaacgagtaaggcactcactcgtctgaacgagatgttccgtaccagtgaagtgaaaaagacttactgggcagtagtaaagaatgcccccaaagagccggaaggtgaattggtgcattatctggcacgtaacgagaagcagaacaagagttttgcttatgacaaagaagtgccgaatagcaagaaagcgattctgaattatcggctgatcggacattcggagaattactatctgcttgaagtagacttgaaaaccggacgtcatcatcagattcgttgccagttggcaaaaatgggatgtcccattaaaggagaccttaaatatggcgctccgcgttccaatcccgatggcagtatttgcctgcatgcgcggaaggtacgcttcatccatcccgtgtcaaaagagctgatagagctcgaagcccctcttcccgaaggaaatttatggaaaggatttgaactgctttagtcagtgcaagtcctttttcttttgccaaaagagtaaatatccctgccatccattcggtaaactctggcgacagcctgatagttccggaatagagtttatatttgcatcatgaaaactataattcatgaagtaaatcctaccatgaaacaatttcgaattaacaagaaaaatacagatgaacgcatttaaacttttaatggctgcttcctgctttttaggtctggcaacgagcggagtggcaaaacaggactattcaaagagtgagggattgttacagtatgtcgatccttatatcggctccggttttcacgggcatgtatttgtcggaacgagtgttccgtacggcatggtgcaactcggacccaacaatatccataaaggctgggactggtgttcgggatatcattattccgacagtattctgattggtttctctcatactcatttaagcggtacgggatgtaccgatctgggggatattctgattatgcctctcaatgaaatccgtactcccagaggtaaccaggatgatatacgtgacggttatgcgtcgaaatactcacatgacaatgagatagcccgtccggaatattattctttaattctggacagatacaatatcaaggccgaactgacagctactgaccgggtaggttttcatcgttatacctatcccgaaggaaaaccggtctctatactgattgacctgcgtgaaggaaacggttccaatgcatacgacagctatattcgcaaagtagatgactatacagtggaaggttatcggtatgtcagagggtggagcccgtcgcgaaaagtatactttgtgctgaagagcgatcagaagatcgagaaatttacggcttatgacgataatacccccaaactttgggatcaactgaaagtagaatcggtgaaaagtgtgcttactttcggcaatgtgaaagaagtaaagattaaagtggctatttcttccgtaagttgtgacaatgcagcgatgaacctgcaagcggaactttctcactgggacttcgacaaggtggtgaagatgagcagtgaccgctggaacaaacagttggataagatgaccgtagaatcagacgatgaggctgccaaacgtgtgttttataccgcacactatcataccatgatcgctcctacattgtattgtgatgtcaatggtgagtatcgggggatgaatgatatgatttacacagacccgaagaaagcgaattataccactctctccctttgggatacttatcgcgccttgaatcctctgatgactatcattcagcccgaaatggtggacaatgtaattaattcaatgctttccatttatcggcaacaggataaacttcctatctggcctttgatgagcggcgaaacaaattgtatgccgggatatagctctgttccggtgattgcagatgcttatctgaaaggatttaccggatttgatgcggaagaagccttgacggctatgaaagcgacagcaacttatgaagggcagaacggagttccttacgtgatggccaaaggatatatccctgctgataaaatccacgaagctacttccatcgctatggaatatgcagtagatgactggggaatcgccgctatggcacaaaagatggggaagacggctgattatgagacattctcgaagcgtgcccattactataagaactatttcgattcttctatccatttcatccgtccgaaactggaagacggttcatggcgtactccgtacgatccggcacgttctattcacggagtcggcgatttctgtgagggcaacggatggcaatatacattcttcgctccgcaagatccgtatggattgatcagcctgtttggcggtgacaagccgtttacatcgaagctcgacagcttctttacgaacaatgacagtatgggtgaaggtgcttccagtgatatcaccggtctgatcggacaatatgcgcatggcaatgagccgagccatcacatagcctatctctatacctatgccggcgaacagtggaaaacagcggaaaaggttcgtttcatcatgagcgacttctacacagatcagccggacggtatcatcggtaatgaagactgtggacaaatgtctgcatggtatctcctttctgctatgggattctatcaggtgaatccgtctgacggtgtgtttgcattcggcagtcctcgttttaaaaagatagaagtgaaagtgcgtggtggtaaagtgtttactgttgaagcaccgaataatagtaaagataatatctatattcagaaggtttatctgaatggcaaaccttatcataaaagttatattacgtacgatgatataattaacggcagtactttaaaatttgagatgggcaaaaagcctgccaagaattttggtaaagcttctgccaataggccgatcgttttgaataaataggtaaaaaatagtttttaggataggtattggttaggatgatgaacgccttcaagtgtttgcggaagcatatatttgaaggcgttttcttattgtcaatgacagatatggagatgaaaaaagaaggcgtatcaaaagtcagtagtaactaaactcccctcctacgggtactcctccttcctgaaggaggagggtttagttacttttgacttttgatacgccttctttttgtttgtgagatattacttctgttttattttcggtttatcaataaacctccaactcgtagattcttgcagccttcagactgttgttttgtgtagattgtgtaaccagcagtctgacgtaacgtaccgaagtcggcttaaactggcgaactaccgtgtttttcttgttatcactcagttcatcaatcgttttccattcttcgtccggactgtttctgccttgtaagaagcaggtatgagtgataaagacgctgccttcatttccggcatttaccaacttccatccacggatcgtctgttcctttccgaagtcgaagtcaatgtagttgggagccgtgcttgtatcacaccatttcgtcttcacatcaccgtctacggcatatcttgcaacttctttttcgttggtttcaccggaacatttgattagtttggcttgtttcaacaggtttgttttagtcgtcgcttcttctccattgtctgctttcaaggctgtgcggaacaattccgaggccggagttactgccggatacttctcattaaccagcgttgcggcaaataatacgatatctgcatgatccggcaaagtaaccgtagtcgctcctttaggaatatccatgccaaacttgaacatatacgtaaactcataagcctcatctttgtcagaagcatgacggtgagtgccgacataagcgatttctgcatctttcaggaagccttccgtatgtcccagatgctcccactgaccgataaaaccggtataggaaggtacggtgatttcctgtgagttgttaccggtgctgaaggtagcaactgcatcttcaccggcagaggctgccaggaaatagatacggttgtaagaatgtccggttggcaactgaagtacattgcctttgcaagtcaaaccattggcaatttctttctctcccaagcggaaaggaatgccgtcggctttcaggatggagtcggggagaagttctgctgcatagctgttgcccgattcgaagttcccttctttgcggaaagcattccaactgaaacatctgcgatcatagtccaaaggaagataagcgcatgccggagcttgaagatcagcttttttcttcagcttcactttaaatgtctgtatgctgtagggagcgatggatacattcagctggttcttgttgaagtcagcactgccgatctctttttccgtaccgtctgcaagtactgccttctctatttcaccggcgaaggtgatggctgcctgttgcggagctgcgcctcctgtttcatatacacgtactacatattcatcggatacttccgcttttttcagcgctttgataacgacttgatcgttgcttgaacgtacaaaagcaaattctttacctagtgttccggcatgtttcggactgctgaaggctttgatcggctgattcagaatttcagctttgatggcggtggcgggtttgtcaagtgctccgttatgtcctgtgaggctataagtaaatgtatggaagccgaagtcctggtgatcctgataagcgtaatttccttttgtttccggtgtatggagaagagtcagacggatcgtgttgttatccggtttatcccagccatatttactgtcatttaggatcgatacaccgtagctgttgttcttatcggtcaggtctgcccattgctgcgcatatacttcgtaagcggtctgtacattattacctctttccacgctgccgattcccagatcgtaagtagccttttcattttctatattcagaggaaactctgctttcagcagtgtgtttgttgactgccagtctatttcgttatagaaatctatgcggtcggcacggctgccttcgtagaggcggatgtattgcttgaagagcgatttgccatacttcttctcaatgcagagtgctttacggagtgcgccgttttccactaaagtgatctttgcgccgtctgtgatggagacaggttcacggtcgatggtctctttcaggatttcccatgcaggccatgcgtacgacttgttttcggtgaagagtgccaggcgaatcgcttttccatcttttacgagttctttgttgttgcgcttgtcggtcagtgagatgatatctccgtttttatccagtgtgattttgtagacggagttttcgatggctgaggcggctgaaggagagatcgttttttcagatcctccggtgcggacatcgtacactgcataactgtttgcgggcagtgacgctgcaaccaggatgtgagcacgtccgttctcgtaaccgatcatttgcgaagcgactttcttgccttgtgcattgtatacagtgaagcctttcggggttttaggctgttcgaggatgatctctgtcaagtccgataccgggaaagcgtttgcattataaagaacgacaggcgttcctttcacgcgtgtatccatctgtccggcaatggcgttgacggaagaagtcagtacttgtgagaattgttttagagagatcagttcatcgttccatgagaactcataggcacgggggatactcgttcccgtcaggtcatcatggaattgatggaagatgaaacgtttccatgcctccgtcagcgtgtgttgcggatagctggcagtacccaaccattcggcagcgaccgccgctctttctgctgcatcgcccaactgttcgttttgccggttgtacagcttcatggctgcctgcgaagtatagcaacctgttccgtgaacatccatcaataactctccgtcaaataccggcagttccgggtgattgttgaacggcagataatctttgaacaactgatcgctggtagcactgatcacctctaccgggccatcacctttgattccctgttctacagaacgtaccgaacccagagtaggagagccaccgatatcccctgttccataatagcggtagaccgtattgagcggagtacgttgggctaatttttccagatctttattcttcgagagatcttcgttgttccatttgcgtccgtagtcatatccgtgggctagcattacttgtttgccgtcaatgcccttccagagtccgatggtaaacggatgcttgctctttccatagaagggatgattacgccagtccagcttctgtgaagagaagccgatcagtccgcagtgtgcggcaatggtgggaagcgtccatccgaatccgaagcagtccggcaggaagatatccgttccttcttttccgaactcttgccggtagtacgtctgtccgagcatgatgttacggatggaggcttcgacggaaggaaccaacacatcacttgcttcccagctacttccggcgatatgccagcggccttcctcgatgaatttcttcatctcttcatactgttcgggatagtattccttcatccacgcatacttcactcccccttcaaagttgaaaacgtattcgggatatttctttagcagaaataagttctgactaatggtattccagacatattcgttgattgttgtctggatgtcccagttccactgggtgtcgaggtgggcgtccgacaccatataggctttcacctttttcttcgcggtgtcatcttgtgcatagcttcctcctgctaaggcaagggcgagggctacggcaattacttttttgttcatcatggtttatttttaacaagtttagtagtttacaaatttatacaaaactaatggaattaattctattagggtttagaatagtacttctttatggaaatggcacggatatttacctttttggcaccactttacatctagaaagtattcttgtccggttcgggctgcatcttgtcagtcataaagaatgattgctcaagaagctttttgtcattcaaaacgtgtccaaatatagcggatttcgaatgattagctgtcctttgtagtgccaatatgtaggcaaatatattttgtctgttcagagtactctatggataattagggtataagataagtagctgattatcattctataatatatgtttgtgaacaatgaaagtacagcaggtgtcggcaatgacaaaccagtatcaatactctctgaccattttatcttatcatgttttttagatgttgcggtaataactcccatgatatgctctccatttgtttcccggtcattacgtttattgcagttgatgtagaaaagaaatttacaatgattcttttagtgtttgttgataaaatagcttttcttgcataacttggttatataaactcaaattcccgttctccatgtcccggcatgcagatgagctgcataatctccaaagtggcatgagatttcattgtgataaggttgcctgcaccttttatctgtatttcttaataatgtgatgtctgtatacattccatagttatcccaatatgtgtctgttagtaggccgggacctgttatgtctaaaatctcctgttgcgattttaagattattgtggctctttctgccatttcatccattattctgtgtaaaaaaggatgtttagggattccaccgaacatatagttggctattcgaagtcgatatcttaaattcaaggcttcttgctctgcctggcagacaattttctcttctcctaaaaccaaattatactttctcaactcatcaagtggctttaaacttaacatatctaaatccatatagaatcctccatagaggtatacaagggctaatcttaagaagtctgctttttgtacattgtgatagaatgcattataggcttcgatgtattcaggtaaatcttgatttaatatatcctgtgcatcatccttattatataggcggatattccagtccggatgattgacttgtatttcttgtttgcatttctcgaatagttcggggaacggttcatctttgcgtagaaagataaggtgtatattctttgggatcattatttattttatttttaaaggttacttaccaaaccaggtaccaaagaaatagtgtatggcatgagcctgattgatacgctcttccatttctttaggaatctggttgttttttattttctctacctcccattgtccgataggatatattgtctttgattcgaggatacgtatgtcttctttatgtggaaatgcgttgaatgcatgcgttagcaagaaagggcctgtggaatccagtatatcaaatccgttattaacaactttcccaccggaatgattgattaacctttggcatacaaagttgataaaatcattatcgggtgttgacgccatgaaagcgttgcaaatgatatattcaaaaccaaagcgtttagcatgccagtcgggttccttacctacgataaaatccgatccttctagtaagaactcaatattttcgaggcactcgaaatccatgtctacgtacaatcctccataaactttcaagagaagatagcgtatagcgtctgctctttgtatgttacaaggatatgtatcatacttctccaggaaatcagggaaatgtttgcagacaaattccctgttcatttcatctgtccataggatatattcccaattcgggagatattctttccatgtttgtggcagttggtcaagaggagaaggtacatcttttgttttccatgtttggtggataattcgtgggattcttaaactgtttttcatagtctttattgttgaaatattttcttttctttaatattttctcttctatatcgaatgagggtttcattgctcttcaacatgtccggagtgtagatttgcggttgataatatgcctcttccagttttttaaactttccatccggcattatctgatatttagtatctatacgttgccctttcaggttatctaggtgtataaaatttctttttatactatcgaactgaatgatgtaattattttcaggaaagttcaactgttgaacattcaccgtaaaatctttattgatttgtgcttccatggttctagctttgctgcatgttccaggccattcacaaatgggaatgtagtcaatgattgctcctgcaaaattgaatgtaactaaccaatgtttatccatatcgtgaagagctgaccaagttctgactattcccatgatatattttccattagtatcttcaatgagagaaagaactgtttcaatgggaggtctcttgtctcttttgtcaagattagcatagaatggagaattgcttattctataagatgtaccttgagttactgctctcgtatgttcaaaatcatcacgagagatactgttgttgtcttggtaaacaaagaatgaaatatcataattgatgggtagctttaggaactcattttttgaaaaaacatagaatacacgttgcaagttcttttcttttatatccgatagcttcactaaagaagtgactttgtagctgttttggccatacatagatagtccgcttgccattattaatataattaaaattgctacttttttcatggttgattattatttatagatgatgatagagtcc

SEQ ID NO: 156 - DNA, 17712 bp, Bacteroides thetaiotaomicron
ggtaagaaataaaaaagtaagaaacggttgcttgtctgaaaaatattacatagctttgtcctattatacatctattagctagttaagattatgacatttagtaacctttgcaatgatattttttggaaatcgacgacagattaccatgtgacggacagcgtagatgcgccgatgaacaatccttacgagttgaagtcgatagagtattatttgtatctgaaaaactggattgatgccgtacaatggcatttcgaagatatcatccgtgacccgcatattgatccggtggcagccgtagctttaaagagaagaatcgataaatccaatcaggaccgtacggatctggtggagttgatcgatagctattttcttgatcgatataaggatgtaaagccgctggcagatgctaccatcaatacggaaagtcctgcctgggcagtagaccgtctctctattcttgctttgaaaatttaccacatgcagcaagaagtggaacgtacggatacgacggaagaacatcgtgcacaatgccaggtgaaactggatattctgctggaacaacggaaagacctttcttcggctatcgatcagctgctggctgacatcgaggcagggaagaagtatatgaaagtatataaacagatgaagatgtataatgacccggcgctgaatccggtactttatgcgaaaaaataacgaatggcgcgtattctcattatccgtttctcggctcttggcgatgtagccatgacgataccggtagtacattcgctggcagtacaatatcctcaacttgaaattactgtgttgagtcgtgctgtgtggcaaccgctttttcagggacttcctgcaaatgtgagttttatcggcgctgacctgacgggtaaacataaaggattatgggggctgaacaccctttattcggaactgaaagcaaagcatttcgactatgtggcagactttcatcatgtgcttcgtacgaaatacctgtgtctgaggttccggctggctaatatacctgtggcatctatttataaaggtagagtgggaaaagaaaaattagttcgccgccggcataaagtattggagaaccagaaaagttctttccgtcgttatgccgatgtgctggagaaactgggtttccctgtattgttgaacttttcttcgatttatggagatgaaaaagggaattttgcagagatagaacctgtcacaggcgcaaaagataatttgaaatggattggtatagctccatttgccaaacacatgggtaagatataccctattgaattgcaggagcaggtagtagcccattttgctgccgatccgaaggtgaaggttttccttttcggtggtggcaagagtgaacaggaagtattcgatggctgggtggcgaaatatcctaccgtcgtttctatgattggtaagctgaatatgcgtaccgaactgaatcttatgagtcatctggatgtgatgctctcgatggattcggcgaatatgcatctggcttcgctggtcaatattccggtgatctctgtctggggagctactcatccttatgccggatttatgggatggaaacagttgccggtcaatacggtacagtttgatctgtcgtgccgtccctgctccgtatatggacagaaaccatgctggcggggcgattatgcctgcctgagagaaataaaacccgaacaggtgatagcgaagattgaaggaataatcaattaggagccaggtactcctgagatatggaacaagaatgaagaataaacttttatataagttgcgtagcgggaagaatcctaagttcatttactactcggtaaatgctctcagacttatcattccgaaaggcattttccggctacggttacaaggaaagttgtcttcactatcccgccggaaggacaaggagtatatagaacatcgtgttgactattataacaaactttccggaacggtgcaattaccttcttctgctccgcatctttcagagcacaagatgagcaaacaaaaagtgtatttctttgatacttatcaatatacccgctggttttctgatcagtttcagtggggtttttgtcccggtgatgtgacatttgttcccgactatccctctattgtgaaaagtcgtccgctgacagatgataacgtgaattcgattgtgatgaaattggataaggttcgtcattttatatttgtggacgacaagaaggcttttacagagaagaaaaatatggtaatctttcgtggaaaggtaaaaggaaaaccttccagaaagctttttatggaaatgtattttcatcatccgatgtgcgatctgggagatgtcagcaaaaatacgactgatccggcagagtggcgtacggagaagaaaacgattaatgagcatttggattataaattcataatggctcttgaaggaatcgatgtggccagcaacctgaaatgggtgatgtcatcaaattcaatagcagtgatgccccggcctacctgtgagacatggtttatggaaggcacgcttattcccaattatcattatattgaaataaaaccggatttctctgatttggaggaacggttgaattactatatagagcatgtagacgaatcattggagatcatcaatcatgcccatgaatatgtgtcccagtttaaagataagagaagagaaaatttgatatcactgcttgtgttggataaatattttaagatgaccgggcaaaagagttgagagatgaagagaagtatgaccattcttgttttttcgtaagatgaaaataatgattaaccccaaatacgaatatctgagagaatatgtagaacgtattccgaaagattttgagacaataggaacggtaattcattccgggcgaaatttgataaagatgatcacggtggatggattggatattaacgtgaaacggtatacgatacctccgctgataaaccggatcgcttatgctttctttcgcccttcgaaagggaaacgggcttttgtctatccggagaaactgttggagaaagggtttgaaaccccatgtcctattgcctatatagaagagacaaaaatgggtttgattggtcattcatattttatgagcatacaatctccctatcgatataatttttgccagtttggcaatgcggatataaaaagctgcgaagatgtagtgaccgcttttgcggaatttacagcgcgtctgcatgaagccggaattctgcatttggactattcgccgggaaatatcctgtatgacaagataggagaggaatatcatttctcactggtggatattaacagaatgcattttggtgaagtggatattaagaaaggttgtgcgaattttgcccgtttatgggggcagacacccttcttcatcttgttgggaaaagagtatgcccattcgagagggatggatgaagaagaatgtgtgcgtttggttctgcattacagaaagaaattctggaacagatatcgtcgcagacatcaggtctggtttcagttggatatttaatggctaaaggagggtaattaatgatagtagcttttgaaaataatgttgtttgttcggatgaaaaagtacgggactacttgctggctcatcatgctgacttgaaagaagatcaggatgaggacgcattatgtctggttcgtttgcataaggaggaagacattgatggcactgatcgtgtggacttagccggatggagggagatttcgagagaactttattggactggggaacagatggagtgcaattattctattatccgttttagccggaagactacttctttgcagatgtcggtcgtactgtcaacctgcaaccagcttgaatggctggagaaggtgttgtggggatatgaagcccaggatactaagaactttgaattgattattgcagatgatggttcgcggaaagaaacttatgatatgttgcagaggataactccgcaattgtcctttcaggtgaagcatgtatggcacgaagataaaggattccgtaaatgcgatattctgaataaaggcatactggctgcacaagcagattacctgcttttcagtgatggcgattgtattccacgtaaagacttcgtctcaactcacctgtgtcttcgccgtaaaggacgtttcctgtccggcggatatcataagttgagtatggatttgtcgaaagatattacaaaggacgatatattatccggcagatgttttgatctgcaatggatgagaggaaaagggatgcctgcctcttttaaaaataataaactgactgctacaggatttaaaaggtgggcattaaatacatttactcctaccaaagcaagctggaacgggcataacgcttccggttggctaagcgatattctggctgtgaatggttttgatgagcgtatgcagtacggtggacaagaccgtgaatttggagaacgtctggagaactatggaattcatggtatgcagatacgttactctaccgtatgcctccatttggatcatgcaagagggtataagacgaaagattctatccagaagaaccggaacatacgaaagcatactcgtggagcaaaggtgcaatgggcttctttgggcattgtaaaggatgaattgagaggtcagtctgtgaaggtgaacagttattatgatcgctatacacgggaagaagagaagctgacttcctataaggaaaaaggaggattctaccgacatatctattctttgccttgcaggtggagaagagcaaagtatcatgataaagtggtgcgtgcttatcagcaagacactgatgctccggcattatcgaaccattcgggagtcattgtctcgttgacgacatttcctccccgtatttctcaacttcatctgatgttgaaatcgattctgtggcagacttgtccgcccgaaaagataattgtatggttgtcggaacaggagtttcccggacggttgaatgatctgccagaagaacttaaaagattgatggctaaaggaatagcattcagatttgtgtctgagaatttccgttcacataagaagtatcattatgttttccgtgaatacccggatagtaaagtgataacagtggatgatgatctgatttatccccggaatacggttgagcgtttgctttccttatcgtatcagtatccggatacagtttgcggaaacgttatccggaagattcatatggatggaaattctttttcggtatatagaaagtggacgaaagtgtttacgatgccggtgaatagctctttgcagaatgtggcaatcggatgtggcgggatttattatcctccccattggtatggagaggagttgtttgactggaaaataatcagtgaacattgtccgtctgcggatgatttatggttgaaagcgaatgaattaaagaggcgggtcaaggtgacaggagggggtgaattctatccccggccgatagagttgcctcaaacacagaataatagcttacaaaagaaaaataatgggaaaactaacctgaatgataaacagtggaaatctttgaatgaactttggaaactagacgaattatactgtataaatggcaaataagaggtaattgtttgatttgagagtgtttagattgtattatcgaatcacagacaagtgtgaaatttatttaaaatcgagggtagttttgcagtattccttgttatatagcattctatatagaaggggctgcagtaaaaataaaaagttgacaagtagaataatatgaatactaatatctctggaccattgattagtcttatagtgcctgtttataatgtaaaggactatttgaagacttgtctgcaatctatactggagcagacctataagaaccttgagattatcttagttgatgatggttctgacgacggctcttccggtatctgcgatgagtatgcgcgtatggatcagcgcattaagactattcatttgcctcatagtggggtgagtgctgcccgtaatgccggtttggctgcagctacgggagagctcttgggttttgttgacagtgatgactggattgatcatgatatgtatcagtatctttacactttgatgcaagagcatgatgcagatgtttctgcttgtacttatcttcttgagcaggagggaagaccttctaaaataatcaacaacacgggtaagctgtatgttttttccagaaaggagattatacgtgctttggtaaagaatgacttggtaaagaactatttatgggcgaagctctttaaacgtaaattgtttgaccgcctttcattccctgtcggacgggtttatgaggacgtagctgtattatataaagtattttatagctctcagaaagtggtattgagttgtgtctctaaataccattatatgattcataagaatgaaagcattactcgtggtggttatgatccggtaaaggaatatcattatttcctgagtctttatgaacaggataagtttattcagaatgcggaacttggaggtgaatcttccgttggcgtacttaagagggggattcatttgattaaccatactttgttgtgccctccgtcaccggcttttgaggatataatagatgaaacgatgttgaaaatgcgtgaatatcgtcatattactccttggcaactaggcccgagtatgtcaatcaaacgatattttatgtgtaaacacttcggcttctataggatgctatatcgtggttatcgtgctatatttaagagaaagcacaaattgttgattgactagaatgactaaggaaaagatagcttttatagtagttcgttatggaaaagatataaacggaggtgctgaatatcattgtcgtatgctggccgaaaggctggttaacgattatgatgttgaagtattgactacgtgtgtcaagaattatgttaccggtgataatgaatatcctgaaggagaagaaatcctgaatggagttttggtacgtcgattctattcagatcctgttgaaccggacttacataaaagctatgtcaggcaggcggctccggcaaagaagtggaggcacttcttgtacagatgtcgtcttttgaagcctttgtcttatgtgaaaccgatttggcattataaagaacaagaagaaataaaggccttgaatagtcaggttttttattcatcttcaatgtatgcttttataagagagaataaagcttcttatagagcattcattccgctttcctttttccctcatacttattatactgcactatatgcaccggagaagacgattctgattcctactatgcataataacggttcatcctttcgttctattattacttctgttttctctgaggttgcctatattggatttaatatagaagcagaacagaaattggtagagaatatagttggaaagcctttggctgctcacggcattataagtgtaggtatagagaagacgaaagctgctgattgggagcaaacaaaggtaaaatataatttgccggaagattatctattgtatgtagggagaattgatgctataaagttgaataatatagttgattactttttaagctataaaaagaaatatgtaggttctcgattaaagctagttttagtcggaggcatttttggaaagacagtcgaacatccggatataatttacacaggttttgttgatgatgcggagaaagtagcgattcagttgaatgctaaagtaatagtgaatccttccagatatgaaagtttatcacttattttacttgaaacgatgagcgaaggtaaggcgatgttggtcaatggcaggtgtaatgtgttgagagaacattgtgaaaagagtaattatgcagctttgtattatatgaatcgcagagattttatgcgaaaattgcataaccttgagaactcagaaacattacgtcaacagatgggagagaaagggcgtcactatgttcaggagaattataattgggagatgattataggacggatgaaaaatgtgattcagatgctctcataagtagaatgttgtattaagggaagctatgaagaaagagaaagttgcttttgttgttgtcagatatggcaaaaatataaatggcggggctgaatatcattgtcagatgttagcagaacggttagtatctgattatgatgtggaagtacttactacctgtgtcagagatgttgcgacaggcgaaaatatatatccggaaggtgaggaagaatggaatggagtggtgattcgtcgttttaggactaatcctgttcagcgtgaaaaggaacgctatttcgcaaagaaggctaaaccagcaagaaaactacgccagttcctttttaaattaggaatcttgaaatacttgtcttatttgattcctgtatggtcttacaaacatgatgatgaggtacaagcgatgaagagtgataaattctattcgtccgcattgaatgattatattcgtgatcatatagatgaatataaagcatttatagcaatgtcttctgattatgtcaccttttattacactgcattgtatgcaggtagaaaaacaatagctattcctacaatgcataatatgggtatttctttccgttctgtattaacatctgctttttcaaagatagcttatgttggttttaataccggagaggaacagaggcttgctgaaaatattctgggtaaggctttgggggctcatgggatattgagtgtaggaatagaggagtctttatccgcagattgggcgatgacaaaagaaaagtttcaattaccagagaaatatttgttatatattggtcgtattactcctaaaaagattcatcgtttacttacatattttgtgaactataagaagaaatattcagattcaacattaagattagtattagtaggtgggctggctatggagcgatttgagcatcctgatgttatatacacaggctttgtcagtgatgaggagaaaatgtcaattctacagcatgccgatattgtagtgaatccttctcgttatgaaagcctttctttaatacttttagaggctatgagtcaaaagaggccaatgcttgtaaacggacattgtaaggtcttgaaagaacattgtttaaaaagtgattttgcttctttttattacatgaataatcgcgggtttaatcaggcacttcgacggattgaacaatcggaagatttgagagaggagatgggagagaaaggtgtattttatgtgaaatcgaactataattggactttgattatggggcgcttaaagcaagctatcaagagtatctaaatctttatatattttcgataacatgctttagtttattcattattatgttccagtcgtaattactgttaacgtaagaatatcctttttctcccatctctaatctaagattggtagaagagtctagcatatgaagcttatcaatgaaacttttttcattagtgtagtataaagcagcattattacttttatggcaatgttctttcaatacattacaattgccattgaccagcatcgctttttttaaagccattgcttccagtaatataagtgataggctttcatacagtgatgggttgattacaatctttgcatgttgaatgattgatatcttttcttgttcttcaacaaaattagtatatataatatccggatgattaaaaggatcactatattgtttgcctacaagaacaaactttaaatcagaattaggatatacctttttatagttgaggaaataagtatacacattgttaagcttgccttggtctactctccctacatagagcatatattcatcaggaagattatacttttcttgggtcactgcccagtctgatggagcacttagctctatccctacgcttacaatactgtggggtgccatgtgcataccaaatatttttcttgctagtttttgttctgctgttgtgttgaaagcgatgtaggctgcctttgtaaagacttgtgtcaaggttgagcgaaatgcagttttgtgataatgcattgtagggattacaatagtcttttctggtgcatataaagttgtgtaatatacatgagaataatctattgtaatagggatgattgctttgtaattatctttattttcttttatgaaattgaagagagccggagaatggaaaacttggctaccgagtgcttctagttcttctttttctttgaaatgccaaatagggaaaaagtaagaagcaatagctagaaagtgacatttgtataaaaaacgtcttaatttataagccggtttagctttctttttataaaagttttcaagttcaggatgagtgggattagttttaaaacggcgaacaatgactttattgataatctctttttccttaaactcaagattttctccagttctataattatctacacaagtagttagaacttcaacgttataatcattggtgagtctttcggctagcattctacaatgatactctgctcctccattgatatttaatccgtaacgtacaacaacaaatgctatattttccttactcatattaatataataagctttccggcaaagatacgattattaatgataacctgggaacttaaaatctggtttttattttactgataatactatattctctatctttgtgcgtaagtttattaatggagagcatgcatggagaataattatttgataagtgtgattgtacctgtacataatacagttaattatttgcgaaaatgtattgaatctatacgaaatcaatctttagaaaatatagagataattctggtagataatttatcaactgatggatcttctgaggtatgtgatgaatatgcaagtatggatactcgggtaaaagtaattcatctttcggtagctaatgcatctgtagctcgtaatgctggcattgatatggcttctgctccatatatagggtttatagacagtgatgattatattgacgtcaatatgtatgaggaattgcttgctgcaattagttcatatggtgttgatttggtatattccaattttcagattgaacatgacgacgggcatatagactcttttgaacctaatagtggtatggtctgtgaaagatcttcgaaggaggtggtgtatgatatgatgtgtgatcgattgaatagctcttgttgtacgaaactctttaagaagacacttttttcttcattaaaatttcctatacataatatgtatgaggatcgtcttatcttgcatcagtggatattagagtctgaaaaagtagtgtggattgataaggcattttatcattatgtaaaaagaagctctagtatttgccatgttatttcaccattacaacgttatcatttctttttagcacaattttgccgcttggagtttattaataataatctattgttcgatacgaaagaacaatataatatgaaaacatcccttgttaagagctgcttaaggacttttaaagagatgcgttcttttccttttagcgaaagtcgtgcctatgttgttgatatgaagaataatttgaagaaattaattcctctgtctaaaaaggaacttgatattaaatgttataaacggctgagaaagattgtttatttttggcctatttattattgggtacattttaaacttaaaaagataaatagtggagaataagtatttggttagtataatagtgcctgttcataataccgctgattatttgcataaatgtattgaatcattacgtagtcagacattacagcagattgaaataatcttggttgataatttatctgttgatggttcttctgagatatgtgatgaatatgcgaaaattgacaaacgtattaaagtgctacatctttctatagctggactctctattgctcgtaatgctggcatgcgtatagcttctgctccttacattggttttgttgacagtgacgactatgttgaacctgcaatgtttgagaaaatgttagatgcaatggtacaaagtgatgcggaaattgcatattgtaattttcttcttgaatatgaatttaaaccaaacgagtctccttaccggaattctggagatattgttattcgagatccaaagaatgtattacaagatatgatgatggaaaaagttagttgttctgcttgtacaaagctttataagagtggctttctgacatcattacaattcccagaggggaaaaattatgaagacagacttgtaatgtatgaatgggttgctctatgtaagaaagttgtatgggtagatagccctttttatcattatgtagaacgacaaacgagtatatgtcacacgatgtctcctatgaatctttatcattattttttggcagaatatgcccgcatgaggttcatggagaaatattctctatttgaagaagaagatctttttaaaattaggactaggttgattgggacttgtcttacaatatttaaggagatacttttgaaggtgaatttgagagaattcaaagaacctgttaaggatatgaggcagaaaatgaaagagatagctgcattgcctgaagatacatatgaattgaaatatcgcaggagggtaagaaaaatagcttatcattggcatttgtactacttgactcatttcctgtttaaaaaaggtggagattcgtgaatagaaaaagggatatttacttaatatctcactagatagtttttttccctttttacttcctttcttttccttttatatcgaaccattttgctaatcttatctgaatgaatctgagatggaatcggcggactcttctccgcatacgtgcggatacataactaggattaatgagttttgaatagtgtctggcctttttatacatgcccagacacatatacttatcgtatagatcatagtaaaagcaacttaaggatcgtaagtatggctctgttaatggagtattaaatttgtggatataaaatgcagttatatcaatggtcgataatatgaatctttcatatttctgtatatcattagaatgacttgctgattcttctaagacacggtataccgtagtgctttctggaagaaactttattttgtgataatatgatatccatagccacataggatagtctcccattagccagtttttgctcttgggttccacttctttcaagtactccattactaaggcactgcgtatgcaagatgtaagggttggaatacaatttccggataataactctatataaccattaaatttccgtccaataatatcttcttctattttgcctttcttttggttatataccttgctggtagtatatatcatgccgtaatcaggattgttttctagaaaatcgatttgtttctgaagttttaatgggtcaatccaataatcgtctccttcgcatattgcaatatactttcctctgactcgtgagcattggtatttggcaaagatatcttctttctttgagtatttgttttctttctgatatatgggtcttatgacttgagggtgattatgctcgtactcgcgaatgatatcaggagtattatcagtggatgcatcatcatggattagaatttcaaatggaaaattggtcttttgcattagaaaaccatctagacactgggatatatataatccatgattatatgtgctacaaattatacttactaatggagtatttgctatatctttcattcaatattaacttttgtgtacctctttcttcattaaatacttctcatccctatcctcagcctcataaaatcccattttatgatatgcatgaagtgcattgttattgtcttttctaacttcaagcaatatctcctgaatgtccgtagaaagatgttctatgatataattaattgtttttttagagatcccatgaccttgatggtcagggtttacacagacatagggtatatataaaaatctctcttctctattgtaatagccaacaattaaagatataatgttagatccggaaatagtatagtacatagagccgttatggtacatttttaatatccattcatccaggttgggcatctgtaacagagaaggaacaaaccagtttgcagaggatatgataaaatccctgaattcggtatatgctagaggttctgtatggattgttatgctcatattttaatcaataataatatgtacaaactggtccatgttttctataacattaaacatttcttctttcgaagaatatttgaggataagtgtccccaatgcatcgccagcatcacggaaagcatgaacattatctccacttttcagttctgttacacaatctaccagattgttttttgcaaagttttcatcaaatgatatttctttaaaccgtccggtctgtttgctatgtaacatataattagaccaatatccccttgcaggtgacatctctatttcggagcaatcttctcccaaagctgcttttatcacatatttaaccatgttgactcctgttgccagttctgtaatctgaggtattaaactgccaccgcttctggcacctaactccagtatatacaatttcccgtttttaccaagaatagcctcgacattatatgcggttgtccccatttttagttcagaaatcagacgctgtatgtccttttccagttctgttataatttcaggtttcatttggaaaggccagcattcaccaagtggggcgaaatctttgacaactgaagaactgtagtattcgtttccaaaacagtggaattttaaaattccgtctacggaaaaggcatctcctgatatctgatatccgtccttctctatgaattcctcaataataatgcgtttttcacgggaatatgagagggcatcttctataaagtcttttagttgatctacgttagtcagtttattgatgcctttacttcctgatgaatcgacaggctttatcataacaggaagggttaaattcttgatttgttccaaagcctccgtgtatgaagaacatccgacgtatttgggaacattgaaattatgttcagccagatatcgtctgaataagtctttctgagaaagaatttctacagaagtataggggctggtgggcaatcctagtttctcacaaacataagcagctgtaggagctgcaggatctgaagcatatgcaacgacgccatctacttgaagtcttttggctaactcgtaaacagcttccttatctgttgtgctgacattataatattcgtgggcatactgatgtcctgggttattcggcaagtaatcgcaggtgattacataatatcccatttttacagcttctttaatcgcatagacctgatataaagagcctcctagcattaaaacttttttcatcttataaactttcgacaaatcgcttaagtctttgaattccttctttaattttatatatatctaatgtaaaagcaatccggataaaatcctcgcaacaatcaccgtaagttattccaggaaccactgccacttgttctttttctaaaagggcatatgcgaactcctcagattttaatccggtagattttatatttaacattgcatagaaggttccttgtggcgcatcgactgttattgttttgattttggcaacttcttccaataaaacatttcggcggagagtgaattcctcaatcataccagccgaatatttctccgaatttcttagtgcttctatagctgcatactgagacggcaatggagcacaagcagctatgttctcttgaaacattgtcatcactgatattaactctgaaggtgcagctatataacccaaacgccatccggtcatacagaattcttttgataaactattgataacaacagtgcgttccttcatcttgtcgcatgtaacaatacttttgaaatgagcattatcataaagtagtgttttgtatacctcatctgttattactatcaaatcattctcaatagctatctgtgctatttgttggatggagtcatcagaaattatccgcccggaagggttgctgggcgtatttaaaataatagcttttgttttaggagtgattgccttccttatattttctatagatatcgataagtcattggtgctgacaggagctgtgataatgggctctccactacacatacataccatctgtacatagtttatccaatatggagctggtataatgacttcatcccctctgtttagaatggctagcagggttaaatataatccttccattcccccaactgtaaccataatctcatttgtcgggttgtattctatattatattgtaacttgtatctggaagatattatttctcttaattctaataatccggcattaggggagtatcttgtacgaccttccagtatcgctttacagccagcttcttttattttatcgtgtggatgtatatccgggtctcccaatgtgaagtctataacattgtcatatttttgggccaaattaaatagacgccttgttaaggaaggggatatagagtttgttatttctgataattgtatcatactatttctttataatttggaggatatactcgacttcattttcacttaaagcatggtgcattggcaagcagatgacgttattggacatttgggttgctattggcagattgtcagggttagcagaatctaatccgcgatatgttgagaatgtactgattagcggatagaaataacggcgtccgaatacattatgttctttcatcttaaaataaagttcatcacgcgtcattccatattcttcagcatttatgaaaattgggaaataagaataattgtggcgtactcctggtatatcattgaaaaaggttatccctttaacaccttgaagttcatctctatatcttatggctactttgcgacgggaattgattgcatgatctacttgcttaaggttaagtaatccgtatgcagcgcgtacctcatctactttactattaataccgggggctacaacttcagtttcactggcaaaaccaaagttctttagatagtcgatgcgctttttagtctgctcgtcatgaacgactaatgctccaccttccaaagtattgtaaactttcgttgcatgaaaactcagagtagccatatctccaaagtttaaaatgctttccccgtttatttctactccaaaagcatgagcggcatcatatatgacttttaatccatatttattggcaatttcttgaatctctttcgttttacaaggcttcccgtaaacgtgtacaggcatgatagctgtagtcctgggggtaatggccgcttctattttactaggatccagattacaggtttctggctcaatgtctacaaaaacaggtttgattccattccaccaaagagaatgtgttgttgctacaaagctaaagggagtagttatcacttcaccggtaattctcattgcttgtaaagcggttattaaaggtagagttccgttcgtaaacaaactgagatagggaactttaagatacttagctaattcctcttctagcttttggtggaagttgccattatttgtcagcattttgctttcccatatttcttttaataagaaagtaaaatcttccaaagaaggcagtaggggggaagtcacatatataggtttatctatcattgtaattatggatattattggtctatataatagttgtttaggttaatgacgttattgtctttgtctccattaagaatcgggtgtcagctccaatttaatgatttaagacttaaatttcacaaagatagatagattccaatac

SEQ ID NO: 157 - DNA, 17704 bp, Bacteroides thetaiotaomicron
ccgctacgctgttgacgagacaggatttcaatgaattcttctttactcattttttgcatagtcttttttctggcaaagatcgagacttaaagatacaaagacaacgggtactttatcgggggcttaccaagcaataaccttgtcagcattattacttttgaatatatcaaaggtatgctctcaagaagataaaaaaactaaagattttttcaattctggtggatatatatctgaaggatatgcattggatagaaaccaagtacgatttaatcagtccagcgattttgtgtttcatcatattcctaacggtaatctaatatgcattacttcaaaacaatttagagcacatgcatttagtcgacattataattgcatactatcaaaagacagtaattttattgcatacgtatctgtgcctcccatattctgcggggataaagattccatttatgctgactttagttttaaaacaggatttatgattgaagtgaatacttatcatttagaaataatcaaaggagatttttttgtaaatacaggggaaagagtgacctctttatgtgatcttcctctcatttataaatcttcaaaatatgctcgtaaagcatttaatgcggatactgtaattacatatcctttaagaatgtgggaaaatttagaaaataagtacaatcattgccaagtaatgataattcaaaaaaaacgtcgtggatgtattgctctgtattgcttttataatgacaaaggtgccaaaaagctaagtcactatatcagatcattagaacatgtcttttggtatagagaaccgaaagattacattgaagtaatagatccaccaatcatagatgaatatgaaatacctcatttaaaagctaaagaaagatccgctaataattaagatgcaaaaataagatgggaatttatcctattacttctatctttacagaatcacacaactaaaatttatcagaatgattataatggctacaattattaaagtgtaaaacaatgagaatactacaaacaataatcttatcatcattattacttttgatagcatcgaatgcttatcctcaaaaagataaaagtcttcaaaatgtttttatcccagaaggttatgcactagatagaaatcaagtacagtataatcagcctaaagattttatatcctatatcgattctttaggaaaaaacaaagtttatttaggatgctttcttgcaaaagaatctaagagattaccaagctactatcgcaaatcctttctatccaaagatagtaattttattatactcactgctattcccagtatattttgcagacgcaatgattcagtctatgcagattttgatttgcttccagaaatgaaagttgagatgaatacttatcatttaacccatattaaagcggacttccttaaaaatacgggaaaacgagtcgcttttttatctgaattacctataacttataagtcttccaaatatgcccgtgaatccttcaatgcagatactgttatcacataccctttaaaaatgtgggaaaaatatgaaaataaatatactcattgcttggtcatattaattcaaaaacgatatcgtggttgtatccctctttattgcttatacactgacgaaggagctaagaaactcaaccactatatcaaatcattacaaaaggtgttttggtatagaaatccgaaagattatatcgaagtaatagatcctgtcccagagacagataatatatttattttgccaaagcgaaatgaatcagataccgtacgtatagttggtcaattatgaaaaatagaattatatcacttttcatatatttattgcctggtttgatctatgctcaaaataatgcagacgacaaatatgagattatgtctctaaccgacatgttgaatctttttaaggacagtatcaagacgtaccagcaggttataatggtataattgccgaatggttcactggcaaataccttgaatattgatattgagtcaacaagcaatattaaatcattgattgtctatgcaacaatgcgtttttatttctatatttgtagaatcacacaacttaaatttaatgcatatgaaacagaaattagtacgaataggtattagcgggatacagaaacaaaaagagagattttgccttatatttcctgtactattatttatatttatctttcccgcatcatctattgctcaaactatcgcagaagaatataatttcaattttaagggaggagaagaacaaaagtggtcttggataaagaaccaaaccggatgctttacttatattgaatcaatgcaaataaagaaagatgataatatagtttataaaatatcatatactccacctccatcaaaaaataagaatatgatatttattacatcttgcactatcatgataccagaacagataaatggagatagctgccaagtatctataaaaagtaaaacaagagagataactaatgcatggcttacagttacagctctcaacagtaatgaagtggcagtagcatctgaagacaaaaagctggaacatccggaatggacggataatgtactatcattaaaattgacggacgggaaatataaagccaaagcattacgaattaatatcttttattttggaaatagtaatccggatcaacaaatatgtttaagtgacctgcaaatcaatattgatggaaaagatctggggaaacaatctattgaagatcaaactgtcattaacacaaacattcacaaaagacttatcaaaaataagattataaaattatctcatgacaatgatagtactctgcttacgcgaataaatgaattgaaagataaaaaaatcataggattaggagaatgtactcatggttcgcaagaattaaaaactgcggttattcaattttcaaagaatctcattcaaaatggagattgcaggtttgttctgttagaggctcccgttgatgccttactactggtcgatgcatatatacaaggaattatatcatcacccgacattgaaaaacaaataaaagaaatcatgcagatgttttttacaaacaatagcgagcttatgggctttgtggattggttaaaggagtataacaagacatctcttcgtaaagtacacctatctggtatggattataaagacatcataagtccatatttttatgactacctattaaatctattggataaagaaaaagggcgatactatttattaaaactatatgataaagaatttaaagatatattgcaatatgctcatgaggatgtttatttaaaaacgaagttgggagaagagaatttttcgctttttacccaatacatagaaacttgtatcaatttgggtattggctcccaattgcctcctcctgattatagggatttctatatgtttacttataccaaacaacttgctgatcatttcttaaaaaaagatgagaagctaatcattcacgctcatagtgcccatctttctaacttggaacgttttgatagttttccgtataaagaaatcccagcagggaatcgtttaaagaaatattatggagataagtattactcaattggttttcaagttggaaaaggaacatttactcaggaatccgccggttattttagcaagctgatagcattaccattatccaagccaccatataatagttttgaacatttagctctaagcacaaaagaaagttatttctattatccatccaaatatatggatgacggtattgttgagttattagttattccaagaatggcacgttatcagagacaatatcaatttcattctgtgaaaaactggtgtgatgcctatgtctttatacaagagagcacgccgctcaaaaatgtaacgactggagaattcgaaacaatgttcaaacaatttcttagaataaaggagttgataaaagaattgaaagcaaacgaagaaaagataagaaataaagagtaacttctactcaaaagtaaaagctactcttcattccatataagattggggatattcagtaagtttccctatttatttgctttaatacgttgcccgtccgcctgaacagcgtacagttccgctccttcaatgtctgcttcggcaggtacagtaaatacaaaccgattggcaaaccatacttttttgccatccttgattaattcgaaagcaaccgcctgttcgccattagtcacagtgtatgttcttccggaaacggtataacttacagtcttggtgattttcacattgttctggaatgtttcgaagtaccctacatctcctccatcttcggatatacctttttgattgcctttggctcctacctgatatcttcggtcttcaatgtattcaataggcggacatttagtggaaaatgttttcatataagccagcgtctgattaatcatatcctgtgtcacgttatatgaaaagcttccgtaagcatacaacttgaaactgaccggaataaagaatccccaggcatcgaagaattcggtcatatccatgttagcagcttttgctacgttgcgtgcatacatcagttgcgctgctcccggatcattgaaaggtaaccagaattcaggggtacgtccttgctcgaatatcttacggatggtattcggtttcttgccgatacgttcgaagtatgtccacaattgctggttaaggcgcatgtgcatttcggaggcttctccttgatataatccatatttattggcatcatcagatgtcatatcctggggggtaaatgccagcgtgttcgggtctcgcggatgcatgaatctgctccaaggggtcggaggcgcatatcggtaaacagccaatgtcccgatggaactaccacgtgatccccactggttgatcttgtacaccacataattagaaaagagattattgctcgattccgtagtactgggccagttgatggctccctgatgcatatgtccgagttcatgtcccggtccccattcattgtcctgattcttgtccatatcgcgcggatcgaagttgtttttgaatccccatccgtcttttgtgcttacatcaccggctgccatgttaatgtaataattggtagcataaagtccgtcggtgaaagtagtgacatgcatcagtgaattgaattctcccgtattcgaataggtgtcgatggcagccagttcctgctcccaatctatcaggttatcccatcgttccattcctcttactactccatactgtttgaagttgtcctgattttgcagcaagtctttcagtgctgtaaacagaatcttcctgcctttcagcacaaatacacatttgtcagatccgtccaaagtgacagattttgccttccggatatattcacggaacagatcatcggttttatccacagtcagatcccatacattgaagcctacacgcgcatgttccgttatctccacatactggggcggaaaatgtattttcactgccggcatgccacggggatcaagtttctgatagatgacaaacagatttcccgcacgtgagaaagaaaacttgttgattccgtttttcaggaatcgttcttcaccgtcgggccccagatccgaacaacaccttagtgaaatggattcaccttgcggtatgccgtctgctaaaacgaccatctcttcacccgcattggttatgataccggtagggttgcaaagaggcgagtagtaattggttctcaatttatctccccaatattcgggcacactgtatgcctgatatgactgtatcctgaatctcttttccgcttcgggataagtattgctctgcaaagactttgccagcacattgaagaatgccggaagccgattgatggcttcgtcggaagcgtccgggaggagttcactgcatgaacggtcggtgaatactgttatcagttgttcgtcaagcggattttccgcagcatggaaaaattccatctcgtcgcaactgacgaaatcatttaatccgcttttaactttgaattgaacagccgcaggtacaaccggatcgttcagcaatatcctatggctgcctcctgctcctttaaaatcataatcttgtatatgaataaaatccgtacttccttgaggcttgatgtaaagttcgaatgctccgaaattaccgttaccattccggctgtgatataggatatagtctagcgtaagctgattctgatcgaactgatattcaagagtaacggggaattttgcagattgactccatgtggaatggtaacaggttccgccgaactgaccgtcataagacttcgatatatcctgccccggctgatggtcggtgtcgtatccaccggtaactttcaactttatatccttctccggatttacacccgaaatatcactcgatttcttttgttgtttgatttccgactggtcataaatgtttgtattttctttggatacaaacttgatcgtagcattcctttctgtagtcagaggattggaagcaatggagaatattcgtgtactggatgccagatcggctcttgtatcaggtacttctttctcggtaatccagtctttggcttcctccggaataactacttcatagtctgtattggaaagcaagttgacttccagatgatcgtttcctgttcccgccacctgaatgacacggctctcttcagccacttcaatgatcaggtcaccgcctgtctgcacaactctgagtttagcagtcagcgcattattggcgatagtaatatttccttctctgactcctttttcgggactggatgttgccgaaaccgtcagttctgtatccgatgctttccttgccgtcagccattcttttccctcagttaccgatgcattccactcccggttcgatttgacaggtacggctacttccccaccctctttcttgaatccaatggatttctgaacttgcagcaccggctctccctgcagctccttatcatcactcttgcaagcatagagagtagtgactcccaccagcagaataagagagatacatagtatgtgttttaccttatccaataacatagtatttataatttttgttgtttttccatttcgttgaccaaactatccaaatcgaagtcaatgttatattcattctctatctgaatctttttgatttgcttcaccagcgaatgcggcttcaaccttcggatcatctctatttccagaagcctgttcgggaaacgtttgcgaatgccatcgatgtctttcatataaatgctgtctgctccctgataaagcgcattggcggattcttcaagaataaatgctcccaaactgtcaggatattgttcgagcactgcccgcagaatttccagactttttccgaaactttgatgcgcatcagcattcatatctttagccgcctgaaacaatcctaactgaaacaggtattctcctgttatcgcttttctctccattgccaaagtctggacatgcaatgcggaatccagctcccccatctcagccagtagtttagctttggtaccataataatcggggttgagactgtcaatcgacagtgcccggtccagaaggctgatacacttccgggtggaatcgacatcataagacgattgcaggatggctaccgcctgttgataaaaactgtcggcactgagatttacgggatggggacgaatgtccggtttctgccgtgaatgacaaccgacggctgtgcagattagcagcaaaacaagtaatatgatattcagtttctttgttttcatgtacatgattctcaatagtcggataatataaataaaaaaaatgactgacagggagttttataggaaaatgtgtccaatctaatcttatttcctccccgccagtctttctattagtttatcagatgcctagttcttttcttgcccaagcctcatcatgatcgtttatcttataaagatagataccagccatattccaccagccgtttcctccgctcggatctatcggatcggcatcacgacgagcttccggaataaagcgaatgtatttatatggtttgccggcttttatattctcattaggttcaacgtgctgtcctctgctgccgggcagtgtataagtctctttacccatcagcgtccaggtattgttattgtcacttccccagatacctacacgttttacgtccccggcaccattaccattatttcggccatcatactcaaagcgcaaggactgcaatggcaattccgacatattgatttgcagataatgaggttgcttattgggtgatgttccactccatatcgtgtgataataggtatttatattatcatcgactaaagctgcaagtgatccttcggacggttcggtcgcattggcagagaacatatcgaccgtaagagcaataggtgccttgataacggactccccggaagttcctcttacgacggcaggttgttccgtctccatgcctgtaggaccatacgttttgatagtaaactcatattcaccgccacatttgaatgtgttatctacgataaataagttggtagtattatctgcgatttccagttccttatcctctttcgtcaccggatcatgatagatgactttcatctttgtaaaattcacatttacaggcatctcccatttcaacttaataaatcccgctcccggagtagctgtcggattcttcaccccttcgggaggaaccggaatgaatttctcctgtgtaacggtgacagtgaactcattaggctctatcggatcagtgcttctgaatgtgatgtgtcccacccgttcttcctctacagtattaggctggataatgaaactttcggaagcatcgcgcatacctctcgtggcaggcaaaggcgtaatccattcacgggcagaagcctccacttcataagtatacgcatctgcaggaccatttactttaaatggaatcgtgattgtttctccggtagctttcacctgatattccttctttgattcgtcaatgtcaacaatatatcctctcggctgctgcttgataatgagtgtaccgacacaattatagttttgtgacgactgcagagtgactgtacaataccgcacaagggtatcggtattctgatccaaagtaaatgtcaggttcttcttgactgtgttctctgctttttctgctttctgtgatttcttagccttcggctgctccggttcgttaaaacgtacccaatcacaagtatccggcacagtaataacatccagattcagattggtatttaccggaatagtcagagaagtcgctttagaatctacgattttcattccatcggccgtcaatccttccacttcgatcaccggttccaggccgaactgtttgacattaatagaaaagctctgatgaccgtaagctatcgtaatctccgctatgcgctgtttataatcctcattttcgtcagcagatacggtgactttaccttcatgtttttgtaacttgcaccatccggcattcgaacttgccgtccagttatcaagcgccacattggtctccacttctatctcatgctcaccaccggcaagggggaaaacgatagctgcctgactctcgctagggatagtcaaagacaacacactgaactccgtttcataatcgggaccacaggaagaaagcgcaatgaacgttcccaaaactcctgccagcccgatgattagtatattttttttcatatcattagatgcattacaagttttctactcttggattgaattggtatctcagtttggcatttacttccctgtatcggtctgtaggctgcaaacggtatttgtaatggagacggaactccttataataagtggcacgtccgtcgggcgtccggatgatattcagcaaatacgtattgtcatactctccaatgggagtcaattgcattacgtcgatatccttatagggcagaatagtaagctcttttgccagcggattctcgggcaactgttctcccatttccagaatgatgcttcctttattgatgatatccagtgcagtggtataatcactgaaactttcatcgcctgccatcagacgtacggaattctccgaaacaggaaatacacgattggaattcgtcggacgacggacttcactggttccatccgtattcggaataataatggtactactcgtataattgtaatatgttgccgtttgtgtggatgcataataattttccttatgaatgcgaagcagcacgtgtcgcttcttcggattacagtccggtgtcttcagcgaatcaatcttatattcgagaaaataaatggagtcgggtgaaatcttatccagatttttcagatacaccggaaacatcgctttggaagagccggcaggaatagtcatttccatagtcggaaactcataacattcttccggtaaatacttcgcgaagcgtgctttattgatatcgaaattagatttgttgtaagctctcaacaatgtatcagagttttgcagtgctactgtaaacgattcatcggaagcctgcgaaccacttaatgaagccaccacgaaaagggtatctcctccctgctgcaactcggctacctggcgatcatacaccaggctcgaattactgagcaaatttacttctttgcggaattgttcctgagcgaaatcatagttatcgcaaccacttattacaaccaaagcagagcaaagaattatagttactatcttcttcatattttctttctgttattcttgtttttcattatctgtcccatcccggattctgatccattgcgggaactttcagtaattcatcatggcgaatcggcataaataccattttgggcagtgcaacccggtcacggatattctgctggtcgattgtcacgatattccagaatcccggattgccactgacgtcggtacggtctttctgcacatccagtccccgccagttggacatattggcatcgtcggtgaggaaagtaccccatctgcgagtatcgaaatagcggtagccttcgttgaaaagttccacttgcctttcgttgcggataatttgctcaaaccggctcgcatcattcatatcgctcaaagaaggaccgggtaatccgacgcgatagcggatcatattgaaatatttagccatttcctgaacatcacgactgacagtaacttcgacatccgtacctgtcatatcgggggtagttacggttacggtccccgttacgttgtttagtgcttctacatattcaagaagtacttccgcatagcggatgatagcaaacggtttggggctggtaatgaatgaacctttcacattcccttttccgccagcccatgaatcgtccggatgaatatacttgacaggagtgtaaccgctgatattgtagtcattgacattacttcccgcaccggcaagtccggctttcgagtcatcgtgcgaataccagaactgctgattgatatagcttgcatcagaagatgcggaattcatagtccacaggcgtccgggaaatccgatggaagcataaaaacgtgccgaacggttgtcatacatcttcggaacatctcctcgcaactggtaacttcccaatactttattggtacctattgtttggttaaggtccgctacataaggatattccgctgacgcattgtgtatatctctgccgtccatcatcaggaagcaatcgaccactctttggggtacggacataccgccccagcctccgaaacctaccgggaacgagtgttttgtgtaactatagacactaccggatgacatagcccagataaactctttattagtggatatgataccttcaccgttgaacatatcagcaaaagaatggaaaggatcgataccacctgccccatcggggaaaggagcggtaggaacattatctgccaacggatatggatgctggttgtcgggcatcactgtaaacagcgaatagtaatccatatcaatcacctgttttgcggcagcggctgccaccgcccagcggtcaggatcgtaagtttggtttacgtaatcggcaccgtcgcttttacgctgccagttgctgaaacattgacgggcagcatcaccgccattaaacaacggagaagcctggaacaagcgcaaacgagctatcagtgccaaagccgcccctttcgttggacgatcagaataactgatactctgttcggtcggtccgtaaatgccttgcgtagcaagtttgaattcattgcatatataatccacggattcatcatatgtagaccgttccctgttatagtattccgccgattctgaagtactcagcacttcatcccccacaatcagcaacggaccatagttcatcagtaaatggtagtaggcataaccgcgcataaagtgtacatatcctatatagcgtcttctgtcggcttccgtcatatcgggtactttaccgacattttccaacatccggttacatcttgtcactactacatacatagtataccacaaatcttgcggcaggtttctgctgttaattttaccgatactgaactgcgctccccagaattcgttagtttgccatctgacggttatctcatccgaagcagtttctcccggattccatgagtttccccaaatggcaccggcgtcgggaaaacgagtcggggtattccaaaggtatccttcggcattcttcatgctatggaaaatggaatcttccttaaatgtagcctgaaaatagctgtctacatccaaaaagttacaggagctgaacagtaaagaactgccaatgaccgctcccaaaagtattttaattcgatttttcatgaatttttcaatattatgtgattagaatcttaagtatacctgaaaagcataagtagcaggtatcggatagacagcaccatttgccgaagcctgttccggatcaaagtatttcactttgtcgatagtgaacagattgttggctacaaattccagatcaacggaagacaatccaacagatttaatccaaggcagatgtttcaggctgtatctcaggctgacttcctgaaggcgcaggaaagaaccgttccgtctccagaaagaagaaagctgggagttgttcgtgtttttgccataagaaagccgtggaaattccgcattcggattctctgtagcagtagttcccgaataccatgcaggggtccatctgttcttgggattgttagctagtttgatcacatttcccaagtctccgttataaaacggaatccatccgtagtcattgccaagtcctgcacgatagtaatccactttcgcagaacccttgaacaaaatactcacagtcaaatctttccattgaaaatcaccgccaaatccatacatcattctaggtaactggttggaataagacaaaggcaccttgtcgtcttcattgataatgccgtctccgttcacatcacgatatttaatgtcaccgggacgtatcgttccgaatccactttggtcaggactggtattgatctcctctttactggcgaacagcccttcggagatgtatccgcgcaaaatattaaaaggcttaccagtcacgctgagataatcataaggtaatttattctcttcaaaatagtcaatgacattttgtgagaacgtataattagcacgaatggtaaaattcatatccttgttgatctgatggaaaaactcaatgtttccgtccgatcccacactgtgcatacgtcctacatttgatttcggataggtcaccatacctacaaaagaaggcaacgtcacacgatcctgaaagatatgatcacgagtgtcccggaaaatatcgacagtaaaagacagcttgtcatgaaagaacttggcgtcgatacccagatttgccttcttcgctacttcccattttaagttgtcggctccagtgtaggtttctgtgataccattatagcggtatccccaggcagatccggcgtgattgtctatcatagtcatataagggaaacgccctacgcctgtataatcgttgacggcaacaatctggtcgtttcctacaataccgtaagaaccgcgaaatttcagaaacgtgaaccaaggcagtttctcagaccaccagttataagaggaaggaacccatccggcagcaatggaaggaaagaaaccgaatcgttcgccttttttaaactgagcagaacctgtataaccgaaattcgcgtcaataaaataacggtttttatagtcgtaagagatacgtccggagagattctgatgacgcttgggaatgctgctgatgcccaaatcatcaatggctccccattgagaatctttctcatctttcatatagtattcgagcaacgcaccgaaagtatgatcgccgaatgtccggttccaattagcttttgcctccaagtagtactgtctgtaagagtgttcagcatctccgtatgccagactttgttgtgaagagcgcagtgatttaatcaaaactccctgtgccgttcgcccggtagcacggtaaagatccggccaaatagagcggtattcgctgaaataaccgatatgttctgtcatcccttgtacggataatgtcagtcctttcaggaatcctttgaattcttgtgtcaatttaagcgtcagcatgtttcggttgtcctcactttgcatatatccggtattattcagcataacgtaaggagaagccaatgtacgctgtcctccatatacgggtaacgtaccatcggagtaagtgaccggaaacagaagtggtgtcaactgttggacagcagaccatactgcgtctgtattcattccgcccgggctgacataggaattgacatatccgtccacaccgaaatacaactgggttgttttggtcagattcatgtcgatattggcacgatagttcagcttgtttacgctcaatggtttcttaaacaggttttcttcctgacgataagcagcaccttcatcctgataacctatcgataaaaaatatctggcaacatcacctcctcctttagcactgacatagtaattctgttggatagaattatgtttcatgatttcgtccatccagtttacatccgggtagaggtccggatccaacttatttttgataaggtctagttccagacgggtatacagatcatcttctcccgacattgctctggcttcattggcaagaagcgcgtaatcataagctcccagatattcgggcagacgtttgatatgggatattttcatggtagcacgtccggtcacttccagttttccgctggtaccgcgtttggtagtcaccaatactacaccattggccccacgtgttccgtagacagccgtcgctgcggcatccttcagaatactgaatgattcaacgtcatcggtatcaatatcctccagtcttccttcgataccatcgatcagcaccaatgctccggtaccggctccgaaagtactgataccacgaatccagaagttagagatatttttccccggttcacccgaagtctgcatagtgatgacacccgccattcgacctccgatcatattattaagagaggtggcgggagttttcaattgcgcgacatcgattgtggtaattgcgcctactaccgatacttttttctgcgaactcatgcccgttaccactacttcatcaatcttagtctcgtcttctttcatgacaatcttaagtttctcttcatctttggtaatcagcatctcgacattcttcataccgaccgattggaataccaacgtggcattcttcgtcactctaattttgaattttccatccaaatccgctaccacgccgacccccggttcattctttacataaacagctgtacctaccaatggctcaccggatgcatccacaatcacgcccgccactgtaaactgtgtcttcgtttcgttctgactgtaacctgccaatggaatgagtatcatcagcagcacaatcaataaaagattttttttcatatatgtattataaaaggttattctatagacaatttacgaatcactttatttccggtatcagcaacatacacgatttgtccatcggcactgacagcaactccgaaaggatgattgaacatagcaatgtccggaccaccatctttataacccttcattcccggaagtccgataggggtacttacggtagctttgtctattgacaatcttgtatcaatcactcgtatacaattgttaccacaatcagcgatatacaacttaccgtcttccgtaaaacagatctggtggggattattaaacttggcatttctcagtagaccgtcttcccatccttttccggcaatttgtccttctactatagcttttccggcataaccctcaccaggataggtttttttatctttaccttccagattaccgacatctactctccatatctgattaccttcagccattgcgatgtaaagcatattttcctgtcctttgacagggctgaatgcacagtatgagtcacaggcgtcaggtcgggtggaagtacctaccttcttaagcaggagttcacaagtacgagtattcggttttatcctgaccagttggcctcttaccatcaccgtataaatgtaatggtcgagtttgttcaccacaaaacagtgcttataattattatcggcaatatcctttgttgcatcatccagcaacactgtcagacgacgaggtgcataacttacacttttagacaaagcatagaaccccataccaccatcttcaggagcatacatcgcattatctatatccgagaaagcaggagcattcagtatagctgccgtaccatactgtagtacaagcactgaattactcttgacagaagccatgacaacatttccattcgagttttctcctttatcattcttacaggttacggatggataattatctcctccgtgccaaacatgacgttcggtgataaagatattatcctcatcgtccagacaaatgtagttgggtgccgacaatgtagaagtagctatatctcctcccacagtaggttggtcggcatccggtgaagcttgacctattacggtagttacacttgtctgagtcttgtagatgaattgttttctggcttgaccttcatattctttcccgtcggacatcgttcgggcaacgagaagattcatttctttcttgtacgttaaccctgaaggaacatatagatagattttgcttccattcgagctgactaagcctgccggatgctttattccatccacatcctcaaagtaaactttcagattggtagtgtctgaaccgaagtttctgccttcgacgatcataggggtggcaattccaccggaatccggataaaatccggtcacctcaataggttgatccggattaaatactgcacttcctatattcttactatccgaacatgaagtcagatagacaaatacggtggcaaaaaatgtcaaaaaaatagttcttttttgcattgtttttctgtgattaaaggttaataattagttgggttaatatggataagtagaaaacttactattctatatctagcattatgataatgtggtagaaataagatgtgcatttttactctaatacgtttgtttttgggtgtgtatgctttatcttaatatttagtaagttttggaatatatatagttgtgtttgactgttatcattcatttgtttttcttgggggtattgaaatttttaatgaattcaatctctcttcagcactgttctgatctatgctgaagaaacgataataaaaatttaatcacagcccggagg

SEQ ID NO: 158 - DNA, 17689 bp, Bacteroides thetaiotaomicron
tatccggtgtggatagtgtcaccatttttatatgcagaataaagatcatttaaagtatcccacgggatgattcatcataggaatctgactatctttcagtttcaatactttcttcagctgagcggcatccatcgaagcacgtggcactgtagccagtttagccgcagaacagaaaatagaaatattctgagaaacaataccggcatccatggctcccattagttgattctgtatcttctgagcatcaccaaaacgggaaacatcactgattaatactaaagataccggagccgtttttacaaaagcctggccacccgctaccgctccacggtaatctccttcagcaatcagatttaactgatgattctttgcgtcatacaagtaacttccttccgataatatcacatatacgtctacatcctgcttattcatagcggaaggagccgttcgttttccagcatccgaacgattgattccgttggccgcccataataagtctgacaaatcagcaagagttaacgctttcgaagcatactcacgcgtagattgacgttcagacaatgccttcatcaccgtaccagtacgatttaaattaggttttggtaacttaacaaccttatcagcagcaaaagcagccgctgaaagcattaaacaaacgaacaatagttgtacctttctcataattgtggtatttataaagttgataggcaaatataaacaaaaaaggtctgcattcactatagaacacaaaccttttaaaagttatttataaggctttattatttcttatctccgaaataacggttgtaaagtccttcaaaacctttaccatgacgagcttcgtccttgcacatttcgtgtacagtatcgtgaatagcgtccagattcaaagctttagcacgagtagcgatacgttttttgtcttcgcatgcaccttgttcagcatctttacgcttttgcaggttagtttttgtatcccaaacacagtcacccagcaattctgcaaatttagaagcatgttcagcttcttcccaagcatagcgtttgaaagcttcagctacttcaggataaccttcacggtcagcctgacggctcatagccaaatacatacctacttcagtacattcacccataaagtgattattcagatccttgatcatttcttcgtcacaaccttttgcaacaccaatcacgtgttcgtcagcaaaagacaatgcaccaccttctacttcaacaacttctacgaatttgctggcaggagctttacacaaaggacatttctcaggagctgcgtcaccttcataaacgtaaccgcatacagtacatctaaattttttcattttcttctcaattttaaattaattagtcaatacgtgtttctttatcttttcttaagcaattcttgcatatacctttataataataatgaacttccgtcacttgatgcccatccatttccagactttcaactttcttcacggcttccggagattttaagtcgtaaatatgtccgcaatacctgcataagaaatgagagtgaacagaagtatccgcatcaaaatttgtattcttctcatcaatcgtgagcatcaatgcagctccctgttccgaaaacaatctcaaagtgttgtataccgtcgttttcgaaagtgtcggcatagaaggagataacgctgtatagatatcatcagccgaaggatgaatgggatgattcatcaaatattccatgatcgctatgcgctgcatggaaggctttatattatgctctaacaatcgttcgtatggtttcataagttctccctcttttcaaagttgtattcattacaattataaatctgatgcaaatatagaaagtcccaatatcatttccaaataaaatcaatattttttttgcagatatgtattactaaattcttccatacaaaaaaggccatcttaataaagatgacctttagacattgatatacctctattttgccttaattcttgttggttttagcctcttcgattattgattcaggtactttttcgcaacggacatatttattcacgtcactatcatcatcttttacagtccaaatcatggaaccggattctagcaaatccgttacgatatagtcattgttccagtcaccattaccaaaatcatattcaccactaataacatatcccagataaggatcgttttctatattaaaagaaccagtaatataacgtgcatacatactgtcaaacttctgatacatttcaaaagtcagttctctacgattaaaagttatatagcaatatgtaccttctgccagagcttgtccgttccattcagaaagttgccacgttccgtttaaattagcagcagtgaccggcaaggcaggaatctctaccttttcatcgtcgtcacaggatgcgaaacaaagcacgaaggcgaataaagccattaatttgaaaatattcttcatgtcttctttttatttttattgttacttaatacagtttacttttatattcaatgttcggtctgacggttgcccttccactccctctataataataggaaaagtaaatgaacgacctttttccacaggaatcagtgaggcgtctattgtaatcacaacgtcggcttcactacccggactgattacttccggctcggtacgaaaagttgcaaactcaggaataacagcagccgacaaacgcaatgattggtttccgctgttaccacacaggattcgttcggaaggacgctttcccgcatttacttcccgaaattctatccggttttgtttcagtctcaatttacccatcttatatggataacgtccccattcatccgctcccggcaacacattacctattaatgtaaggcgtgccacaggcattttgtccgaagaagacagataaacaaaagcattcgtgtctatcgttccgggatgattcttcggatgataagtcaatactacaactctcgtttcaccgggagatatctcccctgtacgtacatctgctaccgcacatccacaagtagttcttacacgggtaagatttatggctttgccacttacattagtacatgtgaaacgatacatttttggagcatcatcttcggttaatgtcccgatattcagcacagtcttgtcaaaacgcagaatatgttccgctccttttatcaacggcggatttatcagcgtatctgttttttcctgtggagtgaaatggacattccgggcttcaaccgcccggaattgtccgatgactacacataataaaaagaatcgtatccaagtaactggtttcattgaatattaaaattacatccaaccattatcattagccttcttgcgaacggtaacagtaatggattgttcgcttccattgcttactttcactgtaatacgggttgcaccggtttttaccccggatactgtcataaacgtaccattgacagatactgaagcgacagttgtatcacccgatgtgcaggtataagttagattctctccattaacaaaatagcaggcaaggtttaaagtcgatgctgcaccttctgctacatacatattgggtactaccatatcagaaccattaccctcaatattgttaagcaacattccggcatccagcaaacctgctcccatcttgcccacatatttcgataactctactctagtagcggaagctccggatgagatgtggttacgatagtaagccttcacttctcctgtattataccagctatcgagtggttttgtagatgatttcaatagttcgacaaactcacttgctttaaaatgacgacgttgtttgacagcatacgacaaccccaatgctgcaactcctgatacatgcggacaagccatagatgtaccatccataaatccataggtcgcattaccgttttgtatccaagtcgagagaatagaaccggaatggattccttcttcccaaccttcagggtcatcttgccccaccggattgtaatattccgtatcaccacctggagcagatatcgtgacttcctttccatagttgctatatgaggccggagtaaaatcggccgctaccgcactgacagatatacatttggaataagcagcaggaaatgcagccattcccgcatattcgtttccggaagcgaaaattgccagtccaccgtctatcaccccattgggcgaaccggcattattgataaagtagtccaatgcatctttttccaacggatacaatttttcccattcttcttccgatcccggaccgggagtatatccttcaatcagattggccaaggaagagttgtatccccagctacactgaagaatgactgcgccattatcagccgcatattttatagcccttgcttcagcatccaaggtaacaccggcttcacccgcaaacacttgacatgacataattttcactccggagtttttggaaccatcgccaccggcaataccgcaaacaccttcgccattattattcatagcagcaatagtacctgcaacgtgcgtcccgtgtcccgtgtcaactgcatccatccacgaaatgattcctgaattgctcacgaaattgtagccatatttatcgtccttatatccgttaccgtcagcatccttatctgcataaagttcttccttttcattgatccacatattacctttcaaatcaggatgggtatacatcacaccttcatccagcacagcaacaatgatagaaggatcgcccgtacacttcttccatgcttccatacaaccgacatcacaccccggcctggaaccatttttcaatacgttctgattgtcaaaagggttattgccactgttattataatgccattgatatgccaatccgggatcggagaaggtgcttcctgtcgtaacagtacgtgttgccgccttctgtcgcaatgcactctcactaacataactccgatagccatcaactctgtaagcacgctgaatgtgactgttagcctgtactttagctacttcgcctaatttagcaagacgaccggcggcttccttcaagtctgtattttcatcaaactttacccgataccacaaatgtaatcctgaagtacgggtacgttcttcatttttagtgtctaccggaaatatacgttcaaaatgatatgtacccagaatatccaacacttcgtcagtagaaggaatcccggaacgggtcatagcccccccactccttgttgcaactgtgagagcctgatcaagaatctctgtcattgcaggatcgaatttaatcagcaattcaccggaagtgacatcagccggaagctgaacttccgtcccccctgttggggtagacggttgttcgatcacttcttgttccgagcatgaagccagcatcaaggcaaacagtgctgtatataagaaatttttcttcattgttcttatttaaaattattcttgttaatgatatttactctatagccctgctagtctgtagttcccgacaatacaaattttctaaaatacaacggataagcgacaccgctaacaatttgatttgtcccggggtctgtacttccgtaataataagaaaaatcgtagtttacgatatccacattattgaatcccactgtatttccttttgagtttctgccgtcttcttgctgattgaatatcatgctttcgggtccccaatatacaaagtaaggatggaatagcaaccaattaggcaaagcacctgtcaggaagttcaaattaatatgaactgtacgggcaaacggtaacacacgcggaatatcctgcccgcttactggagtctgcttccgatatcttacctgattgtcggtcgtcaacagccactggcaagtatctctagatatcttatccatgaatatggatggcttggcagtcaactcatctttactgaagaaatcatccgattgataagtttccggtttatctgcagctctcaatgccgctctcacctctgcgtctgtaggtaattctccctccaagaagttgtatgacatttgcaatgaaatcagtttatcccaagtcaataacttcaagaaagcttctctttcaggttgtccttgagaaatatcaacatgcagaccgacatccctaccattgtattggttgttcccatcaatcaagctcatatctttcagtgtttccgtagcacgacatccggttaatgtcaaatatctcaagtgcgggaaattcttttcgttcaccacatctgtaactacagacaacgactggaaattattacttgccaaatccaaattctccagtttcttacccaatttaataaaattctcagggagagcatttataccaaaagagaatattgtcagatccttcagatactccaattcgcaaatttcttctcctaaagaaatagtacgtatttgtcggttggcattactctgaactgaaaatgattccaggtatttcagatgacgaatttctttggggaatgtttcaccgtcttgcaaatcaatcattgcataacttacagacctcacacgccctacagcttcagtaggaactattccatcttttatttctttatcagtagcttcccaaagggttacaaaactccagttcatcatactttcactggtatcaaaactcatcatgctctggagtttgctattgatagtaataatagccaatgagtcaccggcacgattatcctcaatcttcatagctgctttttgtgttacagtcaacactacagcatctattttattaccgttattgtccaccaattggtcattctcatctactggaaccagatggatctttgccacacgggtatagggagccacattcattccccaacggaaatccactttaagagtacggggacgtgctcctttgtctaaattcaccgctagatctttatccttcggcaatgtcacccaaccgctacgttctccttctacctctcttttctcctcttcagtcatcgtagcctcttctgcgaaagaataatccacacttccgattttgaaatttacgttagtagagataattgatttaaagtgacggttatcgaatgcatccgaactggggatttccacttcaggttctttcaccaagatttgcttaccgaaaccgaactgtgtaaccgtaaccaagctaggctcacgaccattcattgtgaaacttatctgtgctgtacgcgcaacattcgtcagtgtagagtctatggtaagttcacataccgctgaaccaaaaccgtttgccggtgaaacggcaatccaaggtttagaaacgcgtaccacccattgatcattagatgaaacggcgatcttctctgttcctccttctgcaccgatagctatttcttctttatctaccgaaatgccatcgatccttgtttcgtcgtcatccttacatgaggagatgatccccatgcaaagaattagtcctaatgttattttactaaaatatttcattaatagattcttttatattatcgttcaatacccaaagcatcacaaccacgaatatcttgtgtcttatcatataacagaacatacatacctgcctcaatataaggacatacgctagttacatcaatcgagatgttgggattgtctgcaatatccaatatataaagctgcggtgtcagtttctcgtctactttacggatgtcgttagaaccaatttgcaattggatcaaactagggcaagtagtgataccggtcggccattggcgcaagatacgattgccttccgcatcacgttgatggcgaattccgaaagctttcaactggctactgttcaacggttgcgtcgggaacgaagagaaacaattatagctaacgtccatattgctcaaataaggtaaggtagtcgcccggaagtcatcagacaagctggtcaatttattgaaacgcaaatctatagtagtcagcaaatacgtattcttatagtttccgtcttttggtttcaatgaattttccggaatcgatgtcattaaattgttgctcaggataattgtcgaaatcggagaaccggttgcaaacagttctgtagggaacttctggatttcgttatatgacaaggttaccgttgaggcattaatacctttgtaatcatccatcgaacaactgatgttacgtccctccgaacctattttattatacgagaaatctacagatcccatcacatataccgacttggcattgaatatattcggaatatatttcagcttattatgagaaaatcctaagccttccacttgatcggtaaatgcacagaaatcttccggaatctcttcaatctgattgtagtctaacttaaggtcagtcagtttaacattggtaccaaaagcttccagatgtcttaccttattatgcacacaatcaagtaagcctagtttcaccatcttctgtaaagaagcagatgcgggaaactcttccaaattattataacccatataaaaaatctgaattttaggtcctgtatcctcatcgtcagcgagtcgtgtccaatcagcttttaattgggcagcactaatgcctctgttacatgcaatgttcaatgactgtaattcaggaagatcatacaagaagtccggaagctgcgtcatattcggacagttatacaactctacatccgtgagatctttcaaattactccaactcaattcttcattttcatactgtttggcataatccgagttggcatcttcccaatcgacagcaatattatcataggtaaaaggagaattagcaaaatagataatctgcaacttggtcaaccgttgaatagccttcgaaataaacgttattcgattggtaagattaccgatttgtgtatctttcaatgaaatacggctatccttcttgatcggtttcatttcaggatttctattaatggcatcttgtagtaggtctgacaaattcaagcgttggtcatagtcaaggaacattttcttatagtgcatacgaattctatgctttctttcctcgctcatgtccggagtcagttcttcatctccaaataatctgccgctcaccgtttcgctatgtgtaccgaacgaaagcacttttaattcagttaattgtccgatagcatcgggtactctgcctttggcaccgaaaccggcaagcgagagtccggtgacacgcccattattatccaaatcaacaccgggttggtcaccccacatatcaagttctttgttgaagttccagtttaaactgtgaatagtattgtttatcgtcccactataatatctccaattctttccgtccaaagcttcccaaatggctttcagcgctttatagtctttaatgtactccgccgtttccttcaattggatagggacgttggcatcttttgtcaatttgttgtctatcacagtaaaagattctcctcttacagattgcgtttccaattccgatcttttgataccgctttgtgagtaggtggtatatgctactacctgataggtaccggcaggaagccatacggcagagtcgcatgttgctacacctatatccatatacttatcattggcattatcgggattttggtgttctttagaatcttctttataggtgactttcatccccttcaattctgtggtgacacgattaaaggaattcatcaccgtaacatcgacatagcgaatattgctgaataagtattcgccggctgcacgtgtactaattccttctttcgacaatttaaaggtaacggttccatgcggaactgcatctacagtcaatgctttttccagcaatcctccacttacaactgtcagttcattgtcatcgccggcaggtcctgccaacagtacctcatcaagaccgtcatacaaataatagccgacaatcttataagtaccggccagtaattgcaatttgtcactacgcagaccatattccgcattgttcgcattgtatgcgttcagaagcagagtttgtgaaacggtggtaccgttatgcgtcatcaccacctttatcttctgtgcactagacattgattcaagtttgcccacagcacgagtggttgttcctttctcaaaagaggtactcttatagagtttaaactgcacataaccgtattggctttgcagctcctcgtcatcatcggaacatcctgtcactaccaacattgtcagcaggccgacaataaaaggcaggaagaatattgagtatattttatgtagattcatttataatctattattcgttataattattcacaagtaaaatatgcattatatattgataaccagcatatgcttgctaccgtcttctccggtaattattaaaaatacagttttagttaaactgcttccattgcccaaccatacattcaaattttgctttccggtactccaatcttcagatatttcaatatctgaagatgcatcaactatcttttcgtcaacatcataacatttgaaatcaactatactggatgtattaagtgtcacaaatatagactccccaatcggcggattttttatatcagaaatatcagttacctcatattgggtaatgaaataattagcacctcccatactaccatcataagctgtacaactcacaggagctaattggctggtagttacagtaaagggcacatctcctccaccgccacttccggcattgctgattctgacaatcaacatcagtttatttcccgattcatcagagactattaaaaatacatctttaccgtttgcagcctctgtatagattgttatgtcagtttcgcttattggttcagtaacgccattggcctcttgttcatcttcaaagtaatagcaaactgaattgctccaattaaaaggcatttttgccacagtagcgactgatgcaggctgttttatctcaaaaattcctgtcacgccatactctgacttaaagtaatctgcatcgccacctgtataagacgtacaatcaataggattatatgtttgaccgtctaccgcagtaatggctagttcatcgccaccgcctttcgtttctttctgagtaaactgaagaacaagattagactgctcatatttataaaccaaatcttcaccgtcaatgatggtcgcttccaaattatctttgatatcttcatattgagcacgtgagaagacaagaacatatccaactctttcagccggttcgtacgaagcaggagtatattcgtctacaataagtgtcgctttaccaccttcacgttcgcaacgcatccattcattatagctggcatccatgatatacaaatcattattgttgcttcctttttcaacgaatactacctcataatcatcgttcaatgttttaacagtaaaaggcacacgattcttaagagtcgtagtactgcctccggtacctgccactccacctgcgctctgagtaaaagtctttccgtccaaagatacagcccaatcatacttattagatgacggaagtgtcatttccagtacacccggagtcataccatcataagaaacgttgaaagaatagaatgcttttccttcttcatccgagaacgttatcacatttttatctgaagccggaaccggatatttttcacggttatcatcttctattattttcaagccaccacttactttctgattaaccggaccaacaagagaaccaccttcgagttccacccatcccggcagattggtagcagcaaagcggaagtttgcttgcacactaaatttagaaaagtgttggtatcctactttcagttcgttaatctctactccttcttcatcgaatattttcaattcatatcctgctgccgagcgcgtaacctcaccgatcacaatagtctgaccacccattgttaactccaacttagccacacttgcgttatcgttattttggttttcattagtagccatgattgttacggtttgcgttccggcagttccggatactacaaactcttccgtatcgttgttctgaaacttacaccagattgttgatgatgccaaactccagttagtattagccgtgaaagtgaactcttttttctcgcctgcattacagacaatattttgtttttccggaaatatcggagtcaccgtatcatcatcatcgtccgaacatgccgtcaggcagaaagtcataagtaagccaatgaagaagcagctcttgcacaacatcttcatgcaagaatctcctagtggttttaaactaaactttttcatatccatttatatttcttgtttttttaatatccttgttcttttaatttctccgcttctgcttcgcttatccattcgatcacattgacaaacgtgccaaccgtaccgtatgatgatccatctctattgttcacgcttagcgtgacatactgtaggacgaaattttcgttagtactgaagtaagaagtataagcggtaggttgattcatcagcaacttgccgtcaccgtaaatagttccgaaagccgttgctgtagatgcacaaagctgttcatccatttcaactaggggttcttgaacatcctcacggttgaaagtgatttccgtatcgtatccgtcatagtaaagaccatgtatggcaatggtattttctttgccttctacgatatccgaagttaccaaacgcaattctaaattgttcaaataacttgcaaaataagtcgaactgacaacacaataacctgtaaagtttttaatgtcaaacggacggattttctgcattacaacttttgcttcagttccatagagtccccattgttccgtttcaggaattaccagtcgcaatgcaaaacccagcgaatcattaatttccagattatcataaataccttgtacctctaaattggtactcctttctcccgccttaatggtaacggtattcgacagaattttataatgcttaccttccacggcattactttcgcgatcaattacttcgacagcgaaggtccggtcgtgatcggcagccacagtagcagagatcggaacattgaatatctcattcgtttcttgcacggcatacgtataaagcgtgtcagaaaacataagataactgggtccgttgtatgccaccttgtcctgatcgcatccggaaagagctatcagagcagcaacggctgctatacatcctaataataatttcttcattatcatatgcttttaatctatttgttactttcattcggttgaacctgcgaaccgggagcatccagttcatgttgcggtatcggccatacaaataatggatcatctgcttccactttcaagctgctaccgttagccagtgactggtcttgcggcttccgttcgaatcctttatgccaacgttttaaatcatggagacgaaaaccttccatataaagttctttcacacgctctgcttcgataacttccattgcattggaagcagacaaagcagtagaaccaccgtaagttgaataacgtgctgtacggagagtcgtaatatcttttcctgcacgaccatagtcgggttgcgcttgctgcacataagcttcagcacgtatcagatattgttcggacagacgaagcactttaggcatagatacgtgaaggatattagctgcaatgaactcattattaccggcatactttatcaacaaaggccatgaaaggccatgactaaagccggtttgcaaagtttgaaaaatggtctccggacgcaaatcgttcgaatcatacaatccgaacacccaattagccggcacatagtccggacgataattcacatgattgtaattcaagaaaatttgtcccagtttgcctccataagagtttatggtgaaaccaactttccaaatagcctccgttgacatgtcgtccgtccacatatacttataatagctcactccagaagaaatagtgcgagtacaactggccaacagataatattcgctatcaataaccttgctggaatacttgatagcttcatcccactttctcatataaagagcgacacgtgcccgcaaagcgtacaccgtgtattcattgaaataagtagcattattaaataaagctccatcgacagacggatcataatctttatccaaagccaacaattgggcagcccgatcgagatcctcaagaataaactcataagaggctttcagcgaagcacgtttcatttcttcattgccttgataatgcttggtgagtatcacacccaattgattggctgcatcttcatcactttcataagccttgcagaacatcttcaccaattcggaataggcaatcgcacgggcaaaataagcttcaccgcaacactgatcgagcttatacaaatctttatcatcggttgtgttatttctcactctgtctacgcggtcgagcatgaagttacaacgattaatcacgttgtacagtccagcataaacagcctcgatacttgtattagttgccagaatgtctttccagcgccaaatatctccgaatgtattcgtatttccatttaccccatacacaaggtctgcctgcagatcaggaagtattgtcaagttccctgagtacagagcactacttttgaatgcatcgtaaataccaataacagccagattcacatcatctaccgtctgtatagactcatcgaatggaataccgtcttcaggcatcttgtccaaacaagaagcggcagaaaatgccatggctgccaacaggatatataatttaaatttcttaatcatctttctttaaatatactattagaatgaaacgtcaatacccaaagtaaactggcgtgaagccggatattgtgctctatacacattagttgctacttccggatcgagtccggtaaaacctgtccaggtaagcaagttctgtccctgcagataaacacgcgcagatgtgaagaaattagttttcttcagcagtgattgcggaaatgcataagccagtgtcaggttcttcagacgaaggaatgaagagttttcaagaaagcgatcgtcaagctgagccgtcactccgtaacgggggatatcagtgatgtcgcccggttttttccaacgatcgtacaataatcttttcgattgattgtaggcactgtatagtccgttgctttcttcgaagaaacggtcattgttcatcacatatcgttttgccatccagctgaattgcgccgacaatgaaagccccttccacataagggatgtgccgaagccgcctacccaaggagaatcaaacgatttgccggtcatcactttgtcttcttcacgaaattctgttgtcagttctccgtcggctgtgtaccacaaagcatcgccattggccggattcacacctgcataacggttcatgaaatactcacgtacggagtgtcctactacatatttcaatccagtggtagagtttacatattcttctacaccattgtaaagttctaaaagtttattcttattgtaagaaacgtttgcgctcagattccaagtgaaatctttggtacgaatcacatcaccgtcaatcgcaatttccacaccgcgattcatcatagcgccaatgttgtcccaacgattgcctactccggtgatcgcatacgattgaggaactaacatcagcatattagtagtctttttatgataaaaatcgacattcacattgacacgattgtaaaggccaaaactcacgccaacattgtttgcccaagtctgctcccagctcaattcctcatttccactttgtgaaggatagataccagcttcatcattatagtttgcatctccggaaacaagcgcaagatgatcgtaataaggaatttccgagttaccggaagtacctgtactcaacttaacctgtgcgctagtaagccattctatgtctttgaggaaagcctcgttcttgatgttccacataaaacccagcgaccaaaacataccccaacgatgatctgcaccgaagcgggaagaagcatccgtacgtgcagcaacttccgcataatacaaatctttatagttgtactccccacggaagaaaaaagacaaataagaataggcactattactatccggccacgatgtagcgcgagttccggtaagcaggttggtgaggcgatcgttattctgcccctgtgtagatacctggaatccggaggattgataatctatcccttcctgtcccagcagaaaattgaatgaatgatcatcattcaaagcccaccgataattggctgtaagagtttcactcaggctaaggatatcagatgagctgcgccctgctttaccggagttattattaataatgtaactcgggaaagactgcatgaaagccgtagagtgtgaataatcagcaccaaactggccacgaatagtcaagttctgaatcggagtgatctctgcaaatacagtagacagcaatttgtactttttgtatgatacgggattattcgccatccattctatcggattctgccccgttcccgtccaagttccatcattttcggaagccaaagaaccgtcagcattataaggattccagtaaggtaacataaagcgtgaaccggaaataggtgtataaagcgccggttctccctcttcagcctgtgatatttcttcataggccatcattgtattcgtgcccactttcagccagttgctggctttcacttccgcattggcgcgcatattgtaacggcggaaagaagaactctgcgcaataccttcctgatcataaaatcctccggaaacatagtagttcagacggtcggtggcacgattgacagaaagttcgtaactctgcaaaggtgcacgatcgttgaaaacttcatccagccaattaacattcgtgcgagacagtaggtcgtaatcttgtccggtgtctaacccgatttccttttcaaattggatacgttcgggagtattcatcaccacccatttgtcattcgacgccaattgagaaataccccattgggcacgcaacgtaactttcgctttatctattgccagtccgcgcttagaagtgataactaccacaccatttgccgcacgggctccgtagatagaagtcgacgaagcatcctttaacacagagattgattctatatctcccgggctaattgtgttaaaatcagcactggagataggtgtaccatccagtataaacagcggagaggtgcccgaattgatagaattggtaccacgaagctggaacacagccgccttactgggttctcccgaattggagattaccgtcaaacccggtgtctgtccctgcagtgactgatcaaaacctgcagcaggcacattttctaatttttccgctttaacagtggatacggcaccagcaatcgtcccttttttacgagttccatacgctactaccactacctcatctattaaagcagcatctgaaaccagacgaacattcagtgttccggttttggcactaaccgcatgtgcctgtgattgcataccgatataagagaacagcaaagtagcacttgccgtacccttaatctcaagagtgtaattaccatcaatgtcggtaattacaccatttgtagtacccttctctaaaatagacacaccaaccatcggctcattatcttctgccgaaacaacatgtccttttaccttatatccactctgtgcaaaaagcataagaggaatattcagtagagcaaagagtacaaacaagagaattgattttctcatctttgatacttgaatttaaattaatgaattgatttatttttacagatttatctacaaaacgaaaacttagcatattacgcttcacgcatgaaacagtaatat

SEQ ID NO: 159 - DNA, 17205 bp, Bacteroides thetaiotaomicron
gggttacatagttataataatatacctaatcttcctatgtggcttgtagtgagtggtacttatacattggatgaggaaggcaaagtaacaggatgtatgagaacgtcccatgagagatagcgactatgcatcttttgtttttatggctttgcaagaatctaataagtctattcatctatgaatacaccttacaaatatggataaattaactaaagaacaacgccatcgttgtatgtccgctataaaaggaaggaacacaaaacctgaaatactggtgagaaagttcctttttagccgtggcttccgctatcggctaaatcatccgcgccttcccggtcatcccgatttggtgcttcgcaaatatcgcactgtcatctttgtgaacggttgtttctggcatggtcatgaaaactgcaaatatttccgtttacctaaaaccaacatagatttctggtcaaacaagataaaaaggaataaggaacgagataaaaaagaacaatgccagcttgctgctatgggctggcattgtatcacgatttgggagtgccaactaaaaccaaaagtccgaatacaaacacttgagtcgttagcttatacattgaaccatatttttcttgaagataggaaaataaaaacatacgagtttcatgatactgacagtacacttgtggcagcagaaccagaagtgacttatggaagagataagcaacaataaagtgctgttgcttattttctccgatgactattctgtatttctttttaactctattcctgctttttccatcaagtactgatgctgttccttcaccgcccgatacatcgaataatacgcaaagacttcttctttatatttcatgctactaaccgacgcagcaacagcccacgtaacaatgataacaataaaggttacaacatatcggagtttaatatgatagccacgtataaacaccccattgatattgggtggaataaccgttactggatttttcaactcattgattttggcaaatatctcatcctgccgttttaatatgctttcggtatttgcttcgatattcatgcgattgagattgtaatcacaaacatgcctatagaggtattcaagaagtttagacttctgcttgaataattcaatgagtttcggaaaccatagcgaaaaaggcaatgtgtctggttgttgtttccagatatgtttctttaccacagacaaggcttcgttccagcaagtacagaagcttttggcaactccattataaatggtcttttcgtcaaagtccacttttacagattgttccgatttagaaacagtgacattctgtttttcaatacactctttcagttcattgatactttggcgcaaatttgcaagatttgcagctactacatcttctttcattatcttctacgttttgagggtttataaaaaggttcggttctttggttatccttgtctttgtcgtctcgccatcccagttcattacttgctcctccacctccactgggagttatggcttgatgaggttgaacaaccagttccgctgccacattacccaatgtagcacaaaggctattaaaactcaaatcacggtcaagtttagaaccggctatactatattcattttgacagaatgatatgccacgaattttatcagagttatctgtacgattaaagcgcatatctatacccaaacctttgagaattccaagaaaatcattccatgaacgagatacagtcagtgcatcaagagttgcagaacgtagattatacttccgtaattgataagggcgcaaacggctcttgtttcgggctttactatttttaggagcaaagtatagtccatactcttttgtcaaagttcgacatactttggcattgtgtattctttcattgctgtcagaaatgagattgccatcattgtctatccggttaaataccaaatgacaatgaggatgtttcgtgtcgtgatgtcgggctatgatatattgagtattgcgaatccccatttgttccatccatttcttggcaatctctgccatcagcgcatctccttcttcgttatcggggaaacggttaatgtcctgcgaagagaaagcaagtgatacgtgtttcaccggactttttactttcgggcgcatggacgcttgtatctgaaaagaatcggctatggttttattactgatgacacagacaccttcgtgtgctaaaagtatggcacatttcttcttgttcttttggtcattggcataattcactattcctccgaaatccgctcttgttttaatcttcgctatcatggctattgttctttacttgagtgataattctactgacttctgatatgattgagaagcattgttgtttgactgcttccaaaccataagtgtgcatctgatgggcaatctgattgacattattggcgataccggaaaggtcacgaatagccgataccatttcagggctgatgcgctgacagacttgacaatccattgctgcctgatggcaaaattcattgacagacaacccagcctgttccgctttggattggatataaatgtagtcgttctcggtaaacattacccgaaaacatttggtacgtttctgatagttcgccaacttagggcgaccaccaagtttcttctccttcatatttatcttaactttcaatgttcatgaattgattttttgagagtggcagtttatccgcttgccgcataggttttagtggcactaaaacacaaacttgccactcaaaaaatcttcctatatttcccctgctctattcggcatagcttaccatctttgataaaggcttctatccacttgtttgccgtacttccattctcacccaaagttaaaaccgccgcatcataatccttttttgtgaaagtatcgggtaacatattataaagggtattccttcgtgcataaacgccagtctcttgcgaagcggtatagaatcgtttggactgatttcctgacaaattctgataaatgaatacggcatgataaagtaaggtttcgcaaatattcatggctgtagaatagtcatactcatggcagaccagttgctctgtcttgtcatgtgaggaagaattgcgatgtacattctccaaatgccggacagctgtcagcaccatcattatacgataagcaatcagtcccatccgtctgactactccttgcatcttgttatccacttcgtcacaacactcttcattcacacgactgaggtattctataaagtgttcctgtaaatcggagggaagggagaatgaataatttccctgtcgtacaaattcctcatgcagatggcagaatttatctcccaatagtttgaacttggcattcttggattgggaaatgtcgcttgtggcaaacacatttcttatacctcgcttgaagcgaatgatatagaaacaaaagcgactcatcaatccgttttccgcatcaggtatcaatcttcttacttgttcgggagttccagccaaagctactgacactcttggattagctacttcacaatactccctatccttgcgacggctcaaacttaccaactcatgatgaaatgcctttcgcaacacatcggaataattaccatagtccgacttcaatgtttggcttaacgtgtcgccctccgattcaaacaacagtccgattccgtcattatctcccagtatcttcaagaaagagcttgcgctgctattggcaggaatgacaagcatacgcatgggcggctcagctggcatagtcattccactatctttcttacctttgatataagcattcatcgcttctttatattcctgttccaatcgttttgagagttcatgcaaattgcggttaatgggtactaccagttctctgcatagggttaacgccccctttcccatacctgcatctgccacaacaaacagataaagattcggaaaaacaatgcgctcatcgtacacaccacaaacattatgaaagcataccgacaaacacacaatagttcctatcaatatcgtatcacggtcatccaccgaaatggaattgttgacaatctcatgtagaaaaggaggaagatgctcaaacacacattcaggaaatgcaggaagttcttcctctgactttatccatttgcccgttttaccattttggatatttggcaaaatggataaatgttctttgttggatggagccaatgagattccggcttgatttgccaaatggaagaaagaacggatagtaatgccttgccctttggagtgcagacaatgcgtatattgtttatccgtctcttccttttgataggtagagtaaaacctgctgatgcggtgataatactcccgtccgttctctcccaatccatcaacaagtgcaaagcccaattccatccaatctttataattgggtgctatatcaatgccacgttgttctatctcccgaacaatactttctacatcgtcttttaccttattatatataggatcaatatcaggcgtatgtgtttgcagtatttcagaaggggcattctcccaatcttgggcggaaaatattttcttcgacatcatctttgtatttagggttaatatatgcttgtggatcgtggggtaaaaagcatgaacgagccacatcactgccggacatatccactgatggcaaacctgttgctttgatacaattagcaacagccttgaaatatcgggaatgttcccagcctttcaagtctacaggtattatccacttcaatccattaccggatggactgacaaataatagttccgtatcaaaatactcatggttgagtagttgctgttttaactcccctatgttatccacatgatcgaaatccaaacacatcaatcctgagtgcataatcagttccttctcattacgcttgcggaataatcccgaaaaagtacaatagtcgaaatgggtggctttatatcttttggcttcgggagaagatagcatcgaacgcagagactcggtttgtagttgcgcataatgcccgatgacatagcgatacacatccacaatgcctaccgcccttatcggttcgatgttttgaatgggcttgcgaaagaacgaaaagcaataatctgttgttcccatcatctgataatctttttagattcgacaaatcgtctagcttcttccattaagtcatcctgtgtcttatgcgatttattcttcaaccaatcatcaatttccgattgcaagaaagccaaagccttatttattttatgtacgggaatctgtttggtagatacccatccataaactgtctgtttggctggatgtgatggcagataagcacaaagttcgtctatatccatccacttgggtgaattacttgcttgcttatgttgcaaggcatttactttggattgtagtgcttctacggactcaatcaggtaggacaacgcattcggcatttcctccaatgaatttactttataagccattttttcttcgtattaaagttgatgccgcaaaagtatagggatgcttataggtgctaaataggtgcttgaccgccaccaatcaaccgctcatttaccactgacagatttaagtttcattaatacgggaatttattggaagccataataaaaggggaataaactactattgggactaacatattccttaccaaaagcctcaatgctacaaaatacccctcaaaaagccgatgcctcgtgaggggtaaacagtggtaagtatatgattggtattacataagtcattggtgctcaatggtggaagtccccactataacctataaatccaaattgtctatatgcagcgtattagcagctttttctttctgttcatttacgatgtgcgtataaatctgcgtggttctgacgtttgtatgtcccatcaaagacttaatggtgtatatatcaacaccattttccaacaatagcgaagcgaagctgtgccgcccacaatggaaggtgatatgcttcttgatgccggatgcttctatccaagctttcaaaggacgggaaatccaagaggcatctgtcaatccctcaaaaacgagagcttcatcatcatttggacgctcaccgcatagttgaagggcttgttgaatgactggcttataatcgggtcgttttgtcttttgctgaactacgaccgcttgccatgtgcctttactcgtctgctgaatctgtttccatttcaatgcttggatatcactatgtcgcaatcctgtaaggatagaaaacaagaacgcacgtttcagaacatcatctttgcaaggagtatcaaccaacatttgcacttcattcatagtaagtgcaacacgaggtgtctctatgtttgttattccttttacttttgcgctgatgtcaaccgtcagatattcatcaacaaacgcctgcttcaatccggctttgagaatggagaaataggtggatgccgtattctgtgagatagttcctttcttattacctcccatcggggcacgtaacaggaacatcttgatgtcttcaagtagtttcacggaaatcgttttaaacgggatcgggttgccttgcgaatagattttcaacaattctcccacacgggtccagttgactatgattgaattagagctattgggatgccgtttgctgatgatgccattgaagtacttgataaagtcctgttcgcttcgttcattttgtaccgcgatttcgttttccttatcagtgtagaggacggcactgtcatattcgtgctggcgtaacttacgcacattgtcggcatagatacaagcctcttggtctatcgttgaacggcattggataattccattcaaatcacgcttaggcttatagttgaatgttccatccggcaagatacgtgcaatggacgacttgtcccaaacaggtgtggatatagtccggttaatggattccaccacacggcttgcccgtttagaacctctcttgtaaaccgggtacgactctataatcagataccactcttctttgtagttcgaccttctgagcttgacggtcactttggtatggggtaatgctttcttcattctacttctgatttatatagattatcaatttcttgtttgggtacatacacatagtttcctatttgtcttgaggggatggagtattttctgacgtgcgcccatactgaactatcattaatatgatatttctcacaaatctctgtaatggtataacaatcctctggctctaagctatatgttttaggaacaggcttttctttttctgcaatactttcctgcctgtttagaaaaagcctttccatttcggagcgtttgattcgtgtgagtcttgtacccatgttgattacaggaatacgtcctaatttgattagacgatagagggtactgcgttctaccccgaacatagctaccgcttcctttacagaaatatactctctaatgtctgatacttgtcgggcaatggcttctaactttgcgtttctatcctttacgtcctttttgcgtttccaagccactttgctacatttaggagaacagtaatggctgtcgagtgtttttgcgacaaacactttgccgcagaccttgcacttccgtttgatttcaaatccgattgttggcatgttatctacttttaagtatgtattagtatgtataagtgtgattaagtaccacattatctacttttttgtcttgtcgcaaacatgtcgcaaataagagataaaaaagcccatagaaaacacatagcaaccatgaaccccataaacgcaaaaagcgtgcaactcattgagctgcacgcttttgcttattgtttattatctgtatccttatcggaatcatttgacttcctcaaaatctgcatcctgaacattgtcaccatgcttgctattatcctgaccagcattctgacctgcatccatatcaggaccagcctgtgcaccaccctgagctccgccttgagcgtacatttcagcacttgcagtttggaaaacagtattgatttctgccatagctgtatcaatagcagctaaatcctgagacttatgagcatctttcagtttctgcaaagcagcttcaatcggagctttcttatcagcaggcaacttatcacccaattccttcaactgattttctgtctggaaaatcacgctgtcagcctgattcagtttatcgatcttttcacgttctttcttgtctgcttctgcattagcttcagcttcagccttcatcttttcgatttcttccttgctcaaaccgctggaagcttcgatacggattgcctgttctttacctgtagccttatccttagcagataccttcaagataccgtttgcatcgatatcgaatgtaacctcaatctgaggcacaccacgacgagccggagcgatacctgacaagttgaactgaccaattgacttattctgagcagccatcggacgttctccctgcaatacatgaatagtcacttcactctgattatcggcagcagtagagaaggtctcactcttacgagccggaattgttgtattagcatcaatcaatttcgtcatcacaccacccagtgtttcaatacccattgacaacggagtaacatccaacaataccacacctttgatttcgtctgtcaaaacagcaccctgtacagcagcaccaacagctactacttcatccgggttcacgcctttagaaggagtctttccgaagaaatcttctaccaatttctgtacggcagggatacgggaagaaccacctacaaggattacttcatcaatatcggagttgctcaaaccagcgtcgctcattgctttcttacatggttccagacaagcctgaatcaatccgtgagccaatgattcgaattttgcacgagtcaaagtcttcaccaagtgcttgggcacaccgtttaccggcataatgtacggcaagttgatttctgtgcttgttgaagaagaaagttcaatcttagccttttcagcagcttctttcagacgttgcaaagccattggatcctgagtcaaatcagcaccttcgtcgtttttgaattcctgtaccagccagttgatgattacctggtcgaagtcatcaccacccaagtgagtatcaccgttagtagaaagaacttcgaatacaccaccaccgaattcgaggatagagatatcaaaagtaccaccaccaaggtcgaatacagcaatcttcatatctttgtgagccttgtccagaccgtatgcaagagctgcagctgtcggttcgttaacaatacgttttacttccagacctgcaatctgtccggcttctttagtagcctgacgttgagagtcggagaaatatgcaggaacggtgataacagcttctgtaacttcttgtcccagataatcttcagcagtcttcttcatcttctgaagaatcattgcagatatttcttgcggagtgtacagacgaccgtcaatatctacacgcggagtgttgttgtcacctttcactactttataaggaacacgtgtaacctctttctgcacctgatcccagttttcacccataaaacgtttgatagagaagatcgtacgtgtcgggttagtaatagcctgacgtttagcaggatcacctactttacgttcgccgccatctacaaatgcaaccacagaaggagttgtacgcttaccttcactgtttgcaattactacaggttcgttgccctcaaatacggcaacacaagagtttgttgttcctaagtcaataccaataatttttcccatgatcgttattctttttatttattattattcaatttctttttgtccggttgttttctttctctttgtaagggctttcaaacggacgctgattaaaaaacaaaccatgtgccaaaaagaaatcggacgaatacgtgacatattttctgccaaaacgacagttttaaatcgaaatgactgctgtcaagtcacatagaagccagacagctatcgactcattaaacaaatggaaacagctctggttcaataaagcaaaagaatagatcataaaggaataaaaaatatgcctgtatcgttatgtgcgacacaggcatacctatttaatataatacgtatatcttacttttcaagtacaatcaccaacgcattatttgcgtcatacaaaccgattccaccaccggaaagtttatcgaacgacttcacttcattcattgctttcagaatcttaccttccacttccatatcagggcaagccatcattgtgctagccaccccagggaaagagattgatttagcattagtagtgctagtttcaaaaccaccattaatcaagttacatccggcattgccatgaagtgttttctttttcacatcaaaagcaatgaaaggttgcttttccattcccgaagtaattgcttcaccattcacttcctttattttccattctccgttcaatactgatagtttcacgtcagcctcctttttttcaagaactacaaccggacgattggactcattgcaaagaaacattttatccttaccggctttcttataacctttcacctgtgcaagcgcacctaacacatttctctcggtagtcatgtccggacacatcattctggtgctagccattcccttaagctccatgctgcctggcttggcattcacgtcaaagctacccatcatacggttacatccgctgttaccggatactcttccggtcgctgtatcaaaagtaataaagggaagggttctgctttcgcccggagttactttcgagccgttaacttctataatattccactcaccattgattgaagccaatgggactgccttctcaaccgaacggcatgaaaacattgcaagtactgtgctggcaatgcaaattgaaacgaatactttcttcattttgttataacgtttaagttaaaatcgggggcaaagatatcaaaaagattgggaaataccatctaatacgatataaaatacatacatttgccattatctataaaacaaacaataagattacatagttcatctaaagtaaataaatatgagaacaatcgtcctatttctaatcctgtttggttgtggttcctctcatatcacagcgcaaaatgattatcttgttactactatttccaatcaggaaggccctctaagtgaagaagaacagttcataaaagagaacttcccactgcaacttttatgtaaatggacacccggaatgaaattcatgtttattccatccggacgtgacatgttcctccctacccttttggtgtatgagacagaaaaaggggcagacaacagcgttctgaaacacaagattcttactttcgccggatatgaagaaaaatctcaagaactatcaaatgacatgagctattccactcgactcatcttcgaatgtgacggagaaaaatattattatgagattaaaaatacacgtccggatgaaatttgcgaaaagaatccccgtgcctatatcaacggattagttaatctgaaagacgtagacacggcaaaagaattgctgacaggcagaaagatatatgttcagtccgatatggcacgggtggacgacgccaatagttactccggatatcggaaagtgtctattccggtcaacaccgaagcaaccattaccgccataggagttggcagtcagtcatatcccgtgaaaatcatatttcaagattcgcagggacattcctattatctggaagtagctctttcccgcactaattccggtatggacgtgagcgatttccaagctgaaaagaaaatgagatattttcccaacgccatcagtttcagtagcaaaaagtccggaaatctggaaaccttgaaagacaaatatattgatctgaccgtctatccgaaacggacattggctgtaaaaagagtcttcagccttgaaaacaagcaaatggaaaaccgcatacatttgcctcgctacactgttttgaaaataaaagaaataaaaatctccggtccgggaagtctggttatcctctcactggaggattggcatggatcactttatgaaacagaggttgatttgaaatatgatgttatcgtcaaaaacgagaattatattgaagaccttttcggatttggagacatccatcagaagtatccggctatcacagataaacattgggcaatcatcgcacggggtgatttggaagaaggtatgaacaccgacgaatgtcgtctgtcaataggtgatcctgtagaaatacagttaaaaaaagacagtcgtttcgaaacttggttctacaacggaaaaacgctggaatttgagagtggcatcttgcaacgtttcaaataaaaaggagtagcgacgcggtgattatctgaaaataatcacgtatatttgccaagctaacaattctaaaatcttaatttttgatttataatttattaattaaaagaaatgggtagagttcttattatcggtgcaggcggtgttggtactgtcgtagcacacaaagtggcacaaaatgccgatgtattcacagacatcatgattgccagccgtacaaaggagaaatgcgataatatcgtcaaagctataggcaatcccaatataaaaaccgccaaagtggatgcggataatgtagatgaactggtagctttattcaatgactttaagccggaaatggtaatcaacgttgctcttccttatcaggatcttaccattatggaagcctgtctgaaggcgggtgtcaactacctggatacagccaactatgagccgaaagatgaagctcattttgaatacagctggcaatgggcttaccacgaccgtttcaaggaagcaggtctgactgccattcttggttgcggttttgatccgggagtcagtggaatctacacagcctatgcagccaaacattatttcgacgaaatccaatatctggatatcgtagactgtaatgcaggaaatcatcataaagcatttgccaccaactttaatccggaaatcaatatccgcgaaattactcagaacggacgttattacgagaatggtcaatgggtgacaaccggtccgctggaaatccacaaagatctgacttatcctaatattggtccacgtgattcctatcttctttatcatgaagaactagaatcgttggtcaagcatttcccgactatcaagcgtgcccgtttctggatgactttcggacaagaatatctgactcacttacgcgtgattcagaatatcggcatggcccgtatcgatgaagttgattataacggaactaaaatcgtaccattacaattcttgaaagcagtattgcctaacccacaggatttaggtgagaactatgaaggtgaaacctctatcggttgccgtatccgtggcatcaaagacggaaaagaacgtacttactatgtctacaacaactgcagccatcaggaagcttacaaggaaacaggtatgcagggagtcagctacaccaccggtgttccggctatgatcggtgccatgatgttcttcaaaggcgaatggcaacgtccgggtgtaaacaatgtagaagaatttaatccggatccgttcatggaacagctcaataagcagggactgccttggcatgaagtgtttgataaagacctagaactataatagaacgaatcagaatgaagaatataggagataaagcaccggaagtattaggcatcaatgaaaaaggtgaagagatccgactgagtgcttataaaggaaaaaagatagtactgtatttctatccgaaagacagtacatcggggtgcacggcacaggcatgcagtctgcgtgacaactattccgaactgcgcaaagccggttacgaagtaatcggtgtcagcgtagacagcgagaagtcgcaccaaaaattcatcgataagaataatcttccttttacactgatagccgatacggacaaaaagttggtagaagaatttggtgtatggggagagaaaaagttgtatggacgtgcctatatgggaaccttccgcactactttcctgatcaatgaagaaggaatcatagaacggattatcactcccaaagaagtgaaaaccaaagagcatgcctcacagattttaaatcaataaatccattaattataagaataaggtatggcaaagaaagacgaacttaattttgaaacagataataaaatggcatcaagcgaaaaactgaaagccttacaggctaccatggaaaagatagaaaagaacttcggtaaaggttctatcatgaaaatgggtgatgatagtgttgaacaagtggaagtgattcctaccggctccattgctttaaacgtggcacttggcgtaggaggatatcctaggggaagaatcatcgaaatctatggtccggaatcttccggtaaaacgactctggctattcacgccattgccgaagcacaaaaagccggtggtatcgccgcttttattgatgccgaacatgccttcgaccgtttttatgcagcgaaattaggcgtggatgtagacaatctctggatttctcaaccggacaacggagagcaggccttggaaatagccgaacagttaatccgttcttccgctattgatattattgttattgactccgtagcagcattaactccgaaagcagaaattgaaggcgacatgggtgacaataaggtaggtttgcaggcacgtctgatgtcacaggctttgcgtaaattgaccggtacagtcagcaaaacacgtacaacttgtatctttatcaaccagctccgtgaaaagattggcgtcatgttcggtaatccggaaacaacgacaggtggtaacgcattgaagttctatgcttctgtacgtatagatatccgtggcagccagccaatcaaagacggtgaagaagttcttggtaaactgactaaggtgaaagtggtgaagaacaaagtagcacctcctttccgcaaagcagaatttgatatcatgtttggtgaaggtatttctcactccggagaaatcatcgatttgggcgcagaactgggaatcatcaaaaagagcggttcatggtatagctacaatgacactaaactgggtcaaggacgtgatgcagccaaggtatgtatcaaagataatcccgaacttgctgaagaattagaaggattgatcttcgaagccttgaataaaaaataagttgtctcaaccgattcaactataaataatataagctgtctcattcgatgttttgagacagcttatttttagcttaaacataagaaatgtcccccatctgaatcctcgcagtacaattcagatgggggacatttctttcactttttacacgaaatagatataggctaatgtacttaaacttatgaccacccataacaaaacgccttggatcaaaggtttgacaccgacagatcttagaacatccaaagaaagggaagcacctataaaaaacatggtaatagtcaatgtcttgcgtgcaattccattgatggcggcacctaactgcggcacgccattcagcaaatatgtattcgcaatcatagctagaataaagaagaaaataaaccagggaatacttatcttctgacctttacttttaaatataaaagaagtggcgaatgccattggtatgatccaaagagcacgagtcaacttgatagttgtagcaaccttcagtgcttcttcaccataagcagcacctgctcccaccacagaactggtatcatgaatagcaatggcagcccatgtgccaaactgatgttcggtcatatccaaagcatgtccgatagccggaaagataaaaagcgcaatagcattcagaataaagatcgttcccaatgccacagacatttcactgtctttagctctcagcaccggccctattgccgcaatagcactaccaccacagatagcagttcccgaactaatcagataggaagtatttctgtctatcttgaagattttacgaccaataaaccagccgatgagcaacgtgcctaccacagaaataacagtaaactccatcccttctttaccggatgccaaagccgactgaagattcataccgaatcccaatcctactacagaatattgcagcaaatatttagatgtctttttattaaatttgggatgtgcctgtccgcaggttaatgcgaaaataagtccgagaaacaaagctaccggaggagtcacccatgcggaccatgcttgtaaaccaggaatataatctaaaaataagaaaaaagttaaagtagaaagtattgcaacgtaaattgtcttgttgttggtttgcaacgtttttgtagcgcttgaaatcatttttttatctttttataattttgcgggtgcaaaggtacggcaaacaatcaagacaacccaattgtttctaattatgtattataactttttgttatagccacttctcttattgttacattatgctcctacgatgtcctttccaaatggtgataatgctaacgcagccaacttaaagtgctgcaaaccaaagggtatcccaatgatggtgatacataggacagctccaaaaaccagatgtgacaaacaaatccaaataccacccaaaaatatccataaaacattcatcagtatataaaggcatccgcttgaacgcccaccactccttacttcttttccaaaaggccacaaagcaagtcctgccaacttcaatgtttgcataccgaaaggtatacctacaattgtaagcatcatcaatatacttgagattaaatactccactgccgtaaaaataccgccaagcaataaccataacaaattcattaaacagcccataagtatcagttctaatatttatttagtattttctttgttgtctcatccagcctgccttgaaaatacagatcaattaccttttgaaataaatcatcagaagcaacttcattaaaaagtgtcatacacgacagcactttcattgcgtccaatcctccgaatacatctaccgcagtcttacctttcagttgcaaaaatactgttgttatttcacggagtctcactcccaaaatgggatgagcaagatatgcttcggcctcctctttaccacaaattccataatactgagaattatagctcattcccagtccttttaactgaggaaatatgtaccaaatccaatgagaatattttttcccatttttcacttctgcaagtgcttggttataaacaccttgctgggcatctagaaaacgctgtaatttataatctaccatatatatcttctcataccacattcttgatgtatacaaaga

SEQ ID NO: 160 - DNA, 17029 bp, Bacteroides thetaiotaomicron
gaacttagttgaaattaataattagaatagattttgaagacattattaaaggaaaaaaggtaactttattataaataaaaatcaaaaaaaatgttgcggttaatagttatttctttatttttgtaacacaattgaaaagagatggaggagacaataattctggaaaaggtaaaagcgggagatgcggctgcattttctttgctgtatgacctttattggctgaaggtttataactttgcacgactttatatcacttcatcttccgtgatttcagaagtagttcaggatgtttttgtgaaagtttgggagtccaaagagtttcttgatattaccaagaattttgatgggttgctttttatgattacccgtaatattatattcaattattcgcgtagacattttaacgagctgaattttaaaatgacagttctgaaaggacttgaaaattcttatgatatagaagaggaattggatgctgctgatttgaagaactatattgataaattgatttcgcaacttccggccagacgacagcagatctttagaatgagccgcgaagagcatctatctaatcgggaaatcgcggaacgttgtgcagtcagtgaaaaagcaatagaacggcagataacattagcattgaagttcatcaaagagaaccttcctttatttgtcgtatttatgggataaaggctcaaacgtattcatacccatgcttgagtctgaatacgtttaattggctatatggtgtttcttattttttcagtttaaagaaaggattcttgctaatcttgacatccgaaggtttcatcttttcaattgtaacaatacgtcctaatacatccccttcaatcttattgtttgaaataactacagatttacatgcttccagcgtaataccttctttgcgatagtgataaggctggtaagtcgtatcacgtatgagtgtattggaggagaaggtgagcccgtttaccgaacgtgcgaagagtatcggataatcaaataggtggaaggtattatccataatgcggatattgcgatgataggggtacttctgttccggtgtcggtatttccgggtcaatgctaatcacagcttcacagaattgataaattgaagaattgcaagggtaacggaaatcattgttgcgtatcagcacatctttgacagctcctgattcataccatgcgtttgcgtctccggcaatcagaatggcagagccgctggattcgaatacattgttctcgataataaccttgccgggagtagatacaagcagaccacgtgcccggcaacttccgaaatggcagttgcgtatttctgcatcaggtgtgcaggtcagattctctattacatatccggcttccactccggctggaagtggtactgataattcgatgataaattcagctttattcagtgcttcaaatttattcattttaccggtagctacggtacgcatggttttatgctctataaatccgattgtttcgtctgggcgtccccattccatcccttcactcatgtcttgcatgaacttgcatttgatacgggtaggagaaagaacttccataatacgggaacatgttccatggatgttaatagggtcatccatcaatcctgcccaactacagttctcaatcttgagtaatccgctgcatcccatgaagtggaaaccgtcgtcatgtccgctcagcacacgtttcttggaagtgttagggatgatatgtacatcattgaaagagatattcttgctatattgtgacagaattcccagtccgcaggtatggaatagctttacgttctctagctttgtatccatactgtggtaaatgaagataccggcgtgatctctggtgctgtgtcgtaacacaaggaccgtacccggcgcagggaagaatttatcagcctcctttttaggatcggataagcgtattaatccggggtttatttctgttgcatcgtatgagcgccagcctaagttatcacctgtatttggcaggacgagatgggtgtcgggatcaaactgcatgatcgcccaaagactgcttttccatccttcgccgacaaaagtcagtcgtttgttttctatgatataaggatattggtgggagtcgatttcgatctcaaggtattcggaggtagattgagtgacaataccttgcgcagttaatgggatttcccaatcgacggagaaattctttaaagtaatgttccggcaatgatccaaagtgaatggttgcatccgtccatgcataataaactcagaaccattaccgtcaatcgtcagatcattgatctgctccaatagcacggcgagaattttgggattaacatcgtaggtgttcgtttcgtaataatctttttcgatagcatgttgtgcccagaagtcatatcttccttttgggaaaacaagcgtggaaccgggatgttgcttgcaagcatcgattgccttttgtataaatggaactgcgttgatacggctgtcgggtttcaaaccgaaatcagatacggaaataatcttgcttgctgcaatgctgtttacgcaaagtaaaagtgcagatagtaagcatgtctttaatgataggaatgttctcatgtgtttttttatagtttaattggggtaaataggtaaaatctaatgtttgtgttttttccagacacctctggtgaaatccggtatttctacaggaatacttccgttcaatactgacttctcgcttaattcggtgatacacgaccattcggctgcatcataaacgtccatgtcaaggggcagtccgttgcgcaggcaatatattaaccgataatccattacatagttcatttcgttcggtaatcctttacgatgtgcttcctcgccgatggtggcgctaaaagggtgtttatagcgagttaatactgtctccagtgcttcgccttcaagcggagtatctccatgagaatccagggcaatgcatggtaccggatatttttgtgcaaagccgagtgtaccgcatactgtttgcaggcgactgtaagggcggggagtagaaacattatactgaagcatgatcgtttttcctttggcggtatggataagcgtggtgttgacatctcccagcttatacttctgacgggcttccggtgagttctctccgaatcttttccgcgcatactcgctcatgccggcctgatgggtggacatggatacgagatattccattctgtcattgcggtggatgtcgagaatctgacatgcaggtcccagtccgtgggtggggtagggattgcctgtatgttcgatactgtatctttttccccagtgattgtggtaaccgccttcgctctcttcggcaaaatacatggaacggagatcgtgaatatacgctccttctacatgcattatttctccgagtacaccttgacgtgccatttcgagagtagtcagggcaaaagggtcataacagcaattttccagcatgatacagtggcgtcttgtcttttctgctgtatcgaccagttgccagcattcggctatattcatggcggcaggaacttcgatagctacatgtttgccgcattccattgcataggttgccattggggtgtgagtgagccagtctgtacagataaaaattaaatccagatcgttgcattcacacatctttcgccagccgcctggtccggtatatcccgtggcttcggggtgctttgcttctttgagtatgagttgggctttgttcaagttaccttccctgatttcgctgagagctttgatttcggttccttctatttgcagataacgttgcagggtgagtagccctcgattccccaatcctatgattccgatgcggacaattgggataggggggtgtgccaattgcagtacgtgtgattgcgttggagaatcttccatgttcttagaggtttaaagttatacaaaaaagagaatctaatttctcagattctctttgaagagcggaagacggggctcaaacccgcgaccctcagcttggaaggctaatgctctatcaactgagctacttccgcaatttttgtgggcaaagatggattcgaaccaccgaaggcgtaagccagcagatttacagtctgccccatttggccactctggtatttgcccttttgtgcttttgaggaggtttgtttctcaattgcggtgcaaagatacaactatttatttaaactccaaacaaaatcgatcatttttattgcagaaattgcacattcatctcctttgttacccagtttgccaccggcacgatcctctgcttgctccattgtattggtggtaattaatccgtaaatgactggtatgtcgccagttgcgtttaattcggtaattccttgagtcgctcccatacaaacataatcaaaatgtggagtatctcctttaattacacaaccgattgcaataattgcatccacatcgcaattttccatcatttgattggcgccgaaagttagttcgaaacttcccggtacagtttttaccagaatattttcatctttcactccatgtttttttaatgtattgactgcgccgttcaataaggctccggtaatattgaaattccattcggatacgacgatgccgaatttcatgttttcagcgtttggtacagagttgaaatcgtattcggataagttatggtatgctgttgccataattgtagtaattaaagtgggttataaatacatgattttaaaaaggcacggattacacggatttcacggtagcttcgcataattgcattagtacatattgtgcgtactaaaaaccgtgaaatccgtgtaatccgtgcctaaccttatattatatataataaggtatattatttcttcatcaatttagcctgttcgatgtacttgtcgatgtccatagcctggtaagactggaagtatttgtccttgatcttagtgtaggcattaacggcatcatcatactttccttgtttcaccagaatttcaccggcttgcatcaggaagatagggcttaatgagttattgtcagctttgtctgctgcagagagcagggtagaagcggctttgtccagctgacccagttgtgcgtagcagtttcctgttgcgccgaggatagcgggagctaccatctggtcgcctccgttgaagccgtcgagcatctttactgcttcgtcatatttacccagttgtgcgtagcagattcctgcatatgcttttgccagattagcggcttttgttccgctatattcgtcggcaactttgaggaaacctacataaccaatactatcaccgttcagtgcttgttcataagcatcttgttcaaagtattcctgtcctttgaaaagagcagcctgtgccttttcttcacgtggctcagcatagaggttcttgtacatgataaaacctgctacgatgataatcacggctacaacaccgccgatgattgcgtttttgtacttaacaagaaatgcttccgattgtgtcagtgcatcttctacgttcagatgttcgttctgattcttttgttctgccatttttatatgattctttttgttattattcatcgtttgataattcgactcgcaaaagtagtttttttatatctacaaacgaaatttagaggcatctttttttgttttacgctcgaaaacctcgaaaaacttgctacttttgtgaacaaattaacgcgtatacaatgatactgaaacggatatccatattaaactataagaatctggaacaggtagagatcggattctccgccaaactgaattgtttcttcggacagaacgggatgggaaagacgaatctgctggatgcagtgtactttttatctttctgcaagagttcgggtaatccgattgattcgcagaacattcggcacgaacaggatttctttgttattcagggcttttatgaggcggaagatggcacaccagaggagatttactgcggaatgaagcgtcgttcgaaaaagcaattcaaacggaataaaaaggagtatagccgcttttccgatcatatcggctttctgccgttagtgatggtttcgcctgccgattcggagttgatagccggaggaagtgacgaacggcgccgctttatggacgtcgtgatctctcagtatgataaggaatatctggaagcattgatacgctataataaggcattggcacagcgtaataccttattaaaaagtgaatttccggtagaagaggaattgttcctggtttgggaggagatgatggcgcaagcgggtgaaattgtttttcgcaagcgggaggcgtttatcgaagagtttattcctattttccagtcgttttattcttttatttcccaggataaagaacaggtgggtctgtcttatgattcgcatgcacgggatgcttctttactggaagttctgaagcaaagccgggaacgggataagattatgggattctctttgcggggaattcataaagatgaactgaatatgctgttgggcgactttccgatcaagaaggaaggttcgcagggacagaataaaacgtatctggtagcgttgaagctggcacagttcgacttcttgaaacgtacggggcagaccgtccctttattgctgttggatgatatttttgataaactggatgcttcgcgggtagagcagattgtcaagctggtggctggtgataacttcggacagatatttattacggatactaaccgtgaacatctggatcgtattctgcagaaggtaggcagcgattataaagtatttcgcgtagatcagggtgtaattaatgaaatgggagctgaacaatgaaacgtaacgatgccgagcagataggaaaactgattcagcaatacctgcgtcaggagagtctggagtctcctctcaatgagcagcggttgctggatgcctggccgcaggtgttgggaccggcggcaagctataccagtaatctctatatccgtaaccagacgctgtatgtacatctcacttccgccgcccttcgtcaggaactgatgatgggacgggaacttctggtgcgtactctgaatcagagagtaggggctacggttatcacaaacattatttttcgttgaggaaaggaattctgtctgtcactttcatccccagcttttggagagtctcatttgcccggtcatagtagaacggagtttcaagatattggttgttgtgggcatccactccgataatggcggtgcagccttcgtgtgctgctatttcccaaaaagcagggtggggaatggttgttattccatgttcatcgttgtagtcttcgtaacctatattatattccaggggcaggttcaagcgggctgctgtccggcagatgtgtctgctgacaagtttacaatgacggtcgaattcaggatatgaacgcatgaacaggtcgggatgtgccagataggcaaacaagccgctttccatcccttcaatcgcactctcttcataaagttcaagcatatctaccgtatgggtatttcgcccgaaataaggaaacttctcatctgtatggaaatggtggttgccgaagatgatgtaatccagttgatactccttgataactcctttcagccagggaatatactccggaaaatattcacattccaagccgattttaatgctgatttgatctttatatttcttttgtagcgagcggaggctttctacatactccggcagttcttcgggagtcatccggatgtcggatacataatcggtatggtattcccatggtgtgtggtcagagaaaccaagttcctgatagccgcctttgatggcgcttaaaacaaattcttcgtcactccctgtcgcatggaggcagcgggtggtgtgggtgtgataattcgtcctcattacttgttataattatgtccatgcagatgtcgaatgcttctgccggaacttcttctactatttgaaatgggaagcagatgcctgctttataagctgcggggatacgtggcagcaaacggtcataatagccttttccccttcccagccggtttcctttccggtcgaaagctacaccgggaacggcaataaagtctatgtctgcatagtctgtgaatgtttctccaacaggctcttcgatgccgtaagtgccggttgccatatcctcgggaccggtatagaggcgtaattccaattcatcaccgacaactaccggaagcaatatccgcttctcattgctccatttccggataaacgcatgcgtgtctacttcatctttgagcgaatggtagagcaatacagtagttgccgccctgaaagccgggtgggcttcgagggcggcaagtattttagctgattgtagcttctgcaaagtcgaagatgcgtgtcggatcttcagtgatgccataagcttgcgcagttctttttttctttccatctttattgtctttcgtcacttcctcttctgtctcggcgggtgcttttgggaaagcttctcctttttcgagcagttctataccttgttgaactgtagcatccgatttattgaagtatttcagataagcttccagtcccagcatattatagataatgttgccgtatatattcgcttccagtcgtttatacgatttctggatcagaatattccttctctttacacctttcgagtcggcaaagcggatgaactgctctaccaaaccttggtgacgaagataattcagcaggtcttcttccgtttcatactggctcagcttcttccgattattgtccgtgtactggaaagtaaactgaagagttagtccgcggttgattactgatgagagataagaagtgactccggtagtatcttgtggtacaaatacatccggcatgataccgccaccaccataaacagtgcgtcccaggctggtgagatagcgttcgttttcgttcagcttgatgctgtcgcgtgagaagaactcaccgtgttcgtagcggttgtatatgtctagttcataattcttgtctttaccactttcgtaaggacgttggatgcaacgccctgaaggagtataatagcgggcgatagtcaggcggatagcagagccgtcgctgaagtcaatcggttgttgtaccagtccttttccgaaggaacggcgtcctaccactgtaccgcggtcattatcctgaattgctccggtaaagatttcgctggcagaagcagaaccctcgtcaatcaatacaacgagtggcattttctggcaactgcccgtaccgttggcaaattcttccgcacggggatatttacgtccttgtgtatatacaatcagtttaccttcgggcaggaattcattcaccatgcggatggcagcttccatgtatcctcctgtattgccgcgaaggtcaataatcagtcctttacatttcttatgattgagctgggccaaggcgttaagcaattctacgtggcttgtccgtccgaatttgctgacttttacataaccgatatcatcgttcagcatataggcagcgtctactgtattttgaggaatgtctccgcgggtgatggtgaagtccagcaatttcggttctcctacgcgtttgacacccagtttcacctgcgatcccttaggacctttcagtgtgcgcatggctagttcgttgttcagctttttgcctacaaataaactgtcgtctacattaacgatgcggtcgcccgccatgagtcccactttttcagatgggcctccctggataacggcattcacatgaatcgtatcattctgtatcgtaaactggataccgattccgctgaaactgccttccagttccgaattgacttcttcgagattctgtgcagggatgtaagtggagtgcgggtccagttctgccaggatctgtggcatagccttctccacgaggtcggtcatgtttacggtgtctacatattgatcatctacgattctcaacagcgcattcagcttgttggaagaaccgttgatgatacccagacggttgccggcgaagtgcttggcataaaatgtaccgataagaataccggccaccacgctgatagctatgatgataggcgtaaaacgtgaagagtttcttgtactcatgtctattcctttttttaaaacgttcgttttattatttgtttggagaagaatcttcgttcatttctgtatagataacttcgattcctgcccgttttaatagttctattccatcttcgaggcggtaatgttcggagtagactacccgtttgattcctgcctgtatgattaactttgcacattcgatacaaggtgaggcggtgacgtacatcgtggcaccgtcgctgctgttgttcgagcgtgctatcttggtgatagcgtttgcttccgcatggagaacataaggttttgtcaggttattctcgtcctcgcatacgttttcgaagcccgaaggagtaccattgtatccgtcggagataatcattttgtctttgacgatcaacgctcctaccttacggcgctggcaataagagttttccgcccagatgcttgccatacgtatgtaacgtttgtccagttccaattgtttcttttccgtgtccatgagagtgtcttttattttacaacgtgaaaaactaaagaaagtgtctgctggctaccggaaggtttatagtaaaggtatagatttcgctcatctcctccgtaagaggttgcgttgttcagcccttctataaaattctttgctaatatatctgatgattcattacctccttggatagatgcattgaattggttgtcctttccattggcagaccatgatccagtgaaagtagaggttatcactgtgccacttaaggtcccggtgatgatattgctttcttccattccattaaaggtaattacatacctacctgtttcgtcaagcaatttcatgctttgttcgcgggctttgttgtcgtttccccaaaaattaaacatttgatggctatctttgactgtgatataagtcagtttccatgtcttgccggtgaagatgccggctacatcatccgtatcattacatccggaaaacatcggaagcaataacagcaatcctaatactttaagtatcaatctcttcttcatgtccaattctctccttttttaattgtattgtttctttatgccgtttcggatcagcaatgcgtcaatggtaggctcctgcccgcggaagcgcttgtagagcaccatcgggtgttctgtacctcctttcgacaggatattgttgcggaacgaatctgctacttcacggttgaagattccttgctgtttgaacagtgagaacgcatccgcatccagcacttctgcccatttataactgtaatatcctgcggaatatcctccggcaaagatatgggagaattgtgtactcatgcaggcttctttgactatcggcaatacttgtgcgtctttccaggcttcctgttcataggcttttacatcgccctcgaaaggagtgttgcgggtgtaccatgccatatcgagcagcccgaagctcacttgtctcaggcaggcataggctgcattgaaattcgaagcatccacgagtctctgtatcagttcgtccggaagcacttctccggtttcataatgacgggcaaaggtattaagaaattctttctcgatggcaaagttttccatgatctgtgaaggaagttccacaaagtcccaatatacgtttgttccgcttaggctctgataggttgagttggcaaacatgccatgcaggctgtgcccgaactcatgcaggaatgtctccacttcgttgaaagtcagcaaagcaggtttgctttcggttggcttggtgaagttcatcactacagatatatgcggtcggctgtcttcaccggttacgggatctatccattgttccttgtagctggtcatccaggctccggcgcgttttccgggacggggatggaagtcagtgtacagtacggacaggaacttaccgtctttgtcgaatacctcgtaggcttcaacatctttgtgataaaccgggatttccgtatttttccggaaagtgattccgtagagtctttctgccagtccgaatactcctttttttacttgttccagttcgaagtaaggacggagcatttcttcattgatattgaatttcttgtttttcagcttattggaatagtagctccagtcccagggcatgacaatgaagtcatcaccttgttcctcacgtgccagttcctgtacttcgagatattctttctgtgcggtgggagtgtaggcttccaatagttggttgagcagcttatatacggcatcgctgttttcagccattcgttttttgagggtatattccgcataatctttatatcctagtagctgggctattttcatgcgtgtattaaccagcttctttacgatttcgatattgttgaattcgttatcgtgtgtacactttgtattatatgcgatgtagagcttatggcgcaactcgcggttgtcggcataagtcatgaaaggcacataacttggagcgtgcagggtgaaagcccatccttctttatcctcacttctggctgtttcggcagcagcttctacgatgatttccggcagtccggcaatgctggctttgtctgtcagaagcatttgatacctgtttgtctccttcaggttgttttcgctgaagtcgagtgtcagtttgctcagttcgttggtcagttgtcggtattgttcacgggcttctccttcgaggttggcaccgtggcgtacaaaactgtcgtatatatcgtctagcaggcgattctgttcctgggtcagttgcagagattgtttttgtccgtacacttctttcacgcgggcaaacaacttctcattcagtgtgatgttgttgctgtgttcgctgagtagtggcatgattttctgagccaatgcctgtaagtcgtcattggtttcagcactaagcatattgccgaatacggcagttactttgtccagcagccttccggattgttcgtaggcttctattgtatttgtaaatgtcgccttctccgggttttgtatgatcgcatcaagttccgcattctgttgtttgattccttcgaggatggcaggctcataatgctctgtcttgatccggtcaaagggcacagtcccatgcggtgtctgatactgaccgaagaaaggattctgagcgttcagtatattgttcatggtgtaaactagtatcaatgttattaataatctcttcataattctcttcatagaagtacaaaactactaaaattgtaggttataccacggataataccttgctttttaacaatatataaaatgaagacaaaaaaaccgctacggtttcccgcagcggtttcctatatgtttagatttctaattaagcgttaactgatgccatgtgagcgatcaagtcaagaactttgttagagtaaccgatttcgttgtcataccaagatacaacttttacgaaagtgtcagtcaaagcgataccagctttagcatcgaagatagaagtacgagtgtcacccaagaagtcagaagaaactactgcatcttcagtgtaacccagaatacccttcaattcgccttcagaagcttctttcattgcagcgcagatttcagcgtaagtagccggtttagccaagttaacagtcaagtcaactacagaaacgtccaaagtcggaacgcgcatagacataccagtcagtttaccgttcaaagccgggattactttacctacagctttagcagcaccagtagaagaagggatgatgttgccagaagcagcacgaccacctctccagtctttcatagaaggaccgtcaactgttttctgagtagcagttgtagagtgaactgtagtcatcaaaccgtcaaggataccgaacttgtcgttcaatactttagcgataggagccagacagttagtagtacaagaagcgttagaaacgaactgagtacctttcacgtatgttttttcgtttacaccgcaaacgaacatcggagtgtcatctttagaaggagctgacattacaacatattttgcaccagcttcgatatgagcctgagctttgtctttgctcaagaacaaacctgtagattcaacaacgtattcagcacctacagcatcccatttcaagtcagccggatttctttctgcagtgatgcggatagcctgaccgttaacgatcaatttgctgttttcaacatctgcttcgatagtaccgtcgaattgaccgtgcattgtgtcatacttcagcatgtaagccaagtagtctaccgggcaaaggtcgttgatacctacgatttgaatatcgtttcttttcattgcagcgcggaaaacgaaacgtccgatacgtccgaatccattaatacctactttaatcattttgtttaaacttttaagggttttataatatttgttcaaatatctctcagctcgcacatttgttttattttcaaatgcggtgcaaaattacaaaaatgtttttatattcgcatattaaattcacattaaatattgaaaaaagatgggaaagagcacatttttacaagactttaaggcgtttgctatgaaagggaacgtcattgacatggctgtcggtgtagttatcggcggcgcgtttgggaagatcgtatcgtcactggtggcgaatgttattatgcccccaataggcttattggttggtggtgtgaactttacagatctgaaatgggtaatgaaagcggctgaagttggagcagacggtaaggagattgctcctgccgtatctctggattacggacaatttctgcaagcaacttttgactttctgattatagcttttgctatattcctatttatacgtctgatcactaaactgaccacgaagaaggcggcagaggaagccccggctgctcctcctgcaccacctgctcctactaaagaagaggtgttgctgactgagattcgtgacttgctgaaagagaagaaataagtacttgtataatgaataggagattctgttttgagtctcctatttattatatataagtctctctgacatcgtttcccttttcggattttatgttgtccgatgatatatttctctcgtaaatttcgatttttctgtttattcttctatctttttgcctacttttttctacttttgcaaatcatttattcaaaatccaaccattgatatgcaggagaaaataataattcttgatttcggttcgcagacaacacagctgattggtcgtcgcgtacgcgaactggacacgtattgcgaaattgttccttataacaagtttcctaaagaagatccgacaattaaaggagtcatcctttccggaagtcctttttcggtttatgataaagatgccttcaaagtagacttgagtgagattcgtggtaaatatcctattttgggtatctgctatggtgcacagtttatggcgtatactaacaatggaaaagtagaaccggccggtacacgtgaatatggccgtgcacatctgacttctttctgcaaggataatgtgctgtttaaaggagttcgtgagaatacgcaggtatggatgagtcatggtgatacaatcactgctatccctgataattttaagaagattgcttcaacggataaagtggatatcgctgcttatcaggttgagggtgagaaggtatggggcgttcagttccatccggaagtgttccatagcgaagacgggacgcagatattgaggaacttcgtagttgatgtttgcggatgcaagcaagactggtcgccggcttctttcatcgagagtacggttgctgagttgaaagctcagttaggtgatgataaagtggtgctgggattgagcggtggtgtcgattcatcggttgctgctgttttgctgaatagagctatcggtaagaatctgacttgtatcttcgtagaccacggtatgctccgtaagaatgagttcaagaatgtgatgaacgattacgaatgcctcgggctgaatgtaattggcgtggatgccagcgaaaagttctttgcagagcttgcaggtgtgacggaaccggagcgtaaacgtaagattatcggtaagggctttatcgatgtattcgatgtggaagctcacaaaataaaagatgtgaaatggctggctcagggcactatttatccagactgcatcgaatcattgtctataacaggtacagtgatcaagagtcatcataacgtaggtggtctgcccgaaaaaatgcacttgaagttgtgcgagccgcttcgtctgttgtttaaggatgaagttcgtcgtgtaggtcgcgagttgggtatgccggaacatctgattactcgtcatccattccctggcccgggtttggctgtacgtattcttggagacatcacccgtgagaaagtgcgtatcctgcaagatgctgatgatatttacattcagggattgcgcgactggggattgtatgatcaagtatggcaggcaggcgttatcttactgccggtacagtctgtaggtgtcatgggagatgaacgtacttatgaaagagcggtagcattgcgtgccgtgacttctactgatgccatgactgccgactgggcgcatttgccatatgaattcctgggtaagatttcgaatgatattattaataaggtgaaaggtgtaaaccgcgtaacctatgatatcagttctaagccacctgcaactattgagtgggaataagagattttcttgatttatataaaattccagtatcgcaagttactggaattttttttatgtaatataccctttacttcttattacggcctattcgccagagattgttggtgaaggagaaaatattattatatatggtagaaattaaggtgtgcattttatttcttatgcatttattcttttggggatctactaccttttttatttagtatatttgaaaataaatagttgtgcttggctgttatgattcatttttatatttaacagattgggataagttgctctagaacttgggagttttataccaataagtgtattttttcctgtttccataggctattcaaaggttattaagtgcatgtactattctaagacggtgtaaagt

SEQ ID NO: 161 - DNA, 16702 bp, Bacteroides thetaiotaomicron
aaactatatcataattcccctccccatcattgttgaaaattttcttttaaatattttatattccaatcatcgttcttctccacatcttcacatcgttttaacttccactttaaccgattcatataaaggacgaatggataagatcattgtaatccaccaaaattctgctgattgataccataacggaaacagtgaattaaataaaaaacaaaatggttacaagcatccgaaataaaggatgagaaagcatcaatatctctataggattaggatttgattcgcatagtgaaaaaaaagtccgaacttttttaagttcggacttttaatatagtaagaggacatataatgtttgaagtccctcctacctattatctcaattattatattactcttgaaatacctttttcagatattcaatattcgttccataattcttcttcacgttcctcacatcatccttgtctcgtgagcgttctacaaccagccagcccctccagcccattttgtcaagcgtcttttttaccttattcatatccagccgctcattgaaaggaagagtcactccatccgtatctgtacagtgaatctggcaaattctattttttccaagaatcttgagttccttacatagatctcttccattttctaatgcattctgaaatttaaaatagatcttgataccgggagaattaatctctttcaatagtttcacttcttctcttgcatccaattgagtttcaatgccaattacaactctttccgaagcagccatatcccctacttccttcagccgttttattaaagctgtccgaagttccggagtttcctgccagcctgcttccactccacccaaagggagaaaagcgaccttggcacccattactttcattgcatccagacaatcccgaactaattctttataattagcacgatctaaaaaagactgtccataaaaaccggacatagcaatagaaggaacctctaaattatagttctgagctgtttcacgaaatagctgctggaaatggggctcacgcaatttgttatcgaacatttctcttttaccgagactacccatatccaactcgactccatctcctttcaactcatgcaccaattggaacgaaccaatcttctgacgtttcaatatcatccagtcacatacggcgatcttgtaacgttgttttttttgtttcgatgcagcaacagccagcattggaaaacattctgctacgattaatatccaaaggatatgttgaaataatttctttctattcatcatcttaattatacgctgatcgtataaaagacggatgaaaggaaactttgtaatcggctacattccaaatatttaatactaaaacggaaaaggggatatttataaaaataagataatgacactatcctaggtaaatggtgtcactataccactgatatagtgtcattatcgcagacatatagtgacactatctttttgaaaggattattcaggtaagatgtaaaaaaaataggctgccgaaccctgaaaagtccgacagccttgtcaacccaaaaacgatacctatgaaacactgtgtgttatttcaaatcaaatatcaagcgtttaccatgaacaagttcatcgtgggtaatgcggtatttattgaacttcttaccatccaataacaccttatttatataaagagtttccgatccggtacgattactctcaattaccagctcattttccttataccatttaggatccaagcggatcgttactttattaaataccggagtagtcaatgcatattccggcaatcccggacagtcgggataaaaacctatcatattgaaaatagcccatgcagacatcgtacctgtgtcatcatttccagggataccgtccggtttggtcgtaaagtacttatccagcagtcgctgtgtctctttctgtgtacgccattcttcacctttaaagtaagagaacagatgagcgtaagcaatatccggttcgttagccggatcatatagtccttcatcaaacaccatttgcagcttattgacaaaaggtttctttccacccatcagtttagccaatccatatacatcatgtggtacatagaaagtataattccaagaattaccttcgtggaaaccgggattcggttcaaagttctctccctgcctcggattgaacggactgtagaaagttccgtccggaagaataggtcggaatgtaccgaactccttactataataatgcttatatcccaaagagcgtttatagaacatttccgcatctttcttctttcctaaagcatccgcaaaacgggaaagggcaaagtctgcgatataatattccagtgcatgagatacggagttatcatattgttcacgaagcggcacgtatccttttgacatatagtcatcattgtccggacgcatcagattttccgccccgggtaatgtagccgacttgtacatagcttcataagccagatctacgtcaaagtcacgcaatcctttcatccatgtatccacaatcactgggatacttggatcaccttccatcgtaagagtctctcttccatacaattcccatttagggaaccaaccatgttcacgatacatatcgagcatggtacgtaccatttccatctgacgttcgggataaaccaaagtcaaaagctgatgtacgttacgatatgtatcccacaaagagaatacagtatatcgggtacctttcgttgtcagaatctgatcgctctccatagccggatattcaccatttacatcctgcagaacgttcggatgaatcaacaaatgataaagtgccgtataaaaaactgttttctgtgcatccgttcctccttctacagtgatacgtgacaagtcatcgttccactgtgcacgggcatcggaaagcacctgttcaaagttttttcccgactgttctttatccagattcaaacgggcattctctatgcttacaaaggaaactcccatctgtacttcgacctgttctccttcttctgtttcaaaagtgaagtaagcgcccacatcgtcacctgctatttcttttccatagcgggtatacaatttatatttgccttggtcgcgatcccattctgcttccacacctgtcatcggacgttgctttttccaatatccggttgtggcgggaactttgttcactctcatcacaaaatagatgggaaatacagcttggggattataacagaaagtacccaatagtttcattccctctatttcgctgtcacttacacgacgaagcatggctccactctcattggtcaggccttcgcccaaattcagaagtatatgactctctcctttaggaaaagtgaaacgggcaatacctgtacgcggagtagcagagacttctgtctttatattatacttcgtcaaataattggaataatagccgggagaagcctgttcatccttatatttgctcccatattccttatagtctacattcagttctccggtagtaggcatcagcaataaagaacccagttcaggacaaccgacaccactcagattcacatgagaatatcctgtaaagaaacaattggtatgttcataaggcgtcgaccaccaacgtgcatctttatcgtatgtattatcggcagaacccatcacattaaaaggtactacggacatcattccattcgggcaaacagctccgggattggtggtgccgaagtttgtcgttccaataaaaggatctacatagtctatcaacagactcttttccttatccatagggggggccttaccctctcccccaaatacggggagaagggtgaaagccagtgtgcaagttaataatatacgtctcatatccttcttagataatgctcgttcgttttgtaaaatcaattatttcctggatatagccgaaagccattcctacaacggtatctgcagctccataataaacagctacacgctcaccatcctgcaatgccgcacatgggaataccacattgggcacatccccttgaagttcataaggtgcagccggacctatcagatattcacgggtacgataaagtaccttttcgggatgatccttatcgagtatcgccgaacccattgcataacggaaaccgttgcaagtagtgataacaccatgatagaaaagcaaccagccttcatcagtaaggaaaggtaccgaacctgcaccaatcttggtacactgccaggcactttcagggaaaggagttactttcatgacacaacggtgttcaccccagtatttcatatccggactgtagctgatataaatatcaccgaacggtgtatgtccattgtcgctggggcgacttaacatagcatatttgccatctatcttttgcgggaaaagtactccattacgattgaaaggcaggaaagcattctcgcattggaagaaatctacaaaatcaaatgtataggcaataccgatagtaggtccatgatagccgttgcaccaagttacccaataacggtcttcaatccacgtaacacgcgggtcatatttatattcggattcaatcatttccgtgttaccggctttgaactgaatcggttcatgactaatatcccaatgaataccatctttactgaatcctgtgaagatgttcatctgtacagctttgttgtcacaacggaatacgccggcgaatccatctttgaaaggtacgacagcactgttgaaaatactattggatgaaggaatatgatagcgtccgatgaccggattttgcgagtaacgccacattacatctgtacatccgacaggacgttcttcccagggaatttgaatcttattcataataattatttatttagtaattggttatctattatcactcaaaaatagcaatttattttttcttttttgaatcatcatacgtaaaaggtataaaataggtcatcaaaaaagcaggaattgttgcgatcagtacatagataaagaaactacggtatcccagtaaatcactaaaatagccgctgatcattcccggaagcataactcccagattcatgattcccgaagcaaatgcataatgtgacatctgatgtttgccaggagcaatctgctgcatcatgaacaaggtcagtccgacaaatccgaaaccatagccgaaatactccattgtgatacatgttccgatcagataaagactggtcggctggactacagcaaggaaagtataagcaaggaaaggaaggttgaacacgcaacaaagcatgaataaagttttcttcaatccatatctggcaacaaatattccacccagcaatgaaccgataacaaaggcggcagaaccaaagacgccattcaatgttccgatttctgtcaatgacagccccagacctccgacctctctggaggcacgcagaaacaaaggagcaaccttcattataaatccttccgccaatcggtagagaataatgaagaagatataatatactatatgttttttagtaaaaaagttcccaatcacatttaccaaatcctgcatgatttctgaggtagacttcttgccggtagcgggaacttgtgtagaaggcaacatctttatatgataaagaccgagcaataccattactgcagcaattacggcaaaaataatcatccatgcagatgaatacgcacccttattggcatctatcgaagctccttctatcgctccgaaatattcggccagcatacctgccaaagcaactaatccaccgttggcaaccaattttgccacattatagaaagctccctgtactccaatatatttagcctgatcctctttattcagttctgccatatatacaccatcgcaagcgatatcatgtgtggctccactgaacgcaatcaccgccatagtggaaatactgatagcaaagaaataatcaaagaataacgaaaaagctactactccaaacaatataccactcaacagttcggttaccagtacaaaaaactttttggtccgatacatttcaagaaaagggctccataagaatttgagtgtccagggcatcatgataagagaagtccaaaacgttatctgagtatcagaaatacccaaatccttaaacatgaatacggaaaccaaattgatggcaataaagggaagtcccattgcaaaataagcggtaggtacccaataaatcgggttgatagtttttccttgagaagcagttttattctgttgcatagttcaatagtatatagatgaaagggtcatttttctgacccatctatatataatacaactaagaagggcaaactactaacgcttgcccctacttttttttattttattgttacttcgtcgataaagaaccacgaaggatgccctacaccataatgccattcgggacattctttcgtaccggtgacctcaactttcacataacgggcatgcactggcatttccgattcagtcttcactccgcggaactccactttccccgaacggttttccggcatatcatgtgctccccaatgtgtataattctctccatcttcagaataggaataaaccaccttcagagggaaaagaatccaggctccgatctgatgcaggaaatccgtatctatactatgtatttctttctctttacccaaatctataacaaaagcaccgtctgttccttcccagccaatccagctttcaacgaaagtagatcctccgaatagtccgtccactaatgccgtttttccgatttctgcatatttaccggtaggaggaataagataagtaaccttcgctcctatcgcaacacttttttctgcacggggcatatatctctcccgatacaactggcaatattccacaggagaattggaacgttcattcaatgtcggtacattaaattctttcacccgttcttcaaaaagtgccaatttcggactgatctcattcatatccgtaccagtctcagtacgggcaatttccaattccgaatactgaatgggcaagcgggcacgctgcacacgcttcaggaatttattatcttcagccaccgctttctctgcatcatcaaacagttgattataacgtcgcatcagttgtggtttcagcattccgtatttatgggaaacaggagaatcataaatccacaatctttgtccgctgcctatcaacgctccctccatcaccttgatatactgataaaggtatggcgcagcctctccatagtatccatgcaggaaatgctgcatcaaagaatcaacattcgcttcggggttccacattaacttagataccagataggcacgtaactcagcgaagtctcctcccctgcttcctgcaatctgtgagaaatgcatagtggcatgattctttttgaacagacggatattatcctgcaagatatgaaaattagggaacggagccagataattatcaaaattaataccataatcccacacgaaaatattattagtgatggcagcccagccttccattgctttcacaaactctttacctgaggcattttccgtcaaagtcacttcacggtcacaatctatatcacaaagcatgatattcacattcggcaatggcttcacatgtttcggaggattcatcgtatacagataggcaagcgtggaaaattccttatcgggaaaacgggcagccagcttattcaaaaaagtaatgatacttcctgagagtgctccttcataatcatctatcgctttgcaggcatcacatgtacaattggtataattaccatcattctgactcacagacataatatgcttatccggatttgccttaaaaatagaatcaatccgctgagccacgatttcaaaaacttccgggttactcagacaccattggcttgctttcccgggatggcgtttgcctttaaaataagaataatattccggatggtcttttccatatacggaagcaggaagcaacttatcaaaagtatgcacccaataaccggcagcaaacacttcgtttggctcttccagcctgttccaccatttatatatggagtctgtacgaatagcataacattgtgtctggcggtaacggaaagccggattatctattttatcgataagcggcagttcgattgtcttcgcagggttaaaagagtattcgttttctccccagtaatccactccaagatattgttcgagtaaagttacaactccgtagactgtcccattcccactgcctgaaatacgtaagattccatctttcgtagataggctgaaaccgtcttctgtcactccagctggggttttgctactgattataatatctcctttttttgcattctgcccttttacaatgggaaatgtacaacctgaaattctctgaaggaacaattgaaataaatttgctgatatttgattaatctggtcattttctgatagaataatcctggatttagtttttccattatcaactaaaacgacttgtgctgttgcaggaatataacaacatgctcccaacaaacaaagcagctgaaaaataatacggcgaatgattctcatagcatttcctttaattagtttttagataatacaatccaaaaatataagatactcaagaaaaaaatcagttctaagttttattaacaaagaaaacttagaactgatcacaacatgatataaacagcaaatagcccaagctcattcagtaataaacttgggccattttttattcagtttcagtataaatacctacagtattaatataaggagaataataaagagctccatggaaagttactcttatatattgcgcttgtttagccacaagaagaagaatgtaacttgtcttatttgcaaatcctgaagctacaccaagatcctcatatttctctccatcattacttatcgctatacttgcactttccgaagaataaaaccattcatagaaatgtaaagcaatagtttttatattctcttgttttcccaaatcgatatcaagtatgctgccatccggaacataatcatacaagtcgctagattgtccattcaaagtaaaactccaacccgaatggtcatttattacagaacctaccggtttgtctacacaagataaaaatccgacaagtgctgttttataaacaatatatataactttattctcgcctatatctgctcctactccatcaacattcgtgattgtcactggaataacatagttagtacccagctgcacagaagccatatcatccgaaaaactcaaggcaacactctcttccggagttgtttttccttgtttaatcattattgtcgattgcttcaaacttgcactagtcagtaaagaataatctgtgccatgcaatgcattatacgttccaactaatgccggattaatagcaagagtaactttggtgtcaccatctgcggcccatgccgattttaagataccgtcaagcttccattcactgcttaaatttgtaaatccttgactatactgatactctaacagatattctttacttgaagtcagtgtgacatgatttggtttgtaagtcgattcaaatgtcaagaatatcttactattactttcactcgctgatactcctgttccattaatagaagttatagcaatcgggagaatataattttccgatccgttcttaaattcttccatattagtataatgcacttttaaagtatctacagagatatattccccttgttttatatacaaagttgcattttccagttctgcattttgtaaagctacatagctcgttccatattcactgttgtatgcatctaccaatgacctgtcaatagctaattggatggtcaaatcttgtggtgcaggtttagtacacctgacaggagacaaaatatgttcggtggcgatttctttcaaaaaagttccgtctcctttatactctaaagtagcatttgtttcacttggtttataaatatagacataattgatatcatacggatctgttgcttcgtcatcgtcacatgctgtgactaatggcaatgacatagcaaaaaatgtactgtataatatatatttaaataatgctttcatatcatactgttttaaattattgagcaaatgaatatgtttcccatgtcaccttttgacggttttcgttacctaggttagaattgccaatttccacatcatgaccattaccggttacatcgtgtagtattgtagctccttcaccttcattcattggcagatacaacaacaaattcttgtctgtataatcaacttcggtatacatagatttctttatctgattaactgtgcgtgtaactttccaaaaacgaacctgacacatttcacagaaatccggaaaatattcttctcctgaagaaatcatctgaaattgatcaatattcatcggttgtcctattgaagaagataatgaggcaactacagtaccattttggtacaataaagtagtaccggatgctgcatcataactcactgcaaaatgataccatttttgtgcttctaaaccttttcccttagttggatcacctgtatcaaattgagaccccatcgtttttacttgtaggaaattatttttatagctaccattctcggaatagattaagtcaccaaaccgtatatatagttctgtccctaaacctcctgagtttattatagcctgattattcttagtatatccaccgttccctgatttagaggtgactttactccaccattccaatgtataatttggcaaagctaacccccaagctccttccggggctgcatgcataccattataccatgttaatttaggaacagcttgtttcaaaggcttcacaagaaccaataaaaaactggaagaggattccgacttctcaatacctccttccacattcttaatactgatgggaattgcatattgagcaccgccttcagcttcaaaacttttaatatcaacattcacaggatctgcacttacagaacctgcttcaattgtcactgattcaggaaatgatatatattctttaggaggcattttataattagtttcattcttcttattataagcatctaatacagattcgtcaataaataaattagcttttattgtttgattaataatattcaccaaacgtacagttaacgaagtacgcgtcgtaccctctgtcaatgtcaattctttagttttggatgtagacgcttcatttatatagactaaattatctataacatcatacttagcattttcacatgcagtatggaccagtgccagtaccccaaatgccattattttaagtaaagatattctcttcattgtttaaccctttcttttagttattaataggaggattctgtgcagcaatagctgcacgcactgtgggataatcaggatttccaggataatcatactcaatatgataagcccccatacctgcatgttctattccacaagccggatgatagctctgttgctcggtaaagtaatgcttatccactgctctttcaaaagttgcagtcacaatagatttccccatagcttctttaaagacattagggtgacttctacgtacagcttcaaagaaagaatccaatccagaatgtcctagttcataggtctgccaagctatataatcaagacttagaactgtttcctctgaaagcacttcataaaagctcaaccaacctgcaccaccagggatatcagcaaccaacattttccccgtcttatcaaactcctcacgtaaagtcttcataaacgcattgggtactgatggcatactggagttcattaaagtcccccaatcctcaatatcataatcaaatccatcgatattatatttgttacatgtatctacaatagcaagtgcatatttcttagcagcctcaatgcaagattgctcatctttaggatcaaagccccaaaacgcttccttcactgcatcatcgttaccccccggtgtgagattatcaccaatatctcctgcgcgccaacaaagcactgctctggaacccttagcctgaaagtcttttaaatcagcctgttgctcaaccgtcagatttccccaacagagccaaaggctcacaaaatccgtactgtccggtaatccacataaagcatattgcatggaagaacctcccttacctgcccagttaccaaaccagccaaacataatcttatgtggagagttaaaataatccttcaaattattttcataaccttgcgtaggaggttcataataatctttcgcctctatgtcggtccaatcactacatgcgatatttaagaatccctgcgaaaaaaagagagaaattcctattccgtatattatttttttcaatttgctcgttttcataataaaaattattttaacgttctgatttaatttttcttagcccaccaaagatctgtggcagagttatctgcaccacctaacattgatacagctgctttcacatttgcattattcgtattatattctgactgagggaaaggcaaacgacgcataccacgctgcactgtcaccccatctgtattcagattattcacgatagggaatagtttaggataacctgtacgacgaatgtcagcccacgtttcccaaccattcggaaaattggcaatccacttctgaatcaaaatacgctccaaattctctgtaacacttgctgattcattatatttcggagttacagttgacactgctgctatatccttacctgaatccgaaggatcactgtaagcagcaggaaccttttcacttttcaaataatcgccaatagtagctttacgttcttccatagacactgtcactcctgcgtcataaagttctttgggagttcctcccatattccatttatacatcaatgcagcttctgcacgtaaaaaataagcttcagatgcagacataatgagcaattcatcatctataccaatattcaggcgggagaattttgtataatttgcctgagttgtagcactttggtaaataccatttcgcactcctatttgtcctccaccgatagaagcatctgcttctgatgcatatttagccaaacgaggatcattataaccgcttaaatatgaagtgatattagcactgatacgaatttcattccatgaagaagtaacacgataatatggattcataccgtcattatatttactatatgcagcatctgatgcagatgtcatcacaccaattacatcagaaacagcttcttctgctttctccttggcaagtgctggagaaacactagaaatgcgcattgccatacgaagctttaaagaattggcaaatttcacccatttgttaaaatctccattaaatacaagatcgtattctgataaagaactcatatcttcattacctaacactgctactttaaaagcggaaatcgcttcatccaaatcatcaaacatgtgtttataaagatcctccatattgtcatattctacagtaaaagcagttcctgtaatttgagaataaggaatcggtccataacaatcactaattttaagtgaagctgccacacgaagaatctgtgcccattgataagccaatcctttgccatcagaaagatcacgtatctggaaatatccggtataaatctgtggcatagtagtatcaaacatatttccataccacccaactcttggattgtaagtataataattacctccattaccccattgggcgatacaagtaatttctccaccatattcagatccaatcatctgatccaacatctgtgaattgttctgttgtccttgtactaatgcaggaatcatgcttttaatcaatgatccggtgattgcattatcacccagcatttggtcaggtttaggtccaaagggatttgtattatactcttcaaatttatcggtacaacctgttcctagtgctactaacaaagtatacacagacagttttgcaaacttctttattatcttattctttttcataatctaaactagaatgttagtttgacattaaatccgagacttctcaaactaggttgttgaaaatagtcaaccccctgatagaaattactagtgacagaagatgtactttccggatcataaggtgctttacaataaatcatccataaattctttcctgtaagccccagtgtcatatttacatgatttttgaaccatgttttaggaagttggtagctcaagctcagttcagaaaggcgaatattcgttgcactatatgtataataagtaccaacagcagtagttactttactataatattcctcagcatccactttactgtctccaacccatacaccgcctgcctgacgagcaactgcagaactttcagatacaccatatttatcaatcatggcttgtgtatccgatacaactaatcctccaaaacgcccggtgaatgcaaatccaagattccatcccttccaagcaacactaccattccatcccaaataatatttaggaagaatagagccaaccttgcggtattccgtattttcaatagccaaacttccattagaggggtctttccaaatatatccattaggagactgacgcaaacgctgattgatataaatatctcccattgatccgttttcatagagtcttaaagtcggaccaccactagttcccaatgttccttttgagtaatactccatttcgatagcttcgccggtttccggattgatggcaccattcgctaaactaacgatcttgttttgattaagagtgtaagtgaaatttgtagataccttcactttatcaaatgtatcagaatatcctaaagccagctcaataccctgattctgaatattaccagtctgcacaatattattcttatatccagatgaagccgatgcatcaacatagaatgtctgattgaaggtattagaacgatagaaggtcatatctaaattaatacggttgccaaggaatttagcattgacgcctagttcccatgattttgtattttctggtttcagattagtattataatgacttgcaggatattcatatgtatttgtttgctcattataagtatattgcatttgggtaaggtatcgattaggggaagaagcgacctccgcccacgaaccacgaactttcaaataagaaatagcttttggtagctttacagattcactaacaagccatgacagaccaacagacggataaaagtaggaacctttgctggtaaaagctaattgagatgcccagtcattacgcccagtgacagtcaaatacaattgatgattccatcctaattctgcacttgcaaaaacactttgtacttgatcatgccattttgattcattacgcttggaagtattgacattaatattgccataatggaagaaattaggaatttgctccaatcctccctttagatacatagcatcttcctgaatatcattaatagaagcaccaacagttgcattcaatgaaagtttgtcatcaaagaaattcttatttatgctagccattacatcagcataaacagaccgatcattttgtttagtatgtccataataacctttagaactactttctgtaaaagtacctcgtgtactagcataatacttttcataactatcgctatctgaattatccacacgtactcgccctgttacattcacccaatctgttatatcccatttcagactagcattaaacatataacgacgtttagaaagctcattctgcattcgattcataatccaatatgggttttgcatatccaaatcagtaccaaatatagattccggccaatattgtaccataaggtttcgagcctcactatagcgttcatacatctgtacttcctgaaagttttcacctcgtggaaaaagataaagagataccaagggattaaaatattgtccactacctaccatattcttattattttgaataatatattgagctcccaaatcaagactcaacttattatcacagaatttagcggtattacgaatagagaaattatagcggttataagcattattaggtaagatacctgtagagtttgtagtagagacagatgcgtaagtttgattttgttcagtaccagtggtcaacgtgaaaccattcatctccgtcattcccgtattgaagaagtcagatggatcaaagttgctaggagtatccatcaagctcccccaactgcctaactctccttcacgattaccataaatattctgaaacttcggcatcatcatcggagatgaaaaacttgtactattactataagaaatttgcacttttcctacagtaccttttttagtagtgataagaataactccattagaagcatccgaaccatacaaggctgcagcggaaggtcctgttaaaattgtcatgctctcaatatcttcaggattaatatcagctacgctattagatcctggctgtttgttcatcgtacctccagcattatctcctgaatttacattaaacattggaataccatcaataacataaagtgcattatcatttttctccaaagactttgtaccacgcataactacacgagccgcagccccagcaccggctgaagaagcatttattgttacgccagctacttttcctgataaagcattaataaagttagcatcctttatattagtcaattcatctccctttacttgctgtacattataactcaacgctttttgttcacgtttgatacccaacgcagtaactactacttcgtccaaggtttgcgtgtcttcacccattgtgacttttaggggttgggcgt

SEQ ID NO: 162 - DNA, 16608 bp, Bacteroides thetaiotaomicron
gttcattaatacattataatattaggaattacatttcggagacctattattcgtctaattcacaatcactaggatactaaactacgtaaatggtgtgtgcaacaagcaactattagtaaaacctttgattcttacgatcactatactgaaacctattacgcttcatctaacgcagtagcagcttcagccgagagaatctatctattcatcaaagagtatattacttacttatcagatgaagagaaagaagccatctttccggagaagtacaagaaaaaggatgattcttaacctcgtcctgtcttacgtgtagacggttttgtttcagatggcaatttaagaagcttacgacttagttcttcataagagtctttgacgtaaatacaatcatctttgctgaatcggataatagtgtaatcttcatctttatataaagattggataaaatcaatgttgataaccttttcaatatcataggcatcaatcaccttgataaaatttttcataacagtttcatttagtaaagaaacggaagccctgcatccggcctgagaaacttgattcagagctccgtgtctttcgattaaacattttaaaacgtaatctttaaaacattacaaatatgagcaaaaaaaatggttcggacaataatattgtcccaaatctcaaaaaattacccctcgcagagtattttgcagccttaccaaaggcagaacgtcgtccagttatcatatcagctcctaaagaagatgttattacagctattgtagaagcgacacaacgtaatcgtcatacagttcgttgctggatgtatggatatacccaacctaacagtatggttgaaaaaaagattgtggctgagatcttacaatcagatgtcgcaaccttatttcctgaaagaaaggaggaatgattatgactggaatggaattttatttcactcctaaaggtgaagttatgattatcgatgaatgtggtacgcgtcaattggaacagtcaaatcgggagtttatttccgaaatcataactcgaatgggaatattttggccagaagcactggagaaagcatcattggaatatacagaccgacggtataatattccttggtttgaattttcaatagtacgtcgttttcttaaatgtaattttggtgagttcgattcaacaatggatattgatcagatgggaaactttcactttgaggaggtcaaatgtccgttaaagggtgaatgcaaatatgaaggaataatctgtaaaccaaaatttaatagtacactctcggaacgtgagttaagcgttatgcgatcattttatgaagggatggaagaaaatgcaatagcagataagtattgcatttcattggaaactgtacgtacacataaacggaatgcctttaggcgtataaatgtccattccttggcagagttcttttagtatgctaggaaaaacaatctatttcaataacaagtaaactctaaaatcaatattaatcaggcagcatagcatagagatgcagatgtgtttcagtaaatcagctcaacaccattcaaaagttaaacaaagaaacagcctattagagattatggaaaattgcttcgaaatgatggtagcacgatgtattaagatcggaacagttcaaacgttgacgatgttaggactactccccgaagtagtaacaatatcacaagcggaagatatatacggaaaacgcctgattacagaatggcgcgaaaaagcctggatcaaattttatccggcaaataataaggaacgagggaaatattatgtgaagcgttcagaactggaaacagccagcgcaatgatggacctgcataataaagtaccggacaacattatcaaacaactaatgcaactaaccgtatgacccacatactctatcatttcgccgtttgttacgtttggcaggattcgtccggagtcatccatgtttccgggttggatatagtagctggtggctatatactgagattctctattatgatagattctaatttttatattggatgttccatcttgttttatatgtcttcctgtttggaaaacgatcgctttaaatgttgccatactgttttaatgttttttaaatgtttaaaattgcattaaacagcttggatcggggtaatttgataggagattgctttaatttcccctaaacggatgcaaatagagaaacatgttcaaagatagttcaaagaaataccctctttatttaccccaaaacggggtataattgtgtctaatttacataaacgaaaaaagctgatacaaactgtatcagctcaacaccatttaatttttcttaacttgaaattttcgtcggggtagcgggattcgaacccacgaccccctgctcccaaagcaggtgcgctaaccggactgcgctacaccccgaaaacttttaaccgaactcccttttcctttgtagtcggggtagcgggattcgaacccacgaccccctgctcccaaagcaggtgcgctaaccggactgcgctacaccccgctacttttaaagggttgttcttttcaaaagcggtgcaaagatagggagtattttttaattatcaataactaaatgaatgttttttattgattaaattacaatcgactgaaattcatctgtttgcaagtcaactttttttcttggcagaaataagaagcatcattggacgccgaagttcgtcttgcatttccggaatagtatccagcatcatttcactcggttggggctctatcaattcacaaatttcaaatccggtctgaagaagactattaatatatgtagttaaagtcttatgatacttcacgacttcttctcctaaaaaaatagcagtacgtttgccttcactgaagtagcggtctacaggccagtgagcacgttttccatcttggtcgtaataccaatcctgattaccataggctgtgaatatcggatgctctactgaaaaaacaaaagaacctcctgctgtgaggcagctgttgactttacggcatatattaataaaagattccagataatgaaaggtcaaggaactgattacgatatcataagtatccggttgaaagtcgaaatcctcgattgccatacatttatattcgatgagtggtgaagaatttcttttttgagcttcttccagcatcttcccggaaatatcaattcctgtaacacactttgctccatgttcgatggcatagatacagtgccagccaaatccgcagcctaagtccagtactctcttgtctgtaaagtccggtagcattttctgtaatatatgccattctccggcaccttgtaatccctctacagagcgtgacatttgagcatattggctgaagaagcggtcgtcgtcatatttattttctttcataacttcaatgaggttcatattagatgggcaaatatatgcatttatgcgattattgggacgaattaactgaaaataaaatcagataggatgaaccatcttttgctgttttctgttttcaaagtagaaaactaaaaataaaaaagccatatgaaaacggaaaaacaaaaagaaacgaatgaaaaggaagttcatttgttagaacaaaaaggatatgaaagaatggtcaatgagattgttccggtacaacaagcggaaacttaccgtaaaccgacccagaaagcggtaaaagatgctgtaaaggagttgaatcctgatacaaatagtttgggtagcagaggatgattgagtcctctgctattttaagtagacgatcagcaggcttaatgaatattcgggctataccggactcagattagtctattcgtttagtgaaaaaacgatcattctgaaaaaaagaatatttaaacaggcaggaagggctataattacatctgtcataagctaagaatcaataaacgcctgcatttttaaatagggaagtacataatttcattaattgtctgatatactgatcgacttgaactgctctttcccttgttgttgatcattaagctggatgaatggcttaaggataatcattatgctacttcttaccttgcttataattctaataaatcagatgaaaataagcaccgaatcgcctttttatctctttcccattaatgaaaaataggttcctcggtgagcaaggtagcgttggtttaaaaccaacgaggtgttccttttaagccaataagtgttttgtacatacgaaaagatgtatatattatgccgttttatgcaatattaggctgcgttttcgtatattattgcatttatttatgcagtttattttctggtttgttgcttttggtacaataatttttcgacgtaatcttaagaatagcacatcaagatgcaaatatcaaaggctcttatttaggaaaagtaaggataaaactgcttcctttacccacttccgacttaacattaatacttccttcatgcaaagtcatgatttgcttgcataaacttaatccgatacccgaaccggatgttttggtggtaaagaaaggaacaaatattttatccagcacatcgggcagaataccttctccattatcagatatcgttaatgtcgtatttccggcagaaagttttcttgcttttacctgaatcttcttatctgattttcgactgcatgcttcacgggcatttttcagcagattaataagaatctgttctatttgtgttcggtccacatttaatttcagttcgggtgagggaacctcaaactgaaactcttcttccggaaataatttctttaaatccgtgaataattccgcaatagaaatttgtgtacgaataggagcagggattcgtgtgagccgacgatagttctctacaaattccagtaatcctttgcttcttctgtgaatggtctgcatggcttgcagcataacagaatattctttttctcccagttgactggggattcctctctcgcttaatgtttccgaaagagaaatgattggtgtgatagagttcatgatttcatgagtcagcacgcgtatcagcttttgccaggcttccatttcattgcgttccaatacagaatgaatgttttttaaactgattaactgctgttctctaccttgagtggcaaatgtagtgcgtgatatggccatttccagcacagtgctattttgttcgatacggatgacgggggtgtcatgggcaacagaagctttcagcaatgtttccggcaattgtgatatttgtcctaagtgggtaacggccgcctgattcatccattctatatgtccggctttatcggcaacaagcactgccgtatcaactttgttcaataagttctcgtagtattggtgcttgatctcttctgccagcaatcttccccgaaaatcttttaaagtatccgaaagttcttccgcccattcattcattattttgttattgaaaggtggatggaaagtttgcatcatgtcattatagcggaggccgtctgtcaatcgtcgcaacagagcaatttgtttgaactgcatacggtaaagatgtattccaatggttatcagtaatataaggcagatggtagtactgaaccataactgcttttgaaatagcaggtagctgccgatagaaaacaatactatcagtaaaatatgtaaaattactctgaatgcaaatcgtttcataagcctagtttttcaagtttgcgatataaggcaaagcgggtaatacctaaatagtcagcagcacgtgagatattcccttcactaagtttcattgctttttcaatggtttgccgttccagttgttcaaggttcaaaacaatttcttcttcctttttttgcttgggggtgacgtggaactggaagttttcgggttttaataaagaaccgtctcccagtattacgacacgttccattgtatgttgcaactcccgtacattacctggccacgtatatttcagcaacttatttttggcttcccgtgtcaagccacgcatttcttttttatatttgcgtgcataacggtccagaaaatattcagcaagcagaatgatatcattcccacgttcgcggagcggggggatatgtatttcaattgtattaatacgatatagtaagtcctgacggaaacttccttcatccaccatgtggcggatatccgcattcgttgcgcaaatcagacgaacatcaataggcatggtctgtgtgcttcctaaacggctgatctgccgtttttcgatcgcagtgagcagcttcgattgcatgggaagcgaaagattaccgatttcatcaaggaacaaagtaccattggtggcaacttccatccgtccggcttttgacttttttgcatcggtgaatgctcccttttcaaagccgaacagttcactttcgaaaagttgttcggggatacttcccaggtcgatggtaacaaaaggtttgccgtatcggggggagtagcggtatagcagtcgggcaatcacgtcttttcccgttccgttttctcccaaaatcagaatgttggcatctgtactgctaagtttgtttatggttgcaaatacttcctgcatgatcggagattctccgataatatccccttctggagaactttgtccgctgagtgcttctacttgctcttttaagatgtttacctcccgttgagattggcgcagacgcataccggaggtgagagtagccagcaatttttccttctcccaaggtttggggataaaatctgttgcaccggctttaatggcccgtacagctttatctgtatccgcatatgcagtcatgaagatgacaatagcttgcggatcaatctgcaaaatctgcttcagactttcaaaaccttcctgaccgctaattgcatcacggctgaagttcatatctaataagataagatcgggctgaaaggtagtcataaaatgctcaatccggtcgggagtggtagctacctttatcttttctgtataaggttcgagtagtagattgagggcaaagagcacatcttcgttatcatctacaatgagtatctttcctagtttgttgacttcatccatagggtatggggtatatgattcgttacttatcctaaagttttaatgcaagggcaaagatatggataataatcatgtgttgtatgtgcgattgcgcactaaatttgtgcgtatttgcacgctgcttgtaacagcgtagtaaatgtaaataactgaattagaatgaaatataagaatggcacaggttttgaatagtaaataacaaataaacctaagaatgaatctgaaaatactctatataacactcggaatcctgtcgactgaactgctggctgctcaaaatcaaacaatggagatgtcgttggagcaggtggtgaaaatagcccgtctggaatcacccgatgcacgaactgcacgacatagctttcgttccgcttactggaactacaaatattatcgggctaactatttgccatctttgagtttgtcatccgatcctaatctgaatcgtgccatcaataagattacaatgggggacggttccgttaagtttgtcgagcaaaatctgttgaataccgatctgactttgaacctgtcgcagaatattccctggaccggaggttctctttttctcgaaacatctgcgcaacgcatggacttgttcagcgaacataaatactcatggcaaacttctcctgtcatgataggatatcgccagtcgctttttggttataatagtctgaagtgggataaacgtatagaaccggtacgctatcaggaagccaagaaaagttatgtggaaacactggaacttgtttccgccaatgcaattaataaattcttcgctttggccaccgctcaaagtaattacgatattgcttctttcaattatgcaaatgccgatacgctctatcgttacgctcaggggcgttacaatataggcacgatcacagagaatgaaatgctgcagttagaattgaatcgtctgaccgaagaaacaaatcgtatgaatgcccgtatagaaatggataattgcatgcaggaacttcgttcttatctgggcattcaggaagatcgggaacttcgtgtgcgtatcaactcgcaagtaccggatttcagtgtcaatctggatgaagcattggcattggcatacgaaaacagtccggacatacaggcgatgaaacgaagaaaactggaaagtgagagtgctgtggcaagagcccgtgctaatgcgggactgaaagcggatatttatctccgtttcggactgacgcagactgccgaaaagctgccggatgcttatcgaaatctgttagaccagcaatatgtaagtctgagtatcgctcttcctattttagattggggaagagggaaaggacaagtgcgggtagcccgttccaatcgtgatctggtatatacgcaagtggagcaaaatcggacggattttgaattgaatgtccgcaaactggtgaaacaatttaatctgcaaacacaacgggtacatatcgctgcccgtacagatgaaacggctcaacgaagaaatgaagttgcccgcaaactttatatactgggaaaatccactatccttgatctgaatgcttccattgccgagaaagatagtgcccgccgtaattacgtatcggctttgtacaattattggagcttatattacacacttcgaagtatgacactttacgattttgaacggaatatgctattgacagaagattacaatcttcttatagaatagcaacttacttagctttaataaataaaaatataaaatacctgataaagtcatggatataaaattagaaaagaaaccttggtacattcgatacagatactatctgataggcggacttttgtttgctgcctttctgatttatgtaattgttctgtcattaggcccccgaaaattacgtattgatgccgaaaatattcagatagcggaagtgaaagaggataattttatggaatatgtagatgtggagggactgattcagcctatactgactatcaaaatcaatacccgcgaagcgggaagcgttgaaagcatcgttggtgaggaagggagtctgctctatcagggggataccattatcgtcctttccaatccagacctgcttcgcagcattgaagaccagcgtgacgaatgggaaaagcaaatgattacctatcaggaacaggagattgagatggaacagaaaagtcttaatctgaagcagcaggctctgacgaataattatgaactggaacgactgaaaaagagcattgcccttgatcgggaagagtttcagatgggagtaaagagtaaggctcaactacaagtagccgaagatgaatataactacaaactaaaaaacgcggcattgcaacaagaaagcctgcgacatgattcggctgttacgatgattcgtaaagaactgattcgcaatgaccgtgaacgggagcgcaagaaatatgaacgtactcatgagcgattgaataacctggtggtgacggctcctataaaagggcaactaagctttgtcagggttactccggggcagcaggtttcttccggcgaaagcattgccgaaataaaggtactcgatcagtataagatacatacttcgctaagcgaatattacattgacaggatcactaccggactgcctgctaccgtcaattatcagggaaagaaatatccgctgaaaataacgaaagtcgtccctgaagtaaaagaccgtatgtttgatgtcgatcttgtctttaccggcgatatgcccgataatgtcagagtcggcaaaagcttccgtgtacagattgaattaggtcagccggaacgggcgcttattattccacggggtaatttctatcagtctacaggaggacaatggatttacaaagtgaatgcttcgaagacaaaagcaatccgtgtaccattaagtattgggcggcagaatccgcagcagtatgaaattacggaaggtttgcagacgggagattgggtaattacgacaggatatgatacctttggcgatgcagaggaattgatattaaaataaaaacacgcaatattatgaagattatacagttagctatccggaccttatgtaggtttaaaatatatacgattatcaatatcatcggattggcattaagtatggcttgtgtcattattatattccgttatgtggaacaggagcttactgtagacagctatattccggatagagatagaatagcttttcagatacaggaggataaaagttctcccggaagtcgttttgttaccggagctggtttctctgatccggatatagaatgcagttctactgtcttatggtataataaggatgtgattatcttggacaaagaacgcttcgatgtagaaaccattgttgctgatagcaactttgtgaaagtgatgaaatttccggtacgttatggtaatattgcttctttaaatgataatccacaaaacgtcataattacgcaaatattggccaataagctttttggtgacaggaatcctatcggagagaaaattacttattcaacaggtgatccgttgactgtgacaggtgttatcagtatgcaagatagaaaaagttcgatacattttgatcttttggtttcagataaactgcaagaagactgggtcgctacttttccagtcaatgtagtacttatccgccagggggcaaatctgaacacaataaatcaacgtcatgcggcatacgaaacagaaccccggactgaaaaagaaatacgaaatcagttgctatctataaatgacagctattttgattcttctgtcgtttcatacaatgatatgttactacatggaagtcctaaacagttacagcggttgtctttagttgctatccttgtgttgttaatcggcatattcaacttcatgagcctctatactgtgattttattgaagcggggaaaagagttcggattgaagaaaatattcggtagtactccgatacatttgttcgtacaactctacattgagaatttatttctcatagctattgcattatgtctttcctggtttttaattgaaatctctacaggatttattgaaatacagtttggaatggcacaacaaaaagagatagccttcgatggtctgttatctgtcttatttcttctcttgttaccggggattgctgtgatttatccttttttacgataccgacatattacacccgtccgttcattgcaaagtatatatattggaaataaactcactgtggtacgatatctctatttaagtgtccagtatgtcattacctttacactaattgttttgtctttgttttttgtcaggcagctatacgaaatgttgcatacagagacaggctatacaacggataacataatcagagcagagttccagatttacgatcgaaaaacacctacaactaaagaggaattcagagctagtttgagtagaagagagacttcttatagtcagatagatcagcaaatgaatgcttctccattgtttactgcgtggggatataattatcttccatacgaataccaacttgaaaatagcagctttaattttaaaaagccaatggacaatgattataaagcagttgctttgataccttctacagaatctacttcaagactttacgggttcaaactgttggaaggacgtttatggaatgatagtatagaccaggaaggagatgctaaattgattttaaaccggaaagctatgtcattgttcggatttaaaactcttagcaaagctgaacttcaaacagaaaatccgatatggccgcagaaaagtaattcgccctatcaaatcattggagtgatcgaagatttctattgcgggcacctgtcgaaacctatcggaccaatagcgtatatgtattgcaaaacctattccgatcaagtgcctatcgtggcagccatcgttcctggcaagcaacaggaagctatcgcctttttggataaacttcatcacgaaactatggatggaacatttgagtatgcttttgtgcaagatgagatcagtaatttgtatcgggaagaccggcaaattacgattatatattcttctttcgcacttctgggaattttgatttcttcattgggattgttcggactttcattgttcgatatccaacaacgttatcgggaagttgcccttagaaaagtgaatggagctatgatgaaagatattctgcctttacttttaagacagtacattttgatattgggtgcttcgtttgtaatagctatccctttagcttattggggaattaatgtttatctggaaaactatgcctaccggaccgacattagttggtggctatttgctttggcagccatcatcgtcttactaatttcattagtaaccttgatttatcaggtaagaaaggctattgctattaatccggctactattttgaaaggacaatgaaagatgaaaacatcaagtactattatataattttaaaaataatacaattatgatcaagacaattaatttacagaagattttcaagaccgaagaagtagaaacctgggcgttgaataacgtaagtatcgaagtgaaacaaggagagttcgttgccattatgggaccttccggttgtggaaagtcaacattgctcaatattcttgggttattggacaatccgacaggaggggaatattacctcaatggaacagaagtttccaagtacacagagtcacagcgtaccagccttcgtaaaggagtgatcggttttgtctttcaaagcttcaatctgatagatgaattgaatgtttatgaaaatattgaattgcctttgctttacatgggtatctcagcttccgaacgtaaaaagagagtggagactgctatggaacgaatggctatcacacatcgcagcaaacacttcccgcaacaactttccggaggtcagcagcagcgtgttgctattgcccgtgcagtagttgccaatcctaagttgatcctggccgatgagcctaccggtaatctggactcaaagaacggtaaagaagtgatggggctattgagtgaactaaataaggaaggaaccactattgtgatggtaacacattcacagcacgatgccggttatgccgaccgtatcattaatttgtttgacggacaggtagtaacggaagtcagtatgtaatatattcataaagtaccatgattaaacactatttgaaagtagcctttcgcaatttggtaaagtacaagacacagagccttgtcagtatcattggattagctgttggtttcacttgttttgcgctgtctgtcttatggattcgttatgaaatgacttacgatactttccataacggagccgaccgtatctatatggtacgtgcgcattatactgattcccctggtagtacatccaatgttactccttaccctttggcaaactatttacaggagaaaatgccggagatagaagctactgcttccacttccatatatcgggatatgaaattccgtatgggagataatgaacaggaggtagtaatggctacagcagattctgttttcatgaactttttcaatatacggctgctgaaaggaacagtcaacttcctgaaagaaaatgatccggaaatcgccattacggaagagtttgcccgaaagctttttggcagtgaagaggatgctttggggaaagaagtagaactgagcggacgtccccgtaagataggcgccattgtgagcggatggtcccgtcattccaatataccgtatagtgtattgagttcggcaaggcgctatccacgctggagtagtaagggagaacaactgtttatccgtgttcgcgcaggagtggatagggatacttttcaaaagaagatggaagacattgatatcttggatattcccaaagagagcgaacttgtgaagcttctgatcacgcccatttcggctttgcgttattcggattatgtttctaaagtagaggtagttatctccttcagttatattttctatttctctttagcaggcggattggtcattatttgttccttattcaattacctgacgctttatatcagtcggctttgcatgcgtagtagtgaaatggcgcttcgtaaagtaaatggtgcaagtaatacatctttatcggtgcagtttgccattgaactgttgttgattctatgtatcgccctgttatgcggactgttgatgatagaggtgagtatgtccagcttcctgaacttcacacagatagaggccagtgtatattatggagagatcattgcatatcttttgattgtaatcattctgtctttcctgtttgcacagatacctttatcttattttcgccgtcggacattgcaggaagcgataaaagggaatgtggtaactaccagaccttatctgtttcgtaagataggaattatcatgcagttagttgtcagtcttgcttttatcttctgtgcggctgttatgatgaagcaactctattttctgaaaaatacggacttaggaatggaacgccataatgtcggtaatgtagccttatggaatggtgatattaagcaatggtcggcgaagatagctgctttgcccatggtgacagaggctttgcccccttcgtatttcccgattattcctacaggaccgatgatgtatgtcgaaataaacaactgggatgatttgccgaaagcagtggaagaacctttaactgttggtatgatgcctgctaaagaagaattctttgaattttataaattgaatttattggaaggcgagtttatatcggacaagaatcaagaaaatgaagtcgtgatagatgaaaatacatgccgtaaatttggatggaaacgggctttgggcaaaagtttctatcatgaatataatggtcagcgtagcctatataaggttgtcggagtagtcaggaactttagctatcgttctcctacgagtgaaccgggactgattgcttttcagcatcctaaagcgcaagattatctgttgaatcgtgccagcattctgtttaaatttagagagggcacgtggaatgaatgccgtgcgaccatagagaaactgtacagagaggaattttcgaatgcgtatatgcgattgtttaatgaagaagaggaatataacaagtacctccgctccgaagatgcactgatgaaattattgagttttgtatcattggtttgcgtcattatttctgtattcggagttttctcattggtaacgctgtcttgtgaacagcgtcagaaagagattgctatacgtaaggtgaacggagcgcaaatccatcatatcctgcagatgttcttccaggaatatttattgttattgatcatagctgccgttattgcattccccacaggatatgttgtaatgaggagatggatcgacagctacgtgagacaaacatcgatagatggctgggtatatataagtatctttgttgtgatagctattattcttttgcttagcatcatttggagagtatggaaagctgcccggcagaatccggcagaaattatcaagagtgaataacataaacacaatgtcatgatatatcattatttaaaaatagcttttcgcaatctgatcaagtacaagacgcagagtattgtaagtatagtcggcttggcaattggtttcacctgttttgcattgtctgccctatggatacgttatgaaatgacatacgatacgtttcatgaaggggcggagcgcatctacttggcaggtaataaatttgatttgcagggagacggattttcttattattcatccagtttgttggctgattatataaagaaaaactgtccggaggtggagaatgcttgccatatatataatggaggtataacttccattgaacatgagaagaatgtatatcatacataccagttggaagttgattctaactttatttcaatgtttaatatcattgcgatagatggcgataatcgtttgagactgggggataaacaagttgccattacggataaaaccgccaaaaaaatattcggagaagaatccccgataggcaaacaattgctatttcctgacagaggaaatgctgaaatgacgattgtcgcagtagtaaaatcatgggaaggacattccatgtatccttttgatattttgttaccatataaagaccgagatccggattggggaagacagcaatgccatactcttttccgtatctatccgaatagtgatgtagaagctgtagagaagagactggcgaaatataaaatacaactggactcatatagcccggttatatctactcctatagctccgttatcaacattgaggagtactcatccgagggaggatatcaatgtcaaattgaatcatgttcgtctttttgcttgcattggagctttggttattatttgcggattatgtaactatttaacaatgcttgtaacccgtatccgaatgcgcaagcgcgaattggcactacgaaaagtgaatggagcctccaatggcaatcttctttcattactcctttcagaattgatcttgttgcttgtgctgtcattaggcttgggaatcatgatgatagagttaattctgcctgtttttaaggagttgtcgcaaatcgatgagagtacttcatacttttatagtgaagtgtttgtatatatattattattgttactgataac

SEQ ID NO: 163 - DNA, 16519 bp, Bacteroides thetaiotaomicron
acctatgacttattacctactaccgtctcaccttattatatatcttcttatcaaatttataataacgcgctgcacgatgggctactccctgctgtttttcttccaaaggaactacatattccatcatcgctattttcttatggaagttgcgcacatccacaggcttgtcatataccaactcaaaaagagtcctcaactgggcagcggtaaatttacgtggaagcaactcaaacagcatagaaggattgaactccacaaactgacggatataggtcattgcctctttaataatcagattatggtcgaaagccaatgtcattacatctttcaaagcaatccaacaggcctgatgatcatccagattcttgtccagtgcccggtctattttcaccatcgacagataagcaattgtcacgatacgttcaacttttgactgcatagcccgttccagccagcgtacatcctttggattgctggttctgtttttagagccgaatgccttgaattgcatcaggtttacatttctgagccccgtcaattcatacagtacacgttgtgctgcttcatccaaatcttcatccatatagataaggctaccgggaagtttcatatcgtgatacacttcaccattatcttcgcccgcacgttttacaagtaacactttgagttgttctccgtcaaaaccaatcactacacagtctactgatatgtgattgtttgccaagggtgcttttttctgtatactttgcatatccttttctttaatacgatgcaaatataggggcgctttatgattcgaacaataacaaatgacatgctataaaacattgtttttcatagatatacatatcatacaatctacaatatgagtacttagtgttatcttctgaattacaatatgtattttacccgttccggcaacgagtaattgtataaagtacaaaaagcggaatgactctttattatcagcacttttcatattcaccctttgtcttctccggcaacggacttattgtatttcaaacgatatcccattttgtatcttgccgtttttattctatctttgccggataaatattaaaaaatctaaaatggaacgtcatcccgtcattttatccattgccggttccgattgttcgggaggagcgggcattcaggcagatatcaaaacaatctcggcattaggaggctatgcggcatctgctatcaccgccgtcactgtgcaaaacactctaggggtacgcgccgtccatgcaataccacccgaaattgtttgcggacaaatcgaagcggtgatggaggacttgcagcctgtcgctataaaaataggcatggttaacgatattcagatcgttcatgtcattgccgactgtatacggaaatattcaccggagcacatcatttatgacccggtgatggtatctaccagcggccggaagctgatgacaaatgaagccatcgaagagattaagaaagaacttttgccgcttgtcacattagtcacccccaatatcgatgaagcaaaggtgctgacaggcaagagcatccaaaatacacaggatatgctggaagctgccaaacaactctccgacagttatcagatccatatcctgatcaaaggcggacatctggaaggcgatcaaatgtgcgacctcttatattctccggatcacacctattatatatatgaagagaaaaagatagaaagtaaaaacctgcatgggaccgggtgtaccctctcctccgctattgcaagctatctggcaaaaggatattcgatgaaagaatccatccgtcacgctaaagaatacattactcatgccatcattgcaggcaaggacttgaatataggccatggcaacggacctctgtggcattttcccgactccattgcacaaatgtgtacattttgtgcggtcgtatcataaaaatctgtaactttgcacccgcatttaaaaatcaattaaataataaagatatgaaagcatttgtatttcccggtcaaggtgctcagttcgtaggaatgggtaaagacctgtatgaaaactcagctttagcaaaagaattgtttgaaaaagcaaatgatatcctcggatatcgcattacagatatcatgttcaatggtacagacgaagaccttcgtcagacaaaggttactcaacctgccgtattccttcactctgttatctctgctctttgtatgggcgatgatttcaaaccggaaatgacagccggacactcactcggtgagttctctgcattggtggctgccggtgccctgagctttgaagacggattgaaactggtttatgctcgtgcaatggctatgcaaaaagcttgcgaagcaactccttctacgatggccgctatcattgcattgccggatgaaaaggtagaagaaatctgtgcatctgttaatgcagaaggtgaagtttgcgtacctgccaactataactgcccgggacaaatcgtaatctccggttctgtaccaggcatcgaaaaagcctgcgaactgatgaaagctgccggtgcaaaacgtgctctcccattaaaagtaggtggtgctttccactctccgttgatggacccggctaaagttgagctggaagctgctatcaacgcaacagaaatccatactcccaaatgtccggtatatcagaatgtggatgcacttcctcatactgatcccgcagaaatcaaaaagaatctggttgcccagctgactgcttccgtacgttggactcagtctgttaagaatatggttgccgatggtgctactgattttacagaatgcggaccgggtgcagtattgcagggattgatcaagaaaatagatggtacagtaagcgctcacggcattgcataagcattcgtagatatactttaccttttctcaactatagagcgtgtcgactagtttgccgatacgctttttttatgcttattagtcaaacatgagacaattaatatgctgtaaaacacaccattagtcttctctacgagcaaacattccgaatctttcacttgttttcattataggaatcatttattcaaattcgcggaccatgaaaatacatgaatatcaagcaaaagaaattttctccaagtatgggatccctgttgaaaggcataccctatgtcgaacggctgccggcgcagttgccgcatacaagagaatgggctcggacagagtggttattaaagcacaagtgctgaccggcggacggggaaaagccggaggtgttaaactggtagataatacagaagatacctatcaggaagctaaaaacattctgggtatgagtattaaagggcttcctgtcaatcagatactggtcagcgaggcggttgatattgccgcagaatactatgtcagcttcaccattgacagaaacacacgctcggtcatccttatgatgagtgcgtccggtggtatggatatcgaagaagtagcccggcaatcaccggaaaaaatcattcgctatgctattgacccattcatcggtctgcctgattatctggcacgccgtttcgcattctcgctcttccctcacatagaacaagccggcagaatggccgctattctgcaagcactctacaaaattttcatggagaatgacgcatcgctggttgaagtaaatccattggctcttaccgccaaaggcatattgatggctattgacgccaaaattgtttttgacgataatgctctttaccgccatccggatgtactgagtttgtttgatcctacagaagaagaaaaagtagaagcggatgctaaaaacaaaggattcagctacgttcacatggatggaaatataggctgtatggtaaatggcgccggacttgctatggcaacaatggatatgataaaacttcatgggggaaatcctgccaacttccttgatattggcggtagttcgaaccctgtcaaggtggttgaagctatgaaacttctcttacaggacgagaaagtaaaggtcgtcctgataaacattttcggaggaatcacccgttgtgacgatgtagccatcggtcttattcaggcattcgatcagattaagagtgatatacctgtcattgtccggctcacaggaaccaatgagcatctcggacgtgatcttttacgcaaccatagccgttttcagatagctacaactatgcaggaagccgctttaatggctatcaaatcttaagatgaaatcacataaaaaatgaaggaacaatgagtatattaatagataaatccacccgtttgattgtacaaggtattaccggtagagacgggctttttcatgccaagaagatgaaagaatatggaacgaatgtcgttggcggcacttctccgggcaagggaggtacggaagtagacggtattccggtattcaatacgatgcatgaagctgtaaaacagacacaggctaatacttccatcatctttgtgccggcccgttttgcagcagataccattatggaagctgcggatgcaggcatccggctaatagtctgtatcgcagaaggtattccgaccctggatgtcatcaaagcacatcggtttgccgaacaaagaggggcaatgttggttggccccaactgtccgggacttatttctcccggagaaagtatggtaggaatccttccgggacaagtctttcagaaaggaaatgtcggtgtcatcagccgtagtggaacactcacttatgaaatagtatatcacttaacgactaatggtatgggacagtctactgcaatcggcatcggaggagatcctgtggtaggtctgcatttccttaaactactggaaatgttccagaatgatcctgaaacgaaagcaattgtgttaatcggagaaatcggaggaaacgcggaagaacaggctgctgaatatattcgcagtcatgtaaataagcctgtagtagcatttattgccggacagtctgctcctccgggaaaacagatgggccacgcaggagccattatctcgggaggttccggctcggcaaaagacaaaatagaggctttagaagctgccggcatacgagttgcacaagagccttcggatattcctaagttactgaaaagataaacagaaccacacggagaaatagagctttgggcttttgtttctccgtgtggttctattttatgtaccaatatatccccgcgatgataaagtaatatctgaaatttacattccctttttcacgcctaactttattaataaagcattcatcggataagcacagaaaaagccaaaaagcatagccagctgcatcataaaccaaaatatccatgtgtctttaggcaaaggctcattgacaaataaaacaaaataaacgattgccatccagccatacattccgatttgccaagacaacagagaaaagaaatctgctttaaaagcacgggacagtacctttcccaccgatatcctctccatctcccgaatagcatagaattgaaaataaactccgatgattaacgccaatataaaatcaagtacccagtttcctataagctgacttcctgcaacggttaccgggatataattagtgaaccactctcctattatatcagccaatgtgcagcctgctccacaatgtaaagccgataaagccacagactgccaatgaggatgtttcatggacatatctcccatcgacatatccatattcatgtctttcataccggacatatccattttcatttcaccacctcccatcttcatgggagcaccttgtccgaacttattataagcccataaagctaagtaacttccccacaatgcagtcaatatccatactgcattcattatcttcattgattgtggacgatgtgtcagatcgattgctatgtgaactgcaattccgatacctgaacagactaaaaacacggctaataaattgagcataattgtatatttaaaaagattttagactacaacagcccttatttataaatagttcatcccgtccatttttaaattcatcccatcgaactattctccttactgtttgtttataattttattaattaaatattgaattgtatgagcagacgtagtcaattagagcatgaagtatctgttgctcaggaaagaattaagaaggcagccaaagatacaccgaaagatatcataaagttatgggaacaagacttggtagacttggaacttgaactcaataacctggtagatgatgaagaagataataatgaagattaactaaaagagggtgcacttcattgtgaagtgcaccctcttttagttgtagtatttttataagcagaatgcttttattgcttatccacagtggaaatacttatgtaccagttccagcatttcttccggtttgccttccatgtcggcacgtaatgttttgtcctcataactacggagcttgcgtataataccgtcaatcatagccggactaaatacattatattgctcgaagacagcacgttgtttttgcaaacattcggcagatgccgcacaactatccggcaattgagccaatgctttcagcttgtcctcattctctttctgatggatatttacatttacatacgttctctttgcaatgtccaatgcctgttctatctcaaaaccatgacggcaggcaacagccagtcccgcaagcagctgatacaaatctgccgaaccatccggagaacgcatttctaccgtttgtttctggctggtatcaaaatgactttcgctttccaatggatttgccaaagtacacatatcggtcttggcagcccagcccaacggtacacgcaccaatacagaacggttgcgatctccccagcaaacattggtcggtgcttcctgatgaggaaccaaacggaagtaagaagtaggattggtatttccgaaggctgtaatagaaggagcaagttccatcattccggcgattgccttacgggctgtttccgacaatacaccgtctttcagcatctgattttgtccgtcctttacaatacgcatgtgaacatgtagacctgacccggcttttccagccgtaatcttaggcgcgaatgtcacattatacccatatctgtatcccaagttacgaatcacccatttggcaatcatcaattgatctgccgcatcttcggcatgaacaggcaggaactctatttcgttctgttcataaatcatgccatccaatgtaaaattcccaacctcggaatgaccatattttatctgcccacccgtctgagctatatatgacatacactgcgtacggaaatcgttaaacttagcatacggagcagattcatgataaccgcgttgatctgtagcctgaaacattcctgtatccggtgaaataacatagtattccagctcacccatcgcctgaaactccatacctgtgacatcagtaaatgctttacacgctttatgcaaagtatgttccggagaactttccaatggctcaccgtctttattgaagaaagaacaaagcatcgaaagtgtcggtatttctgcaaacggatcgacaaaagcggtacggaaacgaggcactacatacaggtcgctactccccgcctctataaaaggaaacaggctggaaccgtccacccgctctccacaagtaaggatcgcatccagataagccgcattattaattacaaaattcaatgttttcagtcgcccgtcagcagcaggatacatgaaattgaccatacggatattattcttctgaataaaagaaataatatctgccttagtaaactcggcggcaggcttttccaaagcagccaccagacagttaggattcattaaaagttcttgattcatcttctatcggtttgttgttagtgaaccaaaggtaagaaaaaaataaccgcagacaataaaaagagagataaattctttggactttaagaaatagtccggccaggattctgcagaaacgaaagaaggtgtgttgggatcaccaacacaccttctttttatatactgattgttattcagtcaattagttcttcggcaaagcctctttaactaccatcggacggcctacatattcagcaccattcaattctttgatagcgttagctgcttctgtatcatccggcatttcaataaaagcaaagccttttgatcttcttgtttcacgatctgtgattaatttaactgaagcaactgctccatactcttccattacgtttctcaagtctgattccttaacgttatagttaagatttccaatgtacaaattcataaaatacaaatataaaaaattaataatttcaataacaaagttctttggaagttcttaatcagagatggatatgctcaataaatgagaagattcatgtgaaataatcaaatcgaaataaaccttttattgtttagtgagtgcaaataacggcatttcgcgggaataatgcactatgttctctcctttttcttttgcaaaatacccttttttatgaaataagaccaaaacttaacgtatgggtgttccagtgagagtctgtaataaagtcagaatccatattgaatgctttgcgcaaactctatcccggtgataccgggcacctgaatatcaaggatatgatcagaaatacccctatgacttttaatgctgaatataatgttcgtttcactgacatggcgataaagttactactttttcagaacttatacttcattcccatcgaaacatatacagccggtttgaaataagggtccgtatctctggacatatcttcgaaaaaggccttcagtgtacgtgttgtgtaataagcaatccggctgcacgataatcctcccatctctgctatcagacttagcttcagatatttattcagattcattcctgccgatagttccatcatagaaactttgatctgatagcgtccctcagtgctccatcgctccgtataccaaacgtatattttcggactttattctttgctccttacttttttattttaactttgtacgtagataaaatacctaattatggaaataaaaaaattcatcgaaaactatcgggaagcttttggcgaatatgctgaattgcctatcgtattctggtactcggacattcttgaaaatgaaaccgggaaagtgaacggatgcttctttaaaagcatgagtaaagtcaggggaggtaataccatcagtctgaatgcggaaacaattggttgcggcggtggtaagttttataccggattcaccgatatgcccgagcacgtgccgacgttcgtatctctaaaggaacgatataagcagacgccggaaatggtaaaaagctttattgagcaactaggagtaccaagggcagaaaaggaatatctgcattttgcccgtatagataaagtggaaacgttcgatcatttggaaggaatcctttttttggccaatcccgatatattatccggactgaccacctgggctttcttcgataataataaggaggatacagtgatttccactttcgggtcgggatgcagttctgtggtcacacagacgattctggagaatcgtaaaggcggatacagaacattcatcggcttctttgatccatctgtacgcccttattttgaggctgatatactgagttataccattccgatgtcgagatttaaggtgatgtatgagactatgcgcagcagttgcctgtttgacacacacgcatggggaaagattcgggaaagaaaccataatagctacaaagaataagaatatggattttatacttcgtccatggaaagtatctgatgccaaagccttagcaaggcatctgaataataagaagatatgggataactgtcgtgacgggctgccttttccatatacagaaacagatgctgatgccttcattaaatacgcttcggaacaagtggaacagaatgaatattgcatcgaggcgaatcatgaggcaatcggtaatatcggattcgtccgcgggacggatgtcgaacgcttcaatgcagaagtcggttactggatttcggaaacatactggaacaagggccttgcaacagctgctttagaaagagctatagaacattattttcagcatacagatgtaatacgcctatatgctacggtatatgaacacaatgccgcatccatgcgtgtgctagagaaagcaggatttcagaaagcaggaatacatcgtaaggcttgcttcaaaaatggccagttcattgatgcacattattatgaattacttaaaaataagtcgtaagcctccttgctttgttaccgtatatattactgccgactatctttatacagaacctaatacatcgaacgagaggtcccaattcatcacgaaccggaacctctctatgagttattactttcgaagttttactttatctctttaacttcttctcctttttcattcagaagtacggttacttcctgggcgtcttttgtagtgataattactttataaaccttaccggtttctttttcggcaacatacgcttccttgatggtagcatcttcatagcttttcgttattgcctgtgtcactgcttccggcaaatctttcacttcaatctttgtatactcatcctgtggagcttgtgtctgagtttccactgccggagtgttacttacttcctgtgcgaatgctacagaactacctaatcccaataccaatgctactgctactaatacctttttcataatcgtaattttttaagtgtgaataatagaactattgtttcttgtacttaatatatagcaaagcagatgccaaacgtttcactccgccatatataactgataatcaaacatataaacagcagacaatataaatataattgtggaattagtgtggaattatgtagaatctgttgatacataattggggaattactattcaacgctcttaatttggcaagaactgatttctttattcaactgttatatacctataacaacctaattatacaacaatgaaaaaagaagtcttaaaagagcttacagccaaaccggggaaggaacatcatgtatccgatttcaatccctcatttactgctgatatgtccaaacaggatgccaaagaacagttagcccaaaatatcgaaaagctgtcagaactgcaaagtatgctttatgcacaagaccgctactcggttctggttatttttcaggcaatggatgctgccggaaaagacggaacgatcaagcatgtaatgtccggcatcaatccgcaagggtgtcaggtgtactcctttaagcaaccttctgccgaagaactggatcatgactacttatggagaattaatcgttcgctccccgaacggggacgaatcggaatcttcaaccgttcccaatatgaagatgtactgatagccaaagtgcatcccgaaatcctgttatccaacaagctacccggaatactaaaagcgaaagatatagacaacgaattttggaaacgccgctaccggcagattaatgatttcgaacgttatctgactgaaaacgggacggtcatcatcaaattcttcctgaacgtttcaaaagccgaacaaaagaaacgattcatggagaggctgaacgatgaatcaaagaactggaaattctcttctgccgacgtcaaggaacggcaatactgggacgactacatgaaagcctactcggatgtactgacagaaacttcaacagagattgccccgtggtatgtgattccggcagacaacaaatggttcatgcgatatgccgtcgggcaaattatctgtgaacgcatggaaaaactggacttacattatccacagttatccaaggaggcgctggaaagacttgaagaatgcaagaaaaacgtatccgatattaatttctaaacaggatactttctcagagtttaacgggttatttctgtcaggacttgacaaagcccttttaatgttgtatatttgtaagcagaacaataataaacctataaaaccgtaaccaatgaaaagaagtctgtctttcaacatacctgctgtaatgtatcacatgaacggtaacatacagtcaagattgatcagtccgtaaggaaagtacaatattacaacaagacatatctatttccctataacaaataagatatgagtcatcagtatacaagctgaaggctgcgacttccaatggaaatcgcagccttttttgttgccaaatttcagcacagaaagccataaacgggattacatcgtttataataaactcagataccgttttactaaaactatcacaaagtttattataaacacaaacaccgatgattcataaatcatacatttttttcattgtcaccggaaggagaaatccactgttccggttcacgcacttcaatgaataaacaaaaagcgataaaataatacgtttcattgaaaatttgtactacttttgtaaacatcaaagcccaatcatgatttgaccggccaagaaattatgagaccgattaaactttttcaaacgagaatagtctaatctttaagatatcatcaatctaaacattaaagtcatcaatgaaaatggaaacatccgccaaactctattcgctgaattacagcaatgtgaaaacttacctgttcgccctgttattcgtagcaggcaacatcgcacttccacaactgtgccacctcgttccttacggtggaccgactttattaccaatttacttttttaccttaattgccgcttataaatacggctttcgggtaggattgctgacagctgttctttctcctgtcatcaatcatgtcttgtttgccatgccatccgaagccgttctcccgattatactgataaaatcaaccttgcttgccggtgcttccgcccttgctgcgcgtaccgtgaaaaccgtttctttgttagccgtccttggagtaattctctcctatcaactcataggaaccgcttttgaatggatgatcgagggagatttctatatcgcagtacaagacttccgtatcggcattccgggtatgctcattcaatggtttggcggatacgccctgctaaaggcaattgcaaaactctaaactaaaaaagaaagatggacagaagggatttttttaagacagtagctattactggtgccgccatgactatacagcgttcagaggcgatggaaatactgactcagacaatcaataaagcaaatggtgacaaaccggacctggtggccgtcatgggcggtgaaccggaagccatgttccgtcgtgctatcagcgagctgggcggtatgaagcaattcatcaaacccggacagaaagtagtggtaaagcccaatatcggatgggataaagtacccgaactggcaggaaacacgaatccgaaactgatcacggaaatcatcaaacaatgttttgccaccggagccaaagaggtcaccgtattcgaccatacctgcgacgattggcagaagtgctacaaaaacagcggtatcgaagcggccgcgaaagaagccggagccaaagttatgccggcccacctggaatcttactacaaacccgttgatctgccaaagggacaaaagatgaagaaggcgaaaatacatgaagccatcctgaattgtgatgtatggattaacgtccctatcctgaagaatcacggaggcgccaacctgactatctccatgaaaaaccatatgggtatcgtctgggaccgcggctttttccaccagaatgacttgcagcaatgcattgcggacatctgcacactggaaaagaaagcagtgcttaacgtcgtagacgcctaccgtatcatgaagaccaacggaccgcgaggtcgttccgcttcggacgtggtgctggcaaaaggtctctttatttcaccggatattgtagccgtagatacagccgcagccaaattcttcaatcagatacgcgaaatgccgctggacaccgtaggtcaccttgccaaaggagaagcactgaaagtaggaacgatggacatcgacaaactgaatgtcaagcgaattaagatgtaaaccaccatgttaagaaagatacgtatcggaatatcagtcgtcctttttgcactgattactttttattttctcgattttgctaatattctgccgaacagttttcatcgattggcacatatacagtttgtccctgccgtgctatctctcagcataggcatactgattgtactgattgcgttaaccctgttgttcggacgtatctattgctctaccatctgtccgatgggaatatggcaggatgttatagcacgcatttcaaagtctgtgggaaagaagaaaaaaagatatcggtacagtcctgcaaagaatatgctgagatggaccgtgctcggagtgactgtaattgcctccgtatgcggcttctcagtggtattgggattgctggacccgtatagcgcatacggacgcattgtagtacatatcttcaaaccggtgtatatgctgggaaacaacctgctggaatccgtattttccagattcgacaactacacgttttatcaggtagacacctcggtattaagcctttcttcccttcttatagcgatactgacctttgccgccattcttatattagcatggaaacatggacgcacgtggtgtaataccatttgtccggtaggtacggtattaggatttttgagccgttactctttgttcaaagtccgtatcgataccgcaaaatgtaatggttgcggactttgcgctaccaaatgcaaagctgcctgcatccacagcaaagaacacgctattgactatagccgctgtgtagactgtttcgactgtctcggtgcctgcaaacagaaagcgctggtttacgcccctgcttcaaagggacaacaacgttcttccgctacagaaaaacaaccggtggcaacagaatcatcttccgttgctgcagattcttccaaacgtcgttttctgcttgccggactggctactgccggagcagctcccacgcttcttacaaaggcgcaagaatccattgcgacgatggaaggcaaaaaggcatacaaaaaagaaaatccgattactcctccgggatctgtcagccagaagcgtttccagcaacattgtacatcatgccatctttgtgtcagcaaatgcccgtcgcatgtactgaaacccgctttcatggaatacggtctgggaggtgtgatgcagccaacggtcagtttcgaaaaaggattctgtaatttcgactgtaccgtatgcagcgatgtctgtcccaacggtgccatccctccgttgacggtagaacagaaacatctcactcagatgggctatgtcgtctttatagaagaaaattgcattgtcctcactgacggaaccagttgcggagcctgttcagagcattgtcctacgcaagccattgctatggtaccctacaaagacggactgactcttccccacgtcaatacagagatctgcgtcggatgtggcggctgcgaatacgtctgccctgcccgcccgttccgtgccgtatatatcgaaggaaaccctgtgcagaaagaagcgaaacctttcaaagaatcagaagaacataaagttgagatagacgatttcggattctagcagcatcagccccaaatatggatagctttcagaggattgtatacaattcaaaaaaactatccattatattcctcctactttcaataaattcactaaattcgtggcgaactaaaaaaagaaagtaactcatggaggtattcacaaataactggaatagccgtaaatatcagataggctatgctttaagcggaggatttattaaaggatttgcgcatttgggggtgatgcaggctctgctggagcatgatatcaaaccggacattatctccggagtaagtgccggtgcgcttgccggagttttttatgccgacggaaatgaacctcaccaagtgattgaatacttctccggccataagtttcaagacctgacaaagttagtcatccccaagaaaggactatttgatctctgcgaatttattgactttctccataccaatctgaaggccaagaatctggaagagttgcaaatccccttaatcatcacggctaccgatctggaccacggacgtatggttcatttccaccgtggctccatagccgaacgtgtggctgcttcctgctgtatgcctgtcatgtttgctccggtcaatatcgacggaaccaattacgtagatggcggattaatgatgaaccttccggtctccacccttcgcagaatatgcgacaaggtggtagccgtcaacgtaagtcccatcatggcgcaagactataaaatgaatatcgtaagcattgccatgcgctccttccactttatgttccgtgccaatactttccccgaaagagaaaaatgtgacttgctgatcgagccatacaacctctatggatacagcaacaccgaactggaaaaagcagaagaaatcttcgagcaaggttataagatagccaatgacttacttgaccagacactggcggaaaaagggaaaatatggaagtaactccttacttttcccgaaaatatttataatatgaaataaaatctactctatatgaac

SEQ ID NO: 164 - DNA, 16490 bp, Bacteroides thetaiotaomicron
acactatagattgcataatcaataagtaacatgaaatatatttgtatcaaaactgtagcaatttacttgctcgcaaccttacctttattggcgaacgcctcaacacacaaggtaaaaattacacatagcgtcatggttggggacggaatcgcaaaattcatcccggaaggcttcgacgctcaaaagataccttcttttgcaatagaaaaagaaccacgcgaacaaggagcacttcctgccgactgggtacttgttcccgagttctcactcacggatggtaaagcaaacgcatcattaacagtgccggaaggtacaagcatctatggcggtggtgaagtgaccggttcacttctgagaaatggaaagaccatcaaattatggaatacagactcaggagcttatggtgtagacaaaggtactcgtctgtatcaatcacatccttggatgatgggagtgcgaaaggacggaacagcttttggaattttattcgatactacttggaaagcagaactaagcagtacagacgaaaaaatcgaattaaaaagtgaaggaataccctttcgggtattcatcattgacagggaatctccacaagcagtcattcgcggactatccgaactgaccggcacaatgccaatgattcctcgctgggcactaggttatcagcaatgccggttctcatattctcccgacagccgtgtcattgaaatagcagatactttcagactaaaaagaataccatgtgatgttatctggatggacattgattatatggacggataccgcatctttacctttaatccgaaaagttttccgaatcctaaagcggtgaaccgtgatttgcacatacgtggattccattctgcatggatgattgacccgggagcaaaagttgaccctaactatttcgtatataaatcgggaacagaaaatgacgtttgggtgaaaacagcagacggtaagaacttccacggtgatgcatggccgggagcagcagcattccctgattttacttctcctaaagtaaacaaatggtggagaaacttatataaagattttctagcacaaggagtagatggcgtatggaatgatgttaacgaaccccagatcaatgatacgcccaacaaaacaatgccggaagacaacctgcatcgtggaggaggaaagcttccggcaggtacacatcttcagtatcataatgtatatggcttcctgatggttaaagcatccagggaaggtatactggatgctcgtccagaaaaacgtcctttcattctgacacgttccaacttccttgggggacaacgttatgccgctacatggactggcgacaacggttcttgctgggatcatctaaaaatgtcagttcccatgtcattaacattgggattatccggtcaaccgtttagtggtgcagatataggcggtttcttattcaatgctgatgctgacttattcggcaactggattggtttcggtgccttttatcctttcgcacgtggtcatgcttgcgccggaacaaacaacaaggaaccatgggtatttggacaaaaagtagaagatgcctcacgcatcgctttggaacgtagatatatactactaccctacttttatacactcttacacgaagcctcaactaatggcatgcctattatgcgtcctgtcttcttctccgaccctaaagacttgtcactgagagcagaggaagaagctttccttgtcggtgataatttacttatcattccagcatttgctaatcaaccggcacttccgaaagggatctggaaagaactgtcacttgtagaaggagatcagaatgataaatatcaggcaaaaatgaagattcgtgggggagctatcattccgactggaaaaataattcagaacactacagaaaattcattagatcctctgacattactagtgtgtctggacgaacagggcaaagcttccggaaatatgtattgggatgcgggagatggttggtcttacaaaaaaggggactatagcctgctacaatttgtcgcagagcgaaatggtgataaagtgactgtaaagctaacaaagaaaaccggaaaatacaacactgagaataaagacatggcagtgattaaaattataacagatcaaggcatacgtcaagccagtggaaatctagtggaaggtattgaaataagactataaaaaagcactatactttgtttggaaacctaaaaaaaaagttttatgaaaaaagagcacatgaaaaagcaatatccccattggtgcggggtattgctactgtatctgatggcatgtattagtagttgccaagacgacaaaatcagttctagcggatatgatccgtctaaacctgttgtttttacagatttctctccaagtcagggaagtctccgtactcagctccatatctacggtgagaacttcggaaacgacccatcaaaaatttatattactgtaggagggcgaactaccactacaattggctgtaacaataatgaaatttattgtatgatacccccaaaagcttttgatggaaatataaaaatatctatcgaaagtgctgatgggacgtcttcacccatagaatatgaatttgagagacgtttccaatatgtatctcaaacttcagtaggtacattagtaggaaacgaagatgaacaaggcaattcttctgatgtagatggagattttgaaaacgcaaggttcggaaatgcagaatggttgttaatggatacattcggaatacaaaaatgcttgatcgttaatggttttaaaggacctatccggagaatcaatctggaaactcaagaagtatccacacttatgactgaagggcaaggattgtttggaggtatgtactacatgtgtttcgatgcgactggagacactttatttgtatcagacgaccacggacaaagtaacaaagaccgaagagagattgcctacctgctacgctctgaagacttccgaagagcaagaccttatgtttatgatcgtactggatatagttgcgcttatcaacctttgacaaaaactctatattataccgtttattggcagggaactattgacaaagccgtttttgacccgacaacacaaggaatggtagcaaaagaagtattcccaacatatgaaagcaggaatgaacatgcctacctaacagtacaccctgaaggtaaatatatgtatattacaggagcaaattgcctttataaatccatgttcaatccagaaacaaaagaattccaaaagccaacaatgtttgccggttctgaaggagccagtgattgggtagactctcccggtacatcagggcgtttcgtatggccttatcaaggcacatttgtaaaaaacaaggattacatagaagctggtaaatcagatatttacgatttttatctttgtgatagaaacggacattgcatccgtaaaataactcctgacggtatcatctcgacttatgccggcagaggtagtgtatcttctgatggacgagtaaacggatacatagacggcgagctacgcacagaagcacgtttcgacagtccttgtgggatcgcttatgatgaagaaacacaaacattctatatagcagatagagaaaaccatcgaattcgcacaatttctgtagaataaactataaaaacacatttcgaatgaaaaaatatattttaagtttgttttttctaattagctgtgtgcttaacacatacgcacatacagaaaaacaacaacaagaaaaaatagaaatcagcggcattgttctggatcagaataaagagccacttgtcggagtaaacgtttccgtaaaagacatacccggactaggtgctattacagatataaacggtaagtttaaaataaaggttgaaccttatcaatggttagtattcacttttataggatttgataaacaagaaatacttgttaaagaacaaaagagcatcaatgtcattatgcaagaagcaaaagcaactgctatcgacgaggttgttatcacaggaacaggcgcacagaaaaaaattacaatgactggagcggctactacagtagatgtaaatacactgagaacttccacttcaagcattacaaatgcgttggctggtaatgtagcaggtataatggcacgccaaacatctggacagccaggcaataatatatctgaattttggattcgtggaatttctacttttggtgcaggttcgggtgcactagtattaattgatggattcgaaagagacatgaatgagatcaatattgaagatattgaatcatttactgtattaaaagatgcctctgcaacagcaatatacggttcacgtggagcaaatggggttgtattgattactactaaacgtggtaaatcaggtaaggttcaaatcgatgcaaaggttgaaactacttacaacacacgtacatatacccccgaacttgttgatggctatacctatgccaacttaatgaatgaagcacgtactactcgtaataaggaagcattcttctctgatgaaaagctatacatactccgcaacggattggacaaagacttataccccaatgtagattggatggatgtactcttaaaaaaaggggcaccaacttatcgagcaactttaaatctgaacggtggtggctcgcttgcccgttattatgtatctgttagttacgtagacgaaggaggtatgtataaagtggacgaaggattaaaagactataacaccaatgcaaattacagacgttggaattaccgtctcaacgtagatatggatatcacaaagtccaccttattgaaagtaggagtcgcaggttcactagataaaaaaaacgaaccaggaatggcaggaaacatttgggcatcagccatgcgcaacaatcctatctcagttcctgtgatgtattccaacggatacgttcctgcctacggttcggagaatgatcaactcaatccgtgggtagccgctacacaaaccggttatcaagaaacatggaacaataagttgcaagccaatgctactttagaacaaagcctcaactttattacaaaaggattaaaatttattggccgttacggatttgacacaaacaactatcagtggataaaccgtaaaaaattccctgaaatgtggagagcagaacaaaatcgtgcttctgacggaagtttagtcatgaaaaaaatcaaagacgaacaactaatgacacaagaatcatcttctaacggaaatcgtaaggaatatctagaagccgaactgcattatgaccgtacctttggagaccacattgttggagcagtatttaaatattctcaagacaaaacgatagatacctctcagaatggaaatgatattatgcaaggtattgataaacgccatcaaggacttgctggacgcttcacctatggatggaaataccgttatttcttcgatttcaactttgggtataacggttccgaaaactttgcaccgggacatcagtatggctttttcccagcttattctgcagcatggaatattgcagaagaacctatcatcaaaaaacatttgaaatggatgaatatgttcaaactccgttattcatatggcaaagtcggcaatgacgtcgtaggagacaatgaccagcgtttcccctatttatctaccttcggtgccagtgggggatttaattatgcggacatcggacaaaaatatgaatttacaggtttaagctacacacattacgctactacagccgtaacatgggaaatagcaactaaacatgatattggtatcgacttctctttatgggacgataagttcactgggacaattgactatttccacgaacaacgtgacggtatttaccaacaacgtaatttcattcccatttctgttggtctgaacggagctatgagaatatctaccaatattggctctgttttatccaaaggatttgatggaaatttcggattcaaacaacgtatcggagatgtgaacctcactttacgtggcaacttcacctatagcaaaagcgaaattttggaatatgacgaagaatatagcaactacccatacaaaagccagagaggtttccgagttgatcaaacccgtggacttatcgcattgggactatttaaagattatgatgatatacgcaatagccccaaacaatcttggggagatgtaatgccaggtgatatcaaatacgcagacgtaaacggtgatggttatgtaaatgataatgatatagttcctattggagctacaacacgtccaaacttagtttatggcttcggtctctccggacaatggaaaggtattgacattaatgttttattccaaggatctggaaagtctactttttgcattgatggtcccactgtatatccatttgaaaatggagactggggaaacattctaactgatgtagtaaaatcaaaccgttggatattaggtgaaaatgaagatccaaatgctaaatatcctcgtttgagctatggaggaaacagcaataactatcgcgcctccacttattggttgcgtaatggttcttacctacgtttgaaaaatttagagataggatatacaataccaaaaagtcttgttaataaaatgcatttaaataacatccgtatttattttatgggtaccaatttagttaccttctccagtttcaaactttgggatcctgaattaggtagcagtaatggacaaaaatatccactgtctaaatcatatactttaggattaactatcaatatctaatatcaaagacatgaaaaagaaacatatattattagccattgcgttcagtattggactaggagttagtttatcttcctgttcagactatctaagtgtagaacgtttcttcaacgaccgacaaagtgaagaaaaaatcttcaaaagtaaacaatttactgaagaatggttagctaaatgctatgggcttttaaatggttcgaatatagaatacggacttatcaaatttacactctccaattattcggacgatattatttttaatgaaagcgatggtgctgtaaattacaacgctcttaaatttggacaatatgataacggttgggtaaatgactcttatatccgttgttatgaaggtgtacgccaagcttccatcatgatcaataatgtagatattaacgaagaattgacaaaagaagagatcttagacaaaaaggcacaagcccgtttcttaagagcttacttctattggttactacttagaagatatggtccagtacccttaattcctgatgaaacaatcagtattgatgaaacatatataggcatgtcctgtccaagagctacatatgatgaagtagtagactatattgataaagagatgatacttgcagctaacgatctgcctgacagacgagacagacaaaatattgcgcgggcaacaaagggcgcagcactagctgtacgtgcaaaagttttattatactccgctagtccactcaataatccattaccaaatgatcccgataagtttacagactttgttgatgatcaaggccgtatattaatgtcacaaacatatgatgaaagtaaatgggcaagagccgctgcagcagcaaaagatgtaattgatttaggtcgttatgagttacatatcgcagactatcaagataaaggagacaatacttatccagctacagttaagcctccatacaacgcaaaatattctaccaaaaactttcctgatgggtgggcaaatatcgatccgtttgaatcatatcgttcgatttttaacggagatttatatgcaaatgaaaatgaagaattaatctttactcgtggtaataactctttagcagatcaagtgaattatctcgtcagaaatcaaatgccgacctttgcaggaggagagaatcgtcatggtttaaccgctaaacaatgtgatgcttacgatatggcaaatggtgacgcctttaatttgcaacatttcttggacacttgcgacgcaagtaaacgttttgttaccgaagatgaatacaaagcaggaaaatatccgcagcttcgcccgaatgtatggaaagaatatgccaaccgagaaccgcgcttttatgccagtgtagcatttagcggtgctttttggccatttgccagtgccaaagatgcagaatatcgtaaccaacaaatatggtattacagaggcaacaaagaaggacgcaaaaacggatctgataaatggataccaactggaattggaatgatgaaattcatcaatccaaatgattgtaatacaaataatggaaagatctatgataaagtagatgtcgcaattcgctatgccgatattcttttgatgtatgcagaagctttaaatgaacttactccaggtaatagttatgaggtaacaaactggcaaggagaaacgatggtagtttcacgcaatacggaagaaatgagtaaatcagtctcaagagttcgtattcgtgccggaatgccagattatgaacaggaagtatataacgaccaaacattattccgcaaaaaattaatgcatgaacgacaagttgagtttatgggagagaaccagcgctaccacgatttaagacgctggaaaaatgtagctatcgaggaatcggagcagatctacggttgcaatgtattaatgacagaagctactaaagaaagattctatgaacgtgtaagagtcgagaatctacaagccaacttctcacgtaaaatgtacttctggcctattctggaaagagagctacagtggaatagacggatgacacaagctcctggctgggaaactttcgattaatataaaaagaagataaaaatgaaaagaagaataatttatatagttacaatgtttgctgcactatctttctttagtgcatgtaatgacgaatggaaagacgaactttattcacatatgatctccttgaaagcacctataggcagtgaagaggtgtctgatatctatgtacgatacaaacctaacggagaagttgtatatgatctcccggtgctagtcagcggatcaaccccattagatagagacttgaatgttcgtattgctgtggacccagacacgctggttgctctaaatctagccaactaccatgagttgagaaaagatttatggtatgaattattacctgagcaaaactatgaatttacagcacctacctgctatatgcctgcaggcacaagaaaggaattattccctatcaaatttaagttttctggactaaacctgtcaaaagaatgggtattacctctgaccgttgaagaagatccttcatatgtgaccaataaacggaaaggctggcgtaaagcattactccatgttttgccatataatgattactcaggcaattattctgcaacagcaatgaatatttattttgctggctctaatgacgatccattagtagttgataatcgaagagcacacgtcgttgatgaaaatacagtatttttctatgtcggaacgaaggaagataactcaatcgaccgggaaacttacaaaattaatgtcaagttcgaaaaacctatagaagaaactgaaacaaaaaaaacaggtaatctgacaataacagctaccaacccggcaataaatttccaaataataggtaatcctacctatgagatttgggatgaaatggatacaaatcagccttatctattgcatcgttatcatgtattaagaatggaatatagttatgatgacgtaacctcatccaatgttcctacttcgtacagagctagcggttcattgctcatggaacgaaagattaatactctaataccagaccaagaccaagctattcaatggtaaaaatgcaatattatatccctactcaatgaaatatatcaagtcaatggtttgattctatactaaggagcatttaaactatatgctcaatctgattggagaaagaataattattgccaaataaaaagtgacacttagcttagttagcaacttcgctataagtgtcactttttattcataaacagccttacttagattaaaaatacttatatttggcaaatttaattcataaagaaataactcatattataaatataacatattgatgatctaaaacaatgagaaagttactcttattattcctatttatttgtggattagtgctacatgcacaagcacaaaagaatgtagaattaagttccccgaacggagaaataaaagtatccgtccgcctcaccgacaaaatctactatgacgtagcctgcaatgatgaagttctgttgaaagacaattatctccaacttaaactaaaagataaaatattgggcgaacatcccaaactgtccggacaaaaacagaacaaaataaaagaaaccttaacccctgtcgttccactgaaattttcaacgatcaataacgaatataaccaacttctactcaattttaaaggaaactactcagtagaattccgtgcttttaacgatggaatagcctatcgttttatcacccgccaaaaaggagaaatcgaagtattgggagaagacctttcattgcagttcccgacagactatttattacatctccaacagccgggagggttcaaaacagcttatgaagagccgtacacacacatttccagtcactcatggaaaccatcggataaaatgtccgtacttccagttctcattgatacacgtaaatcatataagatactaatcagtgaatctgatctgtcggactatccttgcatgtttctgaaaggaaacgggaccaatggcatatcctccatttttccaaaagtcccccttgcatttggtgaagacggagaccgcagcctcaaaatcgaaaaagaagcggaatatatcgctaaaacaagtggaaaaaggaactttccatggcgctactttgtcattaccaaggaagacaagcaattagttgagaacactatgacctataaactggctgataagaatcagttagaagatgtgtcatggataaaaccagggcaagtaagttgggaatggtggaacggagcaaccccgtatgggcaagatgtaacctttaaagctggttgtaatttggaaacatacaaatacttcattgatttcgcatccaagttcggaatcccttacattattatggatgaaggatgggccaagagtacacgcgatccttacactcctaatccggacgtagaccttcatgagctgattcgttatggaaaagaaaagaatgtgggtattgtcctttggctgacttggttaacagtagaaaagaattttgaccttttcaaaacattcaatgaatggggaataaagggagtaaaaatagacttcatggaccgcagcgatcaatggatggttaactactacgaacgagtagcccaagaagcagccagacatcatttatttgttgacttccatggatcattcaagccggccggactggaatacaagtatcccaatgtattatcctatgaaggggtcagaggtatggaacaaatgggaggctgtaagccggagaatagcatctacttgcctttcatgagaaatgcggtaggccctatggattacactcctggagctatgatcagtatgcaaccgaatatctatcgttccgaacgtcctaactctgcaagtatcggtacccgtgcataccaaatggctttatttgtcatattcgaaagcggtttacaaatgttggcagacaatccgaccttatattaccgcaatgaagattgcactcgtttcattacccaagtacctgtaacatgggatgaaacagttgttctggaagccaaagtaggtgaatatgtaatcgttgcgaagcgtaaaggagagaaatggtttattggtgggatgactaatgataaggaaaatgaaagagaatttgaaataaatctcgacttcctgaaagatggcaggacctaccgtgtaacctcgtttgaggatggaataaatgcaggatatcaggcaatggattaccgtatgaaatcggcagcaatgaataagaatcaaaagctttctgtcaaaatggctagaaatggtgggttttcagctgttctcgaataagcctatactgtagaaatcaagatatctcccataaaaaagagactgcctccaatcaaaaaatgaggcagtctctctttttcataacactctttatcgcttttcctattcagccaagagaacctctaactctgccacagcagccatcttagcctctttaatgacagcagacagagcctgaagttttacataacgtgctttacatggattaaattcaactgtctgtacttcctttgaatcggcaaatgtaccagaagccacagcttttccccactccttgccatcatggctgatatacacttcatatttaccgattctaccttccgaagaatcctgacgaggtgtatatttaagaccttttactgtagtttctttagctaatgcaatctgtatctcatgaggataaggagccagatagaactggttatgtaccgtatgccagaatgtattaatatcaccatccgcagccaatttcatacttccatcagcatcactatccgcatatacaaccttctgtctctcttcagatgcacccgataaattacggactgcattgacatttaattctgctgccgaagcccaatcccgaccataaatttcagataaagcaatcaatttaaagtaacgtgccacaattggtttctccaatgttacaaactgtgcagaagatgaattttcaaaacgacctttagtcttgttttcccagttctttccatctttactgaaatagagctcatagtccttgatacgtccgttctcagagttacgaggttgataaataaacttatcaatctcaagtgatgaagacatatccactactatttcgtggggatgtttagccacaggatcattccaccgactatgccagatagtattcagatcaccatcgattgcgttacgggcctcttcacccccattctcactactaactgatacaattttccacagtgaacgatccacatatatcggaaattcagctgaagttctcgcactttttcctaattgttctgaaacggcatatgcttccacatgaccaccagaaataaattcgaaaggttcagtatatatcttctcttctccgccattcagactataatgaacagtagctccgggagtattagtctttaaattcaaataaccattgttatctctttctatcaatacaggcatacatacgggcatctgtacgcgtgccttctttataagttcttctgtcgaataacttctctccaaaggtagtatgataaaactgaaaacagtaggctgggaacgaagttcatacttttgcatcgggccaggaccacaactggcattaccaagcggacgctgattagcatccagacaaagaacagtttctttacgcatcggtacttcatacttatgaagcaacctacgatgattggcagggtcaaccatatcctgcgctgttgcatgcaaagcagaagcagacatcttatcacctgcaataaagacaaagcctattccatcaggattggttattgaaatccaacgcagatcctcgcgattacccatttcctgtgctctgacatagttcacccattgatcagatactaactcatcatacacgcctacgtaagtggcatcttttcggtcaacatagttttccaacggtccgcgaccataccaacgcatgcgttcaaagccttccggaagttccatacgataaccaatacggggaataattacaccttttgttgaaggaataatagtgctattaaccaaaatagaaccatcggcagccaccgtatattctatattagttcgataatcaaaacccgtttttccccgatatagattctctatctgcagagttaccttattatcttctttccgcacattccaatgtccaggttcaagagtcatctgatacaagcctttctgataccagtcaccatccacttgcttatcattatcagtaggagcacggaaagcattcaattccaaccctttactaatcatgggcaattcatttaatgtataagaagagatcgttccctgctgctttgaaaaagacgcttcaaactgcgagccttttaccagatatgcatcatcagtctctatcagatcaatactaccttctcctgctttaaatacaggcttcgcactatcagaaagtttgaattgctctgatgctacctcatatccagccttttcccattcagtatcttgcttttgacagaagcggaactttataaagtattcggctcccggaattttattgatctgattatcagctatagtaatgaccttactgtcctgtgcgttcaaggacaattcttccagattagccgagaatacaacttttccatcctcttcaatctcataccttccatataagtcatccaaccctgcatgaaatctcttattagtcagtttatacgtcccatttcccatagcctcaacccatacaggctgatgtatttttttcacctcgtatgccttagcagagtatgtacgatcggaaaagattacgccattcgtgcaaaaattaccgtcattcggtgtatctccaaaatctcctccgaaggccatataataaccggaaccatccggagcaggcatcttaatactttgatctacccagtcccagataaagccaccgacaagtgcaggatagcgctcataagtttcccaatattctttgaaattcccgattgaattacccatcgcatgagcatattcacaaaccacatgaggtttgaccgtttctccattctggaatttctgtaaacgctccttccctacgctttccagccattgcacatcggggtacatagaactggttacatcgcaataagagctattaccttcatagtgagtaggacgggtatcatcgagcttcttaacagcctctgcagcagatttaaagttaatgccattaccggattcgttgcccaacgaccacatgactatagaagcatgatttttatagcgtcgcaccatattctcactgcgttccgtaaatgctttcacccatgaaggttcagaggacaatgccataagaccatggcattctacattggcttcggaaagaacatatataccatatctgtcacataaatcatagaaataaggattattaggataatgagaagtacgtacagcattaatattcaatgacttcatcaactgcacatctttttccatttcttctttagataccgtacgaccattctccgaactatggtcgtgtctgtcaactcccttaaacaaagttgattttccattaatcaacagccgaccatcttgcgctagttcaatcttacgaaaaccgaccttgacactacgaatatctacagttttccctttttgcttcaaaagaatagtgagattataaaggttgggcgtttctgccgtccatttcaaaggattcacaacctcaaactgaagtttattcgttcccgttacagcacgcgcattttgggtagcaatctctttaccattctgatccgtcaccttcacttgaatctcgttattacttcttttacctgtaatatctatatccagagagacggatgcatttttatactccttgtctaaatccgtacggaagaagaagtctctgatttgcgttttaggagccgaccacagaaatacatctctgaatataccgctgaaacgccagaaatcctgacactccagaaagctaccatctgtaaagcgatacacctcgacagcaagaacattctttccagctttcagataaggagtcagattaaattcggcaggcaggtagctgtcctccgaatagccgacctttttaccattcacccaaatataaaaaccggcttctaccccattaaaacgaataaagatgtcacgtcctttccatgaatcaggcaatataaactccctgcgataactaccgacaggattaggcatcgtcgcaaaagtatagttagacggacgaggttgaattacattaggccactgaatctttttccaatcccactcacaaaaaggataaatcacattgcaatataagggcttatcccagtttttattatgtcttacggcctctatctgccaagttgcagggactttaatattatcccattggcttacatcatattccggtttacagaaatcctgtggtcggtctttcggatcagccacccagtgaaatttccatattccattcagcgttttgtaataaggtgactcttcaatagtcagattcattgcttgttgttcatcggtaaaaggaatagcaatctgaactgcttcttccttattgactcccgagaccagctcattgctccactccggcttatccgtggtttgtgctgttacagataaagacataaacaaaagtgcaatccatgcacttcgcatgattcgtagtttcataataattgattgagttatttagtttaaatgttcttctataatattttcctaaaatttattcgattacaaatgtagcggcttttacctatttcatac

SEQ ID NO: 165 - DNA, 16205 bp, Bacteroides thetaiotaomicron
gcataaagcaactgtcaatactttatgtaataaccagtaaagatgaagttaaatataaccagcgatttaataaatcgctaaaaatataaaagcaactattgaaaacaacttaataacaagataatgaaatatttatataaatatattgttgtgtgcaaatgggttgaaagctataaaaatcctattatattaaagaaagatgaaaaagttgtagtcaatttagctataaaagaaactgatccagaatgggtaaattgggtttggtgcatagcgggcaatggaatgacaggttgggtacctatacaaattttgaacgtatgtgagaccttaccgaatgaatggcaaatagctattgcattagaagactattctgcttatgagttaccagtaaatcaagacgagatagtaatcggctcaagatacctaaatggttggttatggtgtcgaaaagaaaattcaaccaaggaaggttgggtaccgattagatgtttaaagcgatctattgaatcattgtagaataagtattgccgaaatgataaaatattaccgaatttgtagaaagaagatatatattacgtaatccatagtaaaaatgaaatcaaaaatagacaacaatttaagaaatgcgaagaatataggtgcaacaatcgagaaataccttaatgaaattggtatattcactttagccgatcttgcagaaacaacatctgtcaaagcttttataaagatacgtgaacaacatcctgaaaagactatacctgtgtgctattatctctattctttagaaggagctctattaaacttacattggaatgatattccatcagaattaaaaaaagaactaaaagataaaattcaggattaactattagaacaaatttgattaatgattaggctattaaaaaaattagcagattgattcatttttacacttattaatatgacatatgagattacctttgcaaaaaacaataagtacattaaaatgatacgattacaaaataaaaacaggttttgaaaaggaagccattattaagtcctcagttataaaagagggacaaatagttgatgaacatttatatagtattaggaaaaaatgaaaaaagatataggcgatcaccttattagtaagttagatttgcaggatatagctaaagtgttgtccgatgaattaagcgggtcggaactgaacactgttttactggacatttttaacaagcgtgttcagcaggaaactccctcgtctttactaagtaaatatgagggtaacaagcttgttaagcccgccttattagaagatgttttagaatataaagaaaaagaattacggtgctataaattaatagcaggtagaggatttgaacccatagaactttccccggtcgctcagtttgggacaaatagtgttatagcaacagtagatcagaaaaaagtccttacttctttaagaaacacagaagtacaggcagacccgacgaatacaatagcattacattacgcatcgttaaagaaaaaaggagaattagataacaaaacctataattacagcaacatttcacgggtaataaggacacaggtatttaataatcctaatttcactcctcattttactgttctcgcccttatttcatgtggtagagatactggtagctttaattttgagaaagaagaattattaaaacatttaactacatcgtatgagatatgtaaaagttacggtgtggagaaaatatattatgagattattccatgcaaaggttatgacagtcaaagcccgcttataatggaatcaatatcgtatgtccggaaaaagaatagtaatcttgaggtcttggttatagcaccggaacatgataataactattaccatggtttcagaataaagcagcaaatagtgatcggcggcaatactattgaaattgctgacggtggattgcttgattggacacaacagctattaaccaacaaaaaagagcgaatgatgacattcgggcttggtattcaggtattatatcacctaactaaataaacatggtaaagagtaaagtcatatttgaagatgaagaacaggtagagattaaatatccttgttttgaattaaaggatattgttgagtattattttgaaatatatactcctaacaattctataactccattttcacttgtggctttgcccaatgctaatatcttagtttcaatttatatctccgatagtagtcagacattcaaagtacatcgtgaacatggtataattgatacatcgggtgataagatatctggtagcttaacagaagcgatcactgtaatacacgctcccggaacccatgaattttcaataaaattcaagccgggagttttgtactcctgtttgtctaaagatatttcaactttggtggataatcatttgtctctgcaaaagtatctaaatcaaaaagtaatagacgaactaaaattaaaaagctcttttgccgagcgagttcagtttgtagagaattggcttttaagtaatatgaaaatctttagttctgatttcaaactcaacactgtaataaaagcaatttaccatatcaataataaccgtaattacaaattgaacacagtaagtaaggaagttggggtgtcaaatcctacactcaatagatatttcaaagaagtattaggtatatcacccaaacaatgctttaaagctttacgctttaaaactgcattgaagaactatcgtgcaaatggtagttatgatttatacgacgaattgggatataccgacttttcccattttgtaaaagaagctaaaaatttggcaaacacaactccatcagaactataacaaaaagagaaagtaataaagactataaaagtacatttataaaatattatctatgacaatgaatgaaaatatgaaactttggaaatacagtgggacatttcttgttataacaggagcaatccacacagtatatgcactattacttgggaaagaagactttacggacatgataaaagatggattaataaactccacagatgatagttacagccgtgctttcgccctttggtttttagtatgtgggattatacttattctttgggggctaacactccaatactatatcaaaaaagagcagaaacccgcacctctgattttggggtattgtattttggcgttcgctgtggttggatgtatcatagagccgatttccggtttttggctgtttttgccgcaagcattagttataattgctgcaaatagaaaaaggaacatataatagacaacattatgaatacaatatcagtaagagaacaacctcaatacacccaacaaattatagcgtatttacagcaagttttatcaacttggtgcaattcatactatcgggaataaaattgtaggcttattaatatactgtattccttttatttatatttttatgggtagcttctctttcctatggtttatattaccattcttgattatcgttcctttcgaagagacttgtattattctccaaatgaagaaattggatttgaatcggaaaggattattctttgccaaacattctgtcgattgaatataagaaattttgtaaataataagcaatagaatacaaatgaaaccattgagattaatgccatcgacactgatattcgtatcggcagccatgctttttgggggtgatgacccacttatgcattccgtttctttcggaagttgccggattggagtccattatcttctggtttatttgcggagggcttggagttttcactccacttattattgccggcgtgatgacgcttcgcaaagaagggggcaaattcacaaaagagacctttgtggagcgactacgattcagacctatgagtcgtagagattggcgttattcacttctggcgttggtggtaatcggactcttgacaagtggaattatgattgcgatgcaagtccttttttcggatttcaaccatactccgtcgtttatgactttggatccgctttcaccgggaagatattggctattgcttgcatggttcccatattggttgctcaatatcggaggcgaagagttcttttggagaggtgtgttgttacctcggcaagaaaagactttcgaagacaaaacgtggatattacatggcactggttgggctatttttcatatagcgtttggttggcaactacttgttatgttattaccgctattgtatatagagccttatgtggtacaaaagacacagaacacatggacaggagtatttctacatggggtaatcaatggtcctagttttatcgcaatagcactggggattatttgatataatacaactgcaaaaaatgacaaataaagagattaaaaagttatgtcgctcgtttggagctgatctggtgggagttgcctcggtcgagcggtttgtaaatgctccgaaaggatatcacccaaccgatgttatgccaacggctaagtcggtcatctctcttggaatggttttgcccaaagatattctcgaacaggatatacgaacatatacggatatacgcaatgaggcagttaaaaagatggataaggttgctgcggatgtagcagccgaactcaaaggactcaaatacaaagccgtgtcgatagtctcgcttagcggtaaattcgtagatggacatttccgctcgcgtgtgtcacttaaacatgctgccgaacttgccgggcttggagttatagctcgcaactacctgcttaccaatgataagtacgggaatctgctttggtttacggcagtagtaacctcgttggaattagagcccgatccattggcgacataccaggtttgcaacaactgcaacctatgcgtcgatctttgtccttcgggagcactcacagacgaaaacaattttagtcaaaaaggatgccggaaagtttgctatattaccgtaaaaggtgtattggaacttcgttgctggcaatgccgaaatgtctgcccgtataaacatggtataaatgattaaaataaattatctaaaatacaacgaataatgaaacaagagattctatttgtactactcaaagactttgccgattgggaaggagcgtacattgctccctacctgaattacggttgtggacctgatatcgagagtaagtacgtggttaaaacagtgtcggtgacaaaagctcccgttgtgtcatgcggtgggttcatggtattgcccaattacagcatcgatgatattcccgccgattatgccggaatcgtccacctactggattaacaacggattcgcaaaagatgacaaattcctgaatctattataaaatggtaagcccccgataaagtacccgttgtctagtatcttttttcgctcgatctttgcgtaaaaaagattatgcgaaaaatgagcaaagaagaattcttagaaattctatcccgtcagcaacgaagcggtttgacgataaaagacttctgtgtcaatgaagcctataccgaatctagtttttattattggaaaggaaagtttggtctctcacgaccttatcatggggaaagatcctcttccggagagttcgctcctatcaatttgacctccccgtccacatccaacccgtcttatgatagagtagctatgggatccggggagattcaaatagagtttcctggtggcataatagcccgcttcagtggtatggctgaatcccatgccgccatgcaattactcactcaaatttacggtcatcatgttttgcctgaatgatacgatgcgatatttcctttgcccgggtaagacagatatgcgcaaaggcatgaattcattatgtggagtcattcataacaagatgggctacgacgtccgtttaggtgacgtattcattttcataaaccggcagcggaccacgatgaaacttctgcatgcggaagatggcgatcttgtcttgtatataaaaaggctggaggaaggaaccttccgcttgcccgaatatgatcagcaaagcagatcataccccatggagtggcgtgatctggtcatgatggtgaaaggaatcaataacggatccgctaagaggctcaagcgattgaaggcgttacgaaaaagtgatatataacagtgaaactcaatggaccagaccttgtttaagtaagagttttttcttatttttgtattgttcaaaatcctcataaataatgactcggacagaaacattagaacttttggtagccacactccaacagactaacgccagtcagtctgagtccatcagacagctgacccggcagaatgaacagttacaaaacaaactggatgaactgctggctcaggtagcatggctgaaccgacaactttttggtcgtaagagtgaaaagttatcccgtctagacccaaatcagctatccctgtttgaacagccggtccaatccttagaaccggaacctttggaagaaactgtagttgaacaaactacaacacctatggttactaaaaagaaagaacggcagaaccgtaaactgttggaaggacttccggttgtggaagttgtcatagaaccgcaagacctggatcttacaaagtataaacggattggcgaggaacatacacgtacacttgagtttgaaccgggtaaattatatgtaaaggaaatcatacgtcccaaatatggactgaaagacaataccgctttaccccaggaatatcaggatggtatcgtaatagccgatcttccactgttgcctatttataagggacttccgggtgccagtctgctggcagaaattctcctgcaaaagtatgagtatcacgttccattctaccgtcagatacgggagttccatcacttaggtttgaaaatcccggaaaacacgcttcatggctggttcaaacccgcctgtgagctgctaaagcctttgtatgatgaactcaagaagcaggtattggcagtcgattacatccaggtggatgaaaccacattgcctatcatcaacaagcaaagccacaaagctgtcagggaatatctgtggatggtcagggcggtaaccagcggattagtattctttcattatgatgacggttcccgttcacaggaaacggcacggaacttattggaaccatttaaaggatatcttcaaagtgacggttatgcggcctacaacgtctttgaaggtaaggaaagggtgtgccttgtgggttgccttgtccatatcaggcgtcactatgagaccgccaaagaggaaaataagtctcaggctaagtacgttctggccaaaatacaggaactctaccggatagagcaggcggccgacatacagggaatatcccctgaaatgcgaatgtcaaaaaggcagaaacaggctcttcctattcttgacgagctggaacaatggatggaaacaacctatccgaaagtgcttcctaaaagccagatgggacaagccattgcctatgcctataccctttggccacgcatgagaaattacctcaaagacggcaagctcaaaattgataataatctggctgaaaatgcaatccgcccaatagctttatcgagaaaaaacttcttgttttgtggaaatcatgaagcggcggaaaacacagatgtcatctgttcattattggcatcatgtaaagcatctcaagttaaccctagagaatggcttaccgaaataattgcctggttgccatattacacaagggataagggaaaagacctaaaagagttgctacccaattactggaaactgagaagatccaaagaaatctaacaatactctaatgaaaagcatattataaacagagaatcgctataaacttattagatgtatatagcgattctataatttatacgaggactttatcgggagcttacagttgaatagcttgaacgaaaaaagcaagagattcaatatagtgaaagaaaaacaagttttcaatacagataacaatgtaagcccccgataaagtacccgttgtctttgtatctttaagtctcgatctttgccagaaaaaagactatgcaaaaaatgagtaaagaagaattcattgaaatcctgtctcgtcaacagcgtagcggtttgacgataaaagacttctgtataaatgaagcctataccgaatcaagcttttactattggaaaggaaagtttggcctatcgaggcgttatcatatggataggcattcttcctctttagaggagtttgcaccggttagcctcacctcttcacctgcttcccactctgcctgtgatagtggcgctatacaaacgggtgagatccggatagagttccccggtggtattatcgcccacttcagtggtatggctgaatcccaggcggccatgcaattgctcactcaactctgcaatcgccatgttttgcctgaatgacacgatgcgctactttctctgtccgggtaagacagatatgcgtaaaggtatgaactcattatgcggggttgttcatgataaaatgggatatgatgtccgtttaggtgatgtgtttatctttatcaaccgccagcgcactacaatgaaactgctacacgcggaagatggcggactggttttgtacataaaacgacttgaagaaggcactttccgccttccctcttatgacaaagaaagcaagtcgtaccctatgcagtggcgtgacctggttctgatggtagagggaatcaacgacgaaccttccaaaaggctcaaacgtctgaaagcgttacgaaaaagtgacatgcagtactgaaaaacagcaggtgaaaccttgattatacggttgcttttctgtatttttgtattgttcaaaacaggtatgacgaatgactcagacagaaacattagaacttttggtggccacactccagcaggctaatagctcccagtctgagtcaatcgagcgtctgacccggcagaacgaacagctgcaaaataagcttcaggaactgctggctcaggtagcctggttaaatcgtcagttattcggccgtaagagcgagaaattagcccatctggatccgaaccagctatcactgttcgatccacctgttcagccgttggaacacgaaataccggaagaagccgcagcccaagaacctgtctgctcgacgactcccaaaaagaaagtgcgtcagaaccgcaacatgttggatggccttcctgtagtggagattgtcatagaacccgaaggagtcgatccggataaatacaagcgcataggcgaggaacgcacacgtacacttgaatttgaaccgggcaaattatacgtaaaagagatcatacgtcccaagtatggcctgaaagacaatataagtttgcctcaggggcatcagggcagtgttattatagcccctcttccgctattgcctatctacaagggacttcccggtgccagcctgctcactgaaatcctcttgcaaaaatatgaatatcatgtaccattctatcgtcaggtgcgtgagtttcaccatttaggcctgaagatctcggaaaacacgcttcaggggtggttcaaacctgcctgtgaattacttaaacctctctatgaagagttgaagaaacaggtattgaaggccgactatatccaggtggacgaaacgacattaccggttatcaacaaacagaatcataaagcggttaaggaatacttgtggatagtcagggcggttatggatggattggtcttctttcattatgatgacggttcccgctcacaggaaacagcctggaaattattacaaaccttcaaaggatatcttcaaagtgacggctatgcggcctacaacatctttgagggtaagaaagaggtgtgccttgtcggatgccttgcccacataaggcgacattacgaggttgccaaagaagagaatgaatccctggccggatatgttctggctcaaatacagcaactctatcggatcgaacagattgccgaccaggaggaactcacttatgagcaacgcatgcttagaagacaggaacaggcacttcccatacttgagcaactggaaaaatggatggaaacagcctatccgaaagtgcttcctaaaagccggatggggcaagctatcgcttacgcgtatcaactttggccacgtatgaggaattatctgaaagacggcaggcttaaaatagataataatctggccgaaaatgcgattcgtccgatagccttatcaagaaaaaacttcttattttgtggaaaccatgaagccgcgcagaacactgccataatctgttcgctcttggcatcatgcaaagcctccaacattaacccccgggaatggctcacggaggtgattgcactattgccgtattatgcagccaacaaggagaaagacctaaaagagctgctaccccattgctgggaatcgggaaactccaaagaactctaataatactctaacgaaaaacaagaatataaatacagaatcactatagctttgttcgatttgctatagcgattcttttttatacgggtactttatcgggggcttacattgcttgtagtattttcatagttctattgtttttatgtgtaactatatttgttaaaacgttgcatgccaatcgcaccaaaaggtccatgccggttcgttcagtctcattttgtcttctctatgctttttaagcatttcctttgcttgagggtaatcataccatttgccggctagttcttctccaaatggtcctgaagaaccggggaagaaatcggtaaatttcactcgttgatcagtatcggagagaactatcagttcttcggcatacttacaattggtttctatttgttcgaaccaattatgttcagaattattcttataaaaacaattatagtcgagtacggtaagtgttctttgatcaactaacttgaattttctatatcctagctgatataaagcattcaaagtgtccaattcgtgtcctgctatatcttcatcttctcctatgcattcagtttctactgatatatatagaggtttctcactcactttttccatcgtttgcagtgcaatgatgtcatttccttctatatctattttacaataaaaaggagtaccgtattcatgaaacaaatggtccagccgttttgatttaatcttctttttaatagccttgcagcacattcttgaagaaatagaaactttagttgaactccaaatggtatttggaccgatataaaaatcggtgtctacgtcatttgtgtcagaaatcacatagtttagcaacaatagctttccattctctatgtatttcttaaaaatattctgccattcatttattaaatcagggtcagcatccacagcaattacccgataccctttcaaaagataaaaaagggtatcttctcctttatgaaaacctatatcaaaaatgagattttccattagactattttattttgtataaataataagtttatcattgtcatcaatctttcttttatttcagacttattgatttcatgtgtttattcgctcttgcaaaatgctctcttattttaccctgctgttccatattactctgagtaacatccgagtacccaaaatccttttgttctgagataaaaggatagataaccattatgtttgtggctagtttggatattactccatcggctgtgtcagtattctgaaacgaataatccagcatcttatcaaaaaaacgattataaataacaatgaactgtgtgcaccaaaaccagtcaactttataacgatgatatcctgcagggatcgcttgtccaaatcctccaataccaccggaaagtacttccgctccttgtatataagcttctgtaacttctttgaacagtaatttgggagaataattttccgtgaaataatggtcgtcttcgcaaatgacaatgatgtcatctcctttctcttttgccatttttatgattttgatcatactattccataaacctactgcaccgataggatgggccgaagcctctacccaatttaactcgaattcttccttgttgtcgaactccttagtaatatgttgtttacgttccactctttctctcatattgataacataaaccggaagataaaaatccggttgatgctcggatgcaagctgttctataatcttattgcttttatcgagccatatatcccagtttaaacgttcttcaaaatcctttcgtgcagttttccttagtttggaatatgttatatggttattgaatatctcttctattttatcagcatattccagcgaagaagcatcgatgttgaacagaaatccattttctcgttctttgataacctgtgatacacctcctacattagtgcctaacgatggaataccataggcgcatgcttcgcagaaaactattccaaaacaatcaaagcgagtgggcagaatcagaaaatgcgatcgtgtcaggatctcatggaattttaacctgtcattggagtttgttttgtcgataaaagggtatatttcaatattcggatcatttggtaaggacattggaggttcacttcctacaatagtaagcgtacattgaaatccccttccttttagattatgataaatttcaagtactttatttccacctttcatattccaatttcttccgataaataagaggttacatggtgcatttatcggcgatacgttatctggaatcgggatgttctctgtgatattcgctccaaattcaaccacttctatgttctcggcatcagcattgtaatcctgcattgcgctctgttttgcccattccgaacaataaataattttatccaccttttgtatagcgagtgattccagttgttcggctagtttggtaagacttttgtcctgccagttcatgtattgattaaacagatgaaatgtagtatctccaatataaataagtggtatatccgaaacgagatatgcggcaaagaaataatctcggcatataattacatcataacattcctttttcaataggtcagaaaacaatttaccaaaaagcaacgcataattttcaggaaagaatgtttcattgtttttgaaattggctttgtggaattcccaaacctcagcaaacacagtttcgcctacccatatcaccctatgtttcttttgaagtgaagtgtatagagagtaaagagtacctgaccagttattttgatcattagggtttgatgaagataaaaaagcgatattcatggttgttctaattctatctaaaataatttattaattttcaattgaaagattaaaccattgtatcgcgttgtattctattaaatagattcacaaaaaaacgaaaaatgtcttcattagacatccatttattcttttctaaattttcaaagtcggataataggctatttaatgttttattattatatatagagagaagatagagaagaatttcctttctcaaacggatagaacctaaagacatttcctttttcttcgttacggtgacctgcgtatcacttcttctaaacattaatagttcttgtggttctacaaataatattcctccagctttcgctatatcaaaccacaatttataatcttccacacaggggtaattttgatattcaatatggtgattaagcagaaactcttttttaatcatcacactaggatgaagtagcatgttgtattttagtaattccaacacaggttcgtgtatgattccatatccaaggtgggaaacatttctttcgttgcccttatcgctgaaaatcttagcccatgttccacaaactgtaatatccggattttttttcatacgttttaattgaattcttaatcgttctgtatgcattatatcatcggcatccatgcgtgcaatataagagccggaagccaactctaatccttcatttaagttttgaataaattgatgctcctttctgactaaacgtattcttttgtctgtatatccttgaatgatttctactgtccggtctgttgaaccatcatctataataagaaactcaaagtcggtcagtgtttgattcaaaacactatcaatagattcttttatatatctctcaccatttctgacgggcattagaactgttatttcaggcattgtcttgttctattaattgttcatatacattaatcgtattctctatcatcttttccagagtgaatctttcttggtagttcttgattgcatttgtgctcagttttagccttaaggcttcatcatctatcaagcggatgatggcgtctgctaatttctcttcatctagctctaaaccaaaatcttcatcaaacactaaagggattctcaaagcgtttacttcatcttcgaacatttcggaaagtgcatctacatctgatacgatcattggcataccaaacatggacatttcaatagccacatagctacattgttcatgtaaagaaggaatgactcctatagtatttgttgtatatagttctttcagctcattaaaagaaacagtccctaatatgtcaatctttagttgtttgtatgctttgcggatatgagatgacatatatccggtacattgcccaactaatttcagtttgcaaaaataccctctactggctactttatttaatgcattaagtaaacaaatcactcctttttcacgactgattctgcctacgaaaaggatctctggtgttctagattttctttcctgcaaggtgattcccgtatcatccataccattatatataacagatattttgtctggatggataccatatgctgaaataatgtgtttcattgcggaataagaaacacatataattctatcagataaaggatatgcaatcttttctagttgattttcatttattaaattgaatgtgttattcaaccattgagagtactgtttcttaaacagactttcattatattcaagacttagtttccaaggaatgatatgtaaatgggttaaaatatgtccgcctaaagataactttaaaatatccgctaattttactagtaataattcttgcacatgccaaattaattgtttcctgtttttaaaatagggagatattaagtcggatacgacgttaaaatacttagtaagccaatatatttcatttctcagaggcttggatttagaaggatatgggatattagcaattatcctatcctctgtcacttcaaatttgggaaagatcagactggtatttaaacaaataatatgaactttaatgccgttcatatgtttcataccttctgttaacatttgaatatagcgtacaacaccggatggattgccagtttctattctgaggattacaacatttttttctatcatttcagcattatatagtgtccggtggattttatatcttggaaattaagacattccataagtaacaattggggaattcctccttttagtctacttaatgtcagccgattttctttatataaataagattctttattaaacaagaggcttgacaattgtttctttaaagatgtccattcactttctttattaagaagttgtaatttattcagattgtaaatagcatcaattgattcttttaagtttagggtttccaaaaccatatttgaaaagtagcattttataatcgcatttgccagctttatgatatctttgcgtttatggcacaaaccatattgcaaaagattgactccaaatgatatattagtacaaacatgtttatcactgattaattttttatgtgtttgtactattatgtcaattaatgtttctcctcgaatacttaattcttcataaagattatagagacagagcattttcgtagcatggtaatagaacaaattacgttcaaacaaacttttaggaatttgttttaggtaatcatagaggttctctattaaattgggaagtatttcatcaaaatcagattcctgaatatatgatttagaagctattaaaaacgatatagcgtcgtttttagatacaatattgttcatatctgtttttaattgttttatgaatgctactatttctttatgttcttgaccatataattccagataatcagcttcaatatattctttttcaataagatgaataagagaccatgctattcccatttttccttcattaaatgtattgcttttcataggagaagctagtacctcttgcaataactcaaaagcatgtttttcagctaaagcatccttaaaatagtgagaatattcgaaaagaattaaagaataccccattttaccaaacatcagactagagttgtctaatgaatatccatgtaataatataa

SEQ ID NO: 166 - DNA, 16104 bp, Bacteroides thetaiotaomicron
gtcaatggccgttgagaaaacaaatcatcattatgaaattctataatagagaaaaagaagttgcggaattgaagcgtgtgcaagagcttgcatttactcaaaattccagaatgattgtggtcacaggacgtagacgcattggtaaaaccagtctcataaaggaggctttgaaaggaacgcctacagtttatttattcattggaagaaaagctgaaagcatattagttactgattttgtaaagatagtacgtgaaactctatccatattcgttcctgaaggaatacctacttttaccaatttgatgcaatatctttttgaagttggtaaaacacgtgcttttaatattgtcatagatgaatttcaagagttttataatatccgacctgacgtctttagtgatatgcagaatctttgggatgagtataaacaagaaactaaaataaatttggtcatcagtggttctgtgtactccttaatgcagaaaatattcactgatcataatgaacccctatttgggcgtgctgacaatattttatgtctgcgtgcttttaagatcggtgtcctgaaacaaataatggaggatcttgcttccggatatagcaatgatgacttattagctttatacacgttgacaggaggaatccctaaatatgtagagttgttttgtgataaccaagcgcttactatagataagatgtatgactttgtcttttcggaaaactccttgtttatagatgaaggacgtaatttattgataactgagtttgggaaaaactatggtacctatttttccattttgtcagaaatcgccaacgggcactatacgcaaggcgagatagaatcggcattgggcggtacagctatcggaggttatttaagcaaactggagaatgtatacaatttaataacccgggaacgtcctatttttgcaaaacccggaactaagaaaaatgtacgatatgttattggtgataatttcttgaatttctggtttaaatatattgagcagaatcgctcttatattgaattacagaattttgatgatttgagacaattagcaaaagctgattatccgacctattcaggtagggtgttagagaaatacttcaaacagaaactggcagaaaccggaggtttcaaggaaataggctcttggtgggaaacaaaaagttctattggcaaacaacgaataaattcttatgaaatagatattgttgctcttaaatccagtggtaagaaagctcttattgctgaagttaaacgagttcctgagaacaactatagccatactgttttcatggagaaagtggaacatttaaaacaaaaagaaatgtctaaatatgatattgagacacaagttctgggattgaaagatatgtaaatataataaagaggctgtcttataattgagtagtctctcgaattaataacacataccctgcatttcggaatgcctcggcccgattcattcagcgtgttactttccactccacaggtgctttaaacccctcacgtcctttaccataaggaatctcgggtaaacaaggagtaatggtatcatatttcagagcaacctgatacaaagatctcacaatctgttcatttccattagaagcattctttttctcgtaagggtctgtttgatagtctaccagaaagtcttgtggcaaattcaatcccggcttacgcccttttctgatcaatttatagtctttgttcacaacagctccacatcccaaatagaaattacggtcaatacaactggtactacctattaacaacggaagtatactgattccgtcatacgcacgttccggacgattcttatctcctactaactctttcaatgtcggaacgatatctacaaatccagtcacttgagaactcagattcttatagttactttccgcccttttccaataaaagacagccggcacacgcacacctccgtcccattcgtcaaacttcctgccccgtagtttgccggatgacgatcccggtacaccggcgggaccattatcactaaaaaagatcaaaaatgtattatccattatcccttttttcttcaaagcatccacaatcgtaccaattcctctatccatacaggacaccattgcctgatacgttactctcttctgctctttcggtgtcagactaccaaagtcatcacaataaagttctatatctttttcctgcgcttgcaacggtgtatgaggggcattataagctacatacaacaagaacggaccttctttctcataagtattgatgcatctgacagcttcttgggtaatcaattcagtagaatatcctttatcataacaagtctcccagtcattgtgccaatccaattctccttcacgcatatgatcgaaataatcaattgcaccattcagatgcccgtaaaagtgggaaaagcctctatttatcgggtaatgtaccttccgggtatgtcccaaatgccatttgccgataatggctctgttactatatccgttacgtgccaacatatcggccagagtttcttcattttcatccaatccgtcttcacgccaaggcggaataacggttgtacgtatgccaaatctattgggataacgccctgtcataagtccggcacgagtgggcgtactgataggagctgtatagaaccgatccagtacaactccttctgctgccaaagcgttcagacaaggagtttttatctcgctgccatgaaatccgacatctccccatcccaaatcgtcagcaagtacaataacgatattagggcgttctacctgctgtgcaaacgacaatgtagttgcacttactaccatagacgcccccaagatcagtttattcattatctgtccttcttttattttttcggatgtttcggtaaaacaaagtttgcatgcgcccaacgctcccattccgtaaccaatcttgtcaatacttccggatgctgttctgccacattaaagcgttctgtccgatcttttacgacatcatacagttcccattccttgcctttttcatcacggatagccttccaatctctccagcggatcgctctgttgttctgatgctcccaatacatatattcatgcaaggagtccgttttcttatggacagcaggaaaaagactgctgccgaccaacggataaattttatttcctccatgataagtctccggatatttagctccggttgcttctaaaatagtcggcatgatgtccggcaaatatccgggaacacgacaccacttacctttcttattccctaatgctcctttccacgacagaataagaggagtagaaatgccaccttcataagcacggcatttatattttcggaaaggagtattagaaacctgcgcccacgccctgccataagtcggcgcaaaactcgaagccggattattcacttcctccacctttcctcctcccagctcttcataaggttcggcacaagcaccattgtcggacatgaacaaaataagagtattgtccattttatgattcttctttaagcaatcaatcagtttgccgatattgtaatctacacaatgcacctgagctgcatatacagccatccgataagcgacttggtccttttcctgttctgtcagttcgtcccatttccggttttcccattcggcaaagtctgtatttgaatcaataatccccatctttgccatccgtttacgccgtgcttcccgaatttcatcccaacctttcttacgatatatctttgtaaatttctgtatatctttctctttcgcatgtagcggccaatgaggagcattgaaagccaaatagagaaagaaagggcggtcatccttttgttcatccacaaactggatagcataatcagcaaaagcatccgtcgtataataaggcgcatccggagccggaagtttggtgttatccagcgtcagcccacgtcctcccgatggacgaagatagctgcatgcccccgaaagaataccatagaaacgttcaaagccccgctgtaaaggccatttttcttctccatgcattcccagatgccatttacctgccatataagtatggtaaccgtcttctttcagcacttcggctattgtgacacagttcctgttcagatagcctttatacccttgtactccccaatcattaggactcttctggtcaggattcgcaaaagggtcttcggacatctgcccaatacctgcctggtgctggtacaagcctgtcatcagacttgcacgtgccggacaagaacgggaagtattataaaactgagtaaaacgtacacctttagacgccaacgcatcaatattgggagtaagtatttcgccaccataacaaccgatatcggaataacccatatcatctaccagaatcagtacgacattcggtttctcctgtgcggaacaaaatgatgccatcaataaaggggcagtcattaagaagttggttcttaccataatgctcttatttctttttttgtcccggatagggttctaccatgcagcgtttcgcccattcctcgtacgctttcaccatttcgttcttcttctccggatatttatcagctagattatgttgttcgctccggtcttcattcaagttgtagagttcccatttggcattctcgcccggacgcacgagtttccaaccgtctttggcaaggaatgcacgctcattgaaatgctcgaagcccagataatcatgtccttcacgatgaccggttttgaaaataggaagcaaactcttgcctgccataggaatgatatcgtttcctttgtatttagcaggataagttgctccagccatgtctatacaagtagccatgatgtccatcacatgacctatctccggtgtcataccgcctacattctttttaattcctttcggccagtgcgcaatcatcggtgtgcagattcctccttcataggatttggctttccaaaagcggaaaggtgtgtttgccacattcgcccaacgggcacccaatgaagcataggtcgtttgcggtccgggtaatacctctttattatggggatataccatcttttctcccttacgggtcatgtccggacggtcattctctcccggagagtaattctgacagttctcattactgcaaccattgtctgagaggaaaagaatcagtgtattatccaactggccggtcttctccaatgcgtcaataacctgtccgattccctgatccatacgatcgatcattgcagcgtgcacagccatcgcacgggcatcccattccgcatgagcattgtcctcccatctgtctttaaactgacgttcggacaaaaaatcgtccattcccggaaatattcccagttgcttctgacgctcgtaacgggcattgcgtatagcttcccaaccgactttgtacgtatccttatacttttcaatatcctccggcaaggcgtggagcggccagtgtggagcggtataagccaaatacatgaagaacggcttatcatccttggcatattccgttacttcttctgcggcacgatccgaaagtgcttgagtgatatagtatccttccggtacttcttttacaggtacttctccttcaactaggctgaacgggtcaaagtaatctactactccataaatagttccgtaatgagaatcgaagccacggtttaccggatagtgacataaatccgaataggtgtcatggtaaacatgatgtgccagccattcacgctgatctttacgcaatggagtttcagcaacatgccattttccgatcatactggtagtgtaaccagattctttcagcacttcggctatcgtaaccgcattacgtgaaagtgtgccacgatacccgggcaggttgtcatcaaaagtcattcgtccgattcctgcctgatgctgatacagtccggtcagcaaagaagcacgggtgggacaactacgactcgcattataaaaatggttgaagcgtactccttgttgtgccagtttatcaaggttaggtgtatggatttcactgccataacatcctaaatcagaatagccaaggtcatctgcaagaatcaccagtatattgggtcttttatcagtttttttcccttttgagtttgcaacggaattgccggctatcatcagtgctgccggcaaaagaaaagcttttgaattcatgttttttttaattagaggtctgtttgcaatcctttatctttgttttgggcgtaccattcgcatactttcttgcttagttttgcaactaattccggatgttcgccagctatgttattcttctcgaatttatccagctccatatcatatagttgtgcatcgcttccgtctccgttcaccaacagcttccacttgccgctacggattgccagatgcggacttctatcgtaaggattgccgggaaaaccaaaatgcttatttcgaccaaagtcccacattaaatccgtttttcgttttgcctccgacttcccgagcaaaacttttgcataattctgtccatcacctttatagttcttctcagttttaatcccggccacggaacataaagtaggatataaatccaccgcacatagcactgaagaattattcacccgaccgggtttaatcttcttaggatatttgacaataaacggcatacggatacctccttcgtaaaggctattcttggtacctctcaaataagcggagcgaacagccttgaaactgggtgcaggtccattatcactggtaaagatgataatcgtattttcggataatcccatatcatccagtgccttaataaaacgaccgatttgtttgtccatctctccaagcacaggcgaaaacgcctcttttgtctcccagctttttctttctttttgcttaaactccggtacccatggtgtatgcatatcatccggccaaagattgagaaagaatggactatctttatgacgtttaataaagtcaatactcttatctacaaaatattctgtgcgtttccaacgttttatactgtcattatcacaccatatccacttagaagctgttatcgcagggtccggatcggggctttcataagtagaaagatattcatcaaacccatagttcttgatagaaggggcattgtgcacatcacgtccacctcccatgtgccatttaccaatgtgtccggtagcatatcctgcattctgaaaagcacgtgccatagaaggaagtttgtcgtccagataattacgctgctcgcacctcttattacttgccttgtcgttaaggaaagtattaattcctacttcaatagggaaaagtcctgttgttaatccacaacgggagggtgaactaaccggtgcggaagaataatattgattaaacaataatccgtcctgtgccagtttatcaatattgggcgtcgctacaaattttcctccataacagccaatatcacctatacccatgtcgtcgatataaatgataactacattgggattcgtatccgcttgtgcattaataatagggagtaaagcccccaaccaaggtaaatgtttttttatattcataattattccgatttaattaacaccattctcattgcttccaaacaaaaataaggaagatatcatagaaaaaaggcaaaattctgaccaataaaaagcaatatctaataaataatcgattttctttcacaaaagaataaagatagagaagaactccggtcatatgttcttctctatctcttatatttgataatttatccaatattaatcaatagacaaaactatttaattcccagcctcccagtcaatagcttgatcttcatctggtatttgagtattgatctgacgctctaaagccaaagaacctattacatgatattcggtttctacccccggaattgtagtatagtcaacataagtgtaattaatatttctaatgattatagtcttacgtttcaaataaggacgaataggatccattgtttcagttacactataggtaggggttacctctttcccatagtcatctttacctatttgaaatttcattttattgtcagaatctgcaggagataattccacattgccgatttctccattatcattatttataaatttagcaagaatcctatatcctttcctatcgacacgggtttcatcaataatgccagcatagaaaaaaaggctttgatcgtccaccacataagtcattacatagtttttgacaaatggggcctcactttccgctcctttgatataacacttataatttactgcactataattgcccgaataatcattaaaaggcataacacggagtaatgctttgcgataatgcttacgataattaggggtatagctaccatctgaagattcttcaacagttaaaggcagcacccatttctctgacaaatcaatattattcaacttaaaatctataggtaaaagtgctgtattctcccctgcttttatttcaacggtctccggcaatgaatagaaagtagctggtaatacctgataataaagatctatacgcgtactataacgttctttattaagaaccactaaagtatctgggtccaaaccaatacgtactgtatagtttttatcatttaaagtcgtaccgctaactatcaaaggcacctgataagtagttgcttcgttcgccttatagcgtacgttaattcgtgataccccatcactgtttattggagctttaaaagaaatataatgttcatattgttcaccactccactcttcattacaggagataattaatgcgctaacagttagcatcatcaaataagtatatatctttttcatatcttttcttttttaattaatcattataagtccaaccaggattctgagttaaacgtttgttgcgtttcaattcatcatgttttataggccagaaatacattttggatgaaaaagttgctgaaagattagatatgggtaccggtgtatggaaaagatctttctgactttcagtcataaaagtataacaaccataaacaggcactgactcttccaattctgcatctttccaacgacgaagatcatagtaacgtttcccttcagcaaagagctcaatctgtcgttcacgtttcagtttaatacggaattttgcagggttatcatatataggagtatcataatccggtacaccggcacgcatacgcacaggttttattccttttctcatttcttccggatcacggttaatggtataagctttaattccgtcccatgaggaaacctcataagatgtagtcaattcgtttaatgcctctgcatacatcaacagaatatcggcataacgaatagctggttcatctttatcaataattttggctccgtcgctattttcataagtatcgcttgggttcacgtatttcatcactccaatacctgtacgcagccaaaacatattattggaataaccattacctccacctcgatagtagaatacttgtttattctgatttgcttgctgagattcatttcctaaataccatctggcaccgttaaaagcaacagaagcataaaaacgtggttcccgatttgcatattgcaaagaaacatttgcagaaagcggtttatagtcctgtgcgtttgaagtatagccgactggtcgcgggcgattgtctacacgatccttatatgcttggtatcctgcgtactgagaattcattccaggacaatcgtctccagtattcatataataagcatctacttgtttttgagtcattccatgggtattccatcctttagcaacggaaggcagttggtgaattaccatatccttaatgcgttcaccaccgatgttctgccctctagtaaaaatcagttcaggattatctactgatgacacagttccattaaacaatgcacgatatgattcgtatggatcaatattcgcccatccattcggaaaatcttcatttgaatatacatcgtgatgtggaggcgctatagttgccggaaaagcacctgtattcacggtattgatacctgtggtataaagcttatatacattcaattccattacatctttgcaggcagcagctgcttttgcccatttactttcatcatattcaggagaaagcaaacgattacctttatcatccagcaattgttgtgcatattcatcattattaccattcgttaacggactggcagcatacaatagagctaatgcacgggtagccaaagccgctccccgcgtcggacggtttatactaagttgctctctcgtcaatggcaaatctttagctgctattaccatttcacttgcaatataattggcacaaacatcataagaactgcgtggtgtagcgacatcatcataagagtcattgtagttaaaaccattttccggaactagaggtatcggcccatatttacgaagaagaatccaataaaaataagctctaacaaaacgcgcttgcgctttaagatcaacaatctcttcaggtttatatttatcgttcatatccacattctgcatgaaaatcgtagcctgacgaataccattataacagcgatcccaagtatcctggaaagcaccttcgtcataccctccttcatgaaacttattatatgacatgtttccacctttggatgcgtctatggtaacatcatcatcaccatagtacatacagtcgtcaaacacaaacggagtattgcgtttactgcctacatcgcagcattgcccggtaaggaatgaatatgcacgtgccaaccactgttcggtcttatcataatctgtaaatatcttctccaaagattcacgatctttaaaaatgtattctgaatccaaatagtcagaacatgatgtagtcccgaaaccgattataattatcaataatatatattttttcattttattgttctgaattttataagttaacgcttaaaccgagtgttatagacttagctaatggatattgctcaccacgtgaagcccccatttcaggatcccaaagtttaaaactggaccatgtcagtaaattagttcctgtcatgaaaatacgtacattattaaaatgtatcttattcacgatcttcttcggaagagtataaccgacatcaatcgttttcagacggacatatgaaccattacgcaaccaatatgtcgaattacggtaattatttttatattcatagatcgttgtattaccattaccattatccgtataactcaaacgagggtatgatgcattcggattctcattagcagggatgccaagcttttgtgcagtctccgcatccacccaacgattatccagcgttcctttaagaatattaccccattgtccttctgtaaaagcccatatacatttgccataagtaaagaactgagatttaccggcaccttggaaatgtaagcttacatccaatcccttccaggtagcagaaagacctaaaccataaattagatttggtttactagttgaaccaatagctacgatatcgccatcattgacaacaccatcaccatttacatctttatatttaatatcaccgggcattacaggaccatatttctgtgtaggactgttacgaatgtcatcatagtccttaaataatcctaaagctatcaagcctctattttgattaacccgatacccttttttcatttgataagcataaacattgttctcttcatcgcgttctatgatttcattcttactatatgtgatattaccacgtacagtgaacttaacatcactaattttttgtttataactaaagtttccatcaaacccttttgaatttacttcacccacattagcataaggtttattgccatccagaccaaccattcctggtaagaatgcacgctccatataaataccactacgactttcatcaaaatagtcgatcgtagctgtgaatttgtcattaaataaagccatatctataccaaggtcgcttttggttgctatttcccatgttatatcattagaagcaagttttgtatagcgtaaaccattataagatttattacttccataagtggcccagttgtaacctgcataatatttcgtctgatcattttctttatagttatcggcaattgaataaagatatgggaaacgggttcctacattatcattaccgaccttaccataagaataacgaaccttaaacatattcatccatttcagatgcttttttattattttctcttctgcaatattccatgccagagaatatgcgggaaaaaagccaaaacgatgtcctttcgcaaaattttccgaaccgttgtaaccaaaattgaagtcaacaaaatatcgatagttataattataagcaaagcgccctgccaaagcctgatttcgtctactcactccctcttttaaatcatctcccaaagcaaccgttttaacaaaagcatcttgggtatatttcaatgtcgcgctaggatgatgtgctttaaacgctctgttccaatttaacgtcaaatctaagaattcacgacgatttccacttgaactactctcctgtgccatatttcctgcaccggaaatctttttaaatactaattcaccctcttcattgcgagctcgttccgcaagccattgttccggccatttatgacgtttgatagtattatcattatatgtgtcatatccaaaacgtcctacaaatttcagatttttagtaatgaagtctagtttctgctccaatgttacattagtttgaatagtatttttccaattctcattaaaacctgtttgggtagccgctacccatgggttagtcttattacccgtaccgacggcaggtacatagccattagaatataataccggagttcttattggagtatatccaaaaagttctccccatacatcagaatctcccaatcccggactatttcttttggataaataaccggaaactcctaacttgagaagtgtactttttgtaatatcaatatctgtgttcatgcgataattataacggcgataatcagcgttcgtgttataatctccttttaacgagctatccgtgttatacataccctgttcgtccaaataactgaaagatacaaaatagcgtgcagtatttccaccaccattcatattcagatttacccgatgttgccacgctccctcctttaatagtaaatccatccagtccacattcggatagaggtctggatctaacccaagacggataatatccaactcttcaggctggtaaacgggttcatagttacgagtaatacgtgcttcatttaaaaaatttgcataatttaccccattctcaaattcaggagtgatcgtacgcatattataagtcgtttctgcttttgcggtaatattaattttaccggctttaccgtgtttagttgtaatcaatactaccccattcgcgccttttgatccataaatagcagtggcagaagcatcttttaaaactgaaaaggattcaatatcttctatattgatttcatccatactgcgttcgaagccatcaaccaagacatacgcgctagtacttgcaccaaaagtcgaaattccacgaatccaaaactcagatacatttttaccaggttgtccggaagtctgcattgccaaaacaccagcgacattaccggctaatgtatttacgatactagaagacggattagctttcagatgatctacatttactgttgtaatagcccctgtctgagtcaattttgtctgagctccagtaccagtaataaccacttcgtcaatagcattggtaacatcttcttttagtactatatttacttttgactgattttttattagaacttcttgtgactgataaccaatataagaaaataccaagcgattgtaaggttccactttaattacatatcgtccgttgagatctgtgattgttcctagccctgggacatcttttacactaacattagcaccaatgaccggttctttattctcatctgtgacaataccagagacactaatcttttgctgtgccaaggcgtttatagccacccatagcaacatagtacataagacaaataattttttcatattttagtgtgttaatcattaaattcttctaaagctattttacggatacggtgattataagcatcacctacataaactattcctgtcttttcatcatatgcaatagctttaggacgttcgaaacgagcttcttttctcaaatccccattaacatacccccaaggattagaatttaaactagcgcttcctcgacctgcaaatgttgagacttgtcccagtggagttaaaattcggatagcatggttatgtttatctgcaatataaaagtcatattcatctatctcacctttataattatcattctttacaaatacaccttggtatgccgaatcgaacttagctaaattcccaacagcatctacatatccattttgattagcgcttcctgctaccacgtaaggagtagtaaaagactccccattataatcagaacgaagaatatagtgcttgttaataaccataaggtaagcataatttcctgttggatgaataattatattaaattcccattctttatcttggacggtaaacatatagtccgcccctgtcccaggtgaaacagctgtagtacgggttccgtcaacaaattcttgaagaatatctttttttactctataaaggtgacctttctgaaaatgagtaaaatataaatcaccgttttggggatggattgctgcacatgcgcaaccattgtaattcacaattgttcttctatttgaccatttaaaaccacatggtttagttgtatctgaaacacgatcaaacatatagaccgcaggattagttgcattagcttgtgatgtagccacaaccatatgatacactccgtccttatctttaaaaaaatcaatagaacgcccacgctcataccctccatactcactcctaggaagaatagtatataattgttgccgtccgaaatcaatacagcgtataccagaacctgtaacaccttcagggtcaacagatgtatcctcagcaaaatataacaactcagggtactcaggatcccatttcataaaacaaggattagcaacaccgccacaattatcaaaaggcccgtcttttatttcaaaatttttctttttatcggaaatttgtggattaacctcaccaagtaaagtacttactacttttaatcgttgatattcaaatctcacatcagatttttcagaagtatatgttttttctccatcttttatcgtaacctgtatatcaccttcataggcttttgatggcataagacaatacatatatgtagactttacatttacaaccgagcttttctgaccaccaatataaacttccaattgggaaggattatttccaaaattctctccataaataagtactctttgccctgcagagcctgctttagggtaaatactatcaatacgaataggaaaagcaggattgaatggagttcctccactacctgtaataggagatacttcttttccatcatcacagcttcctaaaaaaaaggctaataatgtaagcatgacgtatggtatacaccaaaacttacttttcttgttactttttaaattcataataaattagatttaaattactgattattcatgactttgttcatcaatacctgcatccaataacctcctattaccgagcgagctctaaaaccaacccatttcccactatctgtgtgatgccagtcgctgatgggtacccgtgaagtcgtttcattgatatatttatagagaggatttatgaactgttcgaaagtatcttggtctggagacatagctgcaatccacataatccagtcagactttgtatactctttgcgagagtccaatggcaatccataaggattctgtttcgtcaaatagtaacttacttccttgtcgattacattattggggaacaaattcagattccacatcttgtcccaaatcatattatatttctgactccaggtattctcacggtcgaaagcaaggcggtaatgattaccttcatttgccatttcttcccatttcaccgccattttcttggctatacctgcatatttctctgcaacatcatataaaccaagcatatgcgccatttcgctatatccggctacacccatgatcgct

SEQ ID NO: 167 - DNA, 15996 bp, Bacteroides thetaiotaomicron
aaatcagactctttatttttttcagtatctagagaataaatcaaattatgacgtatcatcagaccatcaacagccttcgctcgaatggcacatgagctattttttctcatataaaaataattttcttcaatagtaatatttttatgaaccgcccctttatattctctattctccggatcaatgctaataatcggttctccacagtttaaaaacgtattttgacgaatagtcaagtcatgtaccggtcctgactcataccagcttaatccatcatcggctacaaatattccactcatctgcatgccgtagaatgtatttccttctatcagagacttacgtcgtgttgtgataagaatccctctggttggtactcttgcaaagtaattgtttgtaatccgcacttccggtgtccacgtcacgttctcaataaccaggtctttctgttgcattacctccgaagagagtggacttgacagagtgagttccatttctcttggcgttactaattttgcctcttttactttacacttccctactaccaacagagaacgtgaatcaacaagttctatatcgtctcctttaaaaaaggcttcaaatccaaaagtctggtcatgcataaaacgaagttttaaacgattgtccgacaaaaattctattactcgcaaatgtgtaccatgtatatttataggatcatcgtgtgcacctataaaacgggaattcttaatatcaatcataccacggcaaccagaaacctgaataaaatcagcaaatcccgcattagtacgtcctgaacctggacgaggagcaaagttacaacgatcaacagtaatattctcactgtattgacagactaccccgaaatttcctaaataatagaagttgatattctccaacagtattcccttacttctgtttacaaatccactcacttcgtcacggaaagaatcgcgcatctgaaaaatagtatgtagtcctacttgtggtttttctttatattgcagatataacacatttggacgaagttctactgtacgaagcaaattctccatcggactccaagaacgccaagtcatttcacttatacggtcatacgactgcgctattccgttcttaaaagaccaaccatcaccataccactccaactgtgcgtctacaatccgatattgggatgtgggatgtacctgaacaatcaaataatcattcccctcttccaatacttcaacctctgtttgagtaggatgtttataatctatattaaaatttttcaaaacaataccttcacatttatcaagtacgaaacttgtcatttcaccattcatcaataaagttgacccacaaccatcaatagtgatattctttaatgtattaagatacaatccgatatgtttagtcggatcaggatcatccaactcagaagtcgtatttgatatataatataacacttgtgatgatttcgcacagtctaactgataaattcccggtgaaaactttacagtaaccggccttcctttacagtcagcagctttttttaaagctaacgctatattttcaatatcttttccctgctccggaaaaacctctattattctagactgggcaaaaatagccaactggatgaaccaaacgctcatcataaataaaatgtactttttcatgatattgatcttcaaattttacttttttcacaaagatagaaattatctataccctattatagatataaagcaatcaaaaaatagaatgtttgctgcaaatatttcattttttgattgctttgtacacatataatctttctgttattacctaattttgtatccgaacctatataacataaccaatttaaaaaagaaaataatgaaacacacctttattacatttattctactgtctctttgtattttcacttatgcacagaaaaagattgcacgtgaatatatcgaatggtctgacatttggattcccggagctaacaaaacagatcttccacacgtactgcttatcggaaattccatcacacgcggatattacggaaaagtagaagcagctctgaaagaaaaagcatatgtaggacggctctccaattcgaaaagtgtaggtgatccggctttaatcgaagaactggccgtagtactcaaaaatacaaagttcgacgttatccatttcaataatggtttgcacggattcgattatacagaagaagagtatgataaaagtttcccaaaattaatcaaaatcattcgtaaatacgcccctaaagccaagctgatctgggcaaacaccactcccgtccgtaccggagaaggaatgaaagagtttgcccctatcaccgaacggttgaatgtacgtaatcagattgcactgaaacatatcaatcgtgccagcatagaagtgaacgacttatggaaagtagtaatcgaccaccccgaatattatgcaggcggagacgggacacatccgattgacgcagggtattcagctttagcaaatcaagtgattaaagttataaagaatgtattagtacattaaaccttattcattctattttaatatggcaataatgaaaaatcaaaaatcaactctattattaattatctattgtttatcaacctgcatagtaacggcacaacaacatgtagaaacaattaaaaatactttcttaaatccaaaatcaaacaaagtgttagttgttgctcatcggggaaattggcgtagcgcaccggaaaattcaactgctgctattgacagcgccattgctatgaaagtagatattgtagaaattgacattcaaaaaacaaaagatggacaactgattctaatgcatgataatacactagatcgtactaccactggaaaaggagaaattaaaaactggactctggcagatataaaaaagttaaaattgaaagataaggatggaaaagtaacaaattatgttgtgcccactttagaagaagctttgttaacagcaaaaggaaaaatcatggttaatttggacaaagcatatgacatttttgacgatgtatatgctatattggaaaaaaccgaaacccaaaatcaagtaatcatgaaaggaggacagcctatagaaactgtcaaacgagaatttggttcttatttggataaagttttatatatgccagtaatagatttaggtaacaaagaagctgagaaaataatcacagactatttgaaagaattacgtcctgctgctttcgaaattatttattcagaccccaaaaatccgcttcctccaaaaataaaacaattactttttaagaaaagtttgatttggtataacacattatggggatcacttgcaggaaatcatgatgataatcttgcactgaccgatccggaaaaaagctacggttatctgatcgaacagctaggagcccggattttacaaacagatcaacctgcttatttgctcgattatttaagaaaaaaaggttggcacaattaaattaataacatctttaattctcaataaaacacattatatggataagaaaaaaatcagttatttaatactcctttgtttattctctttaagctgcacgctacaggcagagaaatatgaaacggtttctcctaacggaaaactgaagattaaactgaaaatagacaaaggtacccaatacgaagtatggtacgataatacacaacttatacttccttctcccatcggattacatctggcggacggcagagtaatcggcaacggaagtgtaaagtcggcaaagaaaagaaaggtgaaccagactatcgacgtccttgttggtaaaaacaaagaattacaggatgcttataatgaacttaccgtttctttcaatgacagttgcgaccttgtagtacgtgcttatgatgaaggagtggcctatcatttcgtcacccgtctcaacggagaaattacaatcatcagtgaagatgccattttcaactttgcttccaccccaaccatctattatccggaatgcgatgctaattattccggcgaaacggatcaatccggacgtacccatcaggtacatcaaggatatagaaactttgaaagactctataaagtctacaaaggtccgttggaaattccttacgaacgttttgctgtttctccggtattatacgaatatcccgattctccttataaagtggtcataacggaatcaaatacctatgattatccggctctgtatatggaatccaacggctacaactccatgcgcggaaaatgggctaattacccaaaagaaacaatagactccgatccttccaatccttactactggtattccaatcatttggttgttaccagagagaattacatcgcaaagactgatggaaaccgtagttttccgtggcgtgtcatcatcgtttcggaagatgacaaatcattattgaacaacgaactggtatacaaactggccgatccttgccgtctgaccgatacttcctggatccaaccgggaaagagtgcatgggaatggtggcacaaagccgttttggaaggtgttgacttccccagtggaaacaagcagctttctccccagttatataaatactacgtagactgggcttcaaagaatcatatcgaatatatgaccttggatgccggatggtccgaagattacatcaaagaactatgctcatacgccaaagaaaggaatgtgaagattatcgtctggacatgggctagttgcgccagagagaatccgagcgactggatcgctaaaatgcacagctacggtgtatccggagcaaagatcgactttttcgaacggaatgaccagatagccatgcgatggggaaaagaatttgcagaacgtctggccgaaaagcaaatggtagctattttccacggttgcccggtccctaccggattgcatcgcacgtatcccaatatactgaactatgaagcagtaagaggagcggaatgtaacttttgggaaaagacgttgactcccgaatatcacactcgttttcctttcatccgcctgttggcaggaccggcagattatactccgggatccatgagaagtgtcactcaggatgaattcagaccgatggatatagataatactccgcccatgagcatgggaacacgttcgcatgaattgtccatgtttgtcatttacgaccaatggatggcttatttatgtgactcacccactgaatacaataaatatccggatgtactcgacttcctttccaaagttcccgcagtttgggataagaccttgccattgcaagcaaaattaagcgaatacatcgtgacagccaaacaaaaaggcaatgactggtatgtgggcggaatgaccaactgggatgcccgttctacagaagtgaacctcagcttcctgaaagacaatgtctcctatcaggcaactatctttaaagacgctccgaactcctacgagcaacctaaagaatacatggtagagaaaagaacagtggatagtaaaaccatattgaatataaatatggcaaaaggcggtggattcgttattcgtttggaagcagaaaactaatatcgctatgaataaaatttaaatgagataattacatctcaaagaacggtaccatctgatacacggaatggtacactccaatacattaaacggtaccatccagtatgttggatggtaccgtttaatgtattggaaggtaccgtttgtatatcctatcataatcccagcttcgccgaaatctccagcatccgctgaataggcctcactgccttctccgctatttcgggatctacagtaatctccggtgactcattcttcagacactcatagagcttctctaacgtattcaaccgcataaagctacactcgttacatccacaggtgctatcgttcggaggagcggggataaacgttgtctgcggacacttcttctgcatctcatgcaagatacccgattcggtagccacgatatacgtattctccgggtggttcaccgcatacttcagcagtgcagctgtagaccctaccacatctgccagtttcagcaccgtacttttgcattcgggatgtgccagcaccaatgcttccggatgctgcgttttcaattccacgatcttttccaccgagaactgttcgtgcacatgacaggctccgtcccaaagcagcatattcctgttcgtaactgagttgatataatttcccagattccggtccggaccaaagattattttctcatctttgggaaaactttccacgatctgccgggcattagtggaagtcaccaccacatccgttaccgccttcacggcagctgtcgtgttcacgtacgaaataacggtgtgccccggatgctctttgacaaactgcgcaaactgatccgccggacaactgtccgccagcgaacaacccgcttccatgtcgggcaccagcactttcttatccggacaaagcaccttcgctgtctcacccataaagtgaacgccgcacatcacaatgatgtccgcctccgttttggcagccagttgagccaacgccagactgtcgccaacgtaatcggcgatatcttgtatttcacccttctggtagtagtgccccagaatgattgcattcttttctttcttcagctcattaatagcctttatgagattattcataataatattcttttatttcttccttttaaaaaaaatcctttgttagtgatgatagcctgttaatagtgttagcaaataaatacgatttttcttgccggataagttattagtccatacttctgctttatgagtccgttatgaacggaaggaaaggtggaagattgactatttattatcttcattatcaatgtaagccctatcaaatgggagaatgctattaactccctgttgataaagtgcaaagttaaaaactttatggatataaacaggcagataagtgctgaaaaatatgttgatgtctgcatagaaagttttgtctttgttttttggaatgttcataatgaaggccccttataccttcttttgaataatgcaagaattatttttcaaattctttcccgattgttttgacaggttttaaaccgttatcaacacctctgttaacagaaaagaactacctttgcaaccgaaacgtaataaatgaacaacgtatgcgaaaactgaaaataacagagctgaaccgtatcagtgccgaagagtttaaacaagcagaaaaactgcctctggtggtagtgctggatgatattcgtagcctgcataatataggttcggtattccgcacgtcggatgctttccgtatcgagtgtatctatctgtgtggaataacggccacccctccccaccccgaaatgcataagacggctttgggcgcagagttcactgttgactggaagtatgttaataacgctgttgatgctgttgataacctccgtaaagaaggatatattgtttattcgatagaacaggcggaaggcagcattatgctggatcgactcgaactggacaagacgaagaagtacgctatcgtaatgggaaatgaagtgaaaggggtgcaacaggaagtgattgatcattcggatggttgtatcgagattccccaatatggtaccaagcattctctgaacgtgtctgtaacaacgggcattgtcatctgggatttgttcaaaaagctgcgttgacggtgtaaaatcagtcggttaataattagttaataagtggttgatatcatagttaacttgctattaaccaactatttttttctgttcataattatgtgtgatgataagaatattgtagcaacttactcttggttgagtctgattgattcagtgtttattaaccatcctgtttcaagctgttatcagatggcatcacagctattaatagctgacttctcaactgttaatacttctcatgcagactattaacacctgacaggtcaactgttaataccttagaagtcagataaagcggggtaattttcctatggtgatagtggaattggatttaatagaaatatgatggttaataacaacgttgataaccttatgacaaggtgaatcagatttgtccgttctctaccagcagcacaactctttccgtcagtttatcttctcccaacggatcatattcctttttcagactggcaccgaacagtgcggcaaatgtctgatagaatcctgctttgaaaggtcccataaaagctttcaccagttcataactggtggaattactttggcggtctatcaatttaatcaagagtttgccttgtgtaaaagagagtttcttcatccgtgcggtatattgttccttcagtcctttttccacccgtttgagatgtttttggcgagccttctcgttgggtaatgtctgaagatactcgtaagtttcaataatagcctggttaatttctttggagataggatataccttctttacgttacgtaccagccggtagtattccagccgttctttttcgtttttgaattttagcgggcggaagatataaacagtccttaactggacacatggaatggtatctccgttgtagatacacattggaaccaagtatccgttgatgctttgcttgtcctgtgcctgcatcttcgatgaacagaccatagcaaacgccatcattattactatgttaagcctccttttcacgttacaaaaatagaattaaaattttattattcagacatttcttttagacgttaacctatttaaagtatctttgcggccttgtctgtaaaaacgcaaggtgcaaacaaataatttattgatgaaaactactcaactatttcggttgataagtattataaacagcctgttcattattcctgcttgtagtgctcaaaacccttctcaaagtcttatagaagatatttttgaagatttatctgttaataatagtgttgataatgctgttaatgaacccaactgggagaatgaactggaagaattgtccgtccgccttcacgaacctgtagatttaaaccgggctacccgtcaacaactggaacaatttccttttctcagtgatattcagattgaacatctgctggcctatatatacgtgcatgggcagatggaaacactttatgaacttcagttaatagaggatatggacaggcagactattcagtatctattgcctttcgtatgcatcaaagctattaacaatgagtcgtcttttcggtggaaaactatgttgaaaagcgctatgaagtatggaaagaatgaagtgctaactcgcatagatataccgttttataagcggaaaggttatgaacatacttatttgggaccttctgtttataactctgttaaatacgctttccgttatcgcgaccagctctatgcaggtctcgttgcggagaaggatgccggtgaacccttccttgctctgcacaatcgtcaaggatatgattattattccttttatctcttattcaaagactgtgggcggttaaaaacattggctgttggtaactatcggttaagtttcggacaggggctggtgatcagcacggattacttactgggaaagaccgtatatgcttcttctttcaacacccgcagcggaggaatcagaaaacattcttctactgacgagactaattattttcggggagcggcggcaaccgtaagcattacaaaacaatggagtgtgtccggcttttactcacaccgttcgctggacggtgtgctgaccgatggcgaaataacttctatctataaaaccggactacaccgcagccagaaagaagccgataagaagaacgtattcaccatgcagctgaccggtggaaacgtgagttatcaacagaaccgtatccggctgggtatcaccggtatttactatgttttcaaccgaccttatgaaccgcaattaacaggttattctcaatacaacattcatggaaatcagttctacaatttaggaatagactatgcctaccgctggcatcgtttttctttccaaggagagacagctatgggaaaacaaggcagtgctactttgaaccgcttccaatattcaccggtggaaggaactcagttgatgatcgtacaacgatactattcatataattattgggccatgttcgcccattcttttggagaaggaagtgcggttcaaaacgaacagggatattatctgggggtggaaacttcccctttccgctattggcacatccttgcttccttcgatctgttttctttcccgtggaagaaataccggatcagcaaaccttcccggggtatggacggattgcttcaggctacgtttactccgcacaataatttgacaatgtacttaaaatatcgttataaacagaaagagcgtgacttgacaggtagcaaagaaaacctaacgcttcctatttttcatcaccaacttcgatatcgtttgaactatttttatggagatgtgtttagctgtcgtacaactttagattacaaccattttcattctcaagacagggctgctagtaaaggatatcaagttacacaaatgatgtcctcccaactgccttggaccaggctgtttgctgacgttcaaggcagttatttttctacagacgattatgattcgcgggtatatgtatcagagaagggattgctttatacattttacactccctcctttcaaggtcgtggatttcgctgtgccgtccgtctgagatatgagccgaatgaacattggatgtttataactaagttcggagaaaccgtttatctcgaccggaatgaaataggttccggcaacgatttaatccttggaaataaaaaagctgacgtacaaatgcaactccgtattaagttttaaagtatctttgcctttggatattatgaaatagtaaatgataaaataatgtgagcttgatgtgataaacgtccgtattgatattgaactcacattaaaacaattaataaaaagatgactattatttttccttcacccatcttcggccctgttcattcccgccgcttaggtgtatctttgggaattaacttattgccggaagacggcaaagtctgctcgttcgactgcatttactgcgaatgcggctttaatgccgaccatcgtccgaagaagcatctgcccactcgtgaagaagtgcgcatcgccctggaagaaaagctgaaagatatgcagaagaacggtcccgcccccgatgtactcacatttgccggaaacggtgaaccgactgcccaccctcattttccggaaattatagaagatacactggcacttcgtgaccactatttcccgaatgcaaaagtaagtgtattgagcaattctaccttcatcgaccgtcctgcggtattcgatgcattgaacaagatagataataatatcctgaagctggatacagtgaacgaagaatacattcatctcctggatcgtcccaacgggaaatattccgtaaggaagatcatcgaaaagatgaaagaattcaaaggaaattgtattgttcagactatgtttctgaaaggtagttaccttggaaaagatatgaataatacatccgatgagtttgtgctcccctggctggaagcagtcaaggagatagctcccagtcaggtgatgatctatacgattgatagggaaactcccgaccatgatctgcagaaagccactcatgaagaactggaccggattgtagaattgataaagcgaacgggaattccggcaacagcgtcctattgatggataagtgaattatgctatttgttgtacaagatatcggattagatttaaaaaataaggtgacacgctattgacctccgcttatccctatgggatttgtgaataaataataataaaacagcttctgatttagggtaacccaaagatgaagtgtatttattaccaaacgagtaattttacaatctgacattaacagtcttaatttctaataccaaataaataaaaacatgaaaaaagaaacccccatctctttacgacatttcaggcgtattaccgccattttattcttatgtccgatttccctttcttccatacaggcatccgcagcatcggatcagagtgacgtttcttcggcatccgtccatcaggaacaaacttcgggaatccttcgtgcagaaaaaataaacccgacgacggttgatgtactgtttgcgaaccagcaacggatgactatcgacttttacggagagaatattttccgtgtctttcaggacaattccggaggcatcatttgtgaccccgaagcgaaacctgaagcgcagatacttgtagaccagccccgacgcaaggtttccggactgtcggtggacgagaaagatggatatatcaccctcaccaccgcccaagtacggattgaactgaataagcagaccggactgatgaaagtctttaatccgttaaccggcaaatgtgtgatcgaagaagtcgctccggtgatattcggtcctaaagaagtgaccgtaaccttaaaggagaatcccgaagaatacttctacggaggcggtgtgcaaaacggacgtttctctcataaaggcaaggttattgccatcgaaaatcagaatagctggacggatggcggagtggcctcccctgcccctttctactggtctaccaatggttacggaatgatgtggtacactttccggaaaggtgaatacgactttggagcaacagagaaaaacatagtgaaactgtctcacaattcttcttaccttgatattttctatatggtcaacgacggagtcgtttccctgttgaatgatttttatcagttgacgggaaaccccgttttgttgcccaaattcggtttttacgaaggacatctcaatgcctacaaccgtgactactggaaggaagacgagaaaggaatcctctttgaagacggaaagcgttataaagaaagccagaaagacaatggcggcatcaaggagtctctgaatggtgaaaagaacaattatcagttctcggcacgtgccgttatcgaccgttacaagaatcatgatatgcctctcggatggttacttccgaacgacggttacggagccggatacggacagacggaaacactggacggcaacatcgccaatctgaaaagcctgggagactacgcccgtaagaacggagtggaaataggcctctggacacagtcggacctgcacccgaaggaaggtataagcgccttgttgcaacgtgacatcgtgaaagaagtccgtgatgccggtgtgcgtgtactcaaaaccgacgtggcatgggtaggagccggctattccttcggattgaacggagtggcggacgtaggacatattatgccttattatggcaatgatgcccgtccctttatcatttcactggacggctgggcaggcacacagcgttatgccggcatctggtcgggcgaccagaccggaggcgaatgggaatatatccgttttcacatccctacttatataggttccggtctgtccggccagccgaatatctgctcggatatggacggtatcttcggtggaaaaaatgcggcagtcaatatacgtgatttccaatggaaaacatttacccccatgcagttgaatatggatggctggggcgccaacgaaaagtacccccatgctttaggcgaaccagctacatccattaaccgtatgtatctcaaactgaaatcggaactgatgccttacacgtatagctttgcccgtgaagcggtggatggtatgcctctcatccgtgccatgttcctcgactatccgaatgaatatacctacggaacggctacccgctaccaatatatgtatggtaccgactttctcgtagcccctgtctatcagaatacgaaagctgataaagaaggcaatgatatccgcaatggaatttatctgcccgaaggcacttggatagattatttcagcggagagaaatacgaaggcaaccgtattctcagcaacttcgatactccggtctggaagttacccgtattcgtaaagaacggcgctattattccgatgacacaacctaacaataatgtcagcgaaatagacccctcacttcgcatctatgaattttatccgaaccgccatactgcaaccgtagaatatgacgatgacggtgtgacggaagcctaccgtcaggagaaatcggtatctaccctgatcgaatcgaacgtagacgcaaagaaccgtgtgactatcaccattcatcccacagccggaagtttcgacggttttgtaaaagataaaaagacggaactgcgcatcaacgtcacggagaaaccgaagaaactgactgcaagaatcaacaacaagaaagtaaaactgacggaagtaagcacggcagcggaacttctgaatggagaaaacgtattctggtacgaagaaacccccaatctgaataagtttgcaaccaaaggaagtgaatttgagaaagtggttatcacaaagaatccgctgttgcacatcaaactgggcagcaccgacatcaccgccaatcgtatcgagctggacgtggaaggtttccgctttgagccggccgaccggaacttggtaagcaacggaaccctgtctgcaccgcaaaacgctcaggtaagcgagcagaacagagaagcatataccctgcaaccgacttgggacaaagtacccaatgccgattactatgagattgaatttgacggaatgctttatacgactatccgggatactcacttactgtttgaagatctgaaagcggatactccttacgcattcaaagtgcgtgctgtcaacaaagacggtgtgtccgaatgggcagagattcaggtgaaaacgaagactaatccgctggaatttgctattcgtggcattgaaggcgaatcgactgccgcatcgcagggaggattcggtgtagaccgattgttcaacttctccgaatcgggagatacatggcacacgaagtataacgttaactccataccattagatttgattatcgacctcaaaacagttaaccaactggataagttccattatctaccccgtgcggatgccggcaacggtacactgctgaaaggaacagtatcctacagtatggacaaagaaaactggacggaagccggagcattcgaatggcagcgggacggtgatgtaaaagtattcactttcacagagcgtccaaatgcacgttacatcaaactgaacgttacggcaggtgtaggaaactatggttcaggtcgtgaaatctacgtattcaaagtaccgggaacggcaagttacctgcaaggcgacatcaacaatgatggcaagatcgaccgcaatgacctgacttcttatatgaactataccggattgcgtcgtggtgattcagactttgaaggttatatcagcaaaggcgatatcaacatgaatgacttgatagatgcttatgatatttctgtcgtagccactcagctcgacggcggtgtcgacaggaaagctacggagaaagtatccggctctctgtctatcagcactccgaagaagcagtaccagaaggacgaaatcgttgaaatccgtgtgaaaggtaatgatctgcgttcggttaatgcacttagctttgctttgccttatgatcagagcgactatgaatttgtaggtgtggaaccgctgaatatgaaagcaatggaaaatctgacttatgaccgcctgcatacgaatggtgtgaaatctctctatcctactttcgtcaatatgggaaaacaggaggctttggaaggttcggaagaactctttattctgaaattgaaagcgaaacgtaaagtgaagtttgatctgaatctgaaagacggaatattggttgataagcaactgaggatgcattcattctaaatgtatttcgtgtaaatcattgatatataacaaaagaggatgcctgtggggaactattggcatcctctttgctttaagagctattttatttggacgttataaatatacgtataatagatagactttcagattaattttatacatttaccaatgtgtgcgaaggagtgagcgtataggagttaaagataatcatcacaaacaaataatag

SEQ ID NO: 168 - DNA, 15951 bp, Bacteroides thetaiotaomicron
ttgcattggccacattgagaaacaacaaaagagagataccaatcaatagaaaaagattaatagcagggtgggataatgaattcttatgggaacttattttacatgatttataatgcgttttccctgcccttcaaaaatacagtattaatagatgatatacatacccacatactatatgttatatacaaagtagcggtaggttccatgttctgtaaggcttgccatagtacaatggattatcggctttgagacgaatgagagataactgaaatatgaatgagaggtagtcaaaaagaaagctatttgatgaggaaatgatgagagataactatttaaaaagtatctctcattctgtattgtgctgattgtctatatattagttgtcataggatgagagtatgagattaaaatattttttttatttctgaagagaggcggggaaataaagaaaaatcccgtttgtcggatgtgaaaaggtgctatattgctccatgtaagcactatattttttctgttgaagtactttggtatatgctttattgataggtatttatcagtgttgaaatattcggaaacgctatattttaattataatccgaagtggcgcttgctattcctcactacatttgccatatgattattaactaattcatttatatcatgaagaacatgaaaatattaactacggcagtactctgtctgttactctctttttctatgggtgcaacggcaatggcagaaagtatcacttctcctgacggacaattaaaactggatttttcggtcaatgttcagggagaaccggtatacgaacttacttataaaggaaagggagtgattaaaccatcaaagttgggacttgagttgaagaatgatccgggactgatgaatgggtttgcgtgcatcgatacaaaaacttccaccttcgacgaaacttgggagccggtgtggggagaagtgaaatccattcgcaatcattataatgaaatggctgtcacactgaatcagaaggcgcaggaccggaatatgatcatccgtttccggctttacaatgatggattaggtttccgctatgaatttccgcagcagaagaatctgaattattttgttattaaggaagaacattcgcagtttgccatgacgggtgaccatactgccttttggattccgggagattatgatacccaggaatatgattacacagaatccagactaacagaaatccgtggactgatgaaaggggctattaccgacaatgcttctcaaacgtctttttcaccaacaggcgtgcagacatctctgcaaatgaaaacagccgacggtctgtatattaacctgcacgaagccgctttggtagattattcctgcatgcatctcaatcttgatgacaaaaaactgatttttgaatcatggctgacaccggatgcaatgggagataaaggttatatgcagacaccctgtcagtctccgtggcgtacggtgattgtgagcgatgatgcacgcgatatccttgcttccaaactgaccttgaatctgaacgaaccatgtgcttatcaagatgtttcttggattaaaccggtgaagtatatcggtgtgtggtgggagatgattaccggaaaaagcagttgggcatatacagatgatgtttattccgtcaaactcggacagacggattactcaaagacaagccctaacggacgtcacgctgccaacaatgacaaagtaaaacgttatatcgactttgcagcgcagcatggtttcgatcaggtattggtagaaggctggaatgaaggctgggaagattggttcggcaaatcaaaagattatgtgtttgatttcgtcactccctatccggatttcgacgtgaagatgctaaacgcatatgccaaagagaaaggggtgaagctgatgatgcatcatgaaacatctgcctccgtgcgtaactacgaacgccatctggatacggcctaccaatttatggttgacaacggatataatgccgtgaaaagtggttatgttggcaatatcattcctcggggcgaacatcactatggacaatggatgaacaaccattatctatatgccgtgacgaaagccgccgattataaaatctgtgtgaatgcgcacgaagctgtacgtcctactggattatgccgtacttatcccaacctgatcggcaatgaatcggcacgggggacggaatatgaagcttttgccggtaataaaccttttcatactactttgcttccattcactcggcagatcggcggcccgatggattatacaccgggtatcttcgacacgagaatttcttttctggatgggaagcatagcgttgtacgtactactctggcgaaacaactggctctttacgtaacaatgtacagtcctttgcagatggctgccgatttgccggaaagttatgagcgttatccggatgctttccagtttattaaagatgtagccttggactgggatgacagcaaatatctggaagccgaaccgggggattatattacagtagcccgcaaagcaaaaggaaccaatcattggtttgttggcggtattactgacgaaaactcccgtactgccgcgtttactcttgattttctggaaccggataaagagtatgtggctaccctgtatgccgacggaaaagaggctgactacgaaaagaatccgacttcctatcagataaagaaagggatcgttacgaataaaacaaagatgtccgtcaagctggcacgcagcggtggttttgcattgagtcttatcgaagcagctccatccgaccggaaatcaattaagaaatggaaatgagacgcgactaaaacgattgttcaatcttctttgtatttttaataaaatttagaagtactccgcaaagaaaattaaaactttgcggagtgctttttttatcggatggattcttttttgtacttttgcgccatctttttttaaacattatcaataaagagaacaacatgggaggttttttcggaacagtctcgaaatcgagttgcgtgactgatttattctatggtacagattataactcacatctgggtacaaagcggggcggactcgcgacttatagtcaggagaaaggatttattcgctccattcacaatctggaaagtacatatttccgatccaagtttgaaggagagcttgataaatttaaaggcaatgccggcataggcattatcagcgacacagatgcacaacccattatcatcaattcccacctcggccgcttcgccatcgtcacagtcgctaaaatatcgaatatccaggaactggaagaagaccttctcaaccaaaatatgcacttcgccgaacttagttcgagcaacaccaatcaaacggaactcatcgcactgcttatcatacaaggaagaaccttcaccgaaggtatcgagaacgtattcaaacatatcaagggttcttgttctctgctgattctgacagaggatggcagtattatcgcggctcgtgaccaatggggacgtactccggtggtgatcggcaagaaagatggtgcgtatgccgctaccagcgagtcatccagtttcccgaatctggattatgaaatcgaaaagtatctgggaccgggggaaatagtacgcatgtatcccgatcatatcgagcagcttcgccaaccgaatgaaggaatgcagatttgttctttcctttgggtgtattatggtttcccgacctcttgttatgagggcaaaaatgtagaggaagtccgtttcaccagtggaatgaagatgggacagaaggacgaatcggaagtggattgtgcctgtggtatccctgattcgggagtaggtatggcgttgggttatgcggaaggtaaaggagttccttatcatcgtgccatttcaaaatatacaccgacatggcctcgtagcttcacacccagcaatcaggaaatgcgttcgctggttgcaaagatgaagctaattccgaatcgtgccatgcttcagggaaagcgtctgctgttttgtgatgattcgattgtgcgtggaacacagttgcgtgataatgtgaagattctatatgattatggagcgaaagaggtacatatgcgtatcgcttgccctccgttgatctatgcctgtccgtttgtgggtttctcggcttctaagaatgctttggagttgattacccgtcgtattattaaagaactggaaggcgatgagaataagaatctggagaaatacgccactacggggtctcccgaatacgagaaaatggttagtatcatagccgagcgtttcggactgacttcattgaaattcaacacgcttgagactttgattgaagctatcgggctgccgaaatgtaaagtgtgtacgcattgttttgatggtagcagtcacttttaagtaatatactgagaaaaaagagccgtgaattgtttgtcaattcacggctctttttttacctttacggcactataaactatcaaaatgtaaattgcaaatcattaaatcgtaaaatagatatgactttagtagacagatttttgaagtatgtgagctttgatacacagtcggatgaatcaacagggcttactcccagtactccgaaacagatggtattcgctgaatatctgaagactgaactggaatctttggggttggaagatattactttggatgaacatggctatctttttgccacgcttcctgctaatatagataaaaaagtacccactatcgggtttatcgctcatatggatacaagtcccgatatgacaggaaaagatgtaactccacgtattgtaaaaggctacgatgggacggatatagtgctttgtgccgaagaaaatatcattctttctcctgcacaatttccggaactgctcgatcataaaggagaggatttgattgtaacaaacggcaagacgctgcttggtgcggatgataaagcgggaattgccgagatcgtatcagcaatcgtttatctgaaagaacatcccgaaatcaaacatggaaagattcgtatcggtttcaatccggatgaggaaatcggtgaaggtgcgcataagttcgatgtcgggaagtttggctgcgaatgggcgtatacgatggatggtggtgaagtaggggaactggagtttgaaaatttcaatgctgccgctgcaaagattacttttaaaggacgtaatgtacaccccggatatgcaaagaataagatgataaattcgattcgtgtcgctaatcagtttatcgcaatgttgccatcgacggaaacaccggagcagactgaagggtatgaaggattctatcatctgatcagtattcagggagatgtagagcaaagtacagtgtcttatatcattcgcgaccatgaccgtgccaagtttgagaaacgcaaggaagaaataaaacgtctggttgcgcaggtcaacaccgaatatggagaaggtacggctacacttgaattacgtgaccaatactataatatgcgtgagaaaatagaaccggtgatgcacatcatcgacactgctttcgcagccatggaggcggtaggagtgaagccgaatgtgaagccgattcgtggcggtacggatggagcgcagctttcattcaaaggtttaccctgcccgaatatttttgccggcggtcttaatttccacggacgttatgagtttgttcctattcagaatatggagaaggcaatgaacgtcattgtgaagattgccgaactggtagcttccaagtgattacattccacgaatatcaatttattacttaaaacttaatacacaaaaaatgaaaaccactccgtttacagagaaacacattgcattaggtgctaaaatgcacgaatttgcaggctataatatgcctatcgagtactctggaattattgatgaacatctgactgtttgtaatgcagtcggggtatttgatgtatcccatatgggagaattctgggtgaaagggccgcaagcgttagcctttcttcagaaggtgacttccaataatgtggcggcacttgttcccggtaagatacaatatacctgcttccctaatgaagaagggggaattgtagatgacttgctggtatattgctacgagccggaaaaatatctgctggtagtgaatgcggccaatatagaaaaggactggaactggtgtgtttctcataatacggagggggcggagctggagaattcttccgataatatggcgcagcttgctgttcaagggccgaaggctattcttgctttacagaagttgacggatatcgatctgtcggctattccttattatacatttaccgttggccggtttgcggggaaagagaatgtgattatctccaataccggatataccggtgccggaggttttgaactttatttctatccggatgctgccgaggcgatatggaaagctgtgtttgaggcgggggaagaattcggtatcaagccggtgggactgggtgcccgtgatacgcttcgtttggaaatgggcttctgtctgtatggtaatgatctggatgataaaacttcaccgattgaagctggattgggatggatcactaagtttgtggagggtaaggagttcattaaccgtccgatgctggaaaagcagaagtcagaaggaactacccgcaaactagttgggtttgaaatgattgaccgaggcattcctcgtcatggctatgaactcgtgaatgaggaaggggaaggtataggcgtggtgacttccggaacaatgtctcccactcgcaagattggtattggtatgggatatgtgaaaccggaatatgccaaagttggcacggaaatttgtattgatatgcgtggacgtaaattgaaggcaatagtggtgaagccaccttttagaaaataaatcttgagtttataaaatttttagccccggataggttttgatactatccggggctaaattattttatgatggttgatgtgaaacatatccgtgaatctgttgtttatacgatagatttattttaattttgtcaccaaatacgatgaaacaatgtctcaattacctacactcattgccgatcttgcgctgatattgatctgtgccggcgttatgactttgttgtttaagaagttaaagcaacctttggtgttgggatatgtggttgccggttttctggcaagtccacacatgccttatacaccatcagtaatggataccgccaacattaagacatgggcggatattggtgttatcttcttgttgtttgctcttggtctggagttcagttttaagaaaatcgtaaaagtcggaggttctgctatcatcgctgcctgcaccatcatcttttgtatgatattgctggggataggtgtcggtatgggattcggctggcatcggatggacagtctgtttctaggtggtatgattgcgatgtcttctaccactattatttataaggcgttcgatgacttgggactgaggaagaagcagttcaccgggcttgtactgagtattctgattctggaggatatactggctattgtattgatggtgatgctttctacgatggcggtaagccataactttgaaggcaccgagatgctggagagtattggtaaactgctgttctttcttattttgtggtttgtagtaggcatctatctgattccggagtttttgaagcgttgcaggaaactgatgggagaggaaactctgcttatcgtatcattggcactgtgtttcggtatggtagtgatggcagccaatacagggttctctgctgcattcggtgcgtttatcatggggtctattctggcagaaacaatcgaagcggaatctattgaccggttggtgaagccggtgaaagatctttttggcgcaattttctttgtatcggtggggatgatggtcgatcctgcaatgattattgaatatgcaatacctatcattgtaattacgatcgcagttattttggggcaggctaccttcggaacattcggcgtgattctttccggcaaacccttgaagacggctatgcagtgcggtttcagtttgactcagattggtgaattcgcatttattatagcttcattgggtgtatctctgcacgtgacgagcgatttcttatatccgatagtggtagcagtttctgtgataaccactttcctgactccttatatgattcgtctggctgaaccggcttcttcttttgtggatgctcatttacccgcttcctggagaaagttcttaatgcgttattcttcgggctcgcaaacagtacttaatcatgagaatttgtggaagaagctgttgctggcaatggtacgcataactgtggtatattcaattgtcagtatatccattattgcactgtctttccgttttgtcgtcccattctttaaggagaacctgcctcatttctgggcgtcattattgggggctgtttttattatcctttgcatttcgcctttcctgcgtgctatcatggtgaagaaaaaccattcggtggaatttatgaccctgtggcatgataaccgtgccaatcgtgcaccattggtgtctactattgtcatacgtattatgattgcggcgttatttgtcatttttgtgatatcgggattgtttaaggcatctattggattgattattggagtggctgtgcttgcagtcttgttgatggtatggtcgcgtcgtttgaaaaagcaatctatattgatagaacggcgtttctttcaaaatctgcgttccagagaggtgcgtgcagaatatttgggagagaagaaacccgaatatgccggacgtctgttatctcatgatctgcatttggcggatttggagattccgggggaatccacttgggcgggaaaaacgttgatggaactaaatttgggaaagaaatatggcattcatatcgcttctatcttgcgggggaagagaaggattaatattcccggtggctcggtgcgtctttttcctatggacaagatacaggtaataggaacggacgaacaattgaatgtatttagcagtgccatgcaaagtggtgcgaagatagactgggagatgtatgagaagggagagatgactttgaagcagtttattattgatgcagactccgtttttctgggtaaaacaatccgtgaatcgggtatacgggataagtatcattgtatgatagccggtgtggaacgggaagatggaactctgatggtgccggatgtaaatgcaccgttcgaagagggagatgtagtgtgggttgtcggtgaaaaagagaacgtgtaccaattagtcgatcaaaaaaacgaaaaaatacaggtgaaataaaagcagaacgactatttttgctttgtcaaaacataaaaataagaatatcatgaagagtgatccaaaagaatgtctgtattgccagaacaatgaaactttgcataatctgatgattgagattgcgcaacttagtgtatcacgtgtgtttttgtttaaagagcaaacttatcgggggcgttgcctcgttgcttacaaggatcacgtaaatgatttgaacgaattgagcgatgaagaccgtaatgcatttatggctgatgtggcacgtgttacccgtgcaatgcagaaagctttccagccggaaaagatcaactatggtgcttactcagataaattatctcatctgcatttccatctggctccgaaatatgtagacggacctgattatggtggtatattccagatgaatccgggaaaagtttatttgaccgatgctgaatatcaggaactaattgatgctgtgaaagcaaatctctaaccaatagttggtaaaatagtgaacggtgaataaacttgtaacttcatgctataagtttattcaccgttcattatttacttatcttcgtcgaaatcaaagtcgaaatcaaaatcatccataaattccggagctgtgaattcctccagacttctgcggtcttttttggttggacgtccggttccccgtgcgcgatcaatgaatccgctgattttactcatttccaatagttcgtattggtcgggagtggtaacgttttccattacatcgggtacaagctttgcgcctactcgcttctcaatagcttgcaacactttgaatgaataggtaataggcggcttcttaacttgaactacatcacccggctttatcatgcgagatgcctttacgtatgctccgttgatagtgacacggttcatcttgcaggcttcggcggcaattgtgcgtgtcttgaaaatacgaacagcccacatccatttatctattcttgcttctgccatatattgataatttattaattaacagtgtaccatgtgtcatggtggagtacttaatgaccgtttgcatatatacgctgtgaaatagtcaattgtacatactcctatttcttattgaactggttcatggtaatatcaatacctgccagacagaaacttttaatgatttctccggctgtttccagtctttcatccattgtcttgcgatcttcgtcagtaaagtgtccgagtacataatcaatctgtccgcctttggggaagtcatttccgataccaaagcgtaaacgggcatagttctgagttcctaaaatggctgctatgtgcttcagaccattatgtccggcatcacttccttttcctttcagacgcagagtgccgaaggggagagccagatcgtctactactattaacacattttccaaagggatgttttctttttgcatccagtagcgaacggccagtccgctcaggttcatgaaagttgacggtttgagcaggattaactggcgtcctttgatcgaaaaactagtggtaaatccgtagcgtccgtcaataaagggaggagcattgttgattcttgccaatgcctctactgtcatgaaaccaatattatgccgggtttcatgatattcgggtccaatgtttcctagtccgacaattagatatttaatcattgttttttcgtaaaaaacagttcgtgaatataaaaagagaaacgcaaattaacgcaaactaatgcagactgaacatctgctttaatctgcattaatctgcgttttgctatatctctttacagggataatctcaaattactttccagcggctgctgctgcacctcttgctgcacgagtcaacttaacagcacatacaactgcttccttagcgctgatcagttcaagaccttcgaagctcagttcgccaactttaacagtcttacccaatcccaggtgagaaacgttaacagtcagtttttcaggaattacattgtacagagctttcactttgatcttacgcatctgcaatgcaagcttaccaccggctttcacaccttctgcaagaccttccaactgtaccggaacttccataacgataggtttagcttcgtcaatctgatagaagtcaacatgaagaatgttgtcttttaccgggtggaattgaatatctttcaggatagcgtttacttttttgccatcgatatccagatctactacgtaaatgtgcggagtataaaccaagttacgaagaccttcgttagtcactgtaaagtgaacaacttcaccagctccgtaaagtacacaaggcacaccaccgttcttacgaatttcttttaaagctcttgcttgttccgaagagcgttctgcaatagttcttgcagttccttttacttcaattgatttcatttcttaaaaaattgtgttactctaaattaagttattttgcttaattcaccattacacgatgtggattatcacatgatgttgcaaaaaagcggtgcaaaagtactgtttttttttgaaatatcaaagagttacctctttaaaagtcaatatcaatcttaatttcgttttccagcttgtcctcttgtgcttgttcggcaagagcttcctgttctctttttatatcagcttcttcgttcaggcggctgatgtaatcgttcatgtcactgtggttaataaaactgatggcttctgtcaatcctgccataaatttctgaaaatcctccttatataagaagattttatgcttttcgaagctaacctgagagtcatctccttctcccatcaccactttcttactctccgtaatagctaaaaacatttcatctttacggttcttcttcacatcgaggtaatagatgcgtttacctgctttgatggacttggagaaaacgatctccttatcattcatgtctgcgttcattttctttttaaaatcttccatatcattgggtccgttaataatcggcctcaaaattggatattttttttaaactgtcaaaagaaaaagcgcagagaatcaaatactgcattaaaaaatgtgatttatttgtggaaactcattaaaaatatctacttttgcagttcgataataacagtattaatttgaattatgatcaacagagttcttattcgtcttaagattatacaaatagtgtatgcctattaccaaaatggcagcaaaaatctagactcagcggagaaagagttattcttcagcctttcaaaggcgtatgacctttataattatttgttaatgctgatgatggcattaacagagtatgcacaaaaacgcattgatgcggcaaaagcaaaactggctcctactaaagaagagttgtatcccaacacaaagtttgtggataataagtttgttgcacagctggaggtgaacaagcaactgaccgagtttatatccaatcagaagcgaacttgggcaaatgatcaggatttcgtcaaagagctttatgagaaaatagtagaaagcgatatttataaagattatatggcttccggtgacaattcatatgaagctgaccgcgaactgtggagaaaactctataaaacatatatatttaataatgattctcttgatcaggtgctggaagaccagagtctgtattggaatgatgataaagagattgtagatacctttgtcttgaaaacgattaagcgttttgaagaaaagaacggagcaaatcaggaattacttcccgaattcaaggatgacgaagatcaggaatttgcacgccgcttgttccgtcgtacaattctgaatgctgactattaccgtcatcttgtgagcgagaatacgaaaaactgggatttggatcgtatcgcatttatggatattatcattatgcagactgctttagccgaaattttaagtttcccgaacattccggtaagtgtttcgttaaatgaatatgtagaaattgcgaagttgtatagcactgccaagagcggtagctttatcaacggaacgctggatggaatagttaatcaattgaaaaaagaaggtaagttgactaaaaactgatacctttgtccatatagtagaaactaaaacttgattatttatgaacttattgactgtattattgcaagctcccgcagcgggaggtggaagtatgatgtggatcatgctgatagctatgtttgttatcatgtatttctttatgattcgccctcaaaataagaagcagaaagaaattgctaatttccgtaaatctcttcaggtaaaccagtcggtaattactgcaggtggtatccatggtacaatcaaagagattactgatgattatatagtacttgaaatcgcttctaacgtgaagattaaaatagataagaattctatttttgctgatgcttcggctgccggcaatcagtctaaataatctttagtaaacaaataccctatgcttgatcgtaggaaattaagatatacatatttaagactatccaagagaattaaggatttcctgcttagtgataaaagcagggagttcttaatttttttattttttttcctgatagccagtggattctggctgattcagactcttaataatgactatgaagcggaattctctatcccggtgaggatgaaggatgtccctaataatattgtgctcacttcggaacctccttccgaacttcgcgtccgggtaaaagataaaggaacagtgcttctcaattatatgttggggaagagtttctttccggtaaatctgagtttccctgactataaagggcaaaataatcacgtgaaaatctttgcctctgagtttgaaaagaagatactcagtcaattgaatgcttcttctaagatactttcaataaaacctgatacgttagattatatctattcgacaggcaagtccaaattagtacccgttcattttcaaggaaaagtgactgcagggcttcaatattatgtttctgataccatttgcagtccggattccgtattggtatatgctccggccggaattttggatactataacaaccgcttatactcaagaggtaaatcttgaaaatatatcggatacgattcggcaacgggttgccttggataataaaaaaggagtgaagtttgttcccgcctcggttgaactgactttccctgttgatatttatactgagaaaaccgtggaggtgccgttacgtgggattaacttcccggcagataaagtgctccgtgcttttccatcgaaggttcaaattacttttcaagtgggtttaaagcgttttcgtagcattaaagccagtgattttgtgattaatgtttcttatgaggaactgctaaaattaggatcggataaatatacggtgaagttgaagtcggctccccgtggaatcaatcaaatccgtattgtacccgagcaagttgattttctgatagaacaagtttcttccgatggctattaaaataggtattaccggcggtatcggtagtggaaaaagtgtagtttccagattgctggagattatgggaatccccgtttatatttccgatattgaggcgaagcgtatcactcatacgaatgatgtgatacgccgggaactttgcgccttggtcggacaggatgttttcctgaatggagaattgaatcgtcctttattagcatcttatatatttggaagccccgaacatgcgaaaaaagtgaatgctgtcattcatccgcaggtgaaagaagacttcaggcgatgggtgaaagggaaaggtgatatagctatggtcggtatggaatctgccatccttctggaagcaggctttaagcaggaagtagactttgtagtaatggtatatgcaccgttggaggtgagagtggaacgggcaattaggcgtgactattcttcaagggaattgataatgaaacgtatcgaagcgcaaatgagcgatgaggttaagcggaatcatgctgattttgtaatcgtgaatgacgatgaaacccctttaattccgcaggttttgaagtttatttctttgctatctaaaaataatcattacctttgctccgcaaaaaaataattaataaataaaagaatatatactatgttgaagactatcctgtctatctccggtaaaccgggattgtacaaactaatttcgcaaggaaaaaatatgttgattgttgaatcaatcagtgcagataaaaaacgtttccccgcttatggtaatgagaaaattatctctttggcagatatagcaatgtatacagatgatgctgaagtacctttgtatgatgtgctggaagctatgaagaaaaaagaaaatactgcagtcacctccattgaccctaaaaaagctactccggagcagttacgcgagtatttaggggaggtattgcctaactttgatcgtgaaagagtatacgttgcggatattaagaaattgatttcctggtataacatcttaatttcgaatggaattacagaatttaaatcagagccggaagctgaagaagaggttgcgactgatgaaaaataagtcatgaaacattgatggcttagatgtataaatgtaataaggaaagcgtgacaatgttgcaagttgtcacgcttttttgtgtttttatatgtctgcgtaattaaaggatcccctttagtgttctttctgtctcttatacacatctccgagcccacgagacaaggtccaatctcgtatgccgtcttctgcttgaa

SEQ ID NO: 169 - DNA, 15775 bp, Bacteroides thetaiotaomicron
gttccgtatgaaccattgattataatagaatctttagggttatctgaacgataaagcactccgttaagatttccttcaataataggatgccattggtctgcataggcagatttagtaatttctacttggaatggtttctctttttgggggatatagtaaatatatttgtcctcatatttatcactatgtgtatcacgtgttatttgaattccatcatatatccaatctgtttttgttgattttgttatataacgtattcctttatgtaaatgatagatggttatgctaagtaattcatcctcaccgtactttatgcttgtcatcattccccttatagaatcggtatcgttattaggaggagatgcacttgtttttactgaatgaacagaccaatcagtatgagcttcattttccagagatatttcctttccgtttatctcccctttaaagtatccccaataccatgaatcatctttaggaacgggagtttcatcatcatcgttgccgcatgatgctagaataagcattccgaagaatgctccgattaaataaatgtttagtttcatcttatttttattgttttattcgctttcttcttctataatatctcctgttatatccattatgggagagataatctttactgtataaggataaccatttggagtttctatatacaatgttttacctttgtttatgaaagtgggtggttcatgaactacggttttcccgtttttatctgtaatagtaatttctgcatccggcagaggtgacagaaagataatttgcaagcaactgttggtttcttgtacatctatattaaattcaataggggaacgagttgttgccttattccttagagtaaatgaggtaagtcgaattttgtgcttatgcttatttagtattgctgcacttgttggtataataaataataccgataataagataaataaaaactttgctttcatattcaattcttttattgatttatggaggcaaaggtatggagtattagtatagatggataatatttgcagtcacattgctgttttgtaatatcttgataattaatgagatagtaaaatgctggtcacactttacatttcttcgtctttcattctctcttttatccttaatttgcgttgattaatggggtgcgtattgttataaccgaaacaaagtgcaatagttagaggttgcaattttgcttcatttaggcagagatataaaatatcttcttcagtcaacttgggatactttttttgtaagtatgatatataatcggcataaatttcgaaaataatcttttggagtctttttagttctgcatttgttaataccttcattgcttttttgtcagatacttcttgtttcgagagggcgataattctcttgtatatatcactttgggtaaataaccaatttctcagttcatgcttttcttgtctaagtctttctattgtagattctctttcctgtatttcatctatcttattcgcttggtcttgtttcagattgcgctgttcttcttgcagcaaactgattattgattgattatcttcaataatagtctgcattgaagatagtttatattgggtttgctttaaattctgttgatatataagttgtattctttttcttttgttaatatggtattgatagaataatataataagtaagcaacaaaaaatgaagagtgcgattatgagttggagtcgatgttgctcttttatttgctcttccctaatatggattttgatattatatttattaatgagttgttgtagttcgctgtattgttctgtactatacatagaatctaaaatttctacatgttcttctaaataggcagatgcggctttgtagtttcctagatctttttcaatatcatacaaacttaataaagcagcgcctctgcctgctatatttttagtatcttctaagttcttattgagataatagatggcagagtctttattttctcctctttcgtacaacaagcttccaagatgaccataataacttcctggaatctttccttttggaaaccatttaatggcattgcgtgcatgatacaatgccgaatcaggttcttcaaattcatcgtaattaatgcttagattgaattcggatatgcctatcatagaagagtcacctgaatctaacgcataatcaagtgctttacgttggattattattgccgaatctttttggtcttgtgtgcaataatataaactaaaactgtttagtgctacggatttatctttatctgtgatgcaacatttgtataattcccgatatgctttaaacgcctcgtcatagtaattaacgtcgaaataaagatttcctaacgaactgagcgtatgccgtttgatctctatttctttcggatagtctttcaatatagtcagcgcttcttgcaaatgggcaatagcctcctttgtactatttatttctatttccaatcgtcctttgtaaagtaaagctacagctcgctctttctcgtcgctatcgtaataattcaaagctaggttcagtaatgaatcatagggtagcagtgatttttcacatttatctgttgcccgcgctaaaagtagagtatagcgggcggattctttgtgagaaagctcttgtaatgcaggcaatgtttgaagtaattgcaatgcgctgtcggggtgttcttctaatagtgattcagcttgtaaaaatgatgtttcggtccgttctcttgaagagcaggcacagaacaaaaatgtccctagaaatagaatagagcatattttgaccacaagttttgtctttttatttgtttgcatgtggcacaaagataacatttatttattagaatgattttattctatataaataaaagaactttttctgcttttaatacgtttctctagtatagttaaaaaaacgaagaatcaagatgaatatagcaatgaccggagccaccggatatataggcaaacatctttctaactatctgaccgaaaagggtggacaccggatcattcctttgggaagagcgatgtttcgggaaggtatgtccggacttttggttcagacgctgacgcattgtgatgtcattataaatttggcaggcgctcccatcaatcagcgctggacgccggaacataaacaagagcttttcaatagccggataacggtaacacaccgcataatccgtgccttgaatgcagtcaaaaccaaaccgaaactaatgatttcggcctctgccgtagggtattacccctctttggtggaatcggacgagtatacacagactcgtggcgatggtttcctgtccgatctttgttatgcgtgggagaaggaagcgaaacgttgtccgcaaccgaccaggcttgtcattacccgtttcggtgtcgtgctttctcccgatgggggagcgatgcaacagatgctccgcccgctgcgcgcaacaaaggttgccgccgttataggaccgggtacgcaaccttttccgtggatagatattcgtgacctttgttgcgccatggccttctttattgaaaatgaagagttgagaggtgttttcaatctggttgctccgcaagcagtttcacagtccacgtttacacgtgcgatgggaaaggcgtatcatgcgtggacaactttgattgttccgcaagcggtctttcgtttgttctacggtgaagccgcctcttttctgacagccggacagagagtgcgtcctacacgcttgctggaagccggattccatttttccgttcctaccatagagaagttgtttgaggggacggatcacagtacggtagatcggcttgatctgaagcgctatatggggctttggtacgagattgcccggtatgaccatcgtttcgaacgtgggcttatggaagtgaccgctacttataccctccgtcccgatggaacaattcgcgttgagaatcggggatataaacgtaactcaccttacgatatttgtagaacagccaccggacacgccaagattcccgaccctgcacagcccggtaaactgaaagtctcttttttcttgaatttctattccgattattatgtgatggaattggaccaggagaattacaattatgctcttattggcagcagcaccgataaatatctctggatattgagccggacgccccaactgccggaggatataaaaaagaaattagtaactgccgccgaacgtcgtggctatgatacgaatcggctacaatggattgaacaactttaaaataaacattatggattacaaaattactcatcagcccgaacagaaactgttcaagacggaagtcgacggtcgcaccgcttttgtagaatatcgcctgttaggtgattatctcgatattattcacaccattgtccccaaacctatagaaggacgggggattgctgctgcactggtgaaagctgcttatgactttgcactcgccaacggaatgaagccgaaagctacctgctcttatgctgtgagatggcttgaacgtcatccggaaatgaatgcggatagttgaataaataggggctgacctaaaagtacgaaaagtcattttctctttgttgcaatggatatttggacactgtccatatttttgtgacaaagatacgtttggaagaagaactttcgggtcagtccctttttagcttattgtttccatctctttagttgagggaagaactctttcatcgttgcccgcgcctcttctatagtgtactttacttccgaatccttattaaactcctcaaggtagttcaggttgagttcaatcatttcatccattgtgcattctttggtgaaatgcccgtctgcatagcaatactggcaatactcttcattcttgctgccgtctgcttctgttccgaatgtcgtttcatcgatcggcatagcacaacactgacaaattttctgttccatcttttattgattttaagtgagtaaaagtatgataaataattctcttttatctgcttacaaatatagttactttcaataagtactcagttatccgatcttgctattttgttttcaccggcaaacgtttccatatccatcggggaatcattcgccagaagaatacgagaatacgataacgtccgtcgatgatagctacccgctgtttccgatgaagtgcacgtacaatgtcgcggcctacctggtcggttttcatcagcataggataatgctttccgtcattcagcaagtcggtggctacaaatcccggacgaatatcggtaaagtgaatgtctaacttttgcagatgggagagttgttcaagcgcatcgatgtatgtgttctgaaagcgtttcgttgcagaataggcaggggcaactcccagacctttggttccggcaatcgaactgatgacagccagatgtccgcctccattgttcctgaaataggaaaaagcggtatccaccattcgtgtgaaaccttcgacattggtacgtgcggtattcagctcgatttccatattcaattccatattttggaaaccgatgccggaactgagcaaaaataaatccataccgcctagttgatggataagcgcatccagctttccggcactgtattcctgagtgacgtccagtgattgaatttttatctgttccggtgcgatttgccggaactcttcgagagctgactggcgtcttcccgctatgccgatctgccatccttcggacaggaggcgttgggcaacttcctttccgataccggaggtggcgcctatgataatggctcgtttcatctttttggaacaaagatagtcaattttttcattactcttctatttagaattcattaggatagctttatcgttcaggagaataaatggcgtatcgcctctaaaggggcatagaataacattctgggaccggagaaccgcataacctctcgcatccgtttgcgcatggcaggcttataacaatgtacgggacacttcttgcacgagctttttttctctccgaacggacaatggtcaagacgggcatgtgcgtagcggagcaactcttcgcacttcggacaaagggttgcattcttctcttttttccggcaatagagacggatcatgatctctactgttctcttttcctgagtgatacgcggttttttatctgtttccatttgttttcttttggctttggaggctggcttcacttcggcaaagataataaactgatcgcatattctgcaaagaacttccactggaatgattgccgttgctggaaactatgcgtatctttgcggcatgagaaagttattatgtccgcaatgcaagattgctgccctatatgtggtgaatgaccgtaaagagcgtcttttggtctatgtactcgaaaatggagaagttgtgcctaaagatccggcagcttccaccgatggatttgatttgacggaagtttattgtctgggttgttcctggcatggttcgccgaaaagactggtgaagagatagacagttgccggcactttgtctttttttgatttatgtcaataaaaagagggtgcgggattagaatctttcaaccggatttttctgtatctttgcagccaatttttaggacatagacgtatggcaacttctaaagagatgacggcggggccggcattacctctgatttttaatttcactctgccgcttttgttcggcaatctgttgcagcaaacgtattcgcttgttgatgctgcaattgtaggaaagtttttgggtattaatgcgttagcctctgtcggggctagtacatccgttgtgtttcttattctgggtttctgcaacggatgttgtggaggattcggtatccccgtggcacagaagtttggggcgagggattatagtacgatgcgcagttacgtttccgtcagtctgcaacttgctgttgtgatgtctgtggtcatagccatctttaccagtatttattgtgcggatatcctgaagatgatgcgtacaccggagaatatctttgaaggagcgtatgcttatctgcttgttactttcatcgggataccttgtactttcttttataatctgttgtcgagcattatccgtgctttgggagatagtaagacacctttctatttcttggtactggctacggtgctcaatattattctcgatttattctgtattctggtactgggctggggagtgatgggagctgccattgctactgtcttttcgcagggagtttccgcttttctttgttacgtttatatgtatcggaagtttgacattctgcggggcacgccgaaagaacggaagtatcagtcgaagctggcgaagacgttgctttccattggcgttcctatgggattgcagttctccattacggccattggcagtatcatgcttcagagtgcgaataatgcgttgggtacggcgtgtgtggcagcttttacttctgcgatgcgtatcaaaatgtttttcctttgtccgttggagagtctgggtatggctatggctacctttagcggtcagaattacggtgccggaaagcctgaacgtatttggtcggggattaaagccagcacgctgatgatggttatctatacagccgtcactttcttgattctgatgctgggagccaaatcttttgccttgatttttgttgatccgtcggaaattgagatcttggagaaaacagaacttttcctgcatatatcagtctctttcttcccgatgcttgggttactttgtatcctgcgttataccattcagggggtgggatatactaatctcgctatgttttcgggagtgtcggagatgattgcacgtattctcgtcagtatttatgccgtcccggctttcggctttatcgctgtttgttacggtgatccgatggcatggatagcggctgatttgtttttgattcctgcatttatttatgtttatcgcaggttgaaacgtcaggtgctgacaagtgtcgttgcataattgaagtgtgtgtcaaaagtcaatatacccgtaggggagtttagttacttttgacacacactttatcatattttagtcttgtatcggatacagcgggttaccgctttcatctacatccgtccagtcttttacgctcacgttaccgaatgatacggagttttcgttgattactgcacggaaaagatatgaatttccggcagccagaatattgtctggcggggtaatggtcgtattgtaagtacgtgagaaactttctccgttgaccatcaattccatcgttaaagccatcgggtcggaacttttcagcggaagcatgatatattgaaccgtgaaatcattgattcccatgtcggcaggcttatcgtaactgacttctgaagaaatgatccctgttgacagatccatgaaagctcccggtttcgtgggagtaatagtggcggagagtactttgttgagtgtaatattctcacctcccgttatggttatcacgacctgagtggctacgtgctggtaagtgatgggaatgttgacttgtgaactggtcacatcctgatgcagggcatgccaccacagataatccaccccattggataatgcttcggacttgccgttggtaaaggtaggagcggggttgctggaattacaggaaaccgcataaaaactatagatatcattactgagatacattttataactttgtattcccgtcaaaactccgggagaagaagtgatatagttgccttcaccgacaggctctccctctatcgtattggtggtattggaagggtaggcacataaccagctctgcaatccttttcccatcggagacatggcacgcgttatatttcttccttctacggaagcactgaaagtaatgagtgcatcttttttgtcaggattgtcattgtttccctcttctccgccactattttcttctccgttcggataggcaacatccatataaatgttgtttttggagcaggctcctaacagcagcaccgccagtgcggatactgccagatactttgtaattcgaaacttaaaattcatagtcaggttctttttgaaagttagtaattacccctatatacatttcaaaaagaatttagttcatatcggaagaaactatttttagaactccgcttccttctgtatgcagatgatatcgccgtaaacgggatggcggaactcaatatattcagcatggagatagagcctgtccgccttttttccatagagttcatcgcccagaatggggtagtttaatccttgatgatgggcggcatgtacccgtagttggtgggtacgccctgtcaatggataaaaagcgatgcgtatgtacttatcggaatagttcagaatccggtattcggtaactgccggtttgccgtattcttcactgaccatttgccgggggcggtcgagcggattgaggcaaagaggaagattgatggttcctgtttcttcgagttgctggttcaatccatttctatccagcaaggctacataacgcttcttaatactgcgattgatgaactgttcctgcaagtgttgatgaacttccttagttttggcgacaagtaacaaccccgaagtagccatatccagccggtgtacaatcatgggaccggtagcttccggatatttagcttttacacgatggtaaacggaatccgtctcctcttcttttccggggacagacaacataccggatggcttattgactaccaccagccattcgtcctcaaaaacgatttctaattcttccttcctgtgtgcttggggcgaaagtggattcccgtctacttccagtccttgcagcatgtgttgcagaatcggttcgcattttcctttacacgaagggtaataataaccgtgatgccgtacctctgttttcggagagtttccccaccagaactcggccatagccaatggcttcagttggtgaaggtaggcatattgcagcaatttgggcaaggcacattcgcctgctccggcaggggggattttgtgtacggtttgttcaaagatagtacataagtcttttatttctcctttcgcattcagcatacggaactgttcgaataacttttgctgtaaggctgccgaacgttgctttcgttcgttttttagtttttctatttccgtctcaaaggtgataacctcttcttccagcgttttgattcgttctttccatccccgttccaatcgcttgaattccgctttctgatattggctttcacgaacaagtgcgtcctgttcttctttagacagggcaggggatgacttgcggcgaagttccctttctttctttgctgtctttagttcctctttggcttgaataagagccagccttgtttgttccgtttccctgtccagtttttcttttaagtgcagataatgaggattaacttccaatgcactgatacggacattgatagctgaaatttgttcttcttctattttaaagaatccctgtggttgcagcaaatcgtaaacaggtgggacgaaatacggatgcagattctttcctgccagattgccggaaaaagcagcaagataaccgatagaggaagatccttcttcctgggtttgtacgatcagtactccgaacatttttccgagagtcagttcctctagccactctttctttgtcgagatataagctttgacttcttcggccgctaatacacatagcggatgaggagtatagttgaaagggtatgtaaacctttccggtagtgcaatatgggaaaccggttggtcgaaaaaatgtatcattgattcttatctgaatatcgttattgattgcaaaagtaaggcaaatccgcgaattttattctatatttgttttgtagttggaataaaatagaggaataaaatggaagacaaaccaaaattcgcttttgtaggtaacagccacatggcattctgggcactgaatgtatatttccctcaatgggaatgtctgaactacggtgctcccggagaagggctggcgtatgtcgagtcatttcatgaagatacatccgactgccaggtagtgattcagttcgggagcaatgacatttatcagctgaatgaagaaaatacagatgattatgtagagcggtatgtgaaagctgttcttgcggttccaaaggttaaaacttatctcttttgtatttttccccgtaatgactacgatgattatagtacggctgtgaacaagttcatccgtatgctgaatgagaagatagttgcaaaactgacagggacaggtatcatttatctggatgtttttgatcaattactgaagaacggcagattaaatccggagctgactattgacgatctgcatttgaatggaaaagggtatcggatattaagtacggcgctgaagcaggcattcaacggacaggagcatctatgaaattttatgttaacgcttttgtcatgtaaataggtggcatatcatttatttttcctatttttgccccattaatcaatatgtataacccccataaaacgatgagacgatggaaaaagttattatcaactcgtacgaagaatttgaaaagctggtagggcaacaaataggtgtttccgattatgtggaactctctcaggaacgtatcaacctttttgcagacgcaacactggatcatcagtggattcatgtagacacagaacgtgcaaaagtagacagtccgtatcacagtacgattgctcacggttatctgacgctttccatgcttccttacctgtggaatcagattattcaggtgaacaatctaaaaatgatgatcaactacgggatggataagatgaaattcggtcaggccgttttgtccggacaaagtgtgcgtctggtgactactctgcactcactgaccaatctgcgtggtgtggcaaaagccgaaatcaaatttgcaattgagattaaggatcagccgaagaaagcccttgaagggattgctgtgttcctgtactattttaattgagtaacgacgaaaagataagataaggctgtttcctgcaaaggaagcggccttttgttttatttattggatgcaaaatatgtaaatacacggaaatcggttaaaatatcaaaataataagaggtttgtcctcattgtggcatccataagcgccgctgagtgttttacatattatagatgtattcaaataatcatgaagcaattaaaaattgagcgttatgtctttaagtagtcttttaatcatattttcatcttcttttatggcgctgtttccggtgatcaatcctttaggaaacggttttgtcgtcaatggattttttgcagacctcgatccttcacaacgaaaaactgctattcagaaactaaccattaactttataatgatcggtgtaggcactttgctgataggtcatttattcttattgattttcggtctggcgattcccgtgattcaactgggtggtggaatactcatttgtaagacggcgatagaattgctgggtgattccaattcttccgataaagaagggaccagccagaatgtggacagcttcaagtggaagagtatcgaacagaagatattttatcctatcacgtttcctatcagtatcggtccgggcagtatatccgtgatctttactttgatggcatctgccagtgtgaaaggtaaactgttgcataccggaatcaattatctggtcattgcgctggttattatttgtatggctgggatactctatgtgtttctttcacagggacagaggatcattcagaaactgggacctgtaggaaatcagatcattaataaactcgttgccttttttaccttttgcatcggtatacagatttccgtcacaggtatttcccagatattccatctgaatatattatgagttcggatgttctttctttttctttgctttgatagctttcaatgtgttttttcttactgaacgtatggcaggaaccaacaattccggttccattatctccagcatagtgcgcaattcttgctgtagttcggggatggagcaggtcagttgataggcaagtttgatgcaaagagactgcactcctgccggttcttgtcttgataccatccgttccatacagaaatccagtaagtccactcgtggagggtcagctagctgttgttggcatagcaggttcagcaacatccttcgttttcccgaatgcgggcaggtaagtgccgcgtctatcagttcgtcttgtttcagagtcagccactctacctcaggttttgagaagtgggtacagacccacaatgcctgataagagacgatgtcatcctcatcaaagatcagccggtaaatttcctctctgagccgttcgtcttcttttatataatgaagcagttcccgtatattttctatatggaagcgagtggccagttgtgtgcgtaagtccatttctattttgggttcagtatcttattttttatcgtcggtcagttgtaagtgcaagattggatacggcttgcccatactgtccgtttcatcccgtccgatgatctcgaatcccagatgctgatagaaccggagagcctggtcgttgtcttcgttcacatccaccttgtcgatctgcttctggcggatggcatactctatcaatcgctttccgtatccctttccctgttcgtcggggtgtacaaacagcatctcgatcagctcatcactcaatcccatgaatgcggcaatctttccgtgagagttgcggatgatggagagctctactgccggcagatagtggttgcgtatcagtggcttatagaactggatactctcttctgtcaggaagtggtgcgtggagcggacagacttctcccacagctggatcagttcatcataatcctgttcggtggggcgtgctatattgggaatgtagtaacattcatgatcatatatattcccgttataggtcagttctgcctgatgaagtgtaccttcgtagataaatccgtttcgcttcagcacttgttgcgaacgtttgttgtgcggataacagttggcagtgatgaggctgagctgtagttcgttgaagccatagttgagcacggcttgcactgcttccgacatgtatccttttccccaatacggttcgtccagccaatatcccagcatacgtacctgaggattttcccgtttcggatcgggtacgatgccgatggaagctatcaattgctgtgtatcttttaatgtaacagcccatataccttcctgtcctataaatgcgccgtgaaggatttcacgggattcattcaacgtcttgtggggagcccatccggcattattccccaaattggggttctggcaacaggcaaagaatgcttctgcgtcattctcctgaaaagggcgcagcagcagacgtttcgtttcgatattcgggcatagagccgcttcggttctttctgcttccggttctttcttgtatacacattccaaacgatttccgtcggggtcgagtacaacgctctcaaagtatccgtcgcccgaagtgcgtggttcacctgctatggtatacccctcggagcgcatttcttccgtaaagcgaagaatctcctccttgctgggaaatgtgaacgcaagatgtgtcagtccccgcctgttttcctctatcggggtattctgcacatctgcccgactcatcaactccagagtgggaccttcatcaaaagagataaagtatgattcgaatcccttcttgggattgatatatttctcattacttgtcccgcccagaaagcggacatagaaatcttttaattcttccagacggaaagtccagatggcgatatgatgtagcttcataagaatcgtagttaatgttgttatacttctattttattgatgcgtcacatattcgtaaacgatacgtgagatgtccgcaatgattttactgttctcctgattattctcttcggaatctttgacgaagacagctatactgtaagcgtgtccgtcgggcaggaggacgaagccgatatcattgcaggctacctgttgtcctttggcattgcggtcacccgtccctgtcttgtggccgattgtaacttctttgccgagcaatggagcaaccagtcgatcttgtccggtctggcattctgtcatggtctgatagatgaagtctttgtattcctgcgggaacagtgcttctttgcggaatatctccaagagtctcgcggcggccagcggagtagtccagttttgataacacagactttcgtcttggtgcatatcgttttccgtacagacaatggcacaatccgtaacgcccagggaatggatgtactggttcaccgtatctacccctccctgatattgaaacagaatatcacaagcattgttgtcactttgttgcagggtgtaatttaataaatccgcaatgtctatattgaatcctccctgtggaaaactatctcgcagcggactataagtatcgggttttaaatcctctttctttatggtcagttcaaagttcaatgactgttgctgctttcccatataatcagccaatgccaacgcctgatgaaatttgaatacactcatcaatggataatgaatgtcattgttgacagttaccgtatcttttccgtcgataatgacggcaataccgatttcagctttcttgcctttgatagcctgtttgagttggtcctccagagaaagattctgtgcacagataatagtggggatcagacagagaagcaggatgaatgagcgcatactaattttttcattaattggtttgtatttgggttttaagagtcacaaagatataaatactaattttatcagcaaatatttacttggaaatagtaatcctacataagaa

SEQ ID NO: 170 - DNA, 15701 bp, Bacteroides thetaiotaomicron
tttgccataacgaaaaactttatgcctaaagatacaaaaactttgggtaataacaaagcccgggcttgtgaaagtctgggctttgtgcataaaaaaaggttgtgccagcgttttgacacaacctcatttttatttcagttatgcggataaaagattataccaggtgtccgatccactcttcgcggtcgcccggaaggaggtcgatgacggggacttctaccatggtgtagcaccccggttgctgcttcatggaagcgcgtgccacgcacacaagtacctgtgcggtcagtgccggattgttgatgcgcatattgaactcgaacagctgattctgcgttttaccggaaactcccttgcgagtcagatttacaccgtgtcccatatcgagcagtgcgtctacgctgggcacaagttttacatgtgtctcgtcgttcacgaagtaagggtctgccttgatggctgcggctacttcttcaaacttgtatccgtctttcagttcgatatataccatgcggcggtggattcccgttccagtagggatcgtcatggagagggcggctttcactccgtcgatcgcttttacggctacggtgtgtcccatactcatgccgggaccgaagttggtgtaagtgatgcctttcggagcgattgcttcgagcatggtgcgtacgatcgagtcgcttcccggatcccatcctgcggagatgatggatacggctttgtgctctttggcggtggcatccagcgtgcggcgcaggtcaacgatgcctgtgtggatgtcgaagctgtccaccgtgttgattcccattgccaaatattctttcgcgtatttctcaacgctgcgggtcggtgtgcagaggatggccacttccactccttccagctctttgatatctttgactactgcatagtttgccaactcttccggcttgttctctgctcctgcacgacgaactactccggctatttcgaaatcaggcgctgcctgtagcgcttcaagtacatagtgtccgatattgccgtaaccgacaatagctgctcttacttttttcattcttttattggttttatatgaacatttttctttaattctgccacaaaagtaaacaaattactaggaagttttgtttactgcctgcattatttttaattttttcacctctgactgcgaggcggaaatgttgcgaaagtcttttcatctgtggtgaatttgtcttatctttgcaaggtatatgatagaatatgtaagaggcgaacttgccgaacttagtccggcaaccgcagtaatcgactgtaacggggtaggctatgccgccaatatatccctgaatacttattcggctattcaggggaagaaaaactgtaagttatatatctatgaagctattcgggaggacgcgtatgtgctctacggatttgccgacaagcaggagcgggagattttcctgctgctcatttccgtgtcgggcatcggaggcaatacggcacgtatgattctctctgccctttcgcctgccgaactggtgaatgtgatcagcaccgaaaatgcgaatttgctgaaaacggtgaaggggatcggactgaaaacagcgcagcgtgtcattgtcgacctgaaagacaagataaagacgatgggagccaccgtggcaggaggaagcgcttctgccggaatgctgctgcaatctgccagcgtagaagtgcaggaggaagcggtagccgctctgaccatgcttggctttgccgccgcgccttcgcagaaagtggtactggctatcttgaaggaagaaccggatgctccggtggagaaagtaataaaactggctttgaaaagactgtagaataggtaataggtaataggtaataggtaatagggcgtggagaaactaaaacaagcaacagaataataatgaaacaagggaaaatttatatgaaagcatggctggatcttcatggccgtgcaaaggtgttggcgacggatcactggtatcttgaatttgccaatcttttattgcctgtcgtcagcgaatcttatttatataagtcggagacacaggaaagccagaatcaggtgactctgatgctgactctttatctggaagactgtgtgacggacggaggcaactggcgccagttcatccgttggcataaaaggaattacggacgttacctgccgttttatgaattgtcggaaggttatctcaccgacgagatcaataaagaggatatcgctttcttgctgtggggaattaattcgccggtaggcgatgactttgacggtgtggagaatcccttggatgcggacttgctggagtttgccgatgtgatctatgcgcagttggaggatgttttcgagaaagcgcctatcagcgacggacttgccggagactggctgatggaatcggagctgatggagaagcagcggactgctttgcctgttgcctcgccgggcgatcagttgcccgtgaatgtggaacgctttctgaaagcgagtggtggcgagccgttgatgttcttcgattcgtatgaggctttgaaactgttctttgtgcaggccctgcaatgggaggacgaggaagatgctctgttgcccgacttgaaggagttttcggatttcgtgatgtacgctaatccgaaaggtttgctgataggtccggacgtagcccgctactttgccgacaaacggaatccgctgtataatgcggaaatggctgaggaagaggcgtacgaacttttctgcgaggaagggctgtgcccgttcgatctgctgaagtacggcatggaacatgacctgctgccggaagcgcaattccctttcgagaacgggaaagagctgctgcacgaaaactgggactttattgcccgctggtttttgggcgagtattacgaaggagaatgatactttgttaagttatgccaatcaaaaaaagtaacaatccgttcgccggaaaggcgaagcctgctgccggaaaaaagaaagggacggggaaacggataggtaagtcaaaggtggagaaggctaataatcagttgaataggagagtgaaataagcctttggagactgcgccctttctacctgtcaggctacgccgttttatgtaggcaggctacgccgttttaggatgctggtttacgccgtttctccaaggtaaaagggtgcgagcaagaaaacaatgctgcgtctctttaaagttggaatgaaatatcattactatttgtgcctaatgataagtcggagaacagtctcttgaattgaaataaaaatcggtaagcgatgaaaaaataaatgtgctatctctgataaacacaaattttcatcgcttaccgttttttacttatccttttcggactgcttgatttattcttctccgatagcgcttttatcacttttccggaaagccgttactccgaaagaacctttattcttcggcagcttcttccatcgctttccgttcttttttcttattgataaatccgattttcagattggcgtcttcctgttctttcttgatttgctgcatggcggaaaggattttcgacagttcgtaaacgcctgctactgcctgtcggtcagtcggactcatcgtcgttgtgtatctacggtcgccgataaattccacacggatattcttgtctttgttgaggttcagaaattcgatcacgttaccgtcttctcccaatttgtaatcggctttttctattttctcgttcatatccgatgtttcgtagctgtccttcgaagtcggagtttcggcaaaactgccgtcgggagtcatcactttgacgcctacatgatggatattgccggctccgcaataaatggaagtcatgctcataattccctgctcgctcacttggaagcgaaggaaggaacgatggagattcttctcgatggcttgtgtaggccatatgtagttacccacttgctgatattcggcatctttctccagggtgtacttgcctttgatggcgtcaaacgctgcttgctttgcctggagagcactgtccagaaaggccagaatctcttgttgagccttgagttccacatccagcatcaattcctgaccggctttgcgggcctcgaatgctttgggatacaaaatcttgatactgtcgatttgtgtctttgcttcttcgtagtcgccacgttcgtaggcagcacgggcaatcgtcagtttttcattggcttttttctcgatgccgtttccgcaggctgtcagtgccagcgtgccgcaaaagaagataatcagttttttcatcataccatttacattttactattagacgatttgcgatggagatgggacgtgcagtgttcacgacttaccgccaactgttcgttacttgcggtttgccgttcgtgttacttgccgtttaccgttcctcgcccgttcatcgtttactttatagcgacaaaaatacaaatatatcccttatttttgtaattttgccccctcaaaacttgtattggcaataagtgtttgatgattatggaccgcccgaccggtgttttcatcaactatttaactgtctgttgccagtcgttaagcattaaaaagatgatagagttgactcaagaggaactgaaacagtattttagcgaaccgatcttcggacacattgccgaaaccgctgacgcactcggactggagtgttacgtggtaggcggttacgttcgtgatatttttctgcaacgtccctccaaagatatagatgtagtagtagtaggcagcgggatcgcaatggcggaagcacttggaaaacgcttggggcgtggtgcgtacgtctctgttttcaagaatttcggtacggcacaagtgaaatataaaggtacggaagtcgaatttgtaggtgcccgcaaagaatcctatcaacgggattcacggaagcccatcgtggaagacggaacactggaggacgatcagaaccgccgtgactttactattaacgcgatggctgtctgcctgaacaaagcacgctttggcgaactggttgacccgtttggcggcatggcggacatgaaggaaaagaccatccgcacacccctcgatccggatatcacgttcagtgacgacccgctgcgcatgatgcgttgcattcgctttgccacgcaactgaatttttatatcgatgacgatacgttcgaatcgctctgccgtaacaaagaccggattgaaatcatatcccgtgaacggattgcggatgagctgaacaagatcattctttcgcctatcccttcaaaaggctttgtagaactggaacgaagcggactgcttccgttgatttttccggaactggctgccttgcagggagtagaaacacgaaacggacggtcgcacaaggataacttttaccatacgctggaagtgctggacaatatcagcaaaaagacggataatctctggttgcgttgggcagctttgctgcacgatatcgccaagcctgcaacgaaacgttgggagcctaaagcgggctggacgttccataatcataattttatcggtgagaagatgattccgaatattttccggaagatgaagttgccgatgaatgagaagatgaagtatgtgcagaaaatggtcagcttgcacatgcgtcccattgtgatagcggatgatgtagtgacggattctgccgtacgccgtctgctttttgaggcgggggatgatatcgacgacttgatgacactttgcgaagcggatatcacttcgaaaaacatggagcgcaagcagcgttttctgaataacttccagctggttcgccaaaagttgaaagaccttgaagaaaaggaccgtgtccgtaatttccagcctccggtgagtggagaagagatcatggaaactttcggcttacagccctgtcgtgaagtcggtgctttgaaaagtgcgataaaggatgctattctggatggagttatccccaatgagtatgaggcagcccatgcttttatgctggaacgggcggcgaagatgggactgaagcctgtaaaatagcttttcttgttcaaattggggtgactaacaagtcgattctatctcaaatctcctccttcgggaaggaggagtggtcgcagaccgaggtggtaggagaaataatgtttgttcctattactttgtaaatgatagggttatgtattcacctaccacctccccctacgggtactcctccttcccgaaggaggagatttaagatactattgactttttagtcagtcccttatgacaattctataatttcttcgttgcagttagtcagtttctcaactccttcgtttgtcactacccaagagttttcgatacctacagggcctacaccgggaagaacgattttcggttcgagagcaaagaccatgcccggttccagctcctgcttgatgcgcggagcaagtacaggcgcttcgttgatttcaagtccgatgccgtgaccaatgaacttggcttgttgtcccgttcccataaacttatcggcaaaacctgcttgggtaaccatttcgattgcagtgttatacagcatttcgcagggaatgccgggtctggctatcgaagcgatcttttcctggatatccagacaaacttggtgagcggtatatgcttcttccgacaatttgccgatagagaacacacggctcatatcgcccatatatccgttgaagttgcctcccagatcgaccataacactttgtccttctttcagcggagtcttgtcagcgcctccgggcagggcaggatcgagtccgcgaccccctaaagcaaaatcgtagggagaaggataaccggcattatctccggtcagcacacttcccatgaagatttccatgctgcgtccaaacacgcggaagatgccgaggcaaccttgaaggcgcatcagacgttcgatttctatcgagaactcgatatctgtcattccggggtaatatgcgaacggaatctgttcgtatgccttggcatgtgccatgcccgaacgacggaacatttcgatttcgatagctgtcttcacgctgcgtgcctgacggatcagcggtgtcccgttcacgacttcagcgtccgggaacaaacctgccagacgaacatattcggtataaggaagttcgtcgccttccagcatcagtttagtgggcaaaggcagacctttttctttcagaatatcgacgatctgttccggcttgcggatggggaacgagtgttcgcctgtgatattgttgggccgcttgaaaaacagcagtgccggtgaatgaagagggagataaagatagccgctgactacacagccataggtgtagattaaatttgcattacaagtaatgagggcggcatcaatgccctgtgacaccatcagactgcgaatcttgtcgcggcggagttttaattcgggttgtagcattttttattgttattactgtataatgctacaaagataattaattccattgaagaaaataatgttaatctcaaaaaaatagcgctacccgcgtcctgtcacaggaggcgagcagcgcaaaccacaaatacaaatacaactaaacaaagtctcttttaaataacgccttgtcccatcatagcgtgagctactttcatgaatccggcaatgttagctcccttcacataattgatatatccgtcgggttctgtaccgtatttcacgcattgtgcatggataccgtgcatgatggcgtggagtttttcgtccacttcagcagcgctccagctcaggtgcatggcgttctgagacatttccagcccggaagtggcaacaccaccagcgttgactgccttacccggagcatacattattttcttttcgataaataagtcgattgcttccggtgtacatcccatgttggaaatttctccaatgcaaagaacgttattttttatgagattttgtgcatcttctccatttaattcgttctgagtagcgcaaggaagtgcaatatctgcttttacttcccacggacgcttgccttctacgaaggttgcacccggatatttttcggcgtaaggagcaacgatgtcattgcccgaagcccgaagttcgagcatataatctatcttttctccgctgatgccgtccggatcgtagatatatccgtccggtccggagatcgtaattactttggcacccaattcggtcgccttggtggcagcgccccaagctacgttaccgaagccggagatagcgactgtcttgcctttgatatctatattttttgcctgcaacatctgataaacgaagtacaaaccgccgaagccggtagcttccggacgaatcagcgaaccgccgaactccagtccttttccggtaaaggttcccgtaaattcgcgggtcagcttcttgtacataccgaacatataacctacttcgcgtccgcctacaccgatatcaccggcaggtacatccatgtccggtcccagatggcgccacaattcaagcataaacgcctgacagaaacgcatgatttcagcatcgctcttgccacggggcgagaagtccgaaccgcctttgccgccacccatcggaagggtagtcagcgcattcttgaatgtctgctcgaagccgaggaatttcaaaatggagaggttgacggaagcatggaaacggataccgcctttgtacggaccgattgcattgttgaactgtacacgataaccgagattggtctgaacttcccctttatcgtctacccaagtgacacggaaagtgaagatacgatcaggttctaccagtctttctatgatcttgaccttttcaaattcgggatgctgattgtatatatcttcgatcgaaagaagaacttcttttactgcttgaagatactctaattcaccggggtgctttgcctccaaagaggacatgattttctggatgttcatgatatcatattttaaaaggttattctgataaaatgtaaactgctcacactgcaaatataggaaaatttttcaaatatgattggttttatggtgatattttgattaaataatgataaaatgatagtgataggtaataagtaataggtaataagtaataagctgcgctgtaaaccgcatggttattacctgttacctattacttattacctattataaactttataaagaagatgatagcaaatgagatttaaaaaattaactttgcagggtaaacgtcaagtagactgtactatgaatcatttcattatggaataaaaaatagaaagagactatgctcagcaagtataaattaaaccagctttacttcaaagatacgcaattcgccaatttgatgacacggcggattttcaatgttctgttgattgccaacccgtatgacgctttcatgctggaagatgacggacgcattgatgaaaagatatttaatgaatatacatccttgtcacttcgttatccgcctcgtttctcacaggtttctacggaagaggaagcattgacgcagttggagaatatgtcattcgatctggtgatctgtatgccgagtacgggagacaatgacagttttgatatcgggcggcacatcaaagagaaatacgaacatattccgatcgttatcctgactcctttcagtcacggtattacaaagcggattatcaacgaagacctgagcgcatttgaatacgtattctgctggctgggcaataccgacctgttggtttctattatcaaactgatggaagataagatgaacctcgaacatgatgtgcaggaagtaggcgtgcagatgatacttttggtggaagatggcatccggttctattcttccattcttcccaacctgtataaattcgtgttgaagcagagccaggaattttctaccgaagctctgaatgcgcaccagcgcacgcttcgtatgcgtgggcgtcctaaaatcgttttggcgcgtacgtatcaggaagcgatggaaatctatcgcaaataccagaataatatattaggagtcattaccgacgtccgtttcccgaaagtggaacggggcgagaaagacggtctggcaggtatcaagctttgtgccgccatacgcaaaaacgatccgttcgtaccgttgattatccaatcctccgaatcggaaaactcttcgtatgccgccaaatacggtgccagctttatcgataagaattctaaaaagatggacgttgacctgcggcgcatcgtttccgataacttcgggttcggtgactttgtgttccgcaatccggagaccggagaagagattgcccgtgtgcggaacctgaaagagctgcagaatatcctgtttgccgtgcctgccgagtccttcttgtatcatatcagccggaatcacgtttcgcgctggctctattcgcgtgccatgtttccggtagccgagtttctgaagccgatcacgtggaccagtcttcaggacgtagatgcacaccgccggattatcttcgaggcgatcgtgaagtaccggaagatgaaaaatcagggagtggttgccgtcttcaaacgtgaccgtttcgaccgttactccaactttgcccgtatcggcgacggttcgctgggaggaaaaggccgtggccttgccttcattgataatatggtgaagcgttatcccgaatttgaagagttcgaaaatgcacgggtggcaattcctaagacagtggtactgtgtaccgatgtcttcgacgagtttatggagaccaataatctttatcaaatcgctctatcggatgccgacgatgatacgattctacgatatttcctgaaggcgaaactgcccgaccggttggtagaggacttcttcaccttcttcgatgtggtgaaatccccgattgccatccgttcatcctctttgttggaagattctcattatcagccgtttgctggaatatacaatacgtatatgattccttatctggacgaccgttacgaaatgctccgtatgctttccgatgcgatcaaaggagtctatgcgtcggtttacttcagagacagtaaagcctatatgcaggctacatcgaacgtgatcgaccaggaaaagatggcagtcatcttgcaggaagttgtgggaaatcaatacggagaccgttactacccgtctatgtccggcgtggcacgttcgctcaattattatcccttgggagatgaaaaagccgaagaaggcacggtgaacctggctcttggattaggaaaatatattgtagacggaggtatgacgctccgtttctctccttatcacccgaatcaagtgttgcaaaccagtgaaatggaaatagccctgaaagaaacacagacccgtttctacgcattggacttgaaaaacgcagggcatgatttctctatcgacgacggctttaacctgttgaaacttcatgtgaaggaagccgaaagtgacggttcgttacgctatatcgcttctacttacgatccgtatgatcaggtgatccgtgacggtttgtatcccggtggacgcaaggtaatcacgtttgccaatatccttcaacacgatgtattcccgctggcacgcatcctgcaactggttttgaagtacggtgaacaggaaatgcggcgcccggtggagattgagtttgccgcgaccttgagccgtgaacaagataagacgggtacattctacctgttgcaaatccgcccgattgtggacagcaaagaaatgctggacgaagacttgacgctgataccggatgaagacgtggtgctccgttccaataactcattggggcatggcgtcatgaacgaaatttatgatatcgtctacgtcaagacggatggatacagtgcttcgaacaatcaggccattgcctgggaaatagagaaaatgaacctgcaattcctcaatgcaggaaggaattatgtgctcgtaggtccgggacgttggggcagcagtgatacatggctgggcattccggtgaagtggccgcatatctccgccgcccgtgtgatagtggaggccggactgaccaattatcgtgtagacccgagtcagggaactcacttcttccagaacctcacttcgttcggcgtaggctattttacgatcaatgcctttatgaatgacggagtctacaatcaggatttcctcaacgcccaacctgcggtggaagaaacgaaattcctgcgtcatgtccgctttgaaaagccgatggtagtcaagatggatggtaagaagaagctcggtgttgttctgatgccggggattgactgatctctttccggttgataaataaataaaacaaaaaagttctgctctcattggaaaagcagaactttttttaaatagttccgttggttttaaaccaacggggcattccttttaaaggaataaaaaaggatttttattctgctgatatacatctgtttactgttctgtcgaaaaaaagagcataaatccgtcgggaaatatgctctttcttttacaaatggttggttgttcttttattctttcaatgcttcttgcagatcaatgcccaatgctttggcgactccggcaccgtatgcggggtctgctttgtagcagttgcgggtgtgacgctgtttgatgaataattcggagtctcccatagcacgtgccgtgttttcaaacagaagttgctgctcgtctgccggcatcagtcggaacagatcgcccggctggctgtagtaatcatcatcgtattcgcgttcattataattgtatatctctccgttgccggatgctttgagaggcggttctttcatgtgaggagagtctttccattctccgtagctgttgggttcgtagcctttggttgcaccgtagttgccgtctacacgcatggctccgtcacggtggtaagcatggaacgggcaacggggtttattcaccggaatctgttcggagttcactccgagacgataacgctgtgcatcgccgtaagagaacagacgtccctgtaacatcttgtccggtgagaatccgatgccgtctacggtattgatcgggttgaaagcagcttgttctacttctgcgaaatagttttccggattacggttcagttcaaggattccgacgtcttgtagcgggaagtctttgtgcggccatactttggtcaggtcgaacgggttgatgcggtaatggtctgcttcctcttccgtcattaactgaatctggaataaccatttcgggtaatctcccttttcgatgctttcaaaaaggtcgcgttgatgagattcgcggtctttggcgatgatcgcttccgcttcctgatctgtcaggtttttgattccctgcaaggtgcgcaggtggaatttcacccagatacgctggttgtccgcattgataaaactataggtgtggcttccgaatccgtgcatatggcgataggagtaaggaatgccgcgagggctcatagtgattgtcacctgatgaagcgcttcgggcagaagtgtccagaagtcccagttgctgttagggctgcgcatgttcgttttcgggtcgcgcttgatggcatgattcaaatccggaaatttaagcggatcacgtaagaaaaagacaggagtgttgtttccgactaaatcccagttgccctcttcggtgtagaatttcatggcaaaaccgcggatatcacgttcggcatctgccgccccacgctctccggctacggtagagaaacggacgaaacactcagtttgctttccgacttcgctgaaaatagctgcacgggtgtacttcgtaatgtcgtgagtgacggtaaatgtaccgaaagctcccgaacctttggcgtgcatacgtctttccggaatcacttcacggtcaaaatgagccagtttttcaataagccatggatcttgtaacatgacaggtccgcgttgacctgcggtttgcgaattctgattgtcggcaatgggacgaccgttcgcggcagttagttttttttcttccataaaatagatgttagtcggaggcaaagtttaaataaaccgaagtcttttttattcttctgtccgggtttataatatgtaacaaagatagaccgattttgcttgcttgtcaaactgataatttctatctaaagatagagaataactatgaacaatctttaaaacctccgatattttttatttcaagtacatctttcatccaagtcatgtacttcttttacctttttcttctacatcatttgccagagtgaagtacttcctgtcactcactcttttatatgtttgcctgcactcttttacttgtttttcaccactgcggtacaacataaaaaaactcccgtccttcctttcggaaggcgggagcctttatcttaaaaatgactatagctttcttatattttgctgattatacgataccctgagccatcatagctttggcaaccttcataaatccggctacgttagcaccttttacatagtttacatatccgtcggcttcagtaccatactgaacgcaagcttcgtggatattcttcatgatgctcttcagcttttcgtctacttcttcagcgctccagctcaacttgatggagttctgagtcatttcaagacctgatactgatacaccacctgcattagctgctttacccggagcgtacagaatcttagcgtcttggaatacacggacagcttccggagtagaaggcatatttgcaccctcagatacagctatacagccgtttgctaccaactgacgggcgtggtcgccgttcaattcgttctgagtggcagaaggcagtgcgatatcgcatttttcaccccaaggcttagctccttctacatatttgcaaccatatttctctgcgtattcgcggatacggccacggtacaggttcttcagttccatgatgtaatccagcttttcgcggtcgataccgtccggatcgtagatgtaaccgtcagagtcggagcaagtaactactttaccacccagttcgattactttttcgattgtatattgagctacgttacccgaaccggaaacaagacaaactttacctttcaggtcagtacctttggttttcagcatttccatcaggaagtagatgttaccgtaaccggtagcttccggacgaatcagtgaaccaccgaattcgcggcctttaccagtgaatgtgccggtaaattcgtgagccagcttcttgtacataccgaacatgaaacctacttcgcggccacctacaccgatatcacctgcaggtacgtcagtttcgggaccgatgtgacgccacagttccagcatgaatgcctgtacgaaacgcattacttcagcgtttgacttaccacgtggagagaagtcggaaccacccttaccaccacccataggcagcgtagtcagtgagtttttgaatgtctgctcaaaggcaaggaatttcaggatggaaaggtttacagatgcgtggaaacggataccgcctttgtacgggccgatagcgttgttgtgctgaacacggtaacccatgtttgtctgaatattacctttgtcgtccatccaagttacacggaactgaaatactctatcaggaatacacaagcgttcgattaagtttgctttgtcaaactccgggtgtttgttgtattcttcttcaatagtagaaagtacttcttctactgcctgatgatactccggttcgttggggaaccgtcttttcagatcgtctaatacctttgctgcattcataatctttttttcttttattggttgattaaatttcgattacctatttcttttatgcggttgcaaaagtaaagataaaaattgaactagcaaacat

SEQ ID NO: 171 - DNA, 15662 bp, Bacteroides thetaiotaomicron
tacttctactgattatgactttaaatttgatttatacagtcaagtaaagatgtattttcgtgcgaatttgaagtaccctactgtgaatgagctttgggactattgttggaaaataacgaatgaagttaatgataacacatttttatcatttgatgactttgataaggcggcatataaaaatgtctcaggtcgagaagagcttttgcagcatttatctttatataaaaaggaaatttcgttccaatttaagaaaggagcaatgtttgttctttggaagaataaaaaatggtttaaaattgagtttgatttaggtgaaatgatagctgataatggttataagtttgtttacttctatgatatgcaaggcaattacagtctggattttgactatgaagaagattttcaaaaaataagaaaggaagtacgtgataaatgcgtaccagatactacattgtggagtgaatttcacacgtgtctcctgagatttgatagaattaaaggatatcagctatattatccctcgaaaaataagattaaggaaaatatttaccttaaagaactaggatgtgctttggataattttcttttaaaccgaaatctgcaaatgattcaatttgttactaatttgcctcaatcgtatttgtataagtaaagtttatgcagtttctgtttgccctgatatggattggctaaataaagttaaccatattagggcatttcagttaattctactagtgctgtctttcattttaataacaactatattgaaccttgatattgtcttctttgtcagttttagtattctttcctttaaagaaaaaaacagtaattgattgatatcaagataaaactatggaaataacaggatcgtagtgaatgaacatgaactgaccaaaaagttagcttatgatagaataacccaaatgttttcatctgtttttaaggacttccacccataattctcctctttttctttcttttttctcgcaggaaagaatatatttgtatcctagtttaaacgaaaaccagtgtatgatatgataacaacccagttacttcgtcccgagagtatagttgtagtaggggcttcgaataatgtacataagccgggtggcgctatattgaagaatctgataaacggaggttatcagggagaactccgggctgtgaacccgaaagagacagaagtgcagggagttcctgcctttgcagatgtaaaagaattgcctgataccgatctggctgtgttggctgttccggctgtgatgtgtccggatatagtagagacactggcaagcgagaagcagacgcgggcgtttatcatactctctgccggatttggtgaagagacacacgaaggagcactgctggaagaacgtatactggaaagtgtcaacaaatatggtgcttcactgattggtccgaactgtatcggactgatgaatatatggcatcatagcgtcttcagccagcctattccgaacttgaactcaaaaggagtcgatctgatctccagttccggtgctacggcagtctttattcttgaaagtgcggtgacaaaaggattgcagttcaattctgtttggtcggtaggaaatgccaagcagattggtgtggaagatgtgctgcaatttatggacgagaactttgatctggagaaagattcccgtatcaagctactctatattgaaagtattcacaacccggacagattgctcttccatgcctcttcattaataagaaaaggctgtaagattgcggcgataaaagcaggaagttcggaaagcggaagtcgggcagcttcttcacatacaggagcgattgccagttccgattcggctgtagaggcgctgttccgtaaagccgggattgtgcgttgcttttcgcgcgaagagctgactaccgttggttgtatcttcaccctccccgaactgaaagggaaaaactttgctattattactcatgccggaggtccgggagtaatgctgacggatgctttgagcaaaggcggactgaatgtccctaagttggaaggtgaactggcggaagaactgaaagcccaactcttccccggagcttccgtaggaaatccgattgacatccttgccaccggtacacctgatcatttgcgtatctgcatcgattattgcgaagaaaaattagataatatagatgctattctggctatcttcggcacacccggactggtgaccatgtttgaaatgtacgatgttcttcatgaaaagatgcagacttgtcacaagcctatattccctgttcttccctccatcaatacagcaggagcggaagtggcggcattccttgccaaaggacacgtgaacttttccgacgaagtgactttgggaactgcactgtctcgcattgtcaacgccccgaaaccggcggtgcctgagattgaactgttcggagtcgatgtaccgagaatccgtcgtatcattgattccatcccggagaatggatatatcgaacctcattatgtgcaggcattgctgcacgcagccggtatttcattggtcgatgaatatgtttccaataaaaaggaggaagtcgtggattttgcccgtcgatgtggattcccggtagtagccaaagtagtaggtcctgtgcataaatcggatgtcggtggtgtagtactgaacattaaaggggaacagcatctggcacttgaatttgaccgtatgatgcagattcccgatgcaaaagcgatcatggttcaacctatgctcaaaggcacagaactttttattggtgcaaaatatgaagaaaagttcgggcacgtggtactctgcggtttgggcggcatttttgtggaagtcctgaaagatgtatcttccggcttggcacccctttcttatgaggaggcttattcaatgattcgctccttacgcgcctataaaattatccagggaacccgtggacaaaagggagtaaacgaggataaatttgctgaaattatcgttcgtttgtctaccttgctccggtttgcaacagaaatcaaagaaatggacataaacccgctcctggccactgagaaggcggttatagcggtggatgcgcgtatccgaatagaaaaataggactatttttctattcattgggacatattttctattattcagttgttattttgtctacatttgattagttgaataaaggagccttataaaactgaatatatgaaaaaaaatattataacgtttgttgccttaataattggtcttatttgccgtgcacagaccgtagatgagaattattattttaagagtcttagtagccagaatggattgtcgcaaaatacagtaagtgctatcttgcaggattcgaaaggctttatgtggtttggtacaaaagatggattggacagatatgatggtgtatcgttccggcattttaaatatgatagaaccaatccgcgaagtctcggtaataattttgtgacttctctttatgaagatgttgagggaaatatatggatagggacagacgtaggagtatatatctactatcctgaaaaagatacttttcgtcattttgtagaattaagtgatagaaatacaaggatagaacgcgctgttgccatgatttcaggggacaggcaaggacgtatctggatagcttcggaggcgcaaaatctattttgttatgacttaaaagaacaaagtttgcggaactatattttgacagaacattcattggtctctactaacgtgaaatgtttgacagttgataatagcggtactatatggattggattctacggagatggactattttattcgaaagataatttgaaaactcttcacccctatctgtcacctgttgataatgaagaaacttataatgatgatgttgttagtaaaatagtattaggggcatacaattgtttatatatcagttccttaaaaggaggggtgaaagaactgaatttgacttcgggcaaattgagggacctgttgctgaaagacgagaataatgaggctatttattgtcggactctacttgtctatactgataatgagttgtggatagggacggaatcaggtgtttatatttataatcttcgtacggaaaagtatacgcatttgcgtagttccgaatatgatccttattctttatcagacaatgctatttattcgttttgtaaggaccgtgaagatgggatatggattggttcatattttggaggagtaaattactatcctcgttcgtatacttattttgagaagtattatccgaaaggaatagaaaatagtctgcatggtaagcgggtacgtgaattttgtcgggatagtcaaggtatattatggattggtactgaggatggtggattaaatcgtttcaatctgaaaacgaaagacttttctttttttgctcctagtgcaggatttacgaatatacatgggctttgtttagtggatgataaactttgggtaggtacattctctaaggggctaaaggtgatagatacccgttcaggtgttgttttaaaaacatatcaaaaaaatgattctccccgttctttgattgataatagcatttttgcaatctgtaaaacagctacaggtgatatttatttgggaactatgtttgggttggtacgatacaataagcaatcggatgactttgatcgcataccggaactaaacgggaaatttatatatgatataaaagaagattctgccggtaatatctggttggcaacttatgctaacggagtatattgttataatgtgaacgatcggaaatggaagaactatgtgcatgatgataaagataatacaagtcttccatataataaagtatcgagtgtttttgaagattcccatcgtcaaatctggttgacgactcaagggggaggattctgtatatttcatccggagtcggagacttttacgagttataactctactaatggattgcctagtgatgttgtttatcagattgtagaagataaagaagggcagctatggctgacaaccaataatggtctggtttgtttccagccaaatactgaggctatgaaagtgtatactactgcgaatggtttgttgggagatcagttcaactatcgctctagttttgaagatgagaatggaatgatttactttggggggattgacggttttatcgcttttaatcctaaagatttctcagagaataagaatcttcctacagtagtaataactgattttctgttgtttaataaggaagtgtatgcagatgaaccaaattctcctttggaaaagagtataactttctctgataagatagtacttcgggctgatcagaactccttctcttttcgtatttcagctctaggttatcaagctccgagaatgaataaattgaagtataaattagaaggatttgacgatgagtggctatctgtaggcgaaagcccgctgataacttattctaatctacgttatggtcattatatatttcgggtaaaggccgccaatagcaatggtgtatggaatagtaatgaaatctcgttaagtatccagattctacctcctttttatctttctgtttgggcttattgcatttatgtacttttgattattggatgttctgtctatttggttctttattttaagcgtcgcaccaatagaaagcatcgtcgtcaaatggagaaatttgagcaggaaaaggaacgggaagtgtataatgccaaaatagattttttcactaatgtagcacacgagatacgtactcctttgacgttgattaatggtccgttggaaaatattcttttgaaaaagtcagtggactcggagacgcgtgaagacttgaatataatgaagcagaacacagaacggctactaagtctgacgaaccaattgttggattttcgcaagacggagagtcagggtttccgattgaactttgctgaatgtaatattacggaggtattgaaagaaactcataaacgttttacttctttggcgaagcaaagagaattggatttcattctaaatgtaccggtacaggatttctatgctcatgtaaataaggaggcatttactaaaattgttagtaatctgctgaataatgctgtgaaatatgcagaaacgtatgtgcatgtgtacttggaaataaatgggacgggagaaaataagatgttttatattcgttctgtgaatgacggagttattatcccgaatgaaatgaaggaagagatttttaaaccttttgttcgcttcaatgagaaggaagatggtaaagttactaccggaacgggaattggattggctctttcgcgttcattggctgaattgcatcggggaaacttgacgatgttggaaagtgaagaagccaacgttttttgtttgtcgctgcctgtagaacaggatagtgtgataaaactagcttcagaacataaatctgtggaagagagtaaaacggtagaacgtcggatagaacagggggaaagtaagacaaataggcctgtaatactggtagcggatgataatcaggatatgctgtcttttgttgttcgtcaattggaagataattacatcgttttgactgcaaaagatggattggaagcattggaagtgctggataatcaggaagtcacattggtggtaagtgatgttgtaatgcctcgtatggatggatttgagttgtgcaaggtggttaagtctaaactggattatagtcatattccggtgattctgcttactgctaaaacaaatattcaatctaagatagagggattggaattaggggcggatgcgtatattgaaaaacctttctctgttgaatatctacaggcttgcatcgccaatctgattaatagtcgtgagaaactgcgtcaggcttttgcacaatcgccttttgttgcggccaatacgatggctttgacaaaagctgatgaagaatttatgaaaaaactaaatgaaatcattcagggtaactttcataatcctgattttagtatggatgatatagtcgattcattgaatatgagtcgctctaatttttatcggaaaataaaaggagtacttgatctgagcccgaatgaatacttgcggctggaaaggttgaaacgagctgcccaattattgaaagaggggaatgggcgtgtgaatgagatttgttatatggtaggttttaactcgccttcctatttttctaaatgtttccagaaacagtttggagtattgccgaaagactttgccggttagatagtatctcgtacatgcaggatctatatccccgttgcattgcgcatatatacacaatgtacagggcatatagatcctgcatattgcatatatatagcttatctgcctcttttttattgcaatattttatgtgcttttatgtggtatatgaaacaattatctcattcctgtttcatttggtatagatttgctattctttcttctatttgagacattattgcgatttattgggatatttatattacccaaaaactatctcatccgctaattttgtctgcgtcaatcagtcgaaacaataatctaattatatatgatcaaacatttaacacttttgggtacagctcttttattctcttctcaaattttattggcgcagtggaaacctgcgggagataaaatcagaactttttgggcagaaaaggtcgatgtgaataatgtattgccggaatatccgcgtcctattatggaacgttcggattggcagaatctgaatgggctatggaactatgccgtattacctttaggacaatctgctccgactacgtttgatggaaagatattagttccttttgctattgaatcaagtctttccggtgtaggaaaaactttggggatggaaaaagaattatggtaccaacgtgcatttaatattccttccagttggagaggcaagagagtattgctccattttggcgcagtagattggaaaactgaagtgtgggtaaacaatataaaagtaggtgaacataccggtggttttactccgtttacttttgatgtgactgaagctttggagaaatcaacgaataccctgactgttaaagtctgggaccctacagataaaggatttcaacctcggggaaagcaagttagtaaccctcgtggcatttggtatactccggtaagcggtatatggcagactgtgtggctggaaccggtgtccgagcattatattgcaggtataaagacaactcccgacatagatacaaataaaataaaggtaaaagttgaaacggatagcaatagacagtcggataggctggaggtaaaagtgtttgatggaaagcatctggtggctatgggaacctctataaatggtttgccggttgagattcccatgcctgctgatgcaaagctctggtcgccggatagtcctttcctgtatcagatggaagtatctttgatttctgcggggaaactggtggatcagataaaaagctatgttgctatgcgcaagtattcgataaaaagagatgaacatggtattgtgcgtttacagttgaataataaagacttgttccagtttggtcctttagatcagggatggtggccggacggattatatacggctcctacagatgaagctctacgctatgacattgagaaaactaaggattttggtttcaacatgattcgtaaacatatcaaagtagaacctgcacgttggtatacttactgtgaccagatagggcttatcgtatggcaggatatgcctagtggagataaaagcccggagtggcaaaaccgaaaatattttgagggaacggagttgactcgttctgctgaatcggaagagacgtatcgtaaagaatggaaggaagtgattgattgtctttattcttatccttgtattggtacttgggtaccattcaatgaagcatggggacaattcaagacacaggaaattgccgaatggacaaagcaatatgacccttcccgattggtaaatccggcaagtggagggaatcattatacatgtggtgatatgcttgatttacatcactatccgggaccggagatgtttctgtatgatgcgcaaagggctacagttttaggcgaatacggaggtatcggactggtgttgaaagatcatctctgggagccgaatcgtaattggggatatatccagttcaatacttccgcagaagctacagcagaatatctgaaatatgccggaatactgaaagatatgatttcccgtggattttctgcagctgtctatacacaaactactgatgttgaagtcgaagtaaatggtttaatgacttatgaccgtaaagtgataaaactcgatgagtcaaaattgaagaagatgaacacagagatttgcaattctttaaaataacaactaaatagcaaaactatatattatacttatgagaaagacactaattttgattttaaccttgtttgcagtctttacgactgttgatgctagaagtaagaaagaccaggaccgcgcattaatcgacaaagttgccatgtggcagatagatcatcagacgaaagtaaagcatcatgatcttgcatggaccaatggagttttgtttcgtggcatggtggaatgggcagactacacacaagattcccgctattatgactttctgatgcagatagggaaaaagcatcgttggggattcttgaaaagactctaccatgcggatgatcttgtgatagcacagatgtatatccgtatgtatgagaagtatcatgatccggtaatgattcagcctactatcgcacgagtagattcgatagtggctaagccttcgaaagctcgtttatggttaggtgcaaaaaactggtcggagcgttggtcatggtgtgatgctttatttatggctccccctgtctatggacagttgaacaaactgtatcctgaaaaaaactatctggattttatggatcgtgagtttagagaagctacagattccttatatgacgctgatgcaggattgtactaccgggacagaaggtacatcccgaaaaaggagaagaacggtgagaaagtgttttgggggaggggtaatggttgggtatttgccggactgcctttgttattacaaacacttcccaaagagcatccgacttataattattatctgaatatctacaaagagatggcttcatccgtcatcaaatgtcaggataagaatggttcttggcatgcgagtatgcttgatcccgaatcgtatccttcgccggaaaacagtgcttccgggttctttgtctatggtttgggatggggaattaatcaggggatactgaaaggtaagaagtacaagaaagctgctcaaaagggatggaaagcattgaagagctatgtccatgaagatggcatgcttggatatgttcagcccgtcagcgctgctcctgaacaagtcactaaagacatgaccgaagtgtatggtgtaggtgcattcctgatggctggtattgaaatgttgaaaatgaaataacctttttattaataattatgaaaacaaaaacaagagatttaagtgcatgcctgaaaaggcggctatggatcgccggcgtatgtctggcagctttttcttttctttctgtatctgttgtgtatgctgctgacgatattcagactattcagcagcaaaagaaaggaatgacgattaaaggtaaggttttgggtacagatggagaacctattattggtgcatctgtattggtgaagggatcgactaccggagtcgtgactgatttggatggtaattatacattggctaacgtttctaaaggcgctattctggaatttagttatgtaggttatgtgaaactgaccaaaacagtagggagtgaaacaacgataaatgcaatcttgtatgaagattcccagatgttggagggagttgaggttgtggctttcggtacacagaaaaaggaaagcgttatcggagctatttcaacggtaaaagttgcagaactgaaaacaccgtcgagtaacttgaccaatgcacttgccgggcgtattgcaggtgtgatttcttatcaaagaacaggtgagcccggtgtagatgatgcttctttcttcgttcgtggtgttactactttcggttataaaaaggaccctttaattttaattgatggcattgaattgacttctactgacttagctcgtttgcagcctgatgatatcgctagtttttctattatgaaagatgctactgctacagcgctttacggtgctcgtggtgcgaatggagttatcttggtcaagacgaaagaaggtcagaaaggtaaggcgcgattaagcttgagagttgagaactcaatatctgctccaactcaggagattgacttggcagatcctgttacttatatgcgtctgcacaatgaggcctatttgacacgtaatccgttagcgccgttgatgtactccgaagagaaaatagacaatactgtacctggctccggttctgtgatttatccggctacggactggagaaaggaattattgaaggactttacgatgaaccagcgtgtaaacttgaatattacaggtggtggcgatgtggcacgttattatgtggcagcttcctatagtcaggataatggtattctggaggttgataagaatagcaattttaataataacattaaacagagagtttatactcttcgctctaatgtgaatattaatgctactaaaactacagaattgattgtacgtttaagtggtgtatttgatgattataatggtccattgtatggtggttctgccatgtataatctgattatgaaaagtaacccggtattgtttcctgccaaatatcccaaagatgaggctcatgcatacactaagcatactttgtttggtaatgctgaaaatggacagtatctgaatccatatgcagaaatggtaaggggatataaagaatcaggacgttctaacctgagtgcacagtttgaagtaaagcaagacttgaaattcttgacagaaggtttatcagcccgcttattgttcaatacttcccgtatttccagttatgatgtttcacgtaagctgaatccgtattattataagatgactaattatgattatctgactggtgattatgctatcgatattatcaatccggatgaaggttcggagtatttgatttatgatccgggaggtaaaagcattacagctaatatgtatattgaagcagcattgaattataatcgtgactttggaaaacacggagtaggcggattgttggtttatcagttgagaaataatcttcagccaaatgcaggctcgcttcaggcatctttgccttatcgcaatgtcggtttatccggtcgttttacttatgcatataataatcgttattttgcagagttcaactttggttataatggttctgaacgcttccacaaaagtaaacgatttggcttcttcccttctgctggtctggcatgggttgtttcaaatgaatctttttgggacccgtttaagagtgttgtgtccaaattgaagttgagagcttcttatggtatagtcggtaatgatgctatcggaagtgggcgtttcttgtatctgtccgatattaacatgaatgatagtaaatatggagcaaatttcggatataactttgattatcatcgtgatggtatctcagtgaaacgttattctgatcctgaaattacatgggaaaaatctgctaagaccaactttgcacttgaatttactctgtttgatgacttgaatgtgacagccgagtactatacagaacgccgtaagagtattttgcagcaacgcgcttctattccggcatctatgggactttgggtgcagccttatgcaaacttaggtgaagctaaaggaagtggcgttgacttatcactggactataataaatattttgcaaacaaatcatggttgcagttgagaggaaactttacttatgcaactagcgaatatatggtgtacgaagactatgaatatccgggagcatggtggaaacaaaaagtcggttatcctaccaatcaaacttggggatatattgcagaaggtttgtttgtagacgataacgaagtggctaactctcctgtacaattcggagaatatggtgcgggtgatattaaatatcgtgacgtaaataaggacggaaagattactgatctcgaccaagtacctatcggatatccgaaagagccggaaattgtatatggttttggtgcatcttatggatataagaattgggatatatctgtattcttccaaggattggccagagaatcattctggattgactataataatgtttctccgtattttaatacagttgatacgaaagttgtaggaaatagggtaggccataatgcacttgctaagtttattgcagatagtcattggtcggaagataatagagatgcgtatgctgtgtggccgagattaagcccgacttctattgaaaataatagtaaaacgagcacatggttcatgcgtgatggttcgttcttgcgtctgaaacagttagaaatcggatatacgattcctgaaaaggtaactaataaagtcggtattaagaatcttcgattctatgttacaggaaacaacttattgtgcttcagcaagtttaaactttgggatcctgaaatggcaggtgccggtttaggttaccctgtgcagagagtatataatgttggactaaatttaacattctaaatctgatataaaatgaaaaaattacaattattaatattgaattgtttgattatcgttttatcctcctgtgattcatttctggatatcgttccggatgatatcgccacaatcgataatgcatttacaatgagagcgcaagcagagaaatatctgtttacctgttattactatcttccagctcatggactattggaggcaaatcctgcgattgccggtggtgatgaattgtatattacggagtctttccgtagtgcagcacacgtgcatgcctggtatatttcacataatatgcaaagttcggcaagaccgcgttgtgattactggacgggagccgatcagcaaaacaacaagtctttatatcagggaatcagtgactgtaatatttttttagagaatatccagaaggtgcctgatatgacacaggctgaaaaggatcgttgggcggctgaagtgcgttttctgaaagcctattatcattattggttgatcaggatgtatggtccgattcctattatggaccagaatattccggtgaatgctggtgaagaagaggtaaaggtctttagaaatacaatagatgaatgttttgattatgtgattaacacattgactgaaattatcgacagcaaccatttaccagataagataatgaatgaggcggaagaactgggacgaattactcaaggaattgcaatggctataagagcagaggtgatggtaactgctgccagtcctttatttaatggaaacgcggattataaaggatataccgattcaaggggcattgagatctttaatcctaacaaatcggaacaagataagaagcaacgttggatagatgcagcagaagcatgtaaacaagctattgaatttttaaaggctcagggacatgatttatataaatatacttctcttgagtacactatatctgatcagacacgggcaaaaatgaatatccgtaatattgtaacagagaaatggaatcaggaaattatctgggctaattcaaatagtattatcggtcaattgcaggatcatgcgattccacgcggtttggaaccaggaaaagaagggaatgcaagtgttggtggtaatctggctgttcctctgaaaatagctgatttattctacacaaaaaatggagtacctatcacggaagataaaacctggaactatgatgatcgcttagaattgagaaaggcaacatctgatgataaatactttataaaagaaggatatacaacagccagtatcaattttgacagagaagttcgctactatgcaagtttaggatttgacggtgcagtttggttcggtcagggtgtaacggatgaaacgaagccgatttatgtacaatgtaagcaaggacagtctgctgctaatcagatatcaaactcatggaatgaaactggtatatggcctaaaaaactagttcactttaaaagtgttgtaggacagactagtgggtttaccaagattacttatccattcccagtgatgagattaggaaacttatacttgttgtatgccgaggctttgaatgagagtggtgcttctaaaacagatgttctgacctgggtcgacttgatcagagaaagagcaggtttggaaggagtagaagagagttgggatacatacacgaataacaagaaatatgaaacagtagacggcagacgtgagattatccagcaagaacggggtattgagttagcctttgaagctcagaggttctgggatttgcgtcgatggaagttggcatatcaggaacaaaataagcctattacaggatggaatactcaatatagtacaaatgaggattactatacagaacaattgatttatgctcaagaattcagaataagaaactatttctggccgatattagataaagaattatattcgaataaaaatctggtacagaattatgggtggtaaactttaaatttaagacgttatgaagaagaaattatataaatatggtttgctttatataggag

SEQ ID NO: 172 - DNA, 15643 bp, Bacteroides thetaiotaomicron
atattaatcttatagattatttggagattacttattcaaaatataccccctaagcaaggatattattatagttagtttttagggttaaaactgctggggtttcaaacaaaatactgattttcaatagtcatcataatggcttctgactaattttgccttttcgaataaatatagtatttttgttcctcagatttaaaaatgaagaattcatggcagataattatatagaaagacaacaagagcaatacgaggccagaaaagcagcttggaaacaggcacagaaatatgggaaaaagaaaacgactaccagcagtcaagtcaaaacggaggtagcaggtgaaattgtttcaaagtcggacagcctgaaaaaaagaatattcgtgacaggcggagcggaaggcatagggagagcaatagtagaagcattctgtaaagacggacatcaagtagccttctgtgacattaatgctgtgtccggtcaacaaacggcaagagataccggagccatatttcatcctgttgacgttagtgataaagaagcacttgaaagctgtatgcaacagatattggatgaatggaaggacattgacatcgtcatcaacaatgtcggtatcagcaaattttcttccattacagaaacaagtgtcgaagatttcgacaagattctttccgtcaatcttcgtcctgtatttattacttcacggttacttgccattcatcgtaaggcacagtctgattctaatccttatggaagaatcattaatatctgctcaacacgttatttgatgagtgaaccgggaagtgaaggttatgcagcttccaaaggtggtatctattctctgactcatgcattagctttatcattatccgaatggaatatcacagtaaactccattgctccgggatggatacaaacacaaaattatgatcaactccgaccggaagaccattctcagcatccttcccgacgagtgggcaaaccggaagatattgcccgtatgtgtttatttctctgccgggatgagaatgattttatcaacggtgagaatataaccattgacggaggtatgacgaaaaaaatgatttatacggaataaagttctgtattcaacgcatcccgggtaatctctattcccgtctccacaatagaagctgcatgatggaactccagcatatcataagcattgccggacatctgaattaagatatccggctgacaacgttctacctgataacgggtaatttgctgcatcatcattcttgaagattctgtcaacaagttataaggactcattttctttttcttaccgcaatcaatcggagcattgacatcgactgctatcagaatatccccttccgtacgatgcacctgattcagcggaaggggattcagtattcctccgtcaatcagaaccataccatctttccgtaaaggccggaagagcatcggtatagaaatagtagcacgaatagcatcatacaaattaccactatcgaacctcacttcctgatcgcaaacaatatcagtagccattgccacgtatggtataggcaaatcttcaatattcataacgggaataatctgcttcagttctttgataaaacgatcccccttcaccaagccgtcccgacttaatgtcagatccgccagttcccacatcttacgtttatcccagctatagagccattctttacattcctccagttttcccgaagcatacattgcgcctaccatcgctcccatcgagcttccggcaatagaagttatctcgaaattatgacgtaacaattcttcaatgactccaatatgcgcaataccacgtgcgccacccatagaaaggactaatgctactttttgcttatccatataatatacgtttttattagctgtccacaatataacacattttctgcaataaaagatgtccgaccagctctattattctagaagtaaatgaagcaaaaagcagcaatcctctctatgtcagaggtattgctgcttatagtacgcattaataaaaaaggatctttgattctctatttcccttcttttgctttttccgcctttcgcttttctgcatagtctttatacatttggcgccagttacggccatgttcatagaaatacagttcgatcttcgttttataagctttaaagatagcagatatctgtttcatgcttttgtaatcaacagcttgttcgcgagccagtttcagctgttcaagtataaaggctgtttcttcctccgtcatatcaggaacaatctcctgataccctttcatggtaaaagcgactttgccaactgtatatttatctaaaatctgctcaacttgttcttccgtcagtactctgcgcagccctttcatcagtctttcatgaacctccttgggcatagctgagtctgctattatctcacgttcgagctgagttaacggtttgcccgttgtaggattgatacccgcaggtattgtcgtgtatggatgatcattatgccagtctcgaacctggcgaagatgattataaatagtcgtcaccgcaaaacctgatttcttttcatcatccagattgagtgaagctacccattccattgctttcttttcaagagaagcatccgatttcaatttggcaaaagccttcttatcaaaataagcagccaccttgtcgaacgaacgaattgcattttccggtagtagctcccctttctctccaaagctgtacatggcagactccggttcgatagttactttactctcatccaacatctttttatctaaatcgaagacttcggcaaagaaatcatagactgcatttcttttattcggaccgaaatcatgtttttctttgggaagatgaacgttcgtcacgttgtctttcgcatcatagaatccatagatacgctgcaaatacggaaattcaagtgcaggaacacttgctgtccagtccccgccatcagaaaccactaattgcggacggggagcgaatgttgcagccagttcagcattacaagtacctcctgccgataactgaataggcataccgctttcacaaggacaaccgccatcgaaatgagaagccagactaaccaccggggcagaagcagtaaaacggtcatccaacgttgtcagtagtacagtatgcgttccaccaccggaaccaccgttggcaccaatacgcttggtatcgatatctttacgggaagcgagcatataatcgagaatcaacaatccattcattgcctgaatagtatgtgccgcactactgcgatgcgccgtacttcccacctggagaattgattctccccagccaaacaaatcataatcgacacaaacagctcccatacgagctaatgtacccatacgctgctgctgatcttcccgataacgaccgccaccaaaatgtccgttcggacaaataatcagagcgtgtttccctttcgattgaggcgtataaacagacccgcaaacatacagtcccggaagtgtttcaagtgcgaaattctgcacagtatagccatcaaacttccgtattttcgatagaatgggggttgagtttacacattgagccaataaagtatcgatccccaaacgttgacggacctcttttctcagtgaatcggcacgaagttcaaaagcctgcttatccgcataaagcgtattgagataagccagcattttttctccgtcagcatctgtacgacgaggatattcataagccttcaacttatatagattaccgctctgtctgacaaatttataatcgaatggtgacaatacattcgtcaaagattcttctacagaataagggcgaatacggaaatcagcataaggcaaaatcttccctaccgtatcgatatcatatttcagacggattccgaaacgattttgaatatctgtcaatacttcattcaagggacgggcaaattccgtctcgtatgtctgcgtctgtgcttctgccgaaagagatgcagcgagaagcaatgagaaaaggattcgtttcattttcttatatttataaagatgtaacctcccaagaggtttatttcagtttcatttcttcaccgttaataattacgtcatccatagtgatacgttcacaatcttcaaagatacacttctgtctggctccctgaatatggatgtcacgcaatacaatgtcagaaatcggagcttcttccagtcctactattttaatcggagtctttacatccgtcacagtcataccgctgatatgaacattacgaaatatcggagtacgctcactctttgcttctgcaggcatttggctgtatttcagattcaagacgacagcctcctgcttgatgttactcattacgatattactgacacggatatcctctacgactcctccccttccacgggttgacttgatgcggataccacgatcggttccgtcaaatacacagttagagatcgtgaccttacgcacactaccactcatttcactgccgatcactacaccaccatgaccggaaagcatcgtacaattggtaatagtaatattctcacacggtactcccaagcggcgggcttgtgcgtctcttccggatttaatcgtaatgcagtcatcgcctacagaaatatggcaatcactgatatgtacattccggcaggattcaggattgattccatccgtgttgggagaagggacattatttattgtgatccctttgatggtcacattatcacaaaactccggattaacagtccagaaaggagaattgacaattttcactccttcaatcttcaccttcttgcaacgaacaggctgaatgaacggagggcggaaaaaacgacgctgcaaagtgctgacataatctttattcgtctctgcatagatggcagtcgtatcattctgagcatcccacatcggctgatatttattaatatcacgcataccattatcttttaggtcaatcattacacgaaagaactccatccaccacttcttaccttgaccatccagtgtaccttctcccttaatagtaatattttccgcatcaaccgcatagattaacggctggaaacttttcatcatgactccttcgtgacgtacttctacaaaaggaagataatcatcaaagttgtctgaaaaaagcagggtagctccggcttccagttccagtgtaatgttacttttcagatggatacttcccgtcagatacgttccggcaggaaaaaagagcgtacctccgcctccacgattcaaacggtcaatcgttgaatttatcagctttgtattgagagctttcccatttgcttttgcacccgctttcaacatatcaacgcgttcggcacgaaggatcgctgttgcgcaaaggcaaagaaaagccaaaagagtgattcgtaaattcatattctatattattaaatagttcttcttttttatatcttattcggcagcaacaaacttatatgtcccgctttgtacttctttcggttctttttcacccggaagataaacgatagcagtggtattcaccggtacagatacattcagagtaaaagtaccgctctgacgagtccagtctaccagaatcgtaccgtaaagagtctcataagttgatttaacgtatttcaagtctcctaccggcttcggagcaatgacaaatttctgataaccttgcattggctcatccttttcatttacagaagctgataatgttgtagacggacgaataccaatcaatgaattaaagaaccattcatcaatctgtcccatcatgaaatgattccatgaagaaccctgacgcgggtcccactgctccgtcaatgtagttgcaccaaacttcaactggaagccatatccgggagcttcttcatgattgaacatcttataaataagctcatgctgtccattacgtgccaatgtctgaatcagatagcggtttcccacatctcccgtggtcaaacgattgccgtgcgattccacatctttaatcagattcgtcaacactttggcagccagacttgcatccggcgtgtaatctcctttatctcctgtactttgaatcatctgaaggaagatgggaagtgcattactagcttgactccctgtaccatattgtgctgtattactatccaggaaccgtttgttaaacgctaccattatatcgtatgccaatgaactgtaataacgaacgtcaaattcattgcctaccattcgggcagcctttatcagatacatgacagtcatataataatgtgccgtagccaccaacggaacaggtgtattacgggagaatccggcgcggaaatctccataatcataccagtcacccaatccgaaagaaagaataccgttatctgcccgagtcttaagatagtcagtgtaacgacgcatatgctgataatacttcttaatcaaagaatcatccccgtaagtttcatagtacataaacgggaaaataaccagtgaacctccccactccggggattcggcaaaagcatccattccgggaccttcaaagactacatactccggagccgttgtgggcattgccccattcggatgctgggcgtctgccatattctgcataatctgtggagcataggctgtcagatcataattatagagcagtcccggtccattaaggtgcacctgttccagccatccgagtttctcccgatgcggacaatcagtaaatacggattgcatattactgcgaaccgccttctcaatcaatcgatgagctgcattgaatattcggttggaagattcgaatgtagagactttctttgccgaattatagataaaacaggattgaatgtttttaaggacaggcagtttctgaggatttttctgccctttcaatacagcaccttctacctgaatgtaccgaaaaccataatatgaaaaacgaggatgccagatttcgtcaccttcacctttcagtgtatattcataataatgctgacgccctgtctgacgctgattacaagctccttcatccatcaatgcttccgctactatcaaggtgactttctgtcctcgtttaccacgtacggttatctccggaaaaccggccagattctgtcccatatccaacacaactgcagaagggtctactgttcgtttggtagatttggaagcagccatcacctgttctgaattcaacttggttactttctgaatatcataccgttccataatcttcaccggaggtgccatctgcgaacggagcactcctttcggcgcttcctgaaccactaccggacgccaatgactatcattgaaaccaacttgattccatcctttctgttcgcgacgggcatcataatcttcccctccataaatacaattaaaggttatcggactcagatcatatttccactcatgatccgaacggatcgtctcgcgtgttccatcctcataattgattactaattcaaataaaagtgtgggaggaccaaaactaatctgcaatttgcgatagcgccctccctgtacattgtagaatccattccccaataagattcctacaacattctcaccatcctgtaactgctccgttacatcgtatgtattataataaacactcttatcataatcgctccaaagcggagcaaattcactatctcctatttttttgccattcagagaaaactcatagaatcccaggccacaaacatacgcagtagcttccacgattttctttccggatttccgattcgcattcttcccttttgcctctcctgtctgaaacgttcttcgcaagcaaatacttttctttgccaaagtatctaccgcttcccaagcagctttcacctccggtttcttcaattcgccaccatgaaactttcgcccttcgggaaggtgagaatccttacgagtgatggcgccgatccatttccctgaagaaaggtcatcggatgccaaacggaattttgcttcctgactccattcggaaggagtatccgtctcatcccagacacgcacacgccaactataattaaatggattattcagacatatatccgctccttcagtcggaaccagctgactctgtgaagaagtaacctttccactattccagacggaacgtccggtaaaagcctccctaatctctatttcataagcagtctgtctcgtgccattctccggtgattccattgcccatcccaaacggggacagctttcaacgaccaccagcccttcctgcatttcgcaggtaaggcggctgatcgttatattctttgcctgtacgaagcatggcagacaaagtagaagaagaagatatttcttaaaagtcattattgctctgtctcttatctgttataaatatatcactttaatgcattctcgcaaacaagtcttgtcaacgtatctgcatgtcctgcttcttttccattcacaaagatacgcaatccctttccacaatgataacgatcgccattcttatcccaaagaatcgtcagattatgaccatgatataaaacattatccagacagaaccaatcccatttatctgccggaatcagcggattaatctctatcgtatcatccagacgcggacgaagtccaatcaatccggtaatcatcaaatcattgaaagtagaatgattgtaatagcgactacgctcctgatcgcctttcagccaatatccggttacttcgtccagatactcgccaatatatggacgtccacgatgatactgcgactctacatacaattccatctgacggaaatatacgctgtcagacaaaacggtctgaggataattattcatgaaattagccattgcagttaacgtctgtgcagaagcaaacggccagatagccccgtcccattcacatttaccgactccgcgtgtgcggaattccggatgacggcgttctgccgtagtcaatccataaggagcagaaaatcctttctcatccataatttctttccaggcaacttcatatttctttgttgtatccggtaaattgaaataccacggaatatatccgattgcctcgcgcacattggcggaagagtcagtacgcatcgtttcaaagaactgatggcgtgtattccataaatcgttttctacgagactctttaatgtatccgctctcataccatacctcatagccattccttcatcaccggaaaggattcccattatcgaaagggcttttgcattaccatacatatagctgttaatcgtcggacgggcatatttcttatttcggccgccactgatggattcctccatgccatcctgtacatcaccctgccaatacagtccgttcttcaaacggttggtacgttcccaacgctgatattccgtttccagatccttcgtcatatccagcatgaaatctttatcgccatccaccatatagcgtgccagtacagcatctgcattccatgaactgaacttatccatcttcttcatcggtcctccatcattgccacgataccatgtatggataatctgatccagatatttcggatcacgcagccaacgactttcataaatatgatgtccgatagcacaggcaatcaggttatacttatccgaataagaacgctgaaccagaaactcggtcataccatatccgacgggagtctccttgatatgcttacgcaatgaccaccaacgataataatacatttcttcaaaattacgctgcgggcattcaaacaaagggatattttcttccatccattccgaagccttggcattgggaatagcctgaacaatattttcatcttccatgccattgaaagattctgcataatgactaaagtctgcatatttcaaaaaagcggaagaagcgtccttatcggtggacgaagtcttcacattggctatacgatattctgccaatggttcctgtccgcctgcatcgggcaaatcataggtttggtcagcaggagtatccacagtcgggaatgtacgcatttctccggtacggaaaacaatccgttcaatcgttgctaccggagcatagaacatacgcagccctaccctcttaccatccacatacacttgaatattacgatcggcagtcgaaagaacagcttctacatgataagtctttcctgcttcatagttcatcatatttgcaaaacgtgaaccacctttcatacggaaaataccgtccggagtgagttccaatcgtgaacaggcaatgctgttctcatccaggaaatcaatctgaagtatacctttatcattctgtcctgccgacaaatcaaatgagactttcaattctttcgaagccggaatcttacgttctaccttcgcatagtcgaagggatctttatcttgtagcttcaaccattctccttctaaagaaacgggtgcccaaaccggagaataaatattccaattggtcaactcagctattgatcccgactttgaaaaatcatcatccgcgtgtgcagaagcattaatctgtaccggaacaggaatgcgggaaatccacatatcttctttattcacgctatatgaaacccataaatcaccatctgcaggcactccgtttccttcctgaatgccacggggatattgaggaccatatgatttgtaatttcctccatagcgcatcggagtaatttcaccatgtaccaagtttaatgtagtatactccaatccgtccttactcaacgaaatagccaacggccagcggaattccgacggattataaaccgtagcataggttccatcgctcagacgttgtccccagatttttgcattactgttgacaaatccttttgcacgaagcacaggttctgcccaggtatgtcccccatcttcactgatcgaagtcaaagcgtgtttccaaagactcgcaatgcgtccatcgggcaatgtatagcagttgaacgctttatatccttttttcagtggaatgatcggatcttcacggtcagcttcttctacccattgcatcatataaagcggattatccagtatttcctggcaagcctttacgaattcccggtctttgctctttttaaaatagggataatcggtattcttttcgttaaatccatgattgtaataaatgaaataaatcggtccgaacgaaccgtccttctttatctcacgtactacccgaccgataccgtttccgtcgttcggatcatctttcttatccaaagctactccgtaatttcccatcgtaatcaatctgcccgacttagatacataaaagcctacacgctggtgcatgatagcaatcaagtcttttgcctgcatacccggacgggattctttggtatatccgtccggcactttgtaaggaggaaacactatttccggatttgtccattgataaccgtctttcgaggtcatgaggaacgtttgggaaggtggtacatgttcatctgacggatctgccagatactgataataaaactgaccgttccagtaagccagcataggctgatggttgtaagtccatccattgccgttcgacgcttccggatgctcgcggttggcacgcaccagttgaatattatgcactcccactaccggagacaattgtccgtcgtgataggtgggattcgataattcttttcctgtgtaatggattctgtcctgcggagtctgcgcctgaatggtagtcgccatccatccggcagccaatacaagaagaatcttcgttgagttgttcatgatttatttcaggttttagtttattccggattcaacttatctagtttaagtttatttcttcttgctttcttccagcaatgttttaacatctgattctgaagctctaaagatggttccgtgtttatgcccgacaggcacactcacactttctgtgatatccgtgaagttcttaaaatcacgggtacgcatggcaccgtatattttctttttataaacatcaaaatagatcagataatcatcacctaatttctcgacagtcggtccctctacaaacgattcggtaaatggttgtgatgacggcgaataaggtcctgtcagagagtcagaaaaagcaattttcagattacgttcgggacgtgtattatctttgagcaccattacataatcattttttgcccgcttcacaatgacagcgtcaatcgagctgaaaccgggatcatataatactttcgccttggatactgtcttaaaatcctttgtagtgatgtagtataaacgatgattattctcttcttcttcgattcccttttcaaaacgacctggtacacatgaagcccatactaccataaactgttcgctctcgtcatcataaaaaatctccggagcccatacattgacagtggtcggttcgtctgccattacaggaatcatttgttgctccgaccagtgaatcaagtctttggaatttgcataaccaaagcctaaatcccctttccagctggtggtccataccaaatgataagtaccatccggcgtacgcaccatggaagggtcgcgcatcaggcgatgttgtcccaattccggcttcagccaaacaccgggaatactgtcccagtgcattccgtcttcactatacagatatctcaaaccttcatcagccggctcatgaaatgaagtgaacatataataatctttattccctccacaagaagctaaaagcaggatgcttattgcagctaatgtatttcttaactttcccatttctatgattcttttacactatactaatatcctttatacagagacgatgaaaagccggatttgtactcaaatagattggaagattcgtcagaatcaaaatttagagacgataaaaagggcgactctccgagccacccttttcctccatcaaacaaactaaccatttaataatgggaaagaattccacttctttttatagtatctcattggttaccaatcctttttttaccggattctatacttttacagcgttcctccccgtgctttcacacgtttggcccactcttcacgttctttcgtcaaattatatcccctcttggccagataattgttgatacgtcctttgtacttgccgaaagccgcatgtttcttatttgaattttccgcatccatggcaaactcacgcgcttccaccaaccaggcatagatttgtaccttttcttcttctttcaaagaaggaatcatatcaagcgtagcttcataagtcactttcaccacaccataagtcattccatctttcaccgcttctatctgttcttcattcaagaagagagacaagctggccggaaaggcaaaatgagaacggtacaaagccgcatctttttcgttttcagcagccttcaatgcttcatttttcgcatcaccggtcaaccccgattctttgactgccttcacctttgcatcccgtatttcataaatatcattcaattcgaaatagcgattggcaatcacattacaaacatcttcagccacttttgcatccgtcagtccgagtttatctacaatcttttgcgaacggttgacgatagactccacatatttcggatcacgattctctttgttcaaatcgactgctccagcagatatccaaccgcaaagaaacaacagagacattaaaactatctttttcatttcatcttattttttataccatatgccaaaaggaaacccagtcccggtatcttataccgataccggttgcagattacattaattttcctttctcagccaatgtatcgtagttattttttaaatctctccagtctactttgtgttttgtactgattccattgatatacttttcaatattcgtatatccatcacctgtacaatctttattagcatcacttggatcattcggattcaatccattagcaatttcccattcatccggcataccgtcaccatcagtatctacatacggagtccctttgtattcggggaaaccacccatctgacgaatatcagtaatgatacctatcttataagaatctttgggtaaacgacgatatttaaactgaccgtcctctcccattgacttaggagacaggcctgtaagatcaccattagcatccttcgcaagtttcttatcataataaggaatacctgtttttacttcttctatgatgcgttcgtccacgatatcacggcagggtatattggcaccgacatgttttgtcacataatcataagcatcattagctgatgtaattttgatataaggcattgcaaacggctcatagctccgcatattctcagtatatccggctgtatttggctgactctcgatttggataccaccattccagttatctttcgtgatttccggatagccttccataacgttaccatcagcatacacgcgaccgtataccttataattcagtttactgcgtccggcttccggtttcagaatacggcagcctaccgtattattctttggagtagcaggaccgggtttataatagttattgatcatattgaacatggcggtataatcgccaccatcagaagaacgatgcacccaattaaatactacattattaacgaagttgaatactccattccagcctacagacggattgcgaccagagttgctggcccaaaggttacgcataaatgcacagttctcacctcccagtgtgctaccgaatgcatgattataggtatccagagcttttgcagaaattgtattctgaatagtcacattgactgtcggaagtttcaagtccttgctttcatattggccttcactcggatcgtacatatgacgatagaaagaaatattttcgtccagtccccatgtacatgaacagtggtctatcatgatattaccaatcggattaccaccgaaagagtcgtcacgatgccatacttttgtttctccacgacggaatctcatatgacgtacaactacgtcgtgtgtatccacccaaaatgattctccggcaatgcagacaccatcacccggtgctgtctgtccggcaatagtaacgtaaggtgctcgaacaataatcggagattccagacgaatgataccagccacattgaatacaataatacgtgcaccacctgtctcacaagcttcgcggaatgaacccggaccacgatcattcagattagtaaccgtaattactttacctccacgaccaccaaaactatacattccacctccttcagcacccggaaacgagggaattctagcttgtggcaaatcatagggacgaccagcccatgagatataaggacgtccttcttttgcttctttcagtactataggtaacgctttctcccatgcttcatcagaacgtttccgttcctcggtcatcatctttgtataattcgctttggcttcgtcagttatctgcgggtattgtgcccatacaacggtcggagtcaacattgcagctgcaaaagctactaaaagtacatgtttcttcttcatttttattaggttttgtgagattgatcattctaaaatacaataataagacgcaaaacaaggaaatatgtaatcagaaaatataatatatttttctattctaactttaaatacaaaaggaccacttattccttaatattcttttcaaaagatcaaagtgataaatggtccttaggtttatttcagaatgaacattcttcagatcaagtaattattttgataaacgaattcactctgccaaaggatcaaaggtaccatcagctccacctctccaatagtcgccccatcctatattttgttctaatg

SEQ ID NO: 173 - DNA, 15538 bp, Bacteroides thetaiotaomicron
atattatatataataattttatctgttatagctccattgtttatagcttgttcagaggatttgaacttatgcgcacagcaaaatacagtggttgaaactgattattcatgtgatgatgtgattcttcaagaacgtaatccatctcttccagatgttattacaggaaaaccttcttttgatgaagagttgacaagaagtggtgagatgattgggggaactgataaatatctaggttatggttataaattgcttaaggggaattatataccaagtgattttgataactttacgcattccatacttgatattgaatctctaaaagaatatgatgaatcatatattgatgaaaattatcctaactggaacgaccagtcatcgtttgcttattatgattttaataattatacgcatttttcatcaataagtaaaactgtgaaaagtggattttctttaaatctaggatttttttctatagggaaaaagaaaacgacaaccgaaacatttagaacttttattaatgaatcaaaagaacaagcttatggggaaatgaatatattgtttgctcatggcaaatttaccttgttaagttccaatggttctaataaagtgtttgcaaggcagtttttaagaaggtcttttattaataatttatatacctctcctatatcatctatcattgattcatatggagattttgttgttgttggttattatacaggtggaagagcttttgcgcaatatatgggtaatgcggattcaaatacgaatgttgaacagaaaactaaatccttagagaaaaatattaatgcttcacttgtatataaaggtgattcacttaatgggtcgttcggatttaatggaaaggatggtacttttgattctacagtttacaaaagacaagatatatttatacgtgtaaaaacattgggtggtattcaagatgaaacaggtgtagtgaatactacaatggcacttaaagacataaatataaacttgcaatcttggagaaaatcattaaatgattcaaaaaatcatacagtgattgatttaatagaagaaggattatatccaatgtcggattttgtactggaaagaaactttcaaagacgttttgatgatacttctaaggaaattcttcttcctgttacaagactttatactccgtctattacgattgcaagagtattgacaaagacatctgcttcgggagaaagtttatatgatgtagctgctgtgttaacaacaagacagggtgaccaaatagtattgagtaaaagtaatgctacggatgcggaattaaggcaaaatgaagatgataatgtttttatcaaaaaagcccaaattatatcggcagaaatatcaaggtatttcagctctgatattcagataagttataatactagaaagcgtattaatcctcaaatgcgttctccgctatgtatggttttggagaacttcaatgaaaaaggtttctgtaagtactatcatgaggcaactaatatggaatatttatacgacccaactaccaaactctgtttttcattttttgcagatgaaagagatgagagtttgctggaagtatatggtcttagttcatgggcttctaatttagtagaaaaacagatttcaatagcaacattagcaaatctatacacaattataggattgtaattttgaagtctggtatttatattaatataatctattttaatacatggtacattattttaaacaatcttgcttattaatgctttgggcattatttttagtaaacataagttttacaagttgtgatgataaaaatccagaggtacaaataggagaacttactccccaaaaactatatcaaacctcatggcgtggtacaggtcgttgtgatgcttgggtagttcccaatatgggagtaggtatgcaatttatagatactcaatcggggaaagtaaattgggaaagttacgatgaaattgatattacttacaaaatagaaggaaaatatatcatatttaatagcaatgctttatatttaggtggtgctccttgggttattaaaagctatacccaaaaacatataactcttatacaaaatgaagcaagtccagataaagagaaagtagctataatagaattagataggatagattgatttcgattgtatttttaaaaggtatgtatttggatgctctcttttcatattataagtatttgttattatactggtatcatttttatgaaatggacatagggaaaagaagattctcgtgttgctctttctgggtttcggggagtgaaggatattaatcacatattcatattatttatatataatatggcattttgtccttcttctttttccctatagttttatggtatcaattttttgtgttcggcttctggcagctttttgtatttggtatcaaaaaggagttcttcagggtgtaccagggacgataattcggtatcattttatcatgctatatacgcccatcagcgccagaacttgaaaagggctggtatcaattctttaaagtaatattggaaaataaaagagagtataaaatactctcttttattttattagggctgtaataaattgatggctttttgaagattagtttctagttcttttttagcgtttgacatagcatcttcatagtttttttctgattgtctaataatttctattataacagaattatagttggctttttgtgcttcatcttcttctgtattagaaatcagatagaacttttcactaaatattaaatctataaaaacatagttagaataaaaattcagcacttgaaataaaagttttaggctgcccccttttcctagttcaagatttgaaatcgcattttgtttacagtttagctgttctgctaattgagcttgggaatatcctatatgctctcggatttgctttaaccttgtgcctaaaattggtaatgttatgttatacatattgttctattactgtttctacttcgtcgtatattcttttaaagtttttttgcagtaatttctctctattatctgctgtcccaaagttatatacttttggcagttctttgtaggcttcttcttctttcttaattttttttaaatctaaattggttttgcaatggtacattgctgttggaaaattatcttcttgtccgaaatctaatgcaacttgccctactaatgtaccagcctgtaatgaagaaattttggatgccgggataacaaaatccatttgttcattcatattaattgttgtttcgtttcttctgatggtaacaccttcttttacttgcttaacttttccaaatagtttttgtagccaatctaaagtttcaggagctttagcttgcccggataaagtgttacctataatagaagttatagtttttgcggtagctttgccgtattgttcttctaattgcggtagttcctgtaatcccaaacaaattgaaaccttattgctacgtgcagtagaaagtagtgttgcaagttgataaaaatataatgtgggacattcatctactatgattgaagtaggatagttaccttttgtattgacaagtctagttaatcggttaatgataagtgcatttaaagcactattcatgctttgtgttttaggattatttgcaatgatgagataactagggtcttttttatctgatacttttaaattgaaatcattgccactaaatacccaaaaagattctttagttgccagtcttgataactgtacttttagacttgccatctgtccttctaattggtccactgctcctgatttatatgcagcttcaaatggggaaactagtgattttaattcaggttcggaaaaaaggactttaaataatacatcatattcttgattaagaaaagccagtacatgcggtaaatctgaatatttgccattctcatatctagaccaaaaataaatagaagctgctaacaagtttactgctgatgttttaaaaaaatcgctattacctccacttcccttatcacccttttgtaaactctcatataatgcttctgccgtttctgttgcatctgctaggatttctatatattctcgtttcaatggatttattcttctactatattcaatatcagaaaaattaatgacattgaacttgaaattacttggtattttccctaattgcttgttcttctgataattataatatgcaatcttagcaagttcaggaaatttgaagtcgtaaacaacttctgcaaatcctttagctgaatgttgtcttataaaagaatttataacagaaaaagatttaccacttccgggcgttcctattacaaaagttccacgaaaacagttacatatattcagccatccattatgccactttctattgtagaaaaacttcatcggaatattgacagagtattctgtttctaccttgtctttagattgttcaaagctttcattctctatattaaatctatctttcataaagtttgatttaatacgtttggaaatgttatccagagctgaatttattaatgtagctccaattatcgatagtataatgtaagctatattataccattctaaactagtttctcctttttctttaaagagaagaaagcatatacttccaaagaacattatgaaaccaaagattaaaggaaaaatgatttgtttagtcgggtctaattctaaatccttttttgaacgtgttccaatgcaagtaaccattataataaagaatgtaaatagtttgctataaagaatattagaatagataggaatttttgccatttttgataataagggcataatttgttcactaaagggaaaatgaacaaatagtagaatctctatgcaaacagttatataaatgaatgcttgcatgaatccatatagtttttgtaattctttgctttcttccatgatttaatcgggtattttaacaagatttggttcctcacattgaaaagccttgaaatcttctatagctaatttcaagtcttctaaaaaattgctattgcaacctttttctactgctatctggtaatatgcttccatcgcttggacggaacaaatatctgttccgcatattacaaaagctggaatgtcttctaataggcacttgtgtaataatcttttttggtctttcatctttaattcaaatgaaaataccactcttttatgtagtgagagtggtattggtttttattttttggtatcataataatgttcttttttcgtccatgtccgggagagccgggaaaagtacggtatcaaattccttcccggcttctctccagtactggcagaaaaggtatcaattctactactggtaattttcctgtccgaatatatgttgaaccattgcataattttcaccactgttagacttatgcagcttatcatcaataaaaatttttacttctactgtcttaggtagctgtaaattttcaaggttttcttcatctttaggtacagggtaggcagatagccataaatatgttccttgtttggcttcttgctcaaatgtaaatggactttctacaataatttctttggcagcttcttcgggagcttcggaagaaatatctactcctactgtataatgtattagaagcttgaagttttctgggtcgcttacggtagcttcataacgcacttttcctatatctcctgtaggtggagtatcagggtcgttgttatcgtctttactgcatccagacaacataaggcttaaaccaatcattgctaatgataaatactttttcatattgtttcttttaaatagttgataattcaatgtgtatcgttccatttgcagcattatatgctacttcctcaatattggtgaaccgtcttattgattctttccattcttctgtttgtggattgtggtaatattgttcttctaatagacttatcaaattatcaacttgtttgttagatagataaatcttttctccaacccttggaactacaggtaattggattggtatagaaatattgttcacaccatctataggaatatggatgtttatttctatcatagccatttcatgtttagtatatttttggaaggcttaaatttaacaacttccttttctggaacttctacaggttctccagttgccggatttctagctatccgagctggctgaataatcttcttgaaagtaccaaaatcttttatagaaacatctttttctcttagattttgagataattctttaaaaaaactatcaattatttctgctacttcttttgttggtttatttgccttttcagcaaccattttgattaaatcagtcttattcatttgcatatcaataatatttaattacttaaatcacttaaacaaatttcaggaataatttgggtatagtcttctgtatctggtctataatgtattgattcaacaatattgacctcacagataacatcatatacccatgctttaaaatttccttccaaatcactctcattatcattgaatttattaaaatcatttttggcttcatttgttagatattctaataaattttgataggtaaattcattctgaaacattataatgtgaggtgaaatttcttcgcctatccttggaagatgcggaaaattccaatcaccctttacgctcattcctctctctttaaaaaaatggctataaattataaattttattttcatattagttttattttaaaatcatcgttcagtacaagctttctttccatcggttgcccgtttttatcacgaaatccagttaacacaggtgtttcttttttctcgcaaagttctattgcttcttcgggagttatagaacgtcctgacatttcacgccaaatgacaaaatcacattttatgttttcatttctatagttggaacaattataggcttttttgtttatatataagtttcctccacacttaggacacttacacaatgtattatcaaaagaaatatctaagttctctgttagaaccagccgtgaagaaaaatcatttccttctcttgatttaaatccagtcataaacggtgtttttttacctttggcaagtatttctgctgcttccaatggtatttctctttgtgcaatagttttgggtatatagaggttacaaactctgttgttgtccttgtccttttgcgaataccctttacaagcatatccatttagtaaaatttcaatttctctaccacacacaggacacggagtttctaatacttcatttacgaaagaaggaataacgattccattttcgatagtcagatatgcagaaaaaggaactccttttttattatggaagtcatgaaatatatctgttttccctgttgttattaattgcctggctatttcttctgtaatctcttttccccaatatgaatgataaatattaaatgtacatttgtcattcatgtttttgaagtaattacaggaatatcctaaactacctttcattatgtgtcctttctggcaaatagggcataagcctaaatctttgattgtatcattatccatttaatatcctcctttactaatccatttaatgccgtttaaaatattatctactttttgtttcccactatttacatatttaaattgtccgggtacaagtgtttttagtactccagctcttttagcggatttcatttgtcggcatacagcgtatgcaagtcctcgcatccgtctaagttcattgaccacatgaatacataaatctatcctttgcttattatccataagatttttttcaccgccttgcaatgctatattgtttatgtatatcattaaatctacacttcgactgataagttcatactctgtttttgcaattatggttaataatttggggtctccaactgcatatttagctgcttcggattgatacttagctatgtctctagctaaggttgaagcataaataatatcctttccatttttcacaactgcattaactgtagaaagatagttgtatgtcttttcctgtaaggattgaatttgactcattttttgttgaattaaaatttgaaagttacggatttttgtttcctcactttgtatatctttcagtacaccttgttgcgcctgatgggaataaaccaatgttccaatcattgccgggtcaatgacaatagattgtgctagtccttttatgttgcccaacagtaacattagggaaaaaaataaaagcactcttttcatatcattatctgtttgtaaattcatatattccttttttctttttttgttcttctactctatttctgatagtttgaattatgtcactattagctttaagaccattcatcagtagttctggtgttgatttatcgccagaataaatgtagatattggtgttgtttattaaagactggataaaactttgcttttcttcataatcatatacccgatataattctatgtagttaatcctttttgaaagtactccttgatatatttttatttgctctctagttataatccattttgtacaaagtaacattgaaatatatctgtagaaaattataaatatcaacaatactaatatcgttccactgataaattttaataattcatgttctcttatatatttactaaaaatgaacacgaaaatcgctaatgtgattaaaaggaaattcttcattaaccaatatcggaatttaggctttaatataatatcatcagaagctatgtttgttccatcattcataacttaatactttttttttgttcatgttgtttcattagaatttcattgaaatcttttgctttttctgctttatgagaaatcataggagctattattttgcttttttccctaaaactttctagtgaaacgtcatttttgttaatagtgaattctctacccttagttttaaacagcacatcatctttattttcttttattgtcacttctgtattactaatgattccagacactttaatgtcatacaaattaccgtttaaatcattatcaaaacaggtatgtactttagcttgtgggtatcgcaataaagtgttttttatttgattaactgaaatgtaccctcctacactacaaaaaacactttcttctaatttgattttgttagcattgagctgatagaagctcatagcatctaaagcggattctgcaaagtatatatgttttgccatttgggggtgtgggcaaaaatcagcaatccaaagcgagttacttttatctcctccggcagccattcctttgaatccatagtttcttaattcgtaatttgttactttgttgtctttatctgttggattaatatagggaaaacctatattataataattgccgtttccttgtaagtctttaacccttgtgataaatgggagaaacttctctacgacttgatgatttatatttctttcatttgtgagaaatcttaaatcagcgagtgtagtaggaaattctttatacctatctctgtcaaaagatttgttttctgtttttacaactttgaatgcttcatatttaggactataaggctcatttgcgtaatgtcctaaaatcatattaattcgcacaaatgtattttgatgttggaattgtgggaagtcgttaatatgatttttgatgaactgaattaaatctccacctttataattcctatcatagtagtgttcttgtacactatgaggattcttgatgatgatttcatccaacttgttacctgctccgtctgttagtttaaaaacaggcgaaacctttcctttgctaatgtcttgtttatatcctaaatcttcaagtatttgaatgatggatattttagccttataatcgtcaaatgttagcataatattatagtttcattgttggagtatcattattttttccgtaggttctaccatatccgagaatagatgcttcttgcttcgctgttgctttaatagaactatctattttatctatctgggtagatatttgttctccgacagtttgtttagtagcttccctagagctggaatatgttttttctacttccttgtaagaagcataatccttagaaagtttatgtttctctaaaaaggcagccatttcggtgggtttatctttaaaaatttcatcaatccctttagctcctttttgggctacaaactctaatctttctttatcagatatatgtctttctttccctattgtttgttctttattttcagtcgctttaatttctatagtatttgcatctttgattgataatccatttctggcattcaaatctagttttacttttgcagctttgtttagttcctcgtttacaatggtaatttcttttccatttttgagattttcttgctgcataggagttagctctactcctccaagtttttggggaatatgaatgtcttttgcttttattgatacaatctcattagtatctttgtcacgttggtgcaatgttctttctccttttgaattagtctttactacgacattatcagcttttagggcttttatttcatccttagtaaaggataaatcattttttatttcttgtcgtttaggaatgagtaagatagcaatcccagcgattgggtaaactacagtaatagctgcgattgctagttttctagcattgataccatcaattttgatgcgtttaccttcttctttgaaatcaatttcgttggcttttaatttagatttattttcaggtgtattctcggctgttatatatttaagagttgttgctttcccttcaaaatggagtttcccattttctgttttataagacactttttcattgtctagaagtgttctattatcaggagtatcttcaatggaaaaatttagcataccagtttttttcccatttctgatatttgcaatatcttcggggcttaaattttccggtttaactcctacttcattaaacttgttccaatctatatcaacatatgaacctttaccatctagggtttggttttgttcataagcatatcgataaaggtcttctcctttatatgcaattttattttcaaggtcaatgactgtaaatccgtctttatatccttcattcttattagcaccttgttttatatcatcccattttataattgcaacattgtggttttctcgtaaatattggctatattcttggaaattattgctagcttgttctttatcaaagaaactgattattctttctttagattgctctaacaaggattctctattatctcctaaattgccaagtttaagtgtattcagtggataagtatatgtttcattacctttggaaaagataatatcaccatttcgatattcttctgaatatccaagaactgctgctatggctcggaattgtccggcattttcataactatattgcagggcttcaaaacttttcttttcttccattttataatttgaatttatgttctactttagattgagattcatttccaagtgacggcttttgtcctttcatgtattctatatattcatttctgtttttatcagtatgaatagttcctataatttgtgggttatgccggtcataagctattttctgttgctgctcgaagtctaggaattttattcctcttggattatttaaatctaatcttatggcaattttttctttgtcaacgtttaaaatcaattccttacctgattttagagtttccttttgttgcttatccagctcaacaccttttatgtttgaaggtattgaaatgcttttgatttttgttttaagcaattcgtttgtttcagggtctaattgtacaagatatttttcattgttaatagtttttgttattatttcgttatcttgaagtcgttctaactcctttggcttaagatttatatcattcattatttctggtctgactggatgaattttaacgccagcattgttactgtctttccagtacaaacttatttttcctttcatacttatttcttctccattgttatcgtgaaaagaaaggtctagtaaactggttctctttccagataatagagctgtgatatttgccttatccaaagaccatatctgcttttttgatattcctattagttctaattctttatatggaatatcattttcattaaaaatagcttgatttttatccatgtaatgtatatttttgctcaaaagtaataaaaatatcaatatgaagaataaaattatcatgttttttgcttattcattgtttttttcagtgaatggctactgtcagtttaatacggtattacagaaaaaggatattcctaaagcagaaccagtattagcaacgacagaaaataaattgatagaagaaaaagaaaaggctgttgtcgtcaatgatgctttgactacagaacggcttgcatactggaagcaaagaaggtatttatctttgcccattgattcaatggtgataacttcccattatggtaaaagaaaagacccatttactggaaaaatagcaaatcatagagggatagaccttaaaggtaacaacgactatgtttattcgataatgccgggaatggttgtaaaaacaggaaaaaataaagggttgggcaattatgtagaagtgcgtcatggtgattttacttctatctatgggcatttatacagtgtgcttgtaaatgcgaaacaagctgttgaagctgggcaaccaataggcattagtggaagtaccgggcgcagcacaggagaacacttacattttcaaatggaatacaaagataagactatagaccccaagccaattcttgattatattaatgaggtaatcagaaccgttaaaggacaaatttcacagcaaatagataatgagttaagacgcaaataaataaatagaaagggaggattggaaaaaccagtcctctctttttatttgaatcagaaaaaacctttttttaatcctttttcttgtctttgaactttttctaatgaagattgaagttgtgacagagcttctttcattcctttttttacttcaggattcgtgacggattcaataagttcttttcctgtttgaatgttagtcttaagtatttctttattcttcatctgttttgcacgactttcatctataaaaatagatggcatacttttacaactccattcaccatttactaggttaaaatctttaattctttctttcgctaagtaggtgtggatagaaatcttatctacagccttgtcactgtataattggtttgcggatttcattagtccatttatggctttgttatgtgaatcaatgtcggctaatcttccttgtcctttacttagtacttcttcttgatacctattgtaaagtcccagttgggtaaactccttgggagctgcaataatatatgcttcaacagtgaaccctgcatctttaaatttttgtgctgtctttaaaggtacatctggatttctcatagttccttctataataatattgcatttccgtttaatggcttcttctattagtttttctgtaaaaacgctagaaaaaatctgggtttcaatggggtatttaatagggtcttttattagttccttattggggtgaaactgtctgtaaaggtcaccattaacagtgagaaaatctaagttaggatggtctttctttgcaacatttataagagtgctttttccgcaagctggttgtccacctaagattatagcaataggcttttgtgatgatatattgatgtcctcaaataagccatcttttttttgttcaaagatggcttctacttcatagcgttgcataatatgctttcaatttaggtgcgtaatagttttgtatcttatccatgactgataagcgcacattttcagaaacttcaaactgcaacaatccatttgctattttttcttctgtgttgagaacagaaagttctttttgcagtattttttttctgttttcatccttctcttctgatatttcatctatcttcatcatgcggagtgtcccgataatgtcgagcgcaacatccaaactcatttctttattcatggttcattatagttttatgatttatacctcaatagattctgtgaattttaataatggaataactttcactgtatgaaatgaaagttggttaaaaagcttatgggtctttagcatttcaatcgctgcatcagccgtaacaacaccttgttcataaagccggattgttgcatataactggtcattggcaacggggcccattattaaatcatagctgttttttccttttcctctgcggttattaactacaaactccagccactcttttgtagccccatcaaatcgaaggactgaaaactctctatcaagaatattatcggggacttcataaactgaaacgacagcttttttaccatgttcccgattccttttgagtattgcccacttcttagcctgttcaaaattagttgtcgtatagaatccttttccaaagtcagtagctttacgccctttctgtatattaggggatttgacggtaactgttgagccgtgatatagtttcatgcctttttattgatataagttattatagtatctaatatatactctgtatcttgtgtgtgcagcatttcaaaattttcatatagaaattcaaaaacgccatgattggaaaacagcaaaagagtttctttagcacttatatttttagtttccctgtaattttcagcacaaaacatttgaaaaagcaatatctttggattgtccttttgtactttcttctgttctgttttctctttttctaatgcttcataaagtgataatgtgcttgaataccacagttttgtattctcgtccaataatgccttgtacaaattggaggaatatatatagtataacgcatcttctaaaggtagcgtttttcttttcatgactgtatcaaccaattctctcataacaaatgggagcatagccgaaccaagttcattttgatatgtttgattagtttccataactatttattttctaattttatatagctatcttgctgatgtatttagcaaagatagagaaaaaacaatcatcatagacctattgtattgattagtttgtaaataggttctttgtatttctttagatttttaatttgtataacatacttattgattcctagctcattaaagatttctgcgtacatttttattatggattttctgtagtagatggttaatcctactattgcaatgcaaataaaaatcaaatagactagttcactatacgcatagattgctaatacaaaaactccacccatagcccataaaaagctacttaaaagaaattttaagatattcataattttgtttgctgttctttatactggcagccagaccagctttaaaggtttgtttatctctttattttcaatactcaaagatagcaaatttctataaatgtcgcaaataataagacaattatttttgttaaaaatggttttaggcttatcgcttgccgaagttttatttttccctaaagtattggtatcataacagtgttcttttttcgtccatgtccgggagaaccgggaaaagtacggtatcaaattcctttccggcttttctccagtgcaggcagaaaaggtatcaat

SEQ ID NO: 174 - DNA, 15496 bp, Bacteroides thetaiotaomicron
agagaagacggatcattatttttgaagaaaaaatcatgatccaacgaattgtcctgatcaccatgaatcgtttctacaaaagaaggtaagtccgaacagattatatttttttcaaaataaatagataacaacagaacgccactttgtgatatttctctataaggaaggactaaaacgtcactattatttatctcttcataaagttcatcattagacaaaaagtaagatttccaatgaataagggagttagaatctttacctttaagttcctgtaaatagctttcaccgacaccaccaactattctagtttcaatcttttcactatattcagcaggcaataagttaactgcatcaactaaaatatcagttcctttataataggtttgcaaaccaaactgtaatataacatatttatttttttgcaaaaattctttcttggagatcctaatcttaggaataaaaactccatgatgaacaatactgataatatcaggaacaaaatcaaattctttgattacttccattttagatgactccgtatgaacaatgatgttatctatattcctgcaagtatcacgaaacctcttcttatatttttgttttccgctatcgctcatacttttcacaccatgaggataaatattgtgtatcgttaaaataaccttcgtttgaggtgatagtacatgtagcaaataaagaatatatttttctataccaactacttcaacaaaaggtaaccattggaaatgaatagtatcaattttcttaaaagcaacatgtaaaagcaagtaaatgtaattaatccctccctccaatgcctttattaatctctttacaataaattcagtttgactgaatttattagggattagtctaattaaaccatgaccaggaatcaaaagttgtattgatgatttttcattcgacaattctttttctaatgcttggtataaagccttgtcataattatcgacctttcccgacaaatcaactaacaaatatttcatatttatttaaaccataggcgatcgcctaacttatatttcatattatcttttcgccgtccaataatcttagaaggtaccccgctataaccaaaggaggaacatctcttgttacaaccatgccacatgcaacaactgcgcctcttcctattgttacacttggcaaaattgttattcttgaagcaatccatacataatcttcgatagtaacgttactcgcgacaggagtttaatcagaactattataatcatttcacgccggtcaaacccaagaatatttactatatcaacattatcactgattgtaaaatcgctcgtccatcaagtacacgttatttgtaaatattgcaatttctatcaattgtaatacgttgcagacttcaaatgtctacattcctgaatataaaacttagcatgtcggatttcttcataaaacatttgcaacatagtcgtttcagcatatgacacggtgtccatatttttatttcaataaagaaatgtattaagctactaataaaatctctcatttatcgattacttttgcatctgtctatttataaattcaattattttttttgctctaaattcaatccgtaatgatttagccttttctttagatccttctgctaacttttgtcttaaatcagaattatccattaattgtttaatagcagaagcgatatcatcgacactttctgggtttactagtaaagcattagaactatctaatatatcatcattaaatggtaagtttgaagatataataggaagtccacatgcaatggcctctactatagcattagagcagccttcattcaaagtaggtaaacaaaacacatcagcagcactgagataagaagggatatcatcatgttctaatgctccaatatgaactattccattacaatgaggtgtcgcatcgtctcctggtactggctttcctataaaaataacttttatccttttatcaccaatcttatcaattgcagcagcaagtctagaagcccccttacgatggataaaaccaccggtaaaaacaattaaaaaatcatcatcaaaaactccaagtgaattcctattaagaggatttatatcagaaaaaagagaagaatttacagagttaggaagaacaacaatatcctcagcttttgacaacccatattctatacacttccttttattaagacttgatacacttatgacgcctgttaccgcattggaaagccttttcttttctgcaaaagataacgaattgacaagatcctccaatgctgtatctccttcaccacaagcaacaaacaatggtgtaccattcttatagcaatactttctaatatcaaaagcattttgccaaaaatggccataaatagcatcgggctttaaattatgttttgtgattactctcaagatgactttatatcttaaccattctaatatgttttgtatccatcttggagcatttccaagggttaaatatttcggacgataaatatgataacttcgattaccaattttcttttcagaatccactgctagcagagggtctccttttagtaaatggcgtgttatactttgaggagcgataacagatatatcaaccccttgattaaccatttcatttaccaactgctcaacaaaaacatattttggatgagatggagcaggataatcagttgatacaatacaaatattcattactatacaaataaattatacttcattccatgcaggaacatttcttttaacaatttctgctggtgtcccagcaataacaacatttgactcagtgaacgagcgatttacagttgcattagctcctatacttacattgtcagcaatagttatatcaccaaacaatattgcccctgggccaatatacacattattcccaattatgggagcaccgtttttgcctctacttgcccctatgttgacgcatgaatgaattctacagttacgtccaatcttagctttacttgaaataataatagaaccataatgagcgatggacaatcctggaccacaaacattaataggtatagaaaaacctagatgcaattgaatttttcttaattttaatcgatgataaaaaagaaatgccctccccataattcctctattagaacaattggacagatattcaacaattcgtaattctcttaagaattccgaaatataatcaggtgctaagaaactaagaattctttctcgtaatgacacttttgcacttttattacaggccaatctatcactttcatgataataacgcagatcagtaatattttttatcataaaacactatttcttaatattattaataccattacgagttgaaataatagccccccataataaccataccaataggtttccatctgctaaagaactattatgagtcattgtattaatactatatgccaagtaggccccagcaaatactagagatagaatattattcgcagataacttttggattagtatttttaatacaattatcatttgttctacaaacaaagtgataaggaacaaaccaccgaatataccaccataaatgaaagcgttgagaaaaaaattatgaggcattttaatgtgagtgttagtataataaaaaataccgcctactggagttgattgaataaaatcccaggcttcagaccaaatatgacttcgagcatcctctttgatactgaaactcgattcactatatctaaatccatcatccaaaatactgtcataaaataatgggctaccaaatacaattattaatattgtagctataaaaaaaaatatccatttgactttgtttttctcttcagaactaccgactaacttaacaatcattaatatcgaaacaaagcctgcagcaaacaaagcagttcgttcttgtacaacgaacactgaaacaaggaaaaacattaacaatattatattccagaactttaaacgagcgctcttattataaaatattaaagcacacgaaactgcaagtacatatccatttaatacggagccaacaatgcccggaaccgcaagccctgctagagtatccatctcacggagttcagctctctctaaaagttcatcagcagctgtaatatttaaagtatcaagtatgatatatgaaagtggccgctgccacatttgaattaaagtaacgacagcatcaacgaaaaaaatagaaagcaaagataacaaaacaaaccttgcccccctatattttgaaattatcattcgagttgactgatatcctacaaatgcaaccaagtaataacttaataaatttctaagagctatatcaaaacctcctgtagagaaacaagcgacaagataaaagaacacaaatccaaaatacagttttgcatatttatcaaaaaaaagataaccctcctttatgcaaacgactatcataacaacagacattatttgtctgggggtaacagggccaatatataaagacccataaagaattgatgatattaaaaatatcaagtataataagtaataaaataatattttcatatattctagcaatctcctgtttattaacaaacagttatatagtgatcttgaatcaacaacttattttttaaggtgagtaagcgacaatatagcgagcccaggtcctttcttaagaattaaagccagaagaaaataaaagaatgacgcaaaagttattgctataaacatttctaacacccaccaaaaaccatcaaaatctggtatatacataaaaacaccaactgtaataaatgaaacaaagagagaaattccaaaagaatagaagatttgtctcaactcaacatgggtaagtttcttaatagtgtaaaacaaataaggaaatacacatatcacagcaagaagaatagaaatgccagcaccaataagaccataccaataagtgagaggataaagaagccctatcatcactaacattttgattgtataaaatctgaattcctgttttgtaaagccataagctctcaataatggattaaatgaaaacaacaaagtttgaaaaacatatgatacaaatattattttaaacggttcaaccatttccacccaagtactgcccaatacaagaagaacaataggctttgcataaagcacaaccacaatacacatcatggaaagaagatacatgacaatattctgaatttgactaaggacatggtcgaccctagatttatcgtctgttatctgagcataaagtggaaaggcgacattatcaatcacacctgtaacgaaagttcttggataacctgcaattgtttgagcacgattatacaatccaagagatgctgtacccaaaacgttaccgactatagcaacatcaatattagtagcaaaccatgacgtgatatttttcaactgcaaccaccccccaaatctatatagctcataaaatttatctttgtcaataacaaacttaactttatatggataaacaaagaatgaatatattagcctaaacaaatattctgatagtagtgcaataattaatccccaataagacttcatgtagtacacgctaactacaacgagaacaaaactaagaatttttggaaaaactttaagatagaagtatttctttaatttgatctccttctgaaaatatgctattgcaggattttgtcctgctgagaatataacacttaacattataaccatagatggaagcactccttcctcattatggtaataataagtgcatattggaaatatcaaaaattccaaaactattgttgctactattgatgctaataaattcgcagaccaagccgtatccaaatagtctttaatatctcctttcttctgaactaaagctgggcctaatcccatagaaaacgcaattgttccaaggccagtaaaaaacacagcaatagcatagacaccaaaatcagttgaagacaatattctactagttattgccaattgtacaatacctaatactgtaaatataacattttcggcagctgtccacattgttccagataaaaaaacgctttttaagcttttccccattttactttgatataagatatgattttacattatagaggaatgatattattctcctttttgcattaatataacaagtagggatttgcaccagcaaactctttgctgcacaatctaatccctcccgtaaaagtatacgcttaaaagattctctacctgtcttctgagctacaggatgatgaaatgcataattatatttagttatatatttttcaggaatgaactcaacattgcattgccttcttgcaagatcaatcaaatattcacctttctccgactgaacactcgcttgtgataccccccaaggactatattggagcatatttttttctacagcatgaaaatcaccaagtgttaaatcagatacgagtccgaattcttgatcaccaagtttatatctacaagaagaacatgaaggtcgcttcagatactgaaaagcaatctcataactacttcctttaaaaagttcttgatgatgtttcccattttcaaaatcggcataaatataatatggtttccaaccactctctttatatcttacggagaaatactttatctgagaattattattttcttttaatttacttgcaaaaagattttgcaccttaggagtcgtaggtccatgacacaccaaagatatagaatataaattatctgtgttacgcccccaataattatacagagctgaaacttcacatggcagaccgataaataatatttttttcctttttatatttcttatcgtttgatagataccacccttctcagcttgaatatacttagaagtcctaaactgttctaattcctcaatagtttctgctattgcatattccgattttgaaaaatcagaagaataacgtacaccaacaacaacacccttttccaaaataaattgcttactgatggccgttgcatagcctccagaagaactatatctcgttccatcaatatctcgcgtttgcccgccaaacgaagctttcaatacaatatcatttcgattagaggacttcattgggcagatttttatacatttattacaatgtacacacccctcatctgtctctatatatggatacagaaagccttcgtcatctggttgcattctaattaaattcttcgggcagacacaagaacataattcacagccacagcattgattcttactttgatataaaccggatgtcaacatattaaaaagttaatgctgctttcaagaatttcattgatctctcgcgctctgattgaaccttttgggtaacaagtgtataatcgattggctgttcctgataactatcccattccctatgcttatctgtaattaatctatatttaatctcccaaagagaaaggatatcatcgattctagaatgacgctgtaactttactccagtattcttcctataaaacacatatatctgcttttcattcattatagaaaatgctgtaccatggaaagaatctgtaaacacacattctgccccccttatccaattaacgaaactgtctggagactcacctgtcattagaaaatctgcgtattcctggtctatttctgaataactttcgttactaactactgatacaagtttgaggcccttcaaattagcatatctacgagcacatttctttgactcttcatcatttcctaagaaatagcagaaaatatacttatcttcaaatttcttttcaactggaaaaatctttttccaatcttcgcaagatattagataggtaggatcaacaacaacctcagcgtgaatattattatcacatacttttgaaataatatctgctcctgttttttctcgtacagaaagatagtctatcctgctccaagctttacgagatgttctccaatagctctttggatattctgaaacaccaagactagttgcataagatattgttcgaacgctcttgggcacaaaacggaatgaagaatcaactccaaatgagaatccaggatgccatttctggtcactaccaataagaacagcatcatattcagaacctagtttacagagatttgaaaaacctgaaacttcctttatattatgtaatcttcgatgtatgaattctacataagaagtttttcttttcgcaatgttattttgaaaagttgcatcattaaattttgtgcgtgctgcctttttcttcttttcttgataagcatcaatcaaaaaacgaaacaagcccaaatcaagcggataatgtttgttaaaacgatctgcagtataatcgattatctctgtttcacaccctaaagactcaacaatatattgagttgcaaatgcctgaagcatagtgccataatttggatttttataagctattaataatccaactcttttcattgtttaaaatttgactattattaatttgctccgtcaggcagaatcgaactgcaagcttgtgctccacctgtgctgacgaataaccttatattttaaatgtgataaactccctcaagtggacaaatattgaagcaatccaatatcaccttacccttgagcctatcccagttgtgcttgatgtgatcgtgcttaaccatcaatactaccatatcaacatccttcaggaactcatcgaaatcagagaactgattctctgcaatcttgtggttctcgagaaaaggatcgtagcacttcaatggacgagctaagtggcgctgctgaatatcgagtaattgaagggctggagactcacggaagtcatcaacattctccttataggtcaacccataaaggcctactttacggttatcggtgatattgttctccttcatgatctcataaatgcgctcaagaacgaatgttggctggctatcgttagtcttcatcgactcatcgattaccttagcgagctgtggatagtctccaacgaggaaccatgggtcgacagaaatacaatgcccacctacaccaggtcctggctgaagaatatttacacgtgggtgcatgttgcagatgcggataatctcgtatacgttcatattgtcgtgacgacagatacgtgcaagctcgttagcgaaagcgatgttaactgcacgaaaggtgttttcaaccaccttggtcatctccgcagtacgaatatcggttactacaatatcaccctgacagaagcttgcatagtactcttttaccttctcaccaatctcacgcgagtcagcaccaatagtgcggttgttgtgaagaagctcataaatcatgttgcctgggataatacgctcaggagcgtgcacaaggtttatgtcctcaccaatcttgaagccgttctcctcgatgacaggacgtacgaacttgtcgatggttcctggactgacagttgactcgataactacggttgctcccttaggacaaaccttcatcacttccttgacagctgctactacatagcatgcgtcaaccttctttgaaaacttgtcgtatggtgtaggaacggacacgacatatatgtctgtcttctggtactctgtagtgaacttgatgccagctttgagggcattatgaaagagttcgtcgataccatcctctttgaaggtggtgtgacctgcattgagggtattaacgagctgctcgttgtagtcagtaccgatgacctcaactccgtgagaggccatcataagggcggtcggaagaccgatgtaacccaatccaattacattaatcatgagtttgatttttaatgagttattttttgttgttattttctgttgttgggatgaaattgacatcgtaacgttctgtctctttgtcagcaaggatgtctgcaatgcgacagcaagcctgtccatcaccgtaagggttaactgctttgctcatagcatcatatgctgctgcatcgtcaaggaggacgcttacctcattcataatcttatcataatctgttcccacaagatgaacagtaccagatgcaagtgcttcaggacgctctgtggtatcacgcattacgagtactggctttccaagtcctggagcctcctcttggattccaccagaatcggtcaagacaatagtagctctactcataaggtgtacaaactcgagatactgaagtggctcaataaagaaaaagttaggacgagtaagatcttcaccaaacacttcgtggataggcttgcgcacgttaggattgaggtgcataggatatacgaagtcaacctcaagatatttttctgaaagatccttcattgtagttaccatacgaatgaagccgtcaccaaagttctcgcgacggtgaccagtgatgaggacaagcttcttgccgttagcaagacgtgttacatcgtaacctgcctgtacaagtacgttgtcttgctccttagcgagcgcatcatcggtcttaagtttattaactaccatataaagggcatcaataacggtattaccggtcacatagatgttgccatgagctttctcctccaacaggttcctctcagaaagtggagttggagaaaagttataggtagcaatacgtcctgtaatctgacggttcatctcctctggccatggagagtaaatattatgagtgcgaagacctgcctccacgtgacctacaggaatctgggaatagaacgctgcaagggcacctgccattgaggtagtggtgtcaccatgaacgagtacaacatctggacgacactctttgaacacatcacgaagaccggtgaggacacgtgcagtcacatcagtaagatcctgaccttgcttcatgatgttgaggtcgtaatcaggcttcacatcaaagattttgagaacttgatcaagcatttcacgatgctgaccggtaacacatacgatagtttcgaactcatcgttgcgcttctggaactcttttaccaatgggcacatcttgattgcctctggccgggttccgaaaactagcataactttctttgccataatttgactgttattattttattttttattcttttgtaagcagcctaaccacagaattatcactagaagaaaagttgcaaaatacagtagcagtaactaaatattttgagaaagaggaaaggaaaggctaaagacgaaggtctaaaggggatattcgcaggtgccatagtaattggtacttcgactaacttagcataaactactcttcacacttatagtacttcgagtaccattgagcgaaagcccttaagcccttacgtagtgagattgatggcttgaagccaaaatcttgttccaatgaagttgtgtcagcataggtgacagaaacatcacctggctgcattggcactaattctttgtgtgtctcaaaatcgtaatcatcaggaagtaccttggctgctatgagctcttcttgaagaatggtcacgaaatcaaggagattctcaggtgagttgttaccaatattatataccttgtatggtgggattggaagtccgtcctcgccatttttcttctcaggagcatgctgcatgatacagacaataccctctacaatatcatcaacataggtgaagtcgcgtttacagttgccgtaattgaatatttggatggtcttaccctcacgaagtttgttggtaaagccaaaatatgccatatctggacgaccgcagggaccgtaaacggtgaagaatcgcagacctgtgcttggtatgttatagagcttgctataagcatgagccattaactcattgctctttttagtagcagcatagagtgatacaggattgtccaccttatcatcggtactataaggcactttcttattgcttccatacacactactggaagaagcatatactaaatgctccacgctatgatgacgacaggactctaagatgttataaaatccaataaggttactttcaatataagcatcagggttagtgatgctataacgtacaccagcttgtgcagcaagattcacgactacctgaggatggtagttagtgaaaatagactcaacaatttcctttttagcaatactgtcttttatgaaaacaaatctgtcaccgtaagcagacaattcttgtaagcgttcatactttaaacgtacgtcatagtattcggtaatactatcaataccgatgactttcacgctatcaaactcatttagcaaacgtttcaccaaattggctccgataaaaccggctgcaccagtcaccaaaaccactttgttctctaaactaacattgtatgttaccataaagttaatctctttggaaaatgtcacgagtatataccttctctttcacatcatccagacaagaatcgtagcggttggcgatgatggcctgacttatttccttgaatttgattaagttattgaccacttggctaccaaagaatgtttcaccatcttgcatagtaggctcgaaaatcacaatagtagcacccttcgccttgatacgcttcataatcccttgaatggcactctgacggaagttgtcagaattggacttcatggtcaaacgatatacaccaatggttattttttgctctttctgggcatcccatgagcaggaggcagtataataaccagctttacgcaacacttgatctgctatgaaatcttttcttgtacggttactttcgacaatagcagtcatcatgttctgaggaacatcctgataattagccaagagttgtttcgtgtctttaggcaaacaataaccgccataaccaaaggatggattattataatgtgtaccaatacgaggatcaagaccaacaccctgtattatcgactgagaatccagacctttcatctctgcataagtatcaagttcattaaaataactgacacgcaatgcaagataggtattagcaaacagcttaacagcctctgcctccttgatacccataaaaagcgtaggaatatcttccttgattgcaccttcctgaagcaatgcggcaaaagtatgcgcagccttctctaagacaggaatattcgcaatgacctttattgcttcattttcctcgtcgaactgctcgctatcaatcaactttggataaccaacaatgatacgacttggataaaggttatcataaagggccatgctctcacgaagaaactcaggagaaaaaagcaagttaagcttcctgactccctttcgggcatacttcaaataaagtccacgacaatatcctactggaatagtagacttaattaccatcacagcatcaggattgacacttaaaaccaagtcaatgacatcctctatatgatgagtatcaaaatagtttttcaccggatcatagttagtaggagccgctataaccacaaaatcagcatcactgtaggcctcggcgccgtcaagcgtagccgttagattcaatgacttttcagacaaatatttctctatatactcatcctgaataggcgattgtttacgattaagcatatctactttctcaggaatcacatcgactgccgtcacctgatgatgttgcgacaaaagcgttgctatgctaagaccaacatagccggtacctgcaacagcaatcttcaattcttttgtatccattgttgatttatgttagtgttcagaattattctagttatctatccaagacctcaaacttcggcgagttcttggatttaaattcaggtaccactctcttcattagtttcactgtgtccatgatctttaccgtacgggataacttctcaaactctccataagtttcaaggatatcagtgtattcataatgacgtaccttcgctatcattatcttcttattctcggtaggaatcgtattctctttatcgctcaggacttcttcataaagcttctcacccggacgcaatcccgtaaacttgatctcaatatcttcaccgggacgataaccggcaagttcgatcatacgggtagccagatcgacaatcttcacagcctttcccatctcaaagacaaaaatctcattgccttcacccatcgtagcagcttccattaccaggcgacaagcttcggggatagtcataaagaaacgaatgatatcggggtgagtcactgtgacaggaccgccattctcaatctgttctttaaagcggggaattacagaaccgttactacccaagacgttaccaaagcgggtagtgataaatttggtatggccttttacttttccctcacggatagcacatcccagactctgtacatagatttcggccaatcgtttcgagcatcccatgacattggtaggattcaccgccttatcggtagaaaccatgatcatcttctcagctccatattcaactgccatatcagcaacctgacgagagccgacaacgttgaccagcacagcttcacagggattctcttccattaatggaacatgcttataggcagcggcatgaaagattatctgaggctgataagtttcgaataccatacggagacgttctttcacgcggacatctccaatgacaggaacaaaatcaagaccgggataattcttctcaaattccagacggacattatgcaaaggtgactcagcggaatcaaacatgatcagcttcttgatgctcatctgagccagttgccggcaaagttcgctgccaatactaccggcagctccggtcaccaacacaaccttgccacaaaactcagtcatcacctcctccatattgatatgaatttctgaacgacccagcaagtcttcaattttgatagggcgtacccattggtggaaacttccgttttcgtcagcctcactgatactcggagcaatcaacgttttcaatccactccttttacaatactgaagcaggcggtcttcctcttcacgggtattctcgtaacgggcaaacaggatgccgccgatacatttcttatgaataagcttgttaaagcactcttcatctttaaacgaataaacgggaagatcagccacacgccggatggagtcgcctgttccgtagatacagaagcctaccactttatagtgagagctgttcattagccgaactttcaatgccacactcttatcatcaataccatagatcagaatatgcatattcttcttattcagcatattcagcaggagttcataaaccagaatcaactgaatacggaagcctaccatggcaataaaagtcagcataccatcaaacagtacaaagactattttctgactattatgcagtcccgtctgaggcaggaaaagccagatagccattgcgatacagacagcctttatcagtgcacttccggcaattctccataattccttcaactgggaaaaacggatcgtattacggtaggtatggaataaaaaggaacctaagacactggagatcaccgaaatcgctaaaatatggaaaagagaagtgatttctttggaagtctccgttatataatgaatgccgataaatgacacccaggtacaaatcaaagctatgaacgtatcaattcctaatacaatccaataactaaaatagtttttctgcaaatattgaacaaaacggtcaaatgcgtgtttcataatttaaataccccaataaattat

SEQ ID NO: 175 - DNA, 15425 bp, Bacteroides thetaiotaomicron
ggttaatactatattgtatttaattttttatcacgctataaacttaagcaaaaaaaaagataaaacaaattatttgcttatcttttttcctaaattcctaaattctgtttacgaattttatatcacttcaatagcggaagccggtacccatcctactttgccgtcttccaagcgaatttctttccattctttcattgagttatctttgatactgaccttacgtccctcatgaaggatgaacaaacttgttccactttcactcggagtgctgcgaactgttacactaggattcatgacgatcgcttcgcttctatttactaaacgttctttttgctctgaagcaaaaagattagagcatatcacaacgattaagaaaacgatacctgatataaatcctgttttttttagtataatctgcttggagaaaataaagaagtaaaaagcgatgataaatagaataaaggagacaattccccatgtagcccatgcgtctacactcatactgtttatcaaggctttggtccatgatacaaagaaaacttccggaacaggttctactttatctattgttttagcgcgtgccacttccagattggcacggatgtcgctgtttcctggtttcataagcaaagcacgttcgtagttgagtacggcttttgcaatttctccagctttgtagtaactgtttcctaaattatagtacacatccgcagattccccattttttaataaggattcatatatttggatagcagttgcataatcatcttttatatatgcggaatctccttcggcttttgttacatcttccaatttcgtatcagaaaatgtatgtgaacccgcatggatagaatcagcttcagttatttgtatagaatcaatgctctgagttccctgtccgaagcaagtaactgacattgataataatataaaaaacaatatttttttcatgacacaatctcttctgggttaatgttttattgaattttccattctgcttatcacttctattgaagaagagtagactttatccattgcctgattttcatcacctggagcgaaacgagcaaattcacaatcattcaatgcattcaggaattctttaattagttcttcacttactccatggtttctcagcttctcttcaatattgtctttcgacaaacgggaaaccggaatactgagtttgtcgctgatatatccccacaatgctttcagtacttcatcatagaaggcatctttcttgttttcagagagcaacttaccggctagtttcatgcgcttggttgctaccttattagctttctttgttttcatcttagcaacattggcatttgtagcggcttgtttgcggtagatgataaagaagatgatgaaggctaaagcaggaatgatatagaatagccaataggtcattgagccatagaagaaactacccttaggttggagagtaacttcattttgcttaatgtaacggatatcttcacccaatactttcaagtcttctttattggtgaaattggcaatcacctgatcagcatttcctgcacctttctcaacattgattacgtagtcttccgttttcaacgttttgtaagattttgaacggatatcgaaatagctgaaagatgcccccgggattttataattgcctgcatgtcttggaatagccagatattcaatgactttgtttcctgtaagaccttcctgagttaatctgacttggttgtccaccttcggatcatatacttcaaagtcatccgggaacttaatttctggattagaaatcagctttaggtttccggtgccggagattaccaacttaatggtgatagcatcattagttttcagctccttgctattaatggaagaagaaatgttgaactctcccactccacctgaaaagtttgcaggtttaccagcaggaagcggattgacattaattgctattttaggagtaacgatagatttcggtactttaactacattgcttccaccattgaaaaatgcatcaaaaggatcgtcagattgtacagctttacctaccgtcatctggaactgtgccggttctataaataacttacctggttgctggggaaataatacgaattggcgatagattgtcgtattatagttacgtcctttataatgctcctgtgtccatcttgcatttgcattcatttcaatttcttgagaatgaaatcctttaaagtcaggcagtttggcattattcaattgcaagtcatgttctctggtgtatattttataggttaagacaaatgcttcctgctcgtatacattcgttttactggcagttgctgtgataaacaaatcctggttagatacacttgtaccggatgaagagcgtgcagatgagctaccgtcattttgtcctccattactagcttggtcttgtggcaaaaccttcacctttacggagtttgaaaccatctggttgccatcagctacaatagaagctccggggattgtatattcaccggcagtatttgccatcaatatataagtgaatgtaatactacttgtagaggtgacattaccattcattatctgtgtactactttgctgagaacggcttggccccatcaggacgtcgaatcctttgatagccggtgcctgaaagtctttaactttttgtgtggttactgtataagatagcctgaattgatcccctacaaccactacatcgggagcggaagcagtgaatgacaccttgtcggcaagcgcttgggtgctatatgctatcaatgccatcaatataacaatcagttttttcattgcttatgaaatttatatcatcaactttttattattaccaatctttttccagacgaccgccctgaataactttctgttgtttcttcactttgtcctgtacgtctttctcatcctgaatcacagagttaagtaactgttcagcattttcctttgacatctgattatcttgtttttcaggcttcggcggttgttgctgatccttttggtcgtctttcttctgatcgttctgtttatctttgttttgatcctgtttctggtcttgcttctgctgctgatctttattctggtcttgattttgatcttgatcctgctgattctgttggtctttcaacatcttttgagcgagtgccaggttataccgtgtttcatgatctgcaggattgttgcgcagcgacattttgtaggcatccactgcttttgcataatctttaccagcttgaaaaagcactcccatattatggtaaatgtgtgccaatttcattttatccttttctattttgctggcagaatcatattgctccatggcttcctgaaacttttgttgttgtgagagcgtatttcccaaattgtacatggatacagcagatttaggattaacttccaaagccttgcgataattaacttctgcatctacgaatacactatcattgaacagacgatttcctttgcggatatagtcacgctctgctttctgtgccgaaacgccggcagccgataacagaaaagcagcaaacaggatatatttcatttttaacatacgcatagcttacttcttattagagaacagatgaacgtttttgaataatggattcttacgatccaaaattaacatctcagctagtaacaatagtaaaatgatccatgcaatagcctgaaactgttcgttgaaatccgtatatattttcgattccacatcagacttagccatcttacttatttcctgactgatagccttttgagcagaattagaattatctacccgtacatagataccctttccgtctttggctatttcttgacacatgccctcattcagacgggttacaattacattaccttcgcggtcacggcgataatcattggtaccttctacaggaataggagcaccttcgggcatacctactcccagcacacttacctgaatccctttttcggcagcagctttagcagcttctacagcgccaccttcatgattctcaccatccgtgatgacaatgatagcacgtcccactccttcttgcggagtaaaactgcgggttgccaggttgattgcctctccgattgctgtaccctgcttggaaatcagcgatgggctgatagattccaaaaacattttggcggaaatataatcgctcgtgatcggtagctgggtaaaagcatctccggcaaatacgatcataccgactttgtcgttatctaattcatctaccaatctggatattaatctcttggctttttccaaacggctgggctgcacatcctgcgccagcatagaattagatatatccagagctataatcacttccacccctttacgtttcaccgtttcctgcttggaaccaaattgcggacgagccagcaatactgagaataagccgatagcggcaaagatgagccaaaatttcacatccggtcgatatttagatacatccggcattaattgcgctaacaattccggatctccaaaacgtcggatatttctccgtctcctgtaattggaatacaagtagaaagctgctaaaaacggtaatagcagcaataaatataaatatgcaggttcttcaaatcgaaacatcttcttcctattttacgttacaaatcacgattgacgaaacattcctacggaattttcttgagtattgaattacgcaataaaacttccagtagtacacaaaggaaagcagccagtgcaaaccagcgatagtcttcttcccgtttgctatactcttttacgttcaactttgttttctccagcttgtcaatttcttcatatacctctttcagtttcgagttgctcgtagctctgaaatagttaccatcggtagtaccggcaatctgagtcagtgttttctcatcgatttccaccggcatattgatatactgtactgtattaccgaccggataaggatatggagccattccattcgtacccactccgatggtatacacacggataccgaaacttttggcaatctcagcggctgtcaatggcgaaatatctcctttattattggtaccatccgtcaataagatgataacttttgatttcgctttactgtctttcaggcgggttacagcatttgcaactcccataccaacagctgtaccatcttcaataaggccacatttgatattatgaatcatatccagcaatacagcatggtccacagtcagcgggcattgagtgaatgtttctccggcaaacagagtgataccaatattatcattcgggcgtccgttaataaattcggctgctacatctttagcagcttccagtctgtttggcttcaagtcttccgccagcatactggtagacacgtcgatagccagcataatatcaattccctctatttcgctgttttgccacttattagtgctttgcggacgcgctaataccacaataatcaaagccaatgcaatgacgcgcagtataaatggagcatgtagcaaataattcttataacttttaggagtatgcgcatatacccgtgcatccgaaatctgaagggtagcttcagttttctttcgcttcaagatataccatacaatataaggtataagcaataatagcaaaaacagatattcaatattggcaaaaaacattttattttcgatttaacagtttactatttagtattcacaccacattatgcaaagagatcataaagctgcatacctatatatacaaaagtacctattaatgctgctgacaagaatacaataccgcagattaataatattttagtacgcagagaacgtttctcgataattgtgatttccgttggttgcggtttctgattctcctcttccggttgctttgtttcgttgataaagtcgattgcattaatcaaattcgcatcattttcattcatttgcggatcatgcttggcaaattttactaaatcagctgtctggaagagttccttcaaatctgatattgcctctttatcattcatttccaataacttatcgatgatttcagaagaagtcatctctagtgcattgaatccgaaacgatctttaatataagtacgaagagtatctgtcaattccgtataatatgccttcggctgtcctttctgccatactttctcattcttgatacgttcgatttccttcatagcagcctgatgtggtggcaacttaggttctacttttatcttacggataatcggtttgttatcacgtatacgaatgatcagatagatcaataagccgagtaaaggcaatgcaagaaatgagcaaccgatcagcccataccagtcttcccatgcgaaaggcgctttcatcaccgttttctgtccgaagaactggtctggatgcaatgtgtcaactggcatagaatatactttcaatgccagagctttcgatctatattctttgccatccacagtgacaggcatcggcggaagataatagagagctgagtcaaacgaggtaacaatgtattcctgagtaatcagcattcgttggcgatcattcagaaattgtgtatccggtttggcggtttctataatttctacccctcgcaccagtgtatcggtataagcaggaaaaacagcacgttgtttggcgtccatcgctacttgtaattgtactttcgcctgttcgccaattaatatctgcaacgaatctatcttagcttccactgtaacagactgtgccacagttctacctatagaaagcagacataacaatgctatcagaataatatttctattcatctttgattccattaatttcgtttggcaaataaattcagcaatgcctttacgtaatcctggtcggttctcacagatacggagtcaacattacttttggtaaatgtgtcgttcagttcggtctgtttgtttatccaccagtcacggtgtgcccggcgtacagctttggaagaagtatcgatccattgttcatggccggtttccgcatcttttattcgcatcagtcccaccggaggaagatcactcactctcctatcgtaaacctgcaatgccactacgtcatgctttcggttggcaatagtcagagcgtttttaaagttatcctgatcgatgaagtcagatagaataaacgctgtacaacgtcttttcattacattagtcagatactccaatgcgagacgaatattggtacgacggctttccggttggaagtcaatcagttcgcggataatatatagaatgtgtttacgtccctttttaggaggaataaacttttctatccggtctgaaaagaagatcacaccaattttatcgttgttttgtatagcggaaaatgcaagagtagctgcaatttccgttaccatatccttcttcagttgtttaaccgtaccaaattccaaacttccggaaacatcgaccatcaacatcactgtcagttcgcgctcttcttcaaacaccttcacataaggtttgttgaatcgtgccgtcacattccagtcgatgtcgcgtatatcgtcgccgaactgatactcacggacttcagagaacgacatacctctacctttgaaagccgaatggtattggcctgcaaagatattgttagacagtcctcgtgtcttgatttcaatctgacgaactttttttaatatttcacttgtttccatttatacagtagttaaagtagtaagtagtcaggtagttaagtaaaatacacttgactaccttttactgcattgtaatattacggcagattagggcacttcaaccttgttcagaatcttgctgatgatttcgtccgaagtcatgttgttggcttccgcctcgtatgtcagtccaatacggtgacgaagaacatcatgcgcaacagcacgtacatcttccgggattacatagccgcggcgtttgatgaaagcgtatgtgcgggcagctagtgccagattgatagaagcacgcggtgagccaccaaatccgatcatgtctttcagttctttgagatcgtatttctcggggaaacgagtagcaaatacaatatctacaatataacgttctattttctcatccagataaacctggcgaaccaccttgcgggcttcgataatttcttctgctttcaggataggtttcacattgaacttctcaccgttgatattctgacggataatcagtttttcttcttccagcttcggatagtcaatcactactttcagcatgaaacggtctacctgtgcttcaggaagcgggtaagtaccttcttgttcaatcgggttctgagtggccaatactaagaaaggttccggcaacatgaatgtttccttaccaatagtaacctgacgttcttgcatggcttccagcaaggcactctgtactttggccggagcacggtttatttcatccgctaatacgaagttggcaaagataggtcctctttgtactttgaaagattcatctttctgactgtaaaccattgtaccaataacatcggccggcaataagtcgggagtgaactgaatacggctatatttcgcgtcgatcagggaagcgagtgttttgatagccaaagtttttgccagaccgggtacaccttctaaaagaacatgtccgtcggaaagcaatccgataagcagtgattcaaccaaatgtttctgaccaacaatgatttggtccatacctgtcgtaagattggtaacgaaagcactttgtctttcaatccgctcattcagttcgcggatatcaattgattcagccataaatacttaatattttattatttaattctcattaattaaggtgtaagacttaccagtgtgtaaggcttctaaattcgctcccaaaagtacgccatataattaacgattgcaactaatttttattaaaaaacaatgcgaaatctttagattaaggtactttcatacgcttttgtacttacgtaacatttcacccggctatacattgctgtatgagccgggtgaataggtgttttttgtttttattcttttgtaagttccggtatctcgattgtcgtaccgtatggtacgttatcggggttcttgattactttcgggttatgttttacgatatatggccacatggcttttgtaccgtaaaagcgtaatgaaactttcgttaaagtctctccttctttaattgtgtattttgttttggtaccggttatcttgtaggatgcggaatccgaatatgccgaagctgttggttgttgttgggcaggtttactttctgctttgacaggttccgctgtcggttccttcttgacaacaggttgcggttggactgcttccaccacagtatccttgtgtgcaattgtatctgaaagctgtgcttccggctgcacaggttgagtaacttccggtatatcaaccacattcttatcagacgaagatgagaacaaatccggataataaataaacaggatagctcctccgcacagtagtaagactataataatagttgctattaaataaggaatagctgatttttcctttttatcactgtctttatcagtataggtggctttcggttgttctatttccggctgttcttggagagtgacaggctccatatttgctttatgaagctcttgggctataatttgctctgcagtaacttccgctttttctgtaataaccgttttctcttcctcctcttctgttgtttcagtctctggtttctgctcttctataattgtttcttccgattgttccttagcaggttcctctgtcaccggactgaagtcaggttccaaaacagtttccgaagattcctctacaggctcttctcctggggcttcctcagatacagattccggtttcggttcaattttcacttccggcaattcttcagcttctggttcttctgttgcaattagttccggttctgtttcaggttgaccggtttcattcgcgtcagtttcaggaacttcagccacagctactgcttcagcagtcggctgctcttcgattacaggttcttccagttgtatttcttcctgaatatctccaccggcattttcatttcctgctatttcagagtcgatcatttcagtctctgtatcagaaaccgcaccttcctcctcatcggattcttccataggggtatcttccaataccgtaccttcatttaatactaccgtttcaaaatgtgcaaaaggcttatttattgtatctctcagattggtgtccggagtaaacgatactttggtatgaccttttatctggaaacgttcccctgtgttgacattaacgctttcccgactatctacatccacaagtttgaaagtccccaatcctttgattttcacagtcttctcattctccagggcttgttctatcaagagaaaaaactctttgacgaatgcttcggcatccttcttggtcatgctatgtttagccgccaataagtcgataaggtcttgaattgtcagtctttcattcataatgggaaatatatattatttaaacttgtctttcagtgtattgctgggtctgtacgtcaataccaatttaggaggaaccagcatacgttgcttcgtggacggattgatcgaaatgcgctccgcttttttcttcacttcaaaagaaccaaagccctgtattgcaatcgcattcccgtcttccagttcctgtgtcatgtcagacaataaagaacttatcagttcagaagtgtctttgatagtataccccagtctgtctgccagttccgatgtaaattccttattattcatacttgtttaatatctttgcatataaatcaaaatcgtccgcatcggttacttctacctgatagaattgtccgacttcaagttcttctctggaaacactgatcaatacttctgggtctacctccggtgaatcaaattccgtacgtccgatataataatctccctcgatccggtcgatgatgactttcatctgctgaccaatttttgcagcgctcaattctgctgaaataccttgctggatatccattagctcgtccagtcgggcttgtttaacctcctgtggtatagagtcttcatattgctgggcagcataagtaccctcttcttcagaataagcgaaagcccccatcctgtcgaaacgcgccttgcgtacaaattctttcagctcttcaaagtcttcttccgtttctccgggatgtcctaccatcagcgtagtgcgcagatggatacccggtacttctttacggaactgttcgatcagcttgtacgtatcttctttgcttacttgccgacgcatcagtttcaacatgttgtcactgatatgctgcaaggctatatccatatatttgcagacattatcgcgttcccgcatcacccgaaataaatccgttggaaaatgtgccggatacgcataatgcagacgaatccactctacacccggaatttccgagatacgttcgatcaattcgggcagcatttgctttttatacagatcgactccgtaatacgtcaattcctgagcgatcacctgaaactcctttaccccttgcgataccagataccggacttcatccagtatttcttccatcgacttggatatatggcgtcctgtaataatgggaatagcacaataagagcacttgcggtcacatccttctgaaatcttcagataagcataatgcttgggagtggtcaaagtacgctcaatatacaattcctcatggtacgtttttcccaagtcctgcaagagttctttccagttgaatttgccgtagaacttgtctacctgtggtatttcaatggccagttcttgtaaataacgctcggaaagacagcccattacaaacagtttcttcaagtcgccttcttcttttctttctgcaaattccagaatcatattgatagactcttctttcgcgtcaccgatgaaaccgcaggtgttgattaccgctatctccccttccggattttctgtatcatgagttacgctgtatcctgcttcttccagctgacgcatcaactgctccgagtctactaaatttttagaacaacctaaagtaataatatctattctctttcttttcatgcattctctccaaacagggaatcaacaaattcatttttgcggaagacttgcaaatcttccatgccttcacccaatccaatgtattttacaggaatcttgaactggtcggagatgccgatcactactccgcctttggcggttccgtccaacttggtgatagccattgcagtcacctccgtagccaatgtaaattgcttggcttgctcgaaagcattctgtccggtagaaccatccaataccagcaggacttcatccggtgcattgggtactaccttcttcatgacgttctttatcttggtaagctcattcatcaagcctactttattgtgtaagcggccggccgtatcgataatcactacatccgcattgttggcaacagcagaactcagtgtatcgaaagcgacagatgcagggtccgcacccattttctgttttacaacaggcacacctacgcgttcaccccagatcatcaactgctctacggcagctgcacggaatgtatcggcggcacccaaataaacagatttgcccgctttcttgaattgataagctaatttcccgattgttgttgttttacctaccccgtttactcccactaccatcattacataaggctttttcttgataggtacatcaaagtctgctacgtcatccgaattattctcggtcaaaagggcagcaatttcatcacgcagtatgtgattcaactcttgagtattcacatatttgtctgcagcggcccgtttttcgatacgtttgataatattcaaagttgtctctacccccacgtcagatgtgatcaaaacttcttccagattatccaatacttcgtcgtctactttcgacttaccagccacggcacgagcgattttactgaatacgctctctttggttttagataatcctttatctaaagtttccttcttttcctttgaaaaaaaactaaaaaatcccatatctacagttatttgtataatacattatgctacaaagatataacaaaggattggaaaagtaaaaaaagaagcaataaaaaatcccctcactgtttgccaatgaggggattttgtgtttatagcgttttatgctattctgattattttttgaaaaagtcttgtactttttcgtttgcaaccatttgttcatcaaaaacgtaagctccagttttcggagatttcaccattttgataaccttggtgtaagcacgaccttctttagagccttcgtgcaaacttgctactgttttctttgccatgggttatactattattatttaatttccttatgtactgttactctcttcagaatcgggttgtatttcttcaactcaagtctttcagttgtattctttctgtttttagttgtgatatagcgagatgttcccggcattccactctctttgtgttctgtacattccagaatcacctgtactctgttaccttttgctttctttgccattgtaagttttctcctctacgtttagccgattactttaatgcttttccaatcacagaaacctttagctactgcatcgttcagtgcagcgtccagtccttttttgttgatgatacgcagaccgttagcacaaaggctaaggctgatccaacagtcttgttctacataatagaactttttgttaaacaagttcaaatcaaaggttctttttgttcttctctttgagtgtgaaacattgttgccaatcatggctttctttccggtaatttgacaaatcttcgacatttctatcttatttttatagttttatatctatacttatttcaaacaggacgcaaagtaagcacttttatccgtataaaacaaggatttcttaaaataattcacttccagacaccaatttttccttatttgagcaaatcacgaagaattaatagcgcattattgcccgctctttcaatattcatggctcttccgcggttcgtttcctgcctgtaagtacgaatttcatttttataaccagcagcgatccagacagtgcctaccggtttctccggtgttccacctccgggaccggcaattcctgaagttgcgacagcgcagtcggttttcagcgctttcatcgctccttttaccatttcgatcacagtctgctcactgacagcgccatacacttccagtgtttccggtgaaacatggagcagattcatcttcacttcgttagaatatgccactattcctccattaaagtattccgaacttccggcaatggacgtcagacgtgccgcaatacttcctccggtgcaactttctgcggtggaaacggttaaattcttctttttcagcagttcgcctacgattacctccagtgggatatcttcttcgctgaaaatatcatcgcccagtatcgcttccagcttagcctgctcgtcgttcagtgcgctttccacttctatcttgttctgtccccgtccggttagtcgcaggcggatgattccaagtttgggcagatatgccaatttgatgctttccggcaaggctgtctcccacggttccagcttttcagcgagtatggattcggggtaatgttgtactagaaaggtccggtgcatgattacatccgtctgaaacttctcacgtagcttgggcaatacggactcagtcataacggcagtcatttcctgcggaacacccggcatggatacgagtactttattgtctttctcaaaccagctgacagaagcgcttcctaccggattgttgatgaccgtgcaatctttgggaaccattgcctgactcttattcagcgcattcatcggtattttcccggcaagcacccgctttacgttctcaaatacttcttcgctgaatatcagttcggtatggaagtatttacagagagtttgtttggtgatatcgtcttttgtgggaccgagtcctccggttaccagaacgatattcacccttttcatcgcattatctactgcttccatgatctcttcttcccgatcacggatcgaaacaatgcgtagaacttcgatacctatcttatttaattcctgccccatccaggcagaatttgtatcgactacctgccctatcagcagctcgtcaccaatggtaataacttcagcaaacatctttttcctacgttagttaatagaatatgctacctatattaataaggtatatacgctatgttaagtcattaggtttacttcattttttcgttccatatacgtgatccattcggttcatgtgcgtgagccgaatggatcacgtatgtgaactggacggcttacgcacgtggaacgaaggaatgctataaacaaagattcttaatgaatgtacttccctaataatggttgacttgtttatctctaatagctgctatgtgttgactagaaatattactaaccctggcagctgtttactttattatttattattcctgcctccggtttacttattt

SEQ ID NO: 176 - DNA, 15405 bp, Bacteroides thetaiotaomicron
ttaggaagtagctatacacttctgaagagtaggtatgtctatatacaaacttacccaaggatacgttaatgttcgtaaacttgggtaagattttatagatattgtttggagaggacttagaattcacactctttattatatctctgtgtgaatgactatgatcttaaaaacagacccagccaaagaaagctagtcaaagaagctcttgaacttcttgaagatcttctccttcaccgacgtactcggcttgaagttgtccgaagcctccatcttttccagcgtgctcttttcctccttgttcaatgcttccggcacataaatgctgatattaaccagcaaatctcccgtaccgtaaccattgacattcggcagacctttgccgcgcagacgcagcacttttcccggttgagtacccgagtcgatcttcactttcacttttccgtcgattgtcggaatctccacggcaccgcccagtgcagcagtcgggaaactcagcagcaagttatagatcagatcattctcgtcgcggattaagtccggatgcggttcttcctctacgagaatcagcaagtcgcccggcacaccattatgctttccggcattacccttgccgcccattgagagctgcataccttctgccactccggcaggaatcttcaccgtcactacctcttcgccatatacgataccgtcgccgccacactctttacacttgttcttgatgatcttaccttcaccgttacaagtaggacaagtggtgcgggtctgcatcgtacccaaaatcgtctgctggttacggatcaccgaaccgctacctttacaggtcggacaagtctccgaaccgccgtcgccttcggcccccgtgccatgacagtgattacacggcacatattttttcagtttgaatttcttttctactcctgtcgagatttctttcaaagtcatctttaccttgacacgtagatcactgccccgatagcgacgttgctgtgaaccaccgccaccgccaccgaaaccgctgaaccctccgaagccgccgctgaaaccaccgccgcgacctccgaagatgtcaccgaacatggagaagatatcatccatagacattccttcgccaccgaaaccaccgaacggacctccgttgcccgccgcaccgcttactcccgcatgaccgaactggtcgtaacgcgaacgcttgtccggattgctcaacacgtcatacgcttcggcagcctccttgaatttctcttccgcttccttgtcacccggatttttgtcggggtgatattggatcgcttttttgcggtaggcttttttaatctcttctactgtggcggtttttgtcacctccagcacttcataatagtctcttttttctgccatgcttcttaactaaactaacttttgtatttactccccaactactactttcgcgtgacgaatcaccttgtcattcagcgtatatcccgtctgtacgcagtccagaatcttacctttctgctcttccgacggggcagggatgacggcaatggcttcgtgataatcggtatccagcggctggtctttcgtttcgatgaccttcacaccattctgtgccatgacagccatgaacttattataaatcaattcgacaccttccttcacggcttttacgtctttggcagtttccatcgttttgatggcacgttcaaagtcgtcgatcaccggcagaatgctgctgatgctcttttcgccaccattcagaatcagttccgccttctccttcatggtacgtttgcggtaattgtcaaactcagcggacaggcgcagatatttgtccttttgctcctcgatgacagcctgagcatcttccagctccttttcgagttgctcctcatgagtcaggggagcggcctcttctgcctgatcgtcttgcggttgttcttccgccgtatcctttgtttcttccacattcagctcttcagccatcttttctttttcttttggatccatatcttatttttattttttattcataatatcaatttcccaagcaaaaactttgccaatctgaccgttttgccaaaaaacgtggcaaaggtaatacatttatgccagattgacacattccggatagctcataattcattttaaatgtctacctttgcacgctcaaataataatatagtaactggtaaaatagtaaataatagaaaatgattacagtttcaaacgtttcggtgcagtttggtaaaagagtcttgtttaatgacgtgaacctgaaatttacaagtggcaactgctatggtattatcggtgcgaacggtgcgggaaaatccaccttccttcgtacaatctacggagatctggacccgacgaccggtacgattgccctgggaccgggcgaacgcctgtcggtgttgagccaggaccactttaaatgggatgcttatacggtaatggacaccgtaatgatgggccacaccgtgttgtgggacattatgaagcagcgtgaagtattgtacgccaaggaagacttcacggacgaagacggactgaaagtatccgaactggaagagaaatttgccgagctggacggatggaatgctgagagtgacgcagccatgctgttgagcggtctgggcatcaaggaagacaagcattatacattgatgggtgagctgagcggtaaggaaaaggtgcgtgtgatgcttgcgcaagcattgtacggcaaccccgacaacctccttctggacgaacctaccaatgacctcgatatggaaacagtgacctggctggaagaatacctttccaacttcgagcacaccgtgctggtggtaagccacgaccgtcacttcctcgactccgtatgtacgcacaccgtagacatcgactacggaaagatcaatatgtttgccggaaactacagtttctggtacgaatctagtcagctggcgctccgtcagcagcagaaccagaaggcgaaggctgaggagaagaagaaagaactggaagaatttatccgccgtttcagtgccaacgtagcgaagagcaagcagaccacaagccgcaagaagatgctggaaaaactgaatgtagaagaaatcaaaccttcttcacgcaagtatccgggcatcatcttcactcccgaacgcgagccgggcaaccagatcctcgaagtttccggactgagcaagaagacggaagaaggcgtagtgctgttcagcgacgtgaacttcaacatcgaaaagggcgacaaagtggtattcctttcacgtaacccgcgtgcgatgaccgctttcttcgaaatcatcaacggaaacatgaagccggatgccggacagttcaactggggagtaaccatcacaacggcttacctgcctctggacaatacggacttcttcaacactgaccttaacctggtggactggctgagccagttcggcgaaggtaacgaagtgtacatgaagggcttcctcggacgtatgctgttctccggcgaagaggtactgaagaaagtcagcgtactttccggaggtgaaaagatgcgttgtatgattgcacgtatgcagctccgcaatgcgaactgtctgattctggatactccgaccaatcacttggacctggaatctattcaggctttcaacaacaacctgaagacatacaaaggaaatatcctcttctcttcgcatgaccacgaatttattcagacggttgccaaccgcattatcgaactgactccgaacggtatcatcgacaagatgatggaatatgacgaatatatcacttcggaccatatcaaggagttgagggcgaagatgtacggtgataaatagcgtgttgtatcagccggatacactgaataatgtatagaaggtagtataaatagtaccttactgttaaataaagggaaatgcttgttgactgtcggcacattgcttttccctttccttttgtatattgaagtatataaacttgtattgtactgtttgtaaaataaagtttatttagatgtgttgctgagggagagatcgaaagttccaaaattcctccagcaaagtccagtaaagttcaaaagtccactataggattttcagaaaacggaaattggattaaaaacgaggaagaaatgagcagagaaggacttggcgggcatatttaaattttcccggactaaacctgcaatctgattcccaccatcttcaaaatgtgtctccatcataagaaaataacgtgaataggatgaatagttgttgttatttattgttacgtgtgttgccggacgaaccggaagatgttgaacagtcttcttatttattcttgacaatatcagtcgcacgtatatcgaagtagcgttcgccattttactatattacgttgaacataataaaatggtcaacacctgcgtgagaagctttgtcgaagacacgaaaacgtgcaatcgtctgacatatctcgcatctttcggagaagcttagacagtttttggggctaaagattcatgtgttgcgggagaggaattaaacttctctagaagcgctgtttattatttaataaattaaggtgttaatgcttgaaatatagtaagttatatcgcagattgtgtattctaaaaatctaatatggactttctggactttattggactttgaaaggaaggaaattcgtgacttttccttgattgtcataagaaaaaagagttgtgaaaatcgggagaaattatgaaataaaagaaagttgtgacaaacgagaagctttttctctctatgccaatgacgaagtgaaataattgatcggttttgtcattcttttctttcaaatacgctatgagcaaatcgaaattagctattagcaaaaacaaattagctaatagctaatcgaaatatgctaatagctaatttattttcgatctatcctcgtatcttctacatagcataaatcaatgtccaatgtggattatactttttttatttcttataaatcaacttgctcggcaccccgtttccgaagagttcatcgcccagcgttgtaatcttatcacctgtagcaagcacatagcgcagattatcgcatcccatgaacgctccgaactcgatagccgtcacgctcgcaggcagctcaagtgttccggcaagccgtccgcagttgctgaatacccgttgaccgatggtcttgaggttatgtggcagtttgatcttcaggagatacttcttttgtgcgaaagtgaagtcggggatagtcgtcgcatttgttttagaaatatccagagatacgagattcggcatatagtcgcggattagtttgaagtcggcgttatccagtttcccttcgatggtcaggaagttgatgtccctgggttgcagaccagctttcataatctcgtcttccagtttgcccattgcgcctacctgtatggtggtttccagcggttcaccttctataaatgcaaagtgctcccatctgttcttaaaacggtaggcatcactgctgcccagcgggatgaagatggcggtcacactgtccgccagagcttccggcagcagattaggagctgtcttcttgcgtatctgacagattttcaggttgtcacatcctttgaaggctgcatcttcgatattctttatcttttcggaaaggatcactttctccagcgtctgtttacctttggtcactccgttcaccacattcgagaaagcgtaggcagggacgaaattggccatatagatgtagaactttccgttaggatatgtgccggcttttccgctgtacatcttgatttcggcattggagatatcaagcactttcaggctgggaaactcgtcgcggagatgtctgaagtcttctgcgttcagttttcctgtcagtgtcaggtgggtgatgctgttggcttcttcttccgtcatcatcgagatcaatgtgccgggcttgctgacataatacgttttgcttacttgtgcggttgctcccaaagtactggcagccaataaaaaacttatcagtagttgtcttattttcataattatgcagatttgttcagacaaatataggaaaaataggtaagacacgatgtttttttatgttttatatctaattttgtagcgtgattaacaaaaagtaaaaatggagacagaagaaatcagagaaaagaaagaaccgaagagacttcccgtatgggcgtgcatcctgttgtttgcactggggcttttcgtcacctttggattgtatagtacgataggcttcggagttttatctctgattcttggtgatgaggcaaggcaccccggattgttggggcatatggtggcggaagccggcatgctgctggctgtgctgacttcggcagtgattctgctctattttgagcgtcgccctttctctgacttgggactgacactgaaaggtcatgcacggggattgtggtacggactgctggcagccatccttctctacttgatcggcttcggactgtctttggctttgggtgaggtggaagtaaccggttttcgattcgatcctctgaatctgcttgctacctttgtgttctgcctgctggtggctctggccgaagaaatcatgatgcgtggctatatactcggccgtctgctgcatacccggatgaataaattcctgtctctttttgtctccgcactgctgttcgcattgctgcacctcttcaatccgaaccttgccttcctgcctatgctgaatctgttacttgcaggtatgtttatcggcgcttcctatttatatacgcgcaatctttgtttccctatttcccttcatcttttctggaactggattcagggcccgatactgggctatcaggtaagtggaaatgactttgggacatccctgctgacgctgcatctgcccgaagagaacgtactgaatggcggagccttcgggtttgaaggctcgctcatttgtacagtactgatgattatctttacgattttaattgtttggtggggagaaaaacgggaggcaatcagtcttgctgtaccccgatcatgctaagctgaatccgtttccggtcggtatccacgttcatcactctgaccatgacatgctggtggatggacacgatttctgtaggatcggagatgtatcgttcggccagttgggagaggtgtacaagcccgttctccttgatgcctatatcgacgaaagctccgaaatttgtaatattgcctacgatgcccggcagaatcatgccttcgcgcaagtctgcgatggtgcgcacgttcttgtcgaattcaaataccttgatcgctttacgcgggtcgcgacccggcttgtcgagttcctgcatgatgtcttgcagggtaggcaggcccacagtcggcgtgatgtagtccgatatcttgattttttggcggagttccttattcgcgatcagttcgtctacgctacatttcaaatcttttgccatttgctctacgatgtggtagctttccggatgcacggcagtgttgtccaatgggttctttgcttcgggaatgcggaggaagccggcacactgttcgaaggctttggcacccatgcgggggactttcatcagctccttgcgtgaactgaaagctccgttctcggcacggaagttgacaatgttttgtgccagttgcggccccagaccggatatgtatgtcagcagatgactgctggcggtattcagattcacgcctaccaggttcacgcagttttccactgtctggtcaagggctttcttcagtttcgtctggtctacatcgtgctggtattgtcccacaccgatagatttggggtcgatctttaccagttccgccagagggtccatcagtcggcgaccgatggagactgctccacgtaccgttacgtcataatcgggaaactcgtcacgggcgatcttggatgccgaataaatggaagcgccctgctcgctgaccacgaatacaggaatctgccggtcgaaggtctgatgattaataaagtcttccgtttcgcggctggctgttccgttgccgatggagatggcttcaatttcataggcttctatcatcttgcggagtttggaggccgcttcaccggttttattgaccggaggatgcgggtagatattctcattgtgcagcaagttgccttgcgcatcgaggcagacgactttgcagccggtacggaatccggggtcgatggcgagcacccgtttctgtccgagaggaggagagagaagcaactggcggagattctccgtaaatacgcggatagcttcgtcgtcggctttttctttggactgggcggcaaattctgtttcgatggaaggtttgagcagacgtttatatgcgtcggcagtggcttcctttacctgatggctgcattcattattgccatgtacgaactggcggtcgaggcgttccagacaggcttcgtcatccggactgatggatactttcagcaacccttcggattctgcccggcggatggcgagcaggcgatgggaagtgcagcgtttcagcgattcggagaagtcgaaataatcccggtacttggcggcctcttcctcttttcctttcactaccttggcggtgatttccgcctgacgggtgaactggttacgtatggcgttgcgggcacactcgtcctcgttcacttgctctgcgatgatgtcacgggcgcctttcagtgcgtcttccgcatccttgacgtcgcctttgacgaaggtggcggctttggcggtgaggttgggctccctttgcagcatcatgatcatggccagcggttccaatcctttctggcgggccgcttcggcacgggtcttccgtttgggtttgtaggggaggtagatgtcctccagttccgtaggattccaggtggcgttgatgcgcttttcgagctccggagtgagtttcccttgctcgttgatggtactgaggatggtttccttccgtttggctatgtcgcacaacttgtcatgttgctccttgatgttctctatctgtacttcgtccagtccgccggtagcttccttacggtaacggctgatgaaagggatggtggcaccttcgtccaacaagtggagggtactgctgatttgtctttccggtatccccagtaatccggaaatcatttggtgaaatagttccataaacaatttttttgcgaatgaatgagcgacaaaaatacacataaatctgttatagccgacaagttttagtatatttgcaagctaaaatgagatagtaacacttcaaaacttacgagtatgatgagatatatagggtgcctgtttatctgtttgctatggcttttccgggccacagagttatttgctgtctctaacgatcagaaacccatcctgattatctgctcctacaatcccgccgctcatcaaacttcggtcactatctccgactatatggaagaatataacaaactgggagggaaacgcgatattatcattgaaaacatgaactgcaaaagtttctccgaagccccgctttggagcggtatgatgacgcagattctttctaaatatcaaggggagaagcatccggcgcaaattattctgttgggacaggaagcgtgggcggcgtatctgtcgcaacgggattcgatacaggtgaaggtgccggtgatgtgtagtctcgtcagcagcaacatcgtcatactgcctgaggatacggttgccggactggacgcatggatgccggaatcggtcgatctctttaccgaccacatgaatataccggaattgaagtcgggatttatcaatcagtacaatatagaagataatgtccggatgatcaaggcgttttatccgaagacggaacacatcgcttttatttcggacaatacttacggcggcgtcaccatgcaggcactggtgcggaaagaaatgaagaagtttcccgaaatcgacctgatcctgatggacggccggcggcatactatctatacaattgtggaagagttgcgtcatttaccggagaatacggtgatcatggtaggcacgtggcgtgtggatatgaacgaaggttatttcatgcggaatgctacctatgccatgatggaggttactccgaccattccgacttttactccctcatcggtgagtctggggtattgggcgatcggcggagtgctgcccgattaccggaaactggggatggacatggcattggcatccgtacagattgatcgatatccggcggatgagcagcagcacctttccgtgattggcagcaaggccgtactggacagccggaaggtgaaggagtggggactggacccggacatccttccttttgatgtgcagattattaatcagaccgtatcattctatcagcaatatacttatcagatttggtcggcatgtgcgctggttgtcatccttgtgctggggttgtgcatctcgctcttctactatttccgcaccaaacgtctgaaggacgatctgctgaagtcggaaaaagacctgcgggtggcaaaagaccgtgcagaagaatcaaaccgcctgaaaagtgctttcctcgccaatatgagccatgagatacgtacgcctttaaactccattgtaggtttctcggatgtgctcgctgtgggtggcaatacggaagaagaacagcagacctattatcagattatcaagacaaattcggatttgttgcttcgcctgatcaatgatattcttgatctctcacgcctggaagcgaacagggtcacgttgacttgggaagagtgtgacgtggtgcagctatgcaggcaggtggtggcatctgtcagcgtttcacggcagtccggcaatcagttcctgtttgtcagcgattatgagtcgtttcggatgacgacagacatacagcgtatgcagcaggtgattatcaatctgatgtctaatgcggataagttcaccaggaaagggcagataacactggaattttcggtgaatgaagagacggagatggctgtattctctgtgacggatacagggtgcggcatcccgaaagagaaacagaaactggtattcgagcgcttcgagaagctgaacgaatatgcccagggaacaggtttgggattatctatctgtaaattgattgtgcataaatggaaaggggatatatggatcgactccgaatatacgggaggtgcacggttcatgttctcacatccgcttaaaatagaaaaagaatgaaacgatttgcatgtgtttacgtatggcttctttgcctcgtgctctcaattgcggcacaggaaaaagtagtgaagctgaaaattgtacagacaagtgatgtacatggtaattattatccttataattttattacccgtaaggattggcagggcagtctggcacgaatatacgcttttgtggagaaagaacgcgaacaatataaggagaatcttattttactcgacaacggcgatatattgcaggggcaaccgactgcctattactataattatatagatacagtatcaccccacctatgcgcggaaatgatgaattacatgaaatatgatgccggaaatatgggtaatcatgatgtggagacaggccgagccgtgttcgaccgctggataaatacctgtgactttcccgtattaggagctaatatcatcgatatatcgaccggagaacctcatcttcctccttataaggtcatggaacgtgacggagtgaaaatcgtaatccttggaatgatcacccctgctatccctgcatggctctcggagaacctgtggaagggactgcgtttcgacgacatggaggagactgcacgcaaatggatgaagatcatccgtgaaaaagagaatccggacttgatgatcggcttgttccatgcggggcaggaggctttcaaaatgtccggcaagtataatgaaaacgcttctctgagtgtggcgaagaatgtccccggatttgacattgtactgatgggacacgatcatgcgcgcgaatgtaagaaagtgatgaatgtggcaggtgattcggtactggtcattgatccggcaagcaacggaattgttctgtccaacatcgatgtgaccttgaaactgaaagatgggaaagtgcgcagcaaagatataaaaggagtattgaccgaaacgaaagattatggaatcagtgaggactttatgaagaattttgctcctcaatatgacactgtccgtaactttgtctctaaaaagatcggtacattcactgaaagtatctcgacccgtccttctttcttcggatcgtctgcttttatcgacttgatccataccttgcagcttgaaatcaccggtgcggagatatcctttgcggcaccgctttcatttgatgcgaaaataaataaaggggatgtgtttgtcagtgatatgttcaatctgtataagtatgagaatatgctatatatgatgactttatccggaaaagaaatcaaggattatctggaaatgtcttatttcatgtggaccaaccggatgaagtctccggacgatcatctgctctggtttaaggagaaacgtcgcgaaggtgcggaggacagagcttctttccaaaatttcagcttcaattttgattcagcatcgggaattatttataccgtagacgtcaccaagccgcaaggggaaaagattacgattatcagcatggcagacggcagtcctttcctcatggataagatttataaggtggctttgaactcttaccgggggaatggcggtggagaactgctgacgaaaggatcaggcatcccgcaggagaaattgaaagagcgtatcatcttctctacggataaggatcttcgtttctatctgatgaattatatagaaaagaaaggtactatggacccgaaggcattgaaccaatggaaattcgttcctgaaaagtggactgttccggctgccgaacgtgattataagtttttattcggagatagtcaataagtaggcaaaagtgttctttttgacagataatctctcgccttaggttgaacatctcattattactggtatctttgtcgcaaccaaaagagagagtgtatggatatgcaagttgttcctaagataggtatttcttcggtagttcattctaaacatatagatccgggtagtattgatgtggtcggcaatgatatagcgctcttcgacacggagagcgttatttccctttataatggccccagtaaactggaagtggtgagcatcggactttgtctggaaggctctactcgttttaatatcagtctgcgtgagtttgaactgattccgggcagaatggttattgcgttgcccaatcagataatcgaacatcgtcagttcagttccaatttcagagggattttctttgctgtatcaaaaagtctgttggaatcattgcccaaagttggtaatgtgctttcattctttttctttctgaaagattacccttgttttgatctcaatctgcacgagcaggagatgattaaggagtatcatgctttcatcagaaagagattgaaaaataaagacgataggtaccgtagggaggtagtaatgggattgatgcagggcttcttctttgagctttgcaatattttcaacagttatgctccggatgcttctgccgttgtcaaaagtaaaagtcgtaaagaatatatatttgagcgcttctatgaatctttggttcagtcttatcagtcggaacgcagcgtgaagttttatgcggatcagttgtgtctgacgccgaaacatctgtccggagttgtcaaggaagtcagcgggaagacggtaggggagtggattgacgaattagtgatcttggaagcgaaggcactcttgaattcttcgagcatgaacatacaggagatagccgaccgtttaaactttgccaaccagtcgttcttcggtaagtactttaagcattataccggtatgtctcccaaagaataccggaaaagcagatagcttccaaaattacaaaactacagaacgcctgaacgtactcggctcaatgtttccggtgtcatcagcaggtaagaagcgatgtgtgccaaaggtgcccgtttgatgatttccggatgagtttcgagcaatagattataacgctcgcgggcggattcgaaacgccaggaatcggctttggtttgcgatacaatcagggaatattcaagtatcttccgatagaacatattgatttcccagttttgctttgtcagctgcatcattttgtcataagggaacaggtatatgacagcaggctccagtgtctctatgatcaatcgggtagggacttgtttcagcagactttcgatacacatcaggatacagccttcgtatgagaagtgttcggtaacgtcttttccgtttttataataatattgccggagcatccctttcccgacaaaaactaattcatgggctacttctccttcattaagtgcgatcactcctttaggatattcttcacgtatcaggatgctttctatctgccggcgtccctctatactcatttcgggaaagcgggaatttacgacggtatttacagtttctcttagtagtgtatccatgtcattatagtcttgttatgtgcaaaagtactaaaaacggttgatataaatcaagttgattcaaaaaagatgtatctttgtctccaaaataaggatgtatatgataatgaataagatagtaggaatggcagctttactgctttgtctgacaggttgtgtcagagataatgatgcaatatattaccctgtaggcgatgtggatattgaaagaggaggtccggcgttggaagtcggagaggaggatgtattggtagcgcgaagtttcaatgaagaagattatgtgctggatacgatagctcaatatccgaatgacccgactttgggtaaactgacgtttatgattgacttgaaaaatcaacagaaagatcagaacgtcgcagatttcaacggagtgggtaaatcaaaactgaccatgagtctaggctataaggatggcaattacccgtcggagagtcaggtccctatttatacttctcaggacgttacagctaaatatgcagtcaaacttcgtctgaaaggagaattgcttgtatccggtgacgaatggatgatcgattatgtgtatgcgcagctggccagcttgtttcagccttatccgcctgcgaatttccccgaagtctttatgtgcaagggaggtatgaagctggggactttcgattcgttccgaagaacctgtactttcgatatcacttatgatcgttccgacctctcttttagtcaattatacttcaatttatttatcaatctggccggtcagaagcgggaaaacagagtccgactgcggattgataaagagtcttactttgaattgtacgagcagagtgaagaaatgtaagtaagcagcgtttttcttcatttattgacgggtatccatgtgaaagacaatcgttttacatggatataacattcttttacagaaaaaact

SEQ ID NO: 177 - DNA, 15233 bp, Bacteroides thetaiotaomicron
gtatttaacatcggaatatttcgatgaacatgtcgacacaaaaggcgaaaaaatagaaatcccagttgatgatatattaaaaataaataagaaaataaatgagatcttggatattgaatttagctctattatagagaacaaccaaaaggagacaaagcgtaatttaaagaatttcaaaaagaagtacccctcgcttgagacatttattgaagatagtaatattatcgatgataaaaagatagtaaatgagaaagatattgtacaatctgctattgacgagaagagtaggatagagaaaaagttctggaatcaaatagatagagagtttgaaaatgaagaagataaactttttagtgattctgaagaatgttataagcttttaaactcaagtttgcatatatatgtcaaacatcgagaaagtgtattgaaacgtttgcatatgttaattcaaaaatttgatgaagacggaaatgataaatcagaattagaaagctctgtacgaactctttattaaaagaggaacaactttaagtgattcttcaaatatcaatcatttacataatctttggattcttgatgacaagttcacaacattctcaaacgatttcaaagttaaaagcaccaagtcagggcaacctttgtcagatgtttacatttgggctgatgacccagaaaaaacaaaacaaattctgatccttgagttaaaatcaacaacaaacgcacataatgcaggaaataccaaagaaggaatgatagcacaggttaaaagatacgctcacgatttttataagcatccacataaaacattgaattggactgtgaatacggagcaagtacaatatacaggtatcattcttgctaggaaatccgatatagacaaggagttgacatccaatagttttagtggcggatataaacctatcccattcctggcaaattcatattactttgaggacaatttttctaaggatgataatccgagaaataaaatggatattaggatagaactatattcctttgaagacatttatgaacttgcatcgaatagaaacaatgtattctttaagttattaaagaaagaatttgatattgaataagttaaggagaagaaagaagggaataaaactttttttaggatagggataaacggaattcataggtttgaatcattcattacctatcaaaagaaagcaagatacggtgagatgttaaggagcaggcagacatcctgaccgcccagtcattctccgagttccttacaacgttttctctcatacaatctgtcacatgtgtggacagattctcgaagcatgtcagcatcctctcaaggacaccggcttcaatgtagtatatttccatacgctcaatttttaatgttcgttgatacgaatgtaaagaaaaaaagacacctgctaaacagaaccagtccactggcaggaatagtcatagatagttagtttttgtcatatgggaaagaaaaagaaagccgaagcagggctggattcactcccccctttgggtatgtgaaaggaacgttgcgatgaaaaaaaactcctcttcacacatggacgaaacaacgccgagaattcggtaataaaagatgtggcttctctgcccgggtaaatgccatgattacagagttcttcatgttcctataccatcaggctggttaccttcagattaaaaacttatccaacctgtgacagacccggatgggaaaggcgatgataccgccggatacgcacatagccatatgtttagatatagagatacgacgataacgatacgcccttctatcggaataaggatatagcgatatacacggataaccatatataattatcggaatagaggtatggcaggttgtgggtgtatgacagcgtccatatacctgatttcgtttttattatcggtatttcaaatgttccaaaaaactctttaacagattaccatctgggatgatctcctaaattcacatgtaccggactttctatttacctgattaccaaacagccggaataccaacaaacaggataccttgaaatcctttttccctaatgacaatcggagaaaactaccataacaaacattcttgtacctgatggcataatatacctgaacagccctttgacggctgattgaccggaacttcagatccgagcttgtctccaaaaacagccggctatttgttgaaatctgtcattctgtaaccgtcccttccatccgttttttctctgtgggcgtcgtctttttttctcgtggtattatggtcatgttaccggatgggaagagccatctccatcacaaccatgaattatagtgtagccatatttgtatatagccagataatacgctagccggataatgctatcacagaattacaatatagctggatattaaaataaggatagccggaagcgaagggagcacgcacctttccagatacagatatcttaaaatctccatttacagaagtgtataaatatcaattcactaatggagaactataaagaaaaacataagtcacacatggctacctgtcattctccatttgcagatgtgtataagtagcaatccgttaatggagacgatgaaaaaacaataaggcgtatacggctacatgccattctccatttgcagaagtgtagaagtagcaatccgttaatggagacgatgaagaaaaacaataaggcatatacggctacatgtccatttctccatttgcagaagtgtagaagtagcaatctattaatggagacgatgaagaaaaaacaataaggcgtatacggctacatgccattctccatttgcagaagtgtagaagtagcaatctattaatggagacgatgaaaaaaaaacaataaggcgtatacggctacatgccattctccatttgcagaagtgtagaagtagtaattcgttaatggagaataaggtatgtaaagggcagattttccgtatattcgcctccttatccccgaattatgggcgtaagtcacatggttatggagatatatctatcttttaacggggagaacagccggcaaatatctgatggaaaagccaaacaaaatacaggaaaatagccacacaacactctgatatacaataattattggataaacgtggtccgctcctgcggacagcaagttgtgttttggttaaaccaaaaccgtacggtttaacggcaatcgtgctgccaaaccataccctccatgaagctccggagtcgcttctggatggatattaaaagcgaaaatgtctaaaagtgttagtttctctcataaacattatgtaataccgttaatatgctatataacctggagagagtcaatagcagtacgggactgtgcaaatggccgacatcctctccgagtggtcgaaatacaaggtctactgcttcctgaaatacgatgccgaaaacgagggagccatgccggcgattgccgtgggccgcccgtactcgtcaagcaaggcgcagccggtcttccccgaagacgaatcaacgggtccgttcaaaatcctgttcaacgagcacgtggcgcagagcaacctgaaagtcgtcaagaccgacccgaaattcctcgccgtcacgggtaaggcgctcagcaccgacgagaaattcttcgaggtgactgtccgtctgaaccccgagtacgacccgacgattgccggcagcaggcagtaccagacggtgaacgccacgcagatttccaaaaagacgcacaaggttaccgggaacacgaccgccaagggcgccgtgacgaagacgaaagtcgatctctcgacctacaccatcgtgccgtacatgtcgccgcacatcggcatcatctccgaccagctcgtggaggagacgacggagtatttccgcaactacaacttaaatggtatcaccgggacagtgaccgcaacccctcgaaaaacggcgtttacctggtggaagaggtcacgaccacgttcggcgtgggcgggtatcgtcagcggttgaacgtgccgtaccggataaagtccggcggggattagtcccagtcgttgaaatcgtcgggttccacatcgatacaggttaccccggggtagagggtttcgtgcgcgtggcagtggcattcacattccccgttttcttcccggcaacggcactcttccccgtggcaatggcagcatggcgtcccgttgccggcattcatttcattattatcagtcatcgtttccatttgcagattcataatacgggcacaaaaataggtaaaatccggatagatttgatattggcggttataatgatgaataatgaagccattctgaccacccatgttggctggttacagcatatggctgaatctttcaaaattcaagaaattaaaggtaaaagtacagataatataaattacgccacttgcaccctggataccttttggttaatatatcatatgtgctaaagacaggatatccctatctttatctgaagaaagttcgaattgacgggactatcggtgaattagccggaactgtcgggactcattatagagagacaggaaacaggtttgcagtgaaactgaactctgtcatttgacatttgtcatccaaggattcattgctattcgctaaaggagcgaacagcaaatgaatcctgatgtataatttattttcttgactgcaatcctgatgttttattgctcattatactcatactccttattgtcaacaacgaatgttgcatttttatgatttcctacccgccattccactttcccatcggaatattccgcagttttggcagaagcctctgtctggaaaagagtatagcaatgttcaggagcggtagatataagtttgaccatgggtttttcgccggcagtataatatacaacatcaaaaaaggttggattggtctttgttgccgacgaataaatacaataatcaggtgtaaggcggtcaaatgtataagaatttgttccgtcattgaaaaccagttcgtctgacacggacgattgtttttgttccgacggcactttcaaggagcagtttttgtccgcatattcagaaactaaatctgttttttcctttaatttgagtatatgctttttggccttgaaaaggaagtccgcatactgttctccttgtttctcatataatttgagggttacattttccccactttgagattctttcaggagttgcgaagtacagaattccggaagttccgtttggagggaaatccgttttaggggcgtatccttatataacaagcggccatcatcggatttgagttccatcttattatccaaaagaatcttatcaccgggtagatttccggcctttccataagtaacaaaagttccgggacgcgtgatatatttctccagtaattcatactgtcctccgttaatggtcaataagacatagatgcctggacaatcggccgcaggcaatatgccttcataagttccgtcgtatggcggttgggaagaccggcatgatgataaaataagaataaagccccaaagtactgactgcaatatttttttattcatattctatagaaagtttttatgcaatagtttcgtgtcattaggaataacacgaaaactattgcgatgttcattgaagtttctattttccttcctcgatagtacagatgctgacacgattccagtccgcttccgagaacatattgcctatgccttgtcctttcgcagtaatgcggtccgcactgatgcggtattttttgactaataaattcatgacggcattggcgcgcgcttgggctatccgttcattgacttctatgctgccttcgggagacgcgtatcctttcacaacgactttggcattgctgtgtttattcaggtaagttgcaattcgctccacattgggcaactgggatgcatcaatggatgattttccttgtctgaatgtgactacagattctaacgttttggctgtttctacaacagtctgaacctgtggttcccgcttctgacactcttccagcatctggctgagctgcgcaagtttttgatttgcagaattcaaatcctgttttttagaatctacctccatacgcagctcattaatactccggtttaaaccgtctatttccgcctgatcataaggcttggtcattgtaaaataatgcttaccgttactgttcttgaaatggtaaacaataccggcagtaatttctacggcggcattattggcgttgaaacggctccggtgctcgttgaagtctccttccatgtcatacaccagtgcaggttgcaatgccaacgtccatttcttttccgaacctaaattaaagttgaagttcaagcctattttcgtgctccaagaatttatatcaccttttccgttttcataataatgtagccaaccggctcccaaaaccgtctccatctcaaaagtacggggaactccatgatatccacccagcagattcataagattgaactttcccaacagactgatattggatgcgtcaaaagcagtcctgctgttactcgtattaatatatcccataccttcgaccccaagtccgaatgcgggagtcaactgtttggtcaggtccactccaacggcaggacgcatattcttaaaaaaagcgctgtgggtaagcggagttactgttccgccctttagtccaacagaccaattatcgaaaaatttgtttccctcaagcagggtttgacaataagcactcaatgtgcttgtacttaacaagaaatagaaaagaatctttttcatacattaataaattaaattagagttttgttatattcaaatgatgcagaatacaggcttacacaaaaggttcgacagtatctgtattttatcttttaatccaacatgtggcatctgctattttagaatattgttgttttaactaaaggcaacagatacagaaaatcgtctaagggaaaggcactctttcaatgacaactcctttcctgcgtatttcattgggagtatctccaatatttcttttacagaaagtggtaaaatgagaaaacgttttaaaatgatattccagcattatttgcttgactggcagaatattctctatcaatttaagcttgatttcgtgggaagtccgcttttgcagccatcggtatggagtctccccagaaaaacattttttgaataataaattgaacatggtatcattatatccgcataaaacagctaaatctttagcggtcctgcagcttttgtaataagtcatgacagatacaaaaaaacgcaattcatttgacaaggcatcacgaaagaaggatgctatttcatgttttgagtagcaggtcttgaataatgaaaaaagttcatattccttggcccggtgcagttccgggatttccataccttgcttcatataatcaaccagtaggtcaagaaaggaacgcattaacggataaacaggaagaacctccacaggcttgactttctcaagcactatattctgcagatattttattaccttatcatgaaaataaggggctacaatgttgcatgcatgaacgacgagatgcacgtcatctattgccctgactttacatttgtgcagacaactgataaagaacagctcattttccattacgacctgtgacatagacttaatctggtccctaaaaaaacataatgttcccttcaacacgaaacagacttgaaattcatgggagtcattcaggttctgaacagtctcccccttgcctaaataaaggcatctgaattgactgaatctggataaggcaaggggatcgttatataaatcgttcaataaaaatagcttttccatatatttataatattcatgctaaaagcattatttctttaaggcaaaagtaaaacaagaagccaaatacaaaaaaagaggggagtaaatataaaaccaaaacattgataatataaaactaaaaataatatccatatcgctatctgttatgattgtaaacacagagaggaggatttccttctacagccaacgattttataagacagaaatattggaacgcaagcatgataaatatatccgatatcacaacttattggataaagtgatgaacgtttcatgatttattatttttctaataattcttttctatgatctttatacttaccgctttcagttgttgccagccggccttgtcggtcacccggatcataaaatgataatcccccgtatcaacatcttccggaataggaatatacactttggcattataggtcgatgcgctttctggaatctgaaaatcctggttatatacccagggctttacgggtttcttcttctcctccagcggacaatctccggcatcggtactatgggtatggtggtcgaaattgtgatgtatctcgatattatagctgcccagacccatattgtcagtaaaagtatatatgaaagggatttcttctcctttcacatatacctgacagttctgcggtaacgcctcgctatcggtttcaatgaccggcttatccaaatccttgccgttctcatccttgctgcatgcagcaaggagaaagaacataaaggcacaaggaagaatgatgctcctgctttttaccatgattcttattttacggttatattaaacttttccttgaatatcttattggctcccagggcatattccactctgatttcaagaatatattcgcctgcagccgcataattcccatgaccatccctggcttccaagctcttgttgaatgcgtattccttcaaatctcctttagaaaactcatccgccaacgtactattataaaaatactcaccgggtgcagcctctttatagatgcgtatacggatggaatgcaaggcgtcctccgcctttactctgaactttgtcagaatatcagaggcaagtgccgaacggttggttccaatttccactccgtacacttccgcattgcttttcctgaactgcacaccctccagtgaattttccgatacttcgcctttcttgtcgtatacattgaaatgcatgtgataatctcctgcaggggcattgtccggaatcgcaatatgcttatgctggcctccggtaccccattccttctctccattaaaagtataggtagtgtccagttcgaatgaaggtgttccttcttcactatgtatgaagaccgtaatcttttcgagtccgttttccgccttgatatgtgcggacaccattggcttggtacctgtataaccgatcttattatcggagaaatcatgggaggcgccgaacttcaagtcttccacgatgatgtgtgcggctgccgctttcaccgtcagttccgattccctggtttctgtctgtcccaaccggtcggtaacggtaaaatgcaggtgatattttccggcaggcgcttcggagggaatctctatatgctcatggaaatgagcgttctttacacctatatacttgccttcggtgaaagacttttctatcttgaaatcgccgccgtcttcctggtggatctctatatcaatacgcctgatcagattttcggctatgatctcgccttccaagtggaggtcacttccggcaattccggttttactgttttctttgcccacttcattcaaaccaacgattggtttccctgtgctttctttctcatcatcacaggatgaaaaggtaaacatgcataaacccatcaatagaactactgtcaatactaaattctttttcataatcttctttttttatttgaaggaggtaccggtgctttgttttccggtacgttccttcgatgtttgttaatcaattattgtttaaaaatcaaatcctatcattaaagaaaagttacgtcccggttcgggtacgtcaatcagccggtaatagctggtatggtcgtaatacttcctgttcagcaggttcagtccctgaaagttcagtcttagccggaagtctttccatacaaaagcctttccgaccgccatattaagcactccatagccccgggttggcttttcgggagggacaatcccattctgatcgccgacaattttatacgttgccgagacaaaccccgcctcacgtccctccctggcagggtgcgtgtattttaattccacactggcactccatggaggagagaaaggcagggtatatcctttcttgtcaccggagagttgctccgcatacaggtattccccctttaatccggcctccagacagcatatgggcttgtaattgacttcagcctcaaatccgtaacgaatcacccggctttgtgtgtaataataggtttgcaggccttcggtatacgttgaggtcgggttcaaatagatataatttgggaaatagttcaggtaaggatctatttgaatattgaccgcaccggtgtgccagttcattccgagatcaagctggtatgattcttccggggataagccggcgcttcccttttcgtaccggaatatgtggtaattgattccatcagcccccaattctttgggaatcggcacacggaagctttttccgatatttactttcaatatccattgcccggcactgtaattaatccccagcgaaccggtgagactggtgaaagagcgctttaaaccggcggctctttctttaaagacggaatcggcttcttccacaggtgtcttataccagtcatgatagctgtgaatatgggtgtttactctgtccagtcgtaatccggcgctcaatatcaggttctcaagcagaaaataacggtccatgacatatcctcccagcgaggttgtctcaaaatcgggaatgataaatccccagccgccacgtctgttatgctgatactctgcattcaccccagcattaaggctatgctttccggctatcaacactttcattccaatacctgccgtataagtattcttggtgtatttcctttccagggtattggaaggcgtaggcatatagccgtgtgagaccggctccgacaattccttgcggagattgtgctggaatgacagattgccctcccaacggatgttccctgaatgccatgttgaatggttcataattttcagatggttgaccagatggtacggcagatcgatatcacgtctggaacggtcataatctatatccgacagccgtacctccaaaccgtgggcattggcaaaaaatccgcttttggtataaatatcggatattttgaaagcggtggagaaatggtctcccacataccctaatgtaaaactcccgtcctgttctttgcctgccgtattgcgtaaacgccggtcctttaatttaatgtaataggaataatattgaatgctgtccgcgggaactttgtaatctgcataatccaccagtgtcaggcccactttgtaataaagcctgtccctctttcccgccatttgtgccgaaagaccgaccgattcgttattacttcgcataaaaagttccgccctgctttcatacggtctcgccggtatatagtcgctatacaggtttatgacccctccaatggcatccgaaccatagagcagggcagccggtccttttatcacctcaatcctgtctactgaaaactggtcaatttcaagaccgtgctcttctccccactgctgcccttcgtgtttgatgccgttttccgtcacgaccatgcggttgaaccccagtccccttataaccggtttggattgcccggaaccgatattcatcgccttcacacccggtattcccgccaatgtttgcggcagactgcctgaaagattcatttcaaggtaggacttgccgattctgacaagactttgggaggatctcatctgagtatcccgcctgctgtcatttcccatgatgaccacttcgcttaacgtcacgccatcctttgtcatgtccggaacactgtcctggtgctgggcatgagaatgaatgatgaacaggaatgacgcaacggttgcaacaactcttttcatcgctatttttttagattatcgatagaaccttctgccggaaattattccttaaaatccggcatattagccatatgccttcctgcatttgccgtcggaaaaggatatacaatatccgtatttgtataatcgaatgatacaaatatcatatgccataacctgttttttcggacagacaatgtgcaggcacacccacaatggtgtggcaaattttcgcatttgtttatagtaatgcagataaagagggaggggcgcgcagattatacggatgaacgggctgataacccttcatacccatataagcaaccggttcataattaaaaagtggaattataatctgaatatggaaagattcagcctgtgtaaatggggaaagggtaaaatggcagacaggacattgattgcaggggctctgaggatgcccgttgtctgaatggcagacagcaatctcttcgtggtggtgcatagccttcaccacgaagacaggcatgagtgtcataagtaacagccatgcgacagcaattctgttttttgtccttactttcatctacctactttcatagaaacgctgcaaagataataaaaacattcaaatgaaacagttttcagacatgaagcattgtttcatttttttagatatcatcagaatacctataaacaggtgtttgttcatgtcgaaacactgtttcaaaatcccgaaccatgctatctgcttgttttgatactttctgattattaagtatatttgcaatataaaccaatcagccattatgagtgcaatagatatattaagggaaaaagggcttaaaaagagcgcccaacgaatagccattatttctattttgcttgacaagcggttcccgttgacagaaagtgatatcaaggaagaaatgggcgatatgtatgaccggatcacgttttaccggacgatacagactttgttggaagcaaacattattcatcggatcacaatagacaacgttacggccagatatgcactgaataactcccccaatcacagccatattcatttttattgcaaaatatgtcattctgtaacttgttttgaggatattccattgcaagaatatcacttgcctgagaattttgaacaagaggaatgtgaggtcctgattaaagggacatgtaataaatgtaaagtcgaacattcttgaatatctaagacagggataaataaaattcacgacaaaatctatttgtcgtgaattttataagattggcttttagtcttcttttcccaaaaccttccagtactccatattggtaaccttttccaataaaatttttctatccccttcccgaatgttgtcagcagctacaggcggaaccaaggcagcacgattgccgaatccacgccatttgagcatatggctggggaccccgcgttcaagcaaggctttatataccgcttttgcacggcgctcagacaaccgcaaattatactgcgcgcttccacgggcatctgtatatcccgtgatcaggaaatgactatccgggtaattcttcagcaaagctgccagcctgtccagaatcttatgggaaacaagagtaatcacgtccttgtcaaattcaaaatgaatattctctaacaaatcgcaaaataccgtatccaccatgacaggaactttctcttttctctctacaacccgttcaacgattctttccacctcgaccggcttttccacctctacataccgaactactggaggtgtatgcttgttctttccgccaatacgccagataacactggcagaaatctgcacgaagtggggaagactcttttgtacgggtagaagatattcaccttgcagacctagcccgaacgagttacttaaccaggcttttacccccgcgccgaaagacagggggataaaggagttcttatcggatgagcgcccgtcagggttccatgtatcaaaagactcccaacgcgcttctcctgtaggatcatccacaaaattaccgccatatacggaagtaaaatccttatgcagataatttaccccgactctaagatacggttccacccatttggacttgaacaagggggtaaaacggaattgcaagcctaatccccccatgtacagccaatcatgtttcctgccgcttcctgtggtacggttgttgcttgtcactccgacagtcccctgcaggtccagataaaaccatcggttcaattcccgtgccacgtacaggttagccccacccatcagatgatttgccttcagattataaaagtaattttccggtgtgctccggaaaccggttatcgccacacggttccagtttatcagtgaaccaccgacaccgatctcccaggcttttgatgctttttcctgttgtccgtcgtgtatggtcacttcttcctgagaaggtgcgcgacgggttgtttctgtgtcttgccctcttgctaccaaagagactggcagcaaggagaggaagacaaaacctatcatttttttcttcatattcatattcaattatccgataaataaatcaatccatccagtcagccggacaatttttgactgccaaaggagttttttgggacctgtctgcaaaatcaactaaataatactgatcgccctctttggtcaggtagtaagcgtaacgcccacggtactcgttagtattgtagaatactatctggcttccacttttctgccttgagcggacatccacgccaatccagttgttgggataggcgcttgtcaggcagaaccgtctgccaccctttgaaagttccagcgttcccgtatgtacggttcctcccgttccgttgatgaaagtacgcatttgtatgaacacagcccggttatcagccaaagcggatgcagaaaggttgccttccggatgtttccagatattggtaccttcctctttctgcaatctatcttgtcctgtcgggtaagagtatgtcttataaaagtccggtaacttatccgtgtcaatttctccccatagggtggtgacaccctccttgatttcgacaaagacactgttctccttgaaacccggagccggatataattccggaacgtgtatcttatcctgtaaatatatcgtctgtccatagtcgttggaatttccctcaccatcaccgaaataaaggcctacatagttttcttttccgtcccactcatactgtttcaaccggttgatagtatcattctttgcaatattggccttctctgttgctgtaaagaccatcggacgtattatgtataaataagtatcccctccgctataacgttttaatttacttttatctatattctcttcatttacaggttgatttatatcattaatc

SEQ ID NO: 178 - DNA, 15222 bp, Bacteroides thetaiotaomicron
tccatcaaccaattaatcaattatatataagacacttatacacatacataccaagtcctattacgacttagccccaattaatcaatatgattataaccttaaattaacatttatgaaaactcttagcaacagccctccgcctttcaaaatcggagaattcgatctcatttttttacttttatttcagcacagatcagaataggtatgatatgtattctgagttcattatcaacttcaatacccccaatttaagaagatgaataatagcagtcaaacacacccatatattttcaaacttactcatacatacaaaaacaaacgtataccccttgtatgcataccctagttctacccacatagtagacacacaagagtaggtttccctatcacttttttttaaccaatctaattattaaccttttatcacagaaaaacaatgcgaaaaagaagagtttattggacgctgttcattacagctttcgcgtggttagcttcctgttcagatgacgacatcaatggaagcagcgggttcaacccaaaccagcctattgagatcacagaattttatcctgattccggaggtatagccactccgatgatcatcgaaggccgcaacttcggtacagacaccactggcatgaaagtctattttgaagatgtagacgggatcagacatcctgccggattagtcagcagtaacggtagcagaatctatgcatttgttcccaaaggactcaccttcaaaagagagatgaatattcttgtagaaagaagaacgcccgacggtcaagaatacataggcaaagcaccagaccaattcctatacaagacacaaaccagtgttagtacggtagcaggacttgcatcaccggacaataatataaacaccgttggtggtgaccttgccacatgtactttctcctctcctttctatctctgtatagacggtgaagacaatatatttgtggtagaccgtaaaggagacagtggaaaagacaaacaaccaaacacaacctgccgtaatgaaaaaggtgaaggcgtaaacggaaacatttcaatgatttccatcgccagcaattcttccattgtattaaaatatggaactgcatatattaatgcacctgcttattctgatgaaaaagatgctgaagctgtttacattccggatgatgccggcatgaaatattatgatatgcaaaaacttctaaattatgttccccgatatagaacagtcttgaaatcagaagaactcagcaccgtagacgaaaacaactggaagcattgctttgtaatcaacaagctggatcatatgatctatacggtcatgtggaaagggcaattggttcgaatcaatcctaaaaaccgtacagcagaaattttgctaaagaaaatatctaatgtagcaacaggcgacggcggcaaagcaggaagtgactcctatatcgcattcagccctattaaaggagaagaaaacgtactctatgtatctcttgcagattttcaccagatttggagagtggacgtatccaagatcactccggaagataaagacacttataacggagaatcatacgcaggaaaagcaatctacgaaggagttatgaacgggaagggctgggaagacggcttgctgaagaacgccaaattcagacacccgcgccagatttgtttcaccgacgacggaaaaatgtacattgctgacagtggtaattcctgcatccgcgtaatagatactactatgccgaaagaaagagcagccgtaaccacacctatcggtctgccgggagcggaaggttataaggatggaggtccggaaattgccaaattccacttcccttgcggagtagcagtcaacagtgatggaactattgtatatgtagccgacacacagaacaaagtgattcgtaaattatccattgaataaccttatacaaaatacaatatgagaaataattttctactgattgtactgatcatggcgcttataccgctgacgagttacagtcaagacaataagaaaaaacagtttactgtagcgggggtcgtaatagacaaaaccggtgaaccgctaccgggtactaccatttatgttaagaatgcaccgggagtgggaacctcagcagatatggatggtaaattcagtatcaaaatagatgccaaccaaatattagtcattcaggctattggaatgaaatctatcgagaaactggtgactaaagatgaaatgacactcaaagttacattggaagaagatgacaccaagcttgacgaagtagtggtcacaggtatgacttcacaaaaaaagatatcagtagtaggtgcaatcagtaccattgatgtagcccagctcagtactcccggtacttccctcaacaacatgatcggcggacggttggctggtgtcatcaccatgcagagttcgggcgaaccgggaaaaaacatctccaacttctggattcgtggtatcagtactttcggagccagctccggtgcattagtgctgattgacggtatcgagggccgccttgaagacattgatcctgatgatgtaaaatcgttcagtatcctgaaagacgcctccgccaccgcagtgtatggtacccgaggtgccaatggcgtggtcttggttaccactaaacgtggagaaacaggcaaacttaccatcacaggacgagcaacattaaaagtatcgcacatcaaacgtctgcccgaatacctgggagcttatgactacgctctccttgccaatgaggcacgtgccatgtcgggtgaagacgacctttactcccgtctggaactggatctgataaaatacaatttggataaagacctctacccggatgttaactggatagatgaaataatgaaacgcacatctatccagcagaactattacatcaatgcacaaggaggaggcgacatagccagatattatctttcattagggtatcaggatgaaggagcggcctaccggcaggaagacaacctgttcaaaaagcctttgtcatataaaaaaataacctatcgtgccaatattgacatgaatctgaccaaaacaaccaaagtttattttggtctggacggatatatttccaactataccagcccgggtggacaaaacacgaatacggtatggtcagcagtccgtcagctaactccactgatgtttcctaaaacctattcagacggtaccttcccttcttatggaaaacatgaccttgcttctccgtatgtcatgctaaataacaccggatacacgcaagatgaaactcagcgtaatatgcttacactcaaacttgaacaggaattcggaggattcctgaaaggaatgacagcgtcggtacaagcgatgagcgaaaatatcaattatttcaatgaaggacgttacatatggcctgacctctaccgcgctacaggaagaagttcacaaggggtactcatcaaaacattgcgtactgccaaagagaacatgaaatatacacaaaataacaacagatacagaaaatactacatggaagccaaagccaactgggaccgtacatttggtttgcactcactaggagcattggctttatattacatggaagatgttcataacacccaatgggactatgacgcgatgggtattaatgccattcctcaacggcgtcaaaacttatcaggacgcatttcctatggctataacaattgctatttcattgatgcaaacttcggttacacaggttctgcgcaattcgaaaaaggaaaaagattcggtttcttcccttccattgctgtaggctgggtaccgacatcctataactgggtcaatgaggccattccctggttaagcttcctcaagttccgcggctcctacggtcaggtaggtaatgaccagatcagtggtgaccggttcccttatttgacattaatcaatgacaatgccgcctcttactggggatatcgtgaacggggtattacagaaactgtgaaaggagccgacaaccttcaatgggaagtagcaaagaaactcaactttggtatcgatgccaagttcttccacgacaagctctctgtcactgttgactttttccgcgatacacgtgatcacatcttccaggatcgtgtgacgctgcctaagtttgtaggtatggttaccgtcccgaaatcaaatgtaggaaaaatgcatagctatggttctgacggaaacttcgaattcttccaccagatcaataaagacatgagcttcactgtacgcggcaattacactttctctcagaatattattgattactatgaagaaaacaagttaccttatgattatctgagtgtaaccggaaaaccctttaacatccttcgcggatatattgcagaaggtctcttctccagtaaagaagaaatcaacacaagtgccgaccaaagcggattcggccgcattcgtccgggagatatcaaatatcgtgacgtaaatggagacggtattatcaatgacgatgacaaagtacctttgtcctattccaaccaactccctcgggtaatgtatgggttcggagccgattttcattggaaagacttaaccctcagcttccttttcaaaggttcggcaaaagtagactactaccgttcgggactcggtaatgacgcaggatggattcccttctataacggagaactcggcaacgttatcaagctggccaacaatcccaagaacagatggacgcccgcatggtattcaggcaccaccgctacggaaaatccccatgcagaattcccacgtctctcctacggaggcaatacgaacaactcccagctttcctctttctggaaacggaacggttctttcctgcgctttcaggaactcagtctgaagtacaacctgaagactccatggataaaaaagacaggactatcttctgtcgatctggagtttgttgccaacaacctttttactatcgacaaagtgaagtattttgatccggaacaggcatctgcaaacggggccgcttatccgataccggcaacttacacgttccaggtttatcttaaattctaaaaataatatagaacactcatgaaaaagttattcaaaataatattgggagcaacagtaggaagtacactactactcagttcctgcaattttctggatgtagacccatacttcgaagctactttcaaagaagactccatctttcacagcaagaaaaatgctgaaggttatctctggaacactccgaaaggttttcccgacgcaggggctatctggggaaattcctggaatccgggggaatctgcttcggacgaaataacacttaaatatcagacaaatgaattttggggactacaattttccgtaggtaccatcaacagcagaaatctgcctatccaaaaccaatggtacgacatgtatgtcattgtagcaagatgtaacaaaatgcttaaagaagtctacaatgtacctgatatgaacgaaatggacagaagacgttatatcggatatgttcactttatgcgtgggtacgcttattatcatcttttgatgaactggggaccgttgattatcgtgggcgatgaagaactgagcacctccgaacctgccgaatattataatcgcgaacgggctacctatgatgagtctgtagattatatatgcgatgaattccgcctggcaactcaaggcatctattcggcggatgagcaaagcgtcaactattatcaacgtccgaccaaaggagcagccatggcactcatcgcccgtttgcgcctcttccaggcttcaccgcttttcaatggcggagctgcagcccgtaaatgtttcgggacctggaaacgtaaaagcgacggagcctactatgtcaatcaagagtatgacccgagacgctgggccgttgcagcagctgccgccaaacagctgaccaaaatgggatacgagctacatacagtggaagcagatgcccagaacccatatcctctggcctccaatgtccctactgctaacttccctgacggagcaggcaatatcgatccttatcactcttactccgacatgttcacaggagaaggtatcatacagactaataaagaattcatctgggcgatggaatccagtaacgtcactaactatacccatcactcattccctgtcaagtttggcggatggggttcaatgtctgtgccgcagagggtaattgattgctatctgatggcagatgggcggactattcataattcatcggcagaatatccatatgaaccggacttcagcagactcaccggcgaatccaaaaaactggggacatacctactgagggaaaacgtacctatgatgtacgccaatcgttcggcacgcttctatgcctcgataggttttccgggtcgctactggccgatgagttcagcttctaccgacgcctcctacgtcaatcagcaattctggtattctcacgatgataccaatgccggaattgccggtgccggaaataacgtaaacgactacagtgtcagcggttatgttcccgtcaaatacattcatccggacgactcatgggctaacggcaaagggagtgtaaaaggcgcattcgtcaccagccctaaaccgttccctatcattcgttatggtgaagtgctactggaatatgtagaagcattgaaccgtgtagaaggtacagtgaccgtagaagtatccgacaatacaggtacacttattgaggaaaccgttagccgtgatccggcagaaatggctaaatatttcaacatgatacgttatcgcgtcggcttgccgggagtagatgccaacgacatggcagaagcagacaattttgaaaaaatcatccgcaatgaacgtcaggtagagctctttaacgaaggataccgatatttcgatacgcgcagatggggaacctatctggacgaagatgccaacagctccaactggcggggactggatgtgacaaaagaccgtacaaatgccaacggtaatgaaggattctggaatattgtgacgatcaatacacaaaatgtgcgagaccgcattgcactgcctaaaatggtattcttaccgatccgccatgatgaattgctgaaggttcccaatgccgaccagaatttcggatgggacagataatatcaaaacatgaataacagactgaatatgaaaaagaaatttaatataatgctctgcacccttataggtgtattgagtgcttgcaatgaatacgatttcgaccaggaacaataccggaacgaagtaggcttactcagtaattcgagtctgatctacgaccggcaggtggctaatgtaggacaagaaaaagatacgatctatctggttgccacggttagcggctcacaaataagccctaacacacaccatgtagctcttctggaatcggactctttgctgaaagcatacaacaaatccaactttgatatagaaaaagaaaaatttgccaaactgcttcccgatgaatgctatgattttcccaataaggaactggatattcaggcaggcacttccaaagtaatgtttccgatctatctgaaaaatctggaaaggatttcaccggattccatttattttctggattacaagatagatccggaaaaaacacctaattataatccggataaaagtcatgtattattgcgtatctataaagaaaactattacgcaacgacaaagacttctacctactacaattatacaagcagtacgattgtaattcctaaccccagtggtagtcccgaagtccgtagaccgacaaatgccaatcaagtattcccgatcggtgccaattcggtacgcatgatggcaggtgatgaagatcttggcgattataagacagcaagaagcagaattgtatctaagagtatcattctggaaattggcgagcagcaaccggagaatcctcaggccagagaacttaccatcagagcgcatgacagagttaatgatgtggaagtggatccggtcgatgtagtacaacttactccaatcgatgattacgacaacacattcctgttaaacgctatccgtactcccgacggacgtgccacttattacaaagagttccgtctgcattataaatatcgcctggaatccaccgccccttaccgggaagtgaaagccaaactacgatatgaatttaacccaagagtagataacttgtaatcaaatcaaatgagtatgaaaaaaaatatattaatcatcgggctcgcaagcatattcggaattgcttccggacttatctcttgttcgcccgattacgaaaccgagtttaaagtagaaacgctcgtagttcctgataaaagtcaggcacctatcactttcccacttctgggaggagaacatgaaattgaagtgcagaccaatgtaccactcgacagatggagtgcccagtccaatgcagaatggtgcaaggtagtacaacacgagggcaaagtagtcgtatctgccagtgcaaacaatatatacaaacaacgccgggcagaaatcactgtagcctatggtcatcaaagctattccatcactgtctcgcagtttggtaaagaaccggccatccttataggtgacaagctacaacaggaaggatatgtagaaataatagatgcagaaagagaaacattgacaattcctgtagcgaccaacctgaatctggataatatcattataccagacacttgcaactggatacgtctggcagagcaacctgccacatttgatgcaaagacgcgtgcagcggaagacgtaaacaaacaggaactgaaatttacgctggataaaagcaccgagactgacgtacgttattgtacgattatcctccagtcttcccagaattacagctatacagcttctttcctgataaagcaacaacccagaggttatatagtcgaaatcgatgaagacaagaagatctatgaagtgaaagcaatgggagaaacaatcactattcctttcaaagtaaattctcctgccggtgaagtgtcatatacctatgaagtcgaagaatccgcccaatcctggatcactccagtatcattacccgcttcaagagcactgcgtgatgtctccgaaagctttatcattaaagccaacactgaagttgagaatcaacctcgtgaaggaaagataaccttcaagagtaccaatagcaccgacaaagtaccaagtcagttcgtagtcacagtaaaacaggccggatttatcgcgacacctcctttaaatgtgatcaatgctactgctactccgggagccggaagtattcagctgcaatgggagatacctgaagatgtagacttcaacaagataaagattacctattacgataaagtcacgaaagaaaataaagagatcttaataaatgactataagacaacatcctatatcatagatgatacttaccaatgtgcaggtgaatactcatttactatcaacacctatggtccgactggtatggagacagatagtccggtaacaataacaggcatttccggcgaagcttccgaaatggaacgtgttactcttactatcgatatgctttccgacaatgctaatcatgtcggagacggaggcggtttaccggcattgattgacgggaaggtgaatacttattatcataccaagtggaatgctcctgttacaacagaagcacattatgtccagatcaaactgaacaaaccattaaaggacctttgttttgaatatgatgcacgtcaaagcggagtgaataacggaggtgacgtaaaagccgcaacaatatatggaagtatgaacggtgagttctttgaaagtatgggtaatgaagaattcaatctgccgacaacaaacggtggccatgccacagctaaaaacaatgtgagtggaaagcaagcttacaactatatccgatttactcctacggctcgccgtgacaaagatccattggattatactgtcgcaggcagtgcatggtggaatatgtccgaaatatacctttacagaataagacatgatgaagcctgggcaagagaacagctaggcatttaagtaaaacaagaaaagactgacgaagaacaaaataagatcagattagacacattttcttatcgagttcttcgccagtcttacttttttataaaattggatgataagaattatgaatatgaaacccaagaaattaagcctcttattaactatcttgccaatgattattgcagctacaggttgccattcccagcaagagtctaaagtagacatcactcctcattgtatcaatcttcaggcagacagcctctaccggcaagcaatgacattaatggaatcttcttgcgatgtagactccacccgaaaatgcatccgctttctggacaaagctttggcaatcgacagtttaaatcccgactattacggcatgaaagccaaacttttatctgaaatgggagaactggactccgccctatacatacaaacacttgctatggagaaaaacgcaattaccggtgagtatctgttccaactgggactacttcaagctgccaaagatatgcacgctgaagctcacgaaagttttggaaaaagcaaggtcttccttcaagcagtactaaaacaatatcccgacagcttgggagcttttattctggcagaagctgccaattctctctacgaaaataaagattcacttttcatgagaaatatagatgaaatccgtaaacgctttcccgaaaggttgctggaaatagagatgacccgaagggtgaaaccgcattcattggtcaatcaaataagaaggattaaaatagaaaaggattataatattgattttgatatggatagtctggttgaggcgactgtgaataaagactaagttccaactttcctccccttttctttgttctttcagccggaatagattacttttgtcttattccgtgagcaatgaactaaaataacaggaaatatgatagaagatgtgaaaagaatcccatatggagtttccaatttcgtggaagtggtagagcagaatcaatattatgtagataagaccatgtatctgcctctgctggaacagcagcccaacagtctattctttatccgcccccggcgtttcggcaaaagtatcttcctgagcatgcttcgcacctattatgatatttcgcaaaaagaaaagtttcagaaacgctttggtaatttgtggataggcagtcagccaactcccctacagggaacttttcagatactttttcttgatttctcacgcataggcggaatcgacggtacattggcacagaactttgacgattattgctgcggtggattggatgacttcgcatccatttatgaaccatactattatccgggatttgcattagaaatgaagcaactggaaggttccaccaataagctgaattttctggatcgaaaagcccgcaacaatggttcccatctctatctgattattgacgaatatgacaacttcaccaacgtggttctgaacgaacaaggtaatgaaatctatcatgccctgactcacgccagcggattctaccgggagattttcaaaaagtttaaaggaatgttcgaacgcatcttcatgacaggtgtcagccccgttacattggatgatctcaccagcggattcaatatcggctggaacatcagcaccgatttccaattcaatatgatgctgggattcagtgagacagatgtgcggaccatgtttcagtactataaagacgccggacaactgccggcagatacagacatagatgcactgattcgggaaataaaaccgtggtatgacaattattgctttgccaaagaaagtctggaacgtgatccgaagatgttcaactgcgacatggtactttattatctgcgtcattacataacgttggggaaatctcccgaacaaatgattgaccctaatacccgcacggattacaataaaatgaaaaaactgatccgattggacaagctcgacggaaatcgtaaaggtgtgttgcgcaaaatcaccgaagaaggagaagtcatcaccaacttagtgacaaccttccccgccagcgaaatagccaatccggaaatctttcccagcctgctcttttattatggcatgctgaccattaccggtacacgaggagtccgcctgatactgggtattcccaacaataatgtacgcaagcagtattacgattttctgttagaggaatatcaagagaaacggcatattgacttgaatggcttaagagatttatttgatgacatggcattcgacggtcactggcaaaaatctttagagttcatcgctcatgcctacaaggaaaactcctcagtacgtagtgcgattgaaggcgaacggaatattcaaggattctttactgcctacctgagcgtaaatgcttattacctgactgccccggaagtggaactgaatcacggttactgtgacctgttccttatgccggacctactgcattatgaagtgaatcatagctacatcatagagctaaaatacctttcagaaaaagattccgatgcgaaagccgaaatccaatgggaagaagccgttgagcagataaagggatatgcagccgcaccgaaagttcgccaattgatacagaatacaaagttacattgcattgtgatgcaattccgtggctgggaactccaacgaatggaagaagtaattcaaccacatataaaatgacagcacttttgccctcacgctctcattttcgcctcaatccccctattcatcggagttacagcgattagagatccaatggtagcagcgtgagagcaaccgtttgccctcacgttactaccaattattctattttcagcaaatgataaagtgtccccttaccggacttccggcagggaatattcagcttctgaagcgcacggccgaacacagctaccttattgatagccaacctgtcccgtgtcttcgtctgcaaataattcagaatctgcatggacgtcatccattcgcctccctcctcttcttccgccggacggagataacaatggaacaactgttccaacgggctcgcctgctcaaattcacggttcgtctgcttcaaaatcttttcatcctcatcatccagccagtaacgctcacccttataaatggcttccatcgcctgagcataaagctgtttgtaattgatggtagcattggttttgataggagctatcacctcaatacagataaaacgacggctgccactgggatcggcaagcaaatctttctgattgctggtgccgataaaggaagcataacgacgcatttcacgaatagtattgccatgaggcttgcgcaagttagcaacaggcttttgcaacaaatgcttcagaaacccctgctggctgacattgatctgatcaaactcatcaatgttgatcagaaaaaaacgtcctaaataacgctccgcttcctgcttactcttgaaatcgatactgtccgtatagccgaaacgcaactcaggcggcagaataatccggcaaaacgttgacttacgatacccttgcggaccgacaagcaaaggtgacgtactgtttccatgctgccgatccacccctctccaatgcgccaccatgctcagaaaccaacgataaaacaactcctgccagtacggattcgtacaaggaaccaatcctgccaatgcacggatacggtctttcccgtcccaacggccgacatcataaagatattcttctacaggattgtgcaaaggaacatattccgaattcagaaaacggtctacatcacgatcccaggcattgatgccttctttcaaggcacagatagagatactgttgcgcacacgtttgtccacgggcttaaagtaaaagtggatggaatcacgctggcggtattccagatcatctaacacggtgttataacgaaattcataacgacggttcataaattcttccagcagaaaagccgtctcctgctcccttccgatactgtttttcttgccaaaacccttacattcctgataaagattatgaatcgtcgagcgtatgattcgctcatcctcttcccgatagtaatgaatgagtgtctgccggaccgcttcttcttcggggatacccgctttgaaacaatgctcggcaaggtgtacaagcaaaggttgcaaatcatctccacgcttccagtcttccatttcctgaaatgccctgttcaacgccgcttcataaatcttcgtgaaagtttttgcagactcatatcccggtttcaatcgcaacaacagattcttttcaccctgcttgcgctgccggaaagtttcttcaccgggcatagcgagcggttgttccagacagaacggcactgcatcgggattgtaatatggagattcgtccagtgtcatgcgacacttctgtgtcagcaccggtgcttgcagattaatatcataaggaagcatcggctggtagcactttaccgccagccagtaggcatgagcatgaaataattccgcttccgcttctttttcgggcagtcctctgtcatccggcagggcaaaacgcacccatatcttcacgctacggccactggaaccacagaatgcggcgaaagtctgaggcaagagtgccgcctgccgtttcacatattccatttcggacgggcctgccagccggttcacttccaactgcaccagtccgttatattgtttcatttttcgttcgccttctttagtgcgggtacattctacggcagaatagatatatggcagtttgtctatatgttcgtactggctgtacgtaccttccagcatcggtatcaggtttcgcaaagccgtaatgtgtcccgattttgtctccgttttcattttgttgaataatgtacctgcttcgcatatgcttagagcttcttttccactcccgctgtcttgtctgattaaagttattttcattcttttttgtctgtttatctaccaatattgtttatcgcttaattcctgtaaaggtacgatattatattacggcatacaaacttttcctctaataaaaacagactttttgctcgcattaaccttataataaaatacgacatcaatcacacgtagatggttcatttcttaccatgatttccctatatcattgtatctgaatggcttacagtttcctttaatttctgtagtgtactgaataagttgacacttcaaaaatcgaaaataaagatgaaatattcgaaaaagaagtacaactattacagtgatgatgaacgaatgtcttatattcgtgagtatttatcaagtccc

SEQ ID NO: 179 - DNA, 15186 bp, Bacteroides thetaiotaomicron
gatgaatacattatttgataaaatatgggatgcccacgtggtgactacggtggaagatgggccgacacaactttatattgatcgtttatattgtcatgaagtgaccagtccgcaggcttttgccggattgcgcgagcgtggcatcaaggtattgcgtccggaaaaggtattctgtatgcccgatcacaatactccgacacatgatcaggataaaccgattgaagacccgatctccaagactcaggtggatacactgacgaaaaatgcgaaagatttcggtctgacacatttcggtatgatgcatcctaaaaacggaattatccatgtggtaggtccggaacgtgcactgacactgccgggcatgacgattgtttgcggtgactcgcatacttctactcacggtgcaatgggagctatcgctttcggcatcggtaccagtgaagtggaaatggtactggcttcacaatgtatccttcagtcaagaccgaaaacaatgcgaattaccgtagatggcgaactgggtaaaggagtgactgcgaaagatgtcgctctgtacatgatgtctaagatgactaccagcggagctaccggttacttcgtggaatatgcaggttcggccatccgcaatctgactatggaaggacgtcttactctttgtaatctgtccattgaaatgggagcacgtggtggtatggttgctccggatgaagtgactttcgaatatatcaaaggacgtgagaatgctccgcagggggaagcatgggatcaggctatggaatactggaaaacgctgaagagcgatgatgacgccgtattcgatcaggaggtccgttttgatgcagcggatatcgagccgatgattacgtacggaaccaatccgggcatgggaatgggaattacgcaaaacattcctactacggaaggaatgggagaggctgcacaggtttctttcaaaaaatcgatggaatatatgggattccagccgggtgaatcgttactgggtaaaaagattgattacgtatttctgggtgcttgtactaatggccgtattgaggacttccgcgcattcgcttctctagtgaagggacgcaggaaagcggataatgtaatcgcatggctggttccgggatcatggatggttgatgcacagattcgtaaggaaggaattgacaagatattgactgaagcgggatttgcaatccgtcagccgggatgttcagcatgccttgcgatgaatgatgacaagattcctgcaggaaaatattcagtatcaaccagtaaccgtaactttgaaggtcgtcagggaccgggagcccgtactttactggccagcccgttggttgctgctgccgctgcggtgacaggagtgattaccgacccgcgtgagctgatgtaatttcaatcgtaatttgtaaatatttaaattgtaaacagaaagatggctaagacaaaatttaatataataacaagtacttgtgtaccccttcctttagagaatgtagatactgaccagattattccggcacgttttctgaaagcaacgactcgtgaagagaagtttttcggtgataacctgtttcgtgactggcgttataatgccgacggttcgctgaataaggatttcgtgctgaacgatcctacgtatagcggacagatattggtggcaggaaagaactttggttcgggttccagccgcgaacacgcagcctgggcgattgccggatatggtttccgtgtggtagtatcgagcttctttgccgatattcacaaaaataatgagttgaacaacttcgtacttccggtagttgttactgaaggatttttgcaggaactcttcgactcgatctttgctgatccgaagatggaagtggaagtgaaccttcccgaacagaccatcactaataaagcaacgggtaagagtgaacattttgaaatcaacgcttataagaaactttgtctgatgaacggactggatgacatagacttcttgctaagcaataaaaataaaatagaagaatgggaaaacaaggcgtcaaaatagagatcatggacacaacgctccgtgacggtgaacaaaccagcggagtatcttttgtgccccatgagaaactaatgattgcccgtttactattggaggatttgaaggtagaccgggtagaggttgcttcagcacgtgtatcggaaggtgagtttgaagccgtgaagatgatttgtgattgggcagcccgccgcaatctgcttcagaaagtggaagtgttgggatttgtggacggtcatacttcggtggactggatacaacgtaccgggtgccgtgtcatcaatcttctttgtaaggggtcattgaaacattgcacccaacaattgaaaaagactcccgaagaacatatcgcagatattatcaacgtagtacattacgcagatgaacaggatatcggagtgaatgtatatctggaagactggagtaacggaatgaaagattctcccgaatatgtgtttcagttgatggatggcttgaagcagacaagcatcagacgttatatgttgcccgatacattgggaatcctgaacccgctgcaggtgatagaatatatgcggaagatgaagaagcgttatccgaatacccattttgattttcacgcgcataatgattatgatctggcggtaagtaatgtgctggctgccgtgttgagcggtgtcagaggactgcatactacgattaacggacttggcgaacgggccggtaatgcacccctttccagtgtgcaggctattctgaaagatcatttcaatgcaatgaccaatattgacgaaagccgcctgaatgatgtcagtcgggtggtagagtcctattccggtattgtgattcctgccaataaaccgattgtgggagagaatgtctttacacaagttgcaggcgttcacgccgacggcgataataagaataatttgtattgtaatgatttacttcccgaacgtttcggacgtaagcgtgagtatgctttaggaaaaacaagtggaaaggcaaatatccgtaagaatctcgaagatctgggactggaactcgatgaagatgccatgcgcaaggtaacggagcgaatcattgaactgggggacaagaaagaattggtgactcaggaggatttgccgtatattgtatcggatgtattgaaacacggggcgataggcgagaaggtcaagctgaagagttattttgtaaatctggctcacggtctgaaaccgatggcgactttaaagatcgaaataaacggaaaggaatacgaagaaagttcaagtggcgatggtcagtatgatgctttcgtacgtgcgttgcgcaaaatttataaagtgacgttaggacgtaaattccccatgttgacgaattatgcggtatctatcccaccgggtgggcgtacggatgcatttgtgcagacagtaattacctggaactatgacgaacaggtgttccgtacccgtggacttgatgccgaccagacggaggctgccatcaaagcaacaatgaagatgttgaatctacttgaagaataagttgattttatattaacatgcatttgatgcttccgatatgacagagattaattaactttgagtagtataaaagataaaaagaaaagtaacatggattttaaaattgctgtattagcaggcgacggtatcggaccggagatttcggtacaaggtgtagatgtaatgagtgccgtttgcgagaagtttggccacaaagtaagttacgaatatgcaatctgcggtgcagatgcgattgataaagtaggtgatccgttcccggaagaaacatatgaggtttgcaagaatgcagatgctgttttgttttcggccgtaggtgatccgaagtttgataatgaccctactgcgaaagttcgtccggagcagggattgctggcaatgcgtaagaaattgggattgtttgctaatattcgtccggtacagacattcaaatgcctgatccataaatctccgttgcgtgcggaactggttgagaatgcggatttcatctgcatccgtgagctgaccggcggtatgtacttcggtgagaaatatcaggataatgataaagcatacgatacaaactactacactcgtccggaaattgaacgtatcctgaaagttgcttttgaatatgcaatgaaacgcagaaagcacctgactgtggtagacaaggcaaatgttctggcttcttcccgtctgtggcgtcagattgcacaggaaatggctcccaattatccggaggtgacaactgactatatgtttgtggataatgctgccatgaagatgatccaagaaccagctttctttgacgtgatggtgactgaaaatacattcggggatattctgactgacgaaggttctgttatcagcggctctatgggattgcttccttcagcttctaccggtgaaagtactccagtattcgaaccgattcatggttcatggccacaggcgaagggcttgaatattgcgaacccgttggcacagattctgtctgtagctatgttatttgaatacttcgactgcaaggaagaaggtgcgctgattcgtaaggcggttgatgcatcactggatgaaaacgtacgtacacctgaaattcaagtggccgatggtgccaaatacggtacaaaggaagtaggacagtggattgttgactatatcaagaaggcttaaacagatattctgaataagatatatggaggctggattctttaaatggagttcagcctctttttgttcattccgtttctttgtttttttactgaagaaaatgagtccgttgggagaaaaaactagtcggactgttaaaaagtaaaagagtaagatatttgctaatgaaaaacagtacatttgcacagattaatacacaagtgctatgacaaaaaattatctattcttactgttgggtttgctgcttgcagcgtgtagttctgatgacaaggacgaacaaccgattttagtaaccaatgttgtaatgcctgcttcgggaacagtattcaagcccggtgagaaggtaacgataatggcgaaaggatttcaagacaatgatgaaatcatgttcgatattcgctggccgcttcaagacgaagtgctgcatgaaggatatgctaaaggaggacggggtgttataacggaaaagacggctacgagcattacttttctggctcccggacactggcctgcttctacaacggaaatcttgttacgccgctccggtcaaatgatgtctttaggaaagatttcggtggcggatggacaggcacccaaagattttcagctttatggtatcattaattcccgttccaatacccaccgtcctcatgctatcgaatacatcaatcttgaaaagcctcagacggcagagatagtacgacttgcagacaatcaagacttctcttgtgtagtcaaccttcccggaagctggagccttagtggagtatggacgaaggatgatcgccgtacgaccggactttatgatctttctatgaactattgggaaaagccgggagctgatcagcttgtaacaatggggatagcgaccgctaactctgtatttggggtatatcaaggcggagaccgtttatttgttaaaacagttaatgtgatgccctataccagaatgtatgtgccggagaaacctgattatggttttctgctgcccgaagggatgaaggctgaagcattgtcacgttatccctgtatacaaatgagtgatggaaatatactctgttcggctgataacggcgatggaactttttcaccagtagtcttgaacgggcaaaatatagaagagaaaagtatatatgttggcgaaccgatagaggctgtggcattgatccctttttggatagttaagcctgtagaaggtatgggaacggctaaatatacacgtgttggcggatatatcgtatcgaagagaaatggtgctacaataacagagggagatggaacagaatttaggctatggaacccgactacaaagatgctggatgaacctttcaccacattccctaatgctgcgtgttcagtagccacacttgtttcggatgattttaagaaacaggagctttatgtattgtttgatggtagtcggaatggaaggctgatttatgtatatgatttactaaaaggtagctgggagtcattatatccagggggcggatttccttattcagaaatcgtattagcccgataaggttattactcagctcttctccgggctactatgcacaaaggccctttttcatgcttatatgaagcaatggagacaaagccggactgcaagagtatggatttcaattcatcacaagaacgaataatcatcccgtcaatcagatttgtccaagttttgactgacaggttattcagttcgcagcaaatcaggaaatgtccgtttcgctttaatacccgtgttacttcggtgaatgctttcggaagatcgttccaaaagtaaaccgtctcgaaggcagtgaccacgtcgaacatttcatcggtataaggcagtgtgtctaccgtgccttgttctataaaacagcgggtggaaagatatttcttgtttttcttctgtgcgaaaaggacactttccggagaaatgtcaatgccgtatgcttttccttgcggacagcgatgcatcagctgtgtaagattggctccgccaccgcaaccaatgtcgagcacattccattccttattccatactatatgtgacattccccattcggaaagcaaagtgtgtcgtttgttcatttcccggagaatgactcttccccaaaagccttcaggctttttgagattgtggaataacttatggatgatatttcttttgcccatgttataaactaactttgcacgatggaatagatgataatgcctgctaaagtcagcaatccggtatagatcataacttctgtttgtttcattccggcaccctttccaggaacaggagtgtctgactgaagtcgtgccgttaacttgtgggcgataaagtagaacagccaacctccgaatccaccgataatggctcctgctactaaatcaccgggataatgcaatcccaggtacaggcgtgtataagagttggtaaatgcccaaagtacgataaatatgcttaaccagcgtttacggaacaggcaaatcagaaatatggcaagtccgaaagaattggcagcatgacaggaagggaaaccgaatcctcctcctcgtcttccattcacaatatagaccaaatccgctatcggattttccggattggagggacgcaggcgacctaccagcggacgaagaaaactattgcacatctgatcggcaaacgtgatagtgagggcgatcgctaccacatagcacaaagccactttccaatgaaaattcttgagcagtatatataagatactggcatacatcgggacccatataactttacctgtgaatgcactcatgaagtaatcccagaaaggcgaatgtattccattgaagaacaaaagcagttgggtgtctatatccgaaagaaattctatcataaaataaatcgtattattaaaaggtggatttgtctgatcttatcgcttagccaggtcatcatatagtttctgaaggaaggctttgcctttttccagattggctcctttctctgtcccctcatctatctggacggtgttggcatccagattgtacactaattgattttccgcagtcaccatgccaaacagtgtcggttccgtgaaatacccgaagtggggagaagacggattaaagatattcttgctgaaagtaaagtcatcatgcggcaatccgagctgagaaagcagcgtagcggcaatatcgatctgcgaagcgtatgtgtctactactcgtggttctttcacggctcctccgatcagtattagcggaattgtatgcccttccagcggattttctaccggacgcggataagctcccaaatgatccggtacaagtacgatcagtgtattcttccacatcggggtctccttatactgtctcacaaaatctcctacgcaactatcagcataggcgaaagcattcagcactttatcgtctaatcggtagaacggaacttcaaacggctcgtgactgcttgatgtttgcacgattttaaagaaaggttcctgctgcttctcttctttgaggtctttcaggaaacgttggaaaagtgtatgatccggtgctccccatttaccctgacgttcggacaaaggaaaatccgtctcggagataatcttctcaatacccgatgaaaccaaataagagcgcatattggtgaagtctgcatcccctccgtaatagtattccaaactgtatccggcatttttcagactgcgaggaatggaaggaagtccgtccgttttctcaggatacttcattatgctggtactcggctgaccgggataaccactgataatagatgccagtcctcgatccgtccggaaactgtttgcgtagaaattagtgaataacactccttctttaccgaatttatccatattcactgctacattcggctgtccccccattgtttccattaagtgtgtagaaaaactttcgaggataataaagatgatattcgggcgttgagtatttagaatttgcgggatactgtctgttgctgccacaggtttatccagcatttcggccaacaggtcatctgcaactttcgggtccataaaccgatattgcttatcgaaattgttttgatgggtagcagaatacataaaactgaatgccggattgatggctgcatgattcatccgttggttttggctatagtatactttgctcaggttcattgtcgatacggaaaaaccgccacggataggaatgaagagcgcagctgtcagtaataaaaggacgagagatacatactgccgctgataaggtatcttcaacggtgctttctcccggataagtacggcgtagaaaataccgtagaggatggctgcatagatcagcatagctaggattccgagtaatatgaaccagaagctgacgcttgccatggcatctttcggagatgagaagaagtagaagatcggggtggcatccagccggaatccccagaaaccgtataagcccagatcgatgatgaagatgcaggacatcacaaaagcgatgattccaaagtaaccttgccggatgcggcgtagtatggaagatttcgtccaggcggaagcgataagcaggaagcccgggatggcagtcagatatcctgccagtgagaaatccagcggcaagccgtgccacatcacgctgaaataatcgccgattgaggcgtctgtatagagttcatggtagtaagccatgaaaataggtttttgaaggacaaacagaagaacgaacaaaaaataagtcgtgagaaattgcaggattctctttttcatatctataaacttaaaaatattgaacggagacaaaggtacaattcttttctgtatctttgcgcatcaacctgataaaacgaggtgaatgatggcaaaaattgcgaataaattaacagatttagtgggtaatacacctctaatggaactttccggatatagtggaaagtatggtcttaatcagaatattatcgctaaactggaggcttttaatccggcgggaagcgtaaaagacagagtcgctctttctatgattgaagatgcggaggcccgcggggcactgaaacccggtgccaccattatcgaaccgaccagcggaaatacgggagtcggactggcgatggtagctaccattaaagggtatcacttgatattgactatgcccgaaacgatgagcttggaacggcgaaacctgttgaaagcactgggggcgcagattgtgctaacagatggcttgggcgggatggctgcttctattgccaaggcgcaggagttgcgcgatagtatccccggatctgtgatcctgcaacagtttgaaaatccttcgaatgctgctgtccatgagcagacaacaggagaggaaatctggcgggatacggatggtgaagtggcagtgttcgttgccggagtaggaaccggaggtacgatttgcggcgtggcacgcgccttaaaaaaacataatccggatgttcatatcgttgcggttgaacctgcgtcgtctcccatattggcaggaggtcaggcagcatcacaccgcatacagggaatcggggcgaattttattccgaaactttatgatgcttctgtagtggatgaagtgataggtgtgcccgatgacgaagccattcgtgcggggcgagagctggctgcgacagaaggtttgctggccggaatctcttcgggagcggccgtatatgcagcccgacagttggcacagcgtccggagttcaggaacaaaaaaatcgttgcgttgttacctgatacgggagaacgctatctgtcgaccgagttgttcgcttttgatgcctatcctttggattaatatttgaatcatgataagaattattttaattttatttcttagctttccggttgccctgtgtgcgcagacctatcagcaattatcagaaaaggcaattgaatatatcgaaatggacagtctttccaaagccgaagaactactgcttcaggctttgaaactggagccgaagaatgcaaagaatgctatgcttttttccaatctgggattggtgcagcgtcggttgggtgaatatgacaaggcactcgaatcttattcttttgcgctgaactttgctccattggcagtacctattctgctggaccgagctgcgattaatctggaaatggggaatacagaccgtgcttataccgattattgtcaggtacttgacgaagataaacagaataaagaagcgctgttgatgcgggcatatatctatgtgctccggagggattaccccgcggcacgaatcgattataatcgcttgttggagattgacccgcaaagttatagcggtcggcttgggctggctaccttggaacagaaagaaggaaaattcaaggaagcgctcgaaattcttaataagatgattacggcaactcccgaagacgcgactctttacattgcccgtgcagatgtggaacgggagatgaagcatgaagatctggctttggtcgatttggaggaagctattcgcctgaatccttcttcggcggatgcctatttgttgcgtggcaatatttatctgacacagaaaaagaaagcattggcaaagatggactttgaaaaagctatttcgctgggcatacctcctgctgatttgcacgagcagctgaaacaatgtaaataaaagacaaaactaaaaacatattactactaattaatacccaaacagaaaatgaaacgtattgtttttttagattacgtgcgcgtgttcgcatgtttcctcgttatggtggtacacgccagtgaaaacttttatggtgctgccggatctacggacatggcgggaccgcaatcttttttagccagtgaagcagaccgattgtgggtggccgtgtacgatggtttttcacgcatggcagtaccattgtttatgattgtctctgcttatctgctggtaccgatgaaggagggacagacttcatggcagttctaccgccgacgcttcactcatatcctgccaccgttttttatatttatgatactctatagtatcctgccgatgttgtggggacagatagacagcgagacatcaataaaggatatgtctcgaatattcctgaacttcccgacgcttgccggacacctttggttcatgtatcccctgataagtctttacctgtttatacctattatatctccttggttgagtaaagccactgcaaaagaagaacgtttcttcataggactgttcctgttatcaacgtgtatgccgtacttcaatcgctggtttggtgaagtgtgggggcagtgtttttggaacgaataccatatgttgtggtatttctcaggctatcttggatatcttgtgttggcacactacatacgtgtacacttaaaatgggatcgttccaaacgtttcattgtaggactcatttcaatggttgccggggctgcgctgactatttactcattctatatacaggctattcccggaattactcattctacccctgtcatagaaataggatgggctttctgtacgattaactgtgtacttcttacagcgggtacattccttctcttcacttgtataaatcggccggaagctccgcgtttcgtaacagatatgtcgaaacttagctatggtatgtaccttatgcatatattctggctcgggttatgggcgacagtattcaaaaatacgctggaactgcctactgtttccgccatcccatgtattgcagtgactacatttgtctgctgttatataacgacaaagattatctcattcataccgggcagtaaatggattataggctaaatagatcggatgttcttgaattaaacaaaaaagggaagcgattgcttcccttttttgtttactcatcttattatatggtccttcctggttacgcttgaataagttactctttattaaaggtaaatcgatgggacggctcaatacattattatacaaactgcttaatcagattcacaaactcttttccatatttcttcttcttaaactctccgataccactgatttctccgaatgcttcgatggtagtcggccgtgaaatactgagcagatgcaacaccttatccgatagaatgatatatgccggaagaccatcctgatcggcaatctgtttccgcaatccccgtagtgcttcgaataaatcttcgttttctccaccggggataccgaaaggaagttcttttgcgatgaccaccttcttctttttcccttttcctgtgacgatttcttcccgatgaatcacggcaagcattgctttcgcttttccaaaaagaatgttacttccgcttggagtgattttgagatggttattttcattgtaggctatttcgaaatagcctagttgtagcatttgaagtaaataatcctgccagtcacgaggtggtatgtctcttcctgcgccaaacgtctttaattcctgatatccttttgccgtaacttctgccgaataacttccacgaagaatatcaattaatatccctgtacttatttgttgttctgcacgagctatggcgctcaacgctttttgtacgatgactgtaccgtcaaagcgttgtggagggtttttacagacatcacagttgccacaatcttctgttgaggtttctccgaaatagctcagcaggattcttctgcggcagatgtccgcttctgcgtattgctgcatacgttgcaacttttccagattgattgtctgttggttgctttctgtggcgaatttagttaacaggatcagatcgcccagtgaatagaacaatacagtatcgcttggtaagccatctcgtccggcacgcccgatttcctgataaaaactttcaatacttttaggaagattataatgaataacccatcggacattcgatttgtcaattcccataccaaaagcaatggtggcgcatactacctgaatacggtcattaatgaagtcattctgagtctcgtcccgatgctgcggagacaatccggcatggtagacaccgcatcggattccctgcttttgcagcatttgtgctacagtttccgttttattacggctcatacaataaatgattccactttcttctctgtggcgatggataaactccagaatcgctttattcttctcttttgcctgaaaaccgcgttttacgtccaggctgatgttgggacggtcgaaagaagaaataaacgtccggggctgtatcagatgcaactgtcggattatatcctcacgggttattttgtcggctgttgccgttaatgcaataatcggtacctgcggaaactgctgatggagcattcccatttgtgtatattcaggacggaagtcatgcccccattgggaaatacagtgggcttcgtcaattgcgaagagcgaaatactcatatcccgcaacagatagtccttttccgctatcagcttctccggtgaaatataaagcagtttcaggcgtccttcgatacaggcacggcggagattggcattttccgtttcgtcattgctgctattgagtgctcctgctgcgatgccgttggcttgcaatgtttctacctggtctttcatcagtgagataagcggggagaccactacagccgttccttcagaaagcaatgcaggtagttgataacagatcgatttacctcctccggtgggcatcagtaccagtgaatcctgcttgttcaacaggtggcggatgatttcttcctgtaagggtcggaagctgtcataaccgaaatatgattttagagtttctttcatcaacatttgtttaaactttgtggcaaaggtacgcttttctttagcaatctttatcatgtctcgatttctgttttgattttaatgccccaagagttaaagtttcttattattcacccttaattcctctttttcaaggtttttgattgttttattagaaaaaaaatgcacaaaataattgtgtgtttaaaaaaaaagtaagacatttgtaacatgtaacgttgcgaatgagcaattaataacaaataaacaaaccctaaccagttaattcaatgagtgatttagagaacaaaaaagcggaggaagctccaaagaaacgtccctacaatttgagggaaaagaaagaaaagaaggctgcatatcggtcattaatcagaccggaactggcagacgagttgtatgacaagattctgaacattgtagtagttcagaagaagtataaagatcctgactattcagctaaagatttggctaaagagttgaagaccaatactcgctacctttctgcagtagtgaattctcgttttggtatgaactactcttgtttgttgaatgagtacagagtgaaagacgctctgcatttgttgacagacaagcgttatgccgacaagaatgtggaagaaatcagtgcaatggttggctttgcaaatcgtcaatctttttacgctgcattttacaagaacgtaggtgaaactcctaacggatatcgcaagaaacacgctgaaagtaagaagtaattgcgttttccgatactgaccaaaaggaattacctctgaatgaaaagttcggggataattccttttcttatttaatt

SEQ ID NO: 180 - DNA, 14944 bp, Bacteroides thetaiotaomicron
gttctaggttatacatttttatattataaagatgttgtatcatatttcccaccgtcgttgggtcttacttgagttacagtataatatctgttagcaacctttgtgcttccctctagctttaaattttcagttttgtagtaaaggcgattaatgttgctacatccatcatcagagttggaagttgcattatccataaatgtatagtaatactgttgtcgtgaagtatcatatcctcttcctgtaactacaataaaatggtctgtaccgtcgatgtttggatttaaatcgagatcataatcaactcctactatgataactcgttttgcattgagatgtttatcgatacattcaattgcatttttgtagttttgagctggatcatttccccagtttgttaataatccatttgcagaatcaactagcttaaaaacatttaagctacttccgtaattggataatccatatttttttagtgtttctttgcaaagacttaagcaattagctccttctctccaaccaacaaacctacttttgtccattaattctattggatctttgggaacgggtttgtctccacctccaggtttcggaccatcaccgctagttcctccaccgctagttcctccaccactagttccaccaccagtccacccgctaccacttccccaatctccacttccccagtgtccgcttccccaatactcgccagaaccactaccgctgccggaaccactaccggaaccgaaacctgatccgctaccgtagatagttacgtccggtgtcatccatccaatgccacatacatagacggtggtatctaaggctccttgggcattaagccgttgataaacttcttctgtcatgcaatcattgggacctgtacctgcccctgaattgtaactggagatcaatatggtttggttgatccctcttaattttaatttctccgctttacttttcttttccataatacatgataattttagtgtttataaataaagtcgtttcttttggatgcatagataagtttatacacttgtttaagttgaaatcaattgatacatatcaccccatgataaagaagatattctacttccgtcagaattaatttgtaagtttgttctttatctttgctgatttcagatgaaaaacaaggtagcaattcgttgaacagacattcaaatgtcttctcttcttctatgagaatcagaatattataacataaatcgttaataagcacttctttaaaaccctcatatagcagacatggaatgcatactatatcaaagtggtctgaatggcactctttgtttatacgttctttaagcagtttttttgcttctgtcggccagggttccggaatttcgtaaatggataggtagggatttctattaatagtaaatatggcttgttcctcttttccggcatttagaaacatgaaataggaagatgagcatttctcccaatcatacagatcggtataagatagcttttcccattttttggacaaagaatgaagataatcttgataggatgcaatacacatttgtacactcaaatcggggaaggtagtatttttagccttgttttgcattcgcttatgattattcgcgaacaattctactactctattgtaatagtcaggatatttatttaatagagttttgctaagtaaatcacaaatccgttggttctttttatgtccgccgatgatatgtaatagtttggctttgtcgtatagataaaaattacagaaatcatcataaatgtatccattgtcacgaacgctgtgatcaaggactgttgccacaggtttgttataactgtttgactgggcataaaacaatatttgttcaaagaggatattgttatttatgtgaatatctttgctgtttatatcatttaaatggtttgattcgataaagttaaatgcagtccggcagtattcagctataaactccaagtcatttcctccgataattcctgcattatatgacatgatagagtctttttctaattctttttttaggaaggatggcattaataaatctttttgtagaatatgattcatcatacttttataataactgcttcctatttctttgttctgagcaatcaattcactcatctctatggtgttgtctagtttattaggcaaatatacatctccgtctacatgtatgaagggttctttttggagtgaataggttaataacttgggatatgcccaatgaggttcagggcaagttagattgtcgtattgaatgatgatatctgtatacggtagtttcaattgttcggcaaagatttcatatccatgggaatcggtatataaaacgatattttgatagttgtcttttaaagaaagacaacttaatgcccatgacattaaatggtattgtggattcatccatccaaaactattgtctaacaatgaattatttccatgccaaaaggtttgtactattttcataactattgatttgttgtgtgttatttctatagtgataaaattagtaataatgtggaggaaaaggtccttcagatagggctaattcgcatggttggcgcaaatgtttacttttttggcagtgaaatatgttttttgtgcatcaatcttgataaatataagaactgcaaggatcagcacaacctctgttcattcagaattgtgtaatccttgcagttttatttatgtcgggtagaaagaaacagtttgtttagggcagcggatctgcggcagcaggtttcttcggattgtagatagccatacccaccttggaatctgcgcaaccataatacagataccatttatccttataataaaccatcccttcgatgaacaccgttccgtctacatactgcccgctcttttcgaaactatccatcgggcggaagaacggttcgtcgagacgggtgatgaaacgggtcgggtcattggcgtcgaagagggcttgtccggcagcgtaaacattggcggtatagcgtttgtcgcctctgcttgcactgtttttaccattatacagaagtacgattccctttggagtataaatagctggaggaccgcattccgtcagctggctgtcgaagtgtccgtcacggggtgaaaacagttttctcagcgagccgtccgtatttacgtatggagtccagttgactaaatcttcggaagtggcggcaaacacatgttcctctccccaatacatgaagtattttccgtcgattttcttgatcacctgtttcccattgacaacttcggtcagaatggagccggacttgcatcctaaattgaagaacttgccgtcatacgctttggcaaaagcgggaccgtgctttgtccagtctttcagattgcgggaagtggctattgccagacgcggaatgtggcggttccattgcgtataggtcatcacatacagtccttctgctgtgacggcgatacgcgggtcttcgcatccgcccggccattccagtttcttttgagtatcgttatccggataaaataccggggtcttttcccgcttgaagtgaatgccgtcgctcgaagtggcgtatccgagacgtgaggtacggtgaccgataccgacaccggatttatcttctgcccgatacagcacgacaatcttgccgtcatgcagggtagcagccggattgaaagtgtcattggattcccatgcaacgtaatcctgtgtcatcggacaatagaatttcgtgttctctataggagatatcaccggattagctccctgtggtcgttcgaagcctccgaacgcccagtcgggtaatacgttctttttgtcgttggaaggttgtcccaaggcggtacaagtcatcatggttgtagtaaccagaaataaaaaggttgatttcatattatataattattattgggggagtaatatatactctctacatataaattaaaaaataaaaatatgctgtcatctgtcacataaatgggggcaaatagatgattatgtgattgttatgaggtgacggcaaggtgtgatagcagagtgacagtagttttgctgtcactgtggcatcgcggagacgcttacggcgaagaaggtcggtttctgcgccttgatactaaagtttcatcggcgagaaaccaaagtttcatcggtgagaaactgtggtttcatcagtgagaaactttagtttcagcagcttgaaactctagttccagtgacttgaaactttagttccaaaggcatggaaactcttgtttcatacagtgaaacgattggttccaaagcatggaactatcggtttcaccgtatgaagcagttatcttataagtaaagatggagtagagactactgaatgctgttcaataagtccactttgccttcattgaccagtttgaggatcagctctccgaacaacgtattctgccatgcaaaccatgcacgggtaaagtttttcgggtcgtttttgttgaatgattcgtgcatgaagccggtacctgcatccgtatccatcagcattttgatgcaagttttgatttctgcgtcattctggctggtgaaggctttcatcatgatactcatgggccatatcatgtcatatccgatatgcggacctccgataccttccccggcactgcctttgaagaagtaaggattgtcttcgctccatacaaacttgcgggtattctgataaatcggatcagtcactttgacgtcacccagataaggcaaagcgatgagactcggcacgttggcgtcgtccatcagtagctgattgccgaagccatctacctcgaaagcataaatcttaccgtatttcggatggttgcagacagcatatttctttaatgctttttctacttcatccgccagtgcggtacattctttggccagcgccggtttcctgttcacggtgttcagaatttcggcagctttgcgcaaggaagtaacggcaaagaagttggaaggaacgaggaactggaaagtcgtagcgtcatccgaagggcggaaagcggaagcaatcagtccgacaggtttcaccggattgccccaaccgtcattggtcatggtgtcgagtgcgcgttcggtcttacgctggaatctgtacggacctttcgcgtcgtccttacgctgctgttccttgaaagtcttcagcacatttgcaatggcctgcagccattcgtcggagaatacgctggcatcgcccgttgttttccagtaatggtatgccaggcggatcgggtagcagagagagtcgatttcccatttgcgttcgtgaagttccggtttcatgtccgtcaggtcgctcatccattcgcctccttcggagttcatgttgaaggcgttggcgtacgggtcgatattgatacatttaaactggcggttgatgactcctgccagcatctttttcagttcggggtctttattggcaagctgcacatagggccatacctgcgcaccggagtcgcggagccacatggcgtggatgtctccggtgtatacaaaagtgtcctcttttccgtcgaagtgaacggtagtgtccagtgtgttcggaaaacagttctcgaacatccatgccagtttcgcattggtcagtagttgcttgatgtggtcaatctgtcgttccacttcctgcgatacgaataagcgcttggaggcttcgggacggttggtctggtaattattgacccgggtattgtcttgctgggtcacaaattcgcggttttccattgcttgcacgccggcagcgcccgaaagtgctgcgcagaggcaaagtgttttggttatattcatggtaattgttttctttaattcatgtaagggttaataatcaatgttttatttctcgatttcagcgaacagctcgatcaggcaggcattatcgagcagccatttataaggttcctcgttatgtcctgaccagtctctgcccagtaatccgttggcatcccggtagtttctccatgcgtggagcgcgttctctgccatcgcacggacataagtcgggttgtggtcaatcttctccagcgccttgaagcctctgaacagaatcacgttaaaccacgacatatccttgtgtaccttgactgacgggtctttcttatctgctttcgaacggaaaaaggcatcggttcccgcggctgtcttctgggcatcgcgcaagtaatccttgtctcctgtctcttcgtacagtaatacacctgcctgaatcatttgtccactgttgtaggcgtacttgtctttcgagactttccctttcaggttgatattgtcccagtaaaggaagtcgtcgggatcacacaagtgttttctggtccatgcgtaagtttccttggccttgttcagatactttttgtccttcgtcagacggtatagcttgacgccgagtactgttgacggggcattggagcaggtatgcttcgcttctttctgctgttcgcaccagaagattcctccgcccagttcgtcactccagccgctgtagatgtattcgtacagggcaatggcctttttcagatagtcggccttctttgtgaggcggtagtagtcgcaataatccagtgcgatccagatgttgtcatcgtagtagcgtccatgctgaccgtatttgacagggtacgactgatagcatgccggaaggcgttctccgtcccagtactgttccagtcccggcaggatgcgcttttccagtatcgtcttgtacttcttgtctccggtagcctggtacatggctacgcaaccggacatcatccctgagtagggccacagaaaggaggccttcaaggttccgttctgctgtgctccgcctgccagataagtgattttctggtcgggattcacgggatatgtttcggtaagcagcccgtcttccgtctgatataaattcagaacattgtcgaggatagagtcggcaatggacacgaaaggatgatttttcaccgtttttccggaagcggaagcgaggcaaaacaacatacaggctacaaaacatatatttctcatatgggtatcagattattaaatgaagtattcggggttatttttgctgacgttggtcaaacaccagttccacttttacagggaaatggtcggatggtgtacgtgcttcataagccttaatggtgatctcttccggacaatctctcacgtcctcctttttactgttttcccgtacactccgataggtatctgtcagcacaccgtatctcttgacgtggaaagaaggtgaaacgaagatatggtcgatgcggctttcggtaaaactgttcggatcgaagttgttgaaagttccgttgagcgcatatcggtagtcgcacttctcgtaagaatcacagaggacgcctttgctgacaaatgcgtcgtaggactggtgggtctggtcgacgttgaagtctcccgtcaggatagccggcagattcttgcctcttcccagctctttcatcttttcctgtacgaggaaagcgctctccacacgggctttcttgccgatgtggtccatgtggagattgaagaacagaaactcgaaaccggtatctttgcatttgaagtgcccccagctgcaaatacgaggcaatacggcatcccagcctttgctcggcacgtccggagtttccgacagccagaaatctcctttttctacgatgtcgaatttgtcggtgcggtagaagatagcggagtgttcgcctttgtctttaccgtcgtcgcggcctacgccgatatagtcataaccgggaagggcttctttcatgtctttcagttggtgaaggaagcattcctgtgtgccgaaaatatcgaaatcgtgatattgcaccatctgggcaatcaccggataacgctgtccccatccgtctccacgggcggagtcggaaccgttggcatttctcaggttgtaggaggcaacggtgagcgaagtaggctgatagctctgacagttgcagaagactatcgctgcaagaacgataaataaaaggtttcttagtttcatgttttctttagtttgtttggattagatcattcattaaagcattcaaaagtacgacattttattcaaatgaaagggaatagggaatatctttttcagtcgttccccgctgtttgttcggcgtaggactcatctgatactggatattcgctcctttcagtaattggtcgtgcgtcagataattgcgggtgaatgccttgccatttaccttcatatccttcacataacggttgtcggtgttattgttgcttgcttttattgtgacggtttttccattttccagatgcagcttggctgacttgaaaaggggagttcccagaatgtactgatctgttcccggacaaacggggtagaatcctaaagccgagaagacataccaggcagaagtctgaccgttgtcttcgtcaccgcaatatccgtcggggcctgccgtgtagagcttgtccatgatttcacgaacccaatgctgggccttccacggttctcccgaatagttgtaaagataaaccatgtgctggataggctggttgccgtgagcgtactgtcccatgttcattacctgcatttcacgcatttcgtggatcatgccacggctttccataccctgtttgcccggaatgacaaagacggaatccatcatgttgttgaattctttcttgcctcccatcaggtcgatcagtccttgcggatcatggaatacgcagaaactccagtgccagctgttaccttcgcagaactcgccgctccagtctactgcatcaaatttggggttgaacacacctttgtcgtctttgcctaccatcagtttgcgtttcgggtggtagacgttcttgtagttgagtgcacgttgtttgaagatgtcgatttcgcttgccggtttgcccagtttcttgcctagcgtgtagatggtccagtcgttgtacgcatattccagcgtacgggcaacattctgtcctataccgatattgttggggacataacccagtttgttgtaggcgtcgtatgcaaggcggcccgaagctgtgccgcggagatgggcgtttgcgtcatgtttcaatgcttcccaaagtgtttcgatgtcatatccgcgcagtcctttgatataggcgtcggctactacggaagcggagttgttgccgaccatacagtcacggtgtccgggacttgcccattccggaaggaatccgctttcaaggtacgcattgaccagtccttcctgcatcttctgattcatggacggatacatcaggttcaagaatgggaacagacagcggaacgtatcccagaagccggtatccgtaaacatatagcccggtagcacttttccgttgtaagggctgtagtgtacgacctgtcctttggcgtctatttcataaaagctgcgtgggaacagcatcgaacgatagaggcaggaatagaaagtgcgcagattgtcgatattatcgtcttccacatctactttgctcatttcacggttccagatgtcttttcctttagtgaccagctggtcgaaactatccttgcccaattctttgagattcagttccgcctgctcataactgataaaagaagaagctacacgtgcgtgaacgatctcccctttctgggtagcgaatccgatgatcgctccggtatggttgccctgaacttctgtttcgttcgggagaatgttgttctctttcacgccggaagtaaaggtaaacggcttgtcgaactggatgacaaaataattcttgaagttctccggcactccgccgctgttcttggtagaataaccgatgatcttgttttcttccggaatcacctttacataagagcctttgtcgaatgcgtcgataacgacataagcgttcttggtttccggatacgtgaaacggaacatagcggcacgctccgtcggaacgagttccgtagtaacgtcgtggtctgcgagatataccttataataataaggtttggcaacctccgccttgtgcgagaaccagctggcacgttggtcctggtcgaataccagtccgcctgtgatcggcatgatggaaaactgaccgtagtcgttcatccacgggctgggttgatgtgtttgtttgaagccccggattttgtcggcattgtaggtatatgcccaaccgtcgcccattttaccggtttgcggtgtccagaagttcattccccacggcagtgccgtagccggataggtatttccggtcgataactcaaacttggactgcgttcctaccagcgtgctgacatagtctaccggattcttgacggcagaaatttgcatgctgtacaacaccgcacctccaataaataacaggtgtttaaatgaaaaatgtgttttcatgaacaaatgaatttatgaataaaattagtttctgtgacgaaaatagagagaaaaggaatgccgctaccggaagtcgaaacactaaatcgccctgtggcgctataattaaccaaactggcacgcattcttacatatattctgcgccaaaaaagtgctggaaagtttttttgtttacctttgtcatattgcaaatctaaggattctatgccatgaaaaaacattgtattttacttttcttctgctgccttaatctgctgatgaatacagccggtgcctataatctgaagcaggttgctgacaaagaatatatgtccaacagctctattacttctctgtgccaggacgacaaaggactgatgtggatcggcacttgtgacggactcaatatctatgacggtcaggagatcgaagagtttaagacccgtgacaaggaggattacttatccggcaatcaaattgataatattatctataccggcaacgatacttattggttccagacctattatagcctgattcgtctggaccgtaaaacgaactccattacacgctttaatgagtttcagaaactcttcttgatgaataaggataatcatggcaccttgtttatcattaaagacaccaactgcatctattattttcataagaaggaaggcatctttaagaaaatcaatgtgactggtatcccgatatcggatgtcattactttcttctttgataaaaataaccgtatgtgggtgatgatgaaagggtataaccggtgttatgacctgcaacaggaccctctgacggagaatatcactttagtatcgcagaaaagcggtttggatcatcacacgccattgatttgtagcttttacgatgacgccgccgtttactatgtggataaagaatacaatctctatgcctttcatattgagagtaaaaagaatgaatttatagctaacctgggagcgaacatacaggcgcatgacaagatttcctccattgttaaatatcatgatagcttttttgtcggcttaatgatggacggtgttctgacgttggaaaaacaaaagggcagcggtgaatatcagattcagaccttacctataaatagcggaacattcagcctgataaaagaccgctttcaggatgttgtctggattggtacggatgggcagggcgtttatctttactcaaatcctctttattctataaaatcggtggtactgaataactataccgaaaagatagaacggcccgtgcgtgctttgctgcttgacaaggagcgtactttttggatcggtaccaaagggaatggaatacttaaaatttttgattatgaggtacaaaagaatatctcggactgccgctcggagatactgacaacatcgaacagtggtttaggcagtaatgcggtctactgtatcagagaaagtaaccgtaacttgctatggatcggtgatgaagaaggactgaacttttattcgtatcgtgaacgccgtatcaagaaacttcctctctggattgataatgaggaattcaaatacatacatgatatttatgaaacggaggactcggaattgtggctggccagtgtggggatgggagtagtcagagcgcgtatcggaggtacaccggatcatccggttcttgaaaagttacaacgatatgtggtcaatggcggagaattcggctctaattacttctttacgatctgcaagggggacagtctgaacctgttgttcggcaatatgggatacggggtataccgcttcaatgaaacgatcaacggattggaaccgctgaccactcataagtatgagaatatgaacttgaacaaggtagtacctattataaaagatgatgcggacaattatttgatcggtactacttatggagtcatcaagtatgcctcagaaaactcttatcaactgtttaatgcgaaagacggttttctgaacagtactattcatgccattctgaggcattcgtccgataacttctggctgagtacgaatcagggattgattaattttgataccaaaagaaatgtattccgctcttacggctttggcgacgggcttaaagtcgtcgaatttagtgacggagcttcctacagagacccgcaaacgggtatactgttttttggaggaatcaacggctttgtagctattcaggcagacggacgtcccgaacagctttatatgcctcccatctactttgacaaactctctatctttggagaacaatacaatcttggagagtttatcacccgtaaaaaagagaatgaagtactgaatttgaaatacgaccagaacttctttgccgtttcattcacctctgtcgattatctgaacggaaataactgcacctattcttataaactgaaaggattgagtgaccagtggattaataatggtaaagaaagttctgtctctttcacgaacatggctcccggtgagtatacgttattggtgaagtactacaatagtgtattcgataaagaaagtgaagtctattctttgttgatacggatcggtgacccgtggtacgcctcttggtgggcatatctcatttattctttatgtctgcttatgatagccgccatgctggtacgttcgtttattctccgcaccaaacggaaaaagcaggaactgctgaatgaaatagagaaacgccatcaaaagaatgtatttgagtcgaaacttcgtttcttcactaatatagctcacgagttctgtaccccgttgactcttatctacggtccttgcggacgtatcctttcatcaaaaggactcagtaaattcgtagtcgattatgttcagatgattcagacgaacgcggaacgtttgaataacctgattcatgaactgatcgaattccgtcgtatcgaaaccggaaaccgggaagtgaggatcgaagccctgaatgtatcttccttaatgaaaaatacggccaagacctttgtcgatatggctaaatcccggaatatcacgttcctgagcaagatacccgagcaagtttcctggaactcagacaaaggttttctgaatactattattatcaatctgatatccaatgccttcaagtatactccggatgggaaaagtatcaaaatagaagtggataccaacgatgaaaacctgctggttctccgggtggccaatgaaggaagtacgattaaagaagaagactttcaatatgttttcaaccgttatgctatcctggatagctttgaaaaccaggatgaaaagaacttctcccgtaatgggctgggacttgccatttcctacaatatggcgaaattgctgaatggtacgctgaaggtggaaaatacgcctgacggctgggtattgtttactttgtcattgcctccgctggaagtgactaccggcgtatcgtcttctaaacgaatcacttcggaatacattccaaaaatagagtcgcaactggtgctgaaacttcctcactatgaatttgacaagatgcggcctacattgctggtgattgatgatgaactggaaatgttgtggttcatcggggaaatcttctctaacgattttaatgtggtcaccctgcaggagccggaacgggtggagcaggtattgaatgaagtttatccgaatgtgatcatttgcgatatcatgatgccgggagttggcggtatcgaattgacgaaacggattaagtcggtgaaggaaacgtcacatatacctattattatggtttccggccggcatgaaatggaacagcagatggctgcactttctgcaggagccgagatgtatatcaccaaaccgtttaatgccgaatatctccgtatctctgtttgtcagatgttggaacgtaaggaagtactgaaggattatttcagttcagcaatcagctcttttgaaaagacagatggtaaactgacacataaggaatcgaaaaagttccagcaatctgttctgaagattatcaatgaccacattcaggagaaggaactgactccccgtttcatagccgatcatttggctatcagcgttcgcagcctttaccggaaaatggaggagatgggggaagaaagtcctacgattatgattaaggagtgtcgtttgtatgtagcgaaagatttgctgctgaaaacgaaaaagacgattgatgaaattgtattcgaagccggattctctaataaggtcactttctttaaagtatttcgtgaaaagtacggatgcacgccaaaagaattccggaccaaacacttggaagaagtacaataattattggagtggtatggcaacaattagaattttttcgaattttcattcgaaaaaaataatactgagtaattggaggatttttctctttatccctaccagtagcagttttaatttatgaaatagaaagatatgatagtgtcgcatttagtttatatatgagtaaatgtctatgccaaagaagtaaaaaaggaagttcgttctccagttattgttttcttgatttttatcttgattttaatagcggggaatttaacctttaaggagaactggaatactattaaatcatgccaaaatagtaaatatccctgccgtataatataaaacacaaagaaggaaaactaaaaatcttggcaaacacattaattttgctggtgcattaaaaaggtcagaataatat

SEQ ID NO: 181 - DNA, 14684 bp, Bacteroides thetaiotaomicron
acctaagatataataataaggtttaaatgttggaagaatagtttcatcattaccgtcagtactaagatttttacgtttaaaatgttcttgataaaactgagccaatgcctttacctttgcatctgcatatgttatttcatcatcggctgattctgtacaagttatatcttcagtcaaacttaatgctgtcggacgtttattccataattcatcataggtttcttttattgttttatcttcattgtagacattattacttttagcagcaataaaattttttgcataaacctcaatccgatgtcttctctgaccattcaatggttcaactcctaaatagttacatgtattgccattaaaacctgtaagtttccaagtcgatttcagtgcttcttggcccactccaccatcaaataacatccaacgtcgcacatcgtggaaacgtttaccttcataagcaagttctatttgacgttcataaagtatagcctcaaatagtttggcacgatcattaaaaatagctggatctaatccacaattatctgtatatcctacacgcttacgaattcgtttaagagcattcactgcctcgtcaaaatgatttgccccacaagcagcctccgcataattcaataatacttcggcaaaacgtatttccatatatggagcagcagactgtctgaatccattacctgaagtcttttcaaagatatataaaggattagaattgagtgctaaatcatctgtacgcttacgcaaataaatccccgtatttttggtacctagacaatcagctgcatagcctgacttagagttactattacgatcatctacattatcataccaacaataattccacaacttgtaattattccctgtagtatacccattaatgccataaggtaattgacctttttcaccaaaagatttcaagtcatcactatcaaacttccattctacaccagggaacgcaaaagtgcgataaaatcttggatcgcggtttaaaaagaaaagttcttgattataatcataagatccattcatgtcatttggtttcttcccatccgccattggaaaaagatcaaccatttctgcagtgggagtcataccacccccacctccagcattagctgggcgaagagaatgttcccatccattccatttttcaagctgtaagtgctcggctggtgatacattattatataaagttactaatactgcctcagaaacagttcctccaccaccttctgagccaatataatcggagaatatctttccccaacctgctgcattctttcctgaattgttttcataagccaatccaaaattaccttcttccagtttttttacagcagctaagtttgtttgatatgcagtttcccatcgtgtaacatcatccgccctattaaaaagcggactggcatataacaattccacacgaccttttaaagccaatgctgcccccgatgttatgcgtccaaaattcttattttctgactcccaacgtgctggcagataatcagcagctgtttgcaaatctttgcaaataaaatcaatacattcttttgtagacgagcgtggaactaccaaatgaataccttcactatctccaattataggattttgtacattatcaataataggtacaccaccatacatcattaccattaaataataacgccatgcacggaagaaaaatgcttgtcccaacaataactgcttttggcgttcagttaaactttcactgccaatcactccttcgatcatatcattacactcacgaatacgcacccaaggagaataattgttatctagattaaaataatcagtaacagtttcataatctagaggagaattaggattcatcaaacctgatatccctccatattcttctgtacatttcgaatattgatcacttgttcctgtgcttggcatatcacccatagaaccagtcagatcagatccacccgtcgcactcggcagcatgatataatacaagtaagctatacggttatcagctgactcatagttttcataaatagtcgtaccgttaaaacttccatataattttttgtcttccaaaaattgatcactacaacctgtaaagatggcagctgttatggtcagtaatgcaattgaaccatacttatttattttcttcatcattgtattcaaattattaaaatgaaacattaacacctaacgtgaatttacgtaagttcggataatatccatagcttcccgcccaagaagcccatgctccttctggataagggtttaggaagttaaatacattttggcaagtaagattgaaacggcaactactaatgccaattatttttagccattctttaggcaatgcataagctactgtcatattacgaagttgcactgttgctgcacttactttccaaaaagtagagggtgcaccatttacgctactatagcgaatattcgggtattttgcatttctgttttgtgctactgtaactatattattagcgtcataaatatcctcatatacaaacatatctttccacattgccgacacattactatattcagagtaactttctttacgcatagttgtaggaactaaggaatatgctccccaacttgcaccaaactgcgcactaatagaaaaatctttataagagaaaccgaaatttaaagttccaccgtaaggattactagcacggtgagaaatttttatataatcttgttcatcaacaataccatctgccggaccaaaagttccagttgattcatcatattgtccacgtacatccttataaatcagcataccaggatgtacattttcttttgtatttcctaaatatttagtaatactatatttatcaaagtactcattaatttcctgataactacggaacatacctatacattcataaccccatagtcctctatcagaacgttcatttctcactaatttatcaaaatcatatgcagccttccaacctgtctctctgattttattatcattgtatcctgttgtaagttttacccaatatgacatgtcttttccaattttatccttccatcctaatgacaattcaacaccatatgtatctacctcaccaaagttttctggagcaggttgtattcctaccgtattcggataataagaagttccttgatgtgaagcaaacatttcacggcccatatcataatagaagtccaaattagcgctcattcgattcttcaaaaaggccatatcaataccaaaattagttttataagtcttatcccaatgtacatcaggatttactccttgtttcggcatacgaatcgtagcacttgtatttgtactagaattagttccaaagatcggtcctttgtctggattacgggtgtaaagctgagtccaaagccaagcattcacattatctttaccaagaataccaaacgaaccacgtatcttcaaaaagtcgatttttgtcttgtctttatcaaaccatttttcatctgaaataacccagccggcagaccatgaagggaacattccccaataattctgaggagcaaatttggcagaggcatcagaacggagcataaactcaaacaaatatttatcatcatatgaataattcacacgaccaacataagaaagcataccagactcactgcggttaaacgtcacagtttgagcaaaaccttctgcattggaatccacagaactagattggccatctgtaaaaggtaatgggtctgtaagactaccattcaaatcttcccattctgattctgctttttcaatagagaacaaaccactgacataatgcttaccaaactgacgtgcatagcttactgttaagttcatttgataactatctgagcgattcatactacgccccaaagagttgccattattcaactcatacaatcccaatgtattagcattgtattcaatctcgtcaccaacataaaggtgaccaccactgccaccacgggatataaggcgatatacatcgatttttgtaccgatagtatttgttttccctgtacttatattttttgaataagaagcttttaccttcaaaccacgtaagtatttactccaaccaaaatcatactctaatgaaccgttaagagaaaaattctgattctgattctcaacattatctgacgcattctgtactgctgcaaaattatacttctgctgatcacttggattagttatattttccatacctgaatgaaaaatataatatccatttacttgatcaggcacataaggtacatgtaacattaaagattcaaaatcaccatcagagccaccaccttttacatttttaggtttatttgtctctccataattaccagatacctgcaaagaagctttcatccattttgaaatattagcatttacaccagcacgatagttccaacgattatagtccaagcgccctatattaccttcttgctgataatacgaaacaccaccgaaataagttgctttttctgttcccccgctaatgttgacactatgacgctgcgtcaaagccgcactccattctttatctaataaattataattcatacccttcattgcctccaattcatcagattgaaaaagttgtaccctcaagtcatcggattcttgatccttagtagcagtattagcagcacgagcagcattgtatatacgaccgtaatcataggcatttagcatcttaggtaacatcaatgcatctgtataaccaaactgtcctgaataagaaattttgggagcaccgacttttccttgtttagtcttaaccagcacaacaccatacgcagcacgtgctccatatacagccgctgcagcatcctttaaaacagtcacattttctacttcatttatatctaaattattgaaagcaccttcatctgcaataaagccatcaataacatatagtggagtagggcttgcattacctcctaaatcagaacttggagtaatggtagtattcactgaactttgacgaatctgtaagcttggtgtactacctgggcgcccaccactaagtgatacatgtaaaccatttattttaccagctaacgcgtcacccaaactacccactgacaaatctttcaattcttcggtggaaatcgtttcaatggcacctgttgcattacgtaatttctgagaaccataatcaccaagtactacaacttcatctaatttcagttgatcttctaaaagtacaatcctaggattttttaaatcagatataatttgtgaagtatatccaacaaaggaaactttcaatttgctttttggagcaaccttaatattaaatttcccatcaatatctgtcactgtacctactgtcccatttaccaccatgacagtagcacctattatcggttcaccacttacatctacaacaagtccagttactgtctgattctgggcacacaatggcataacaaaagtcaacagtgtaccgatgaataaactgagaataatatttttcttattcattgcatttaatttttattatcatactactttacttactcttcaacaagtggaagccaccgtggatcaccagttctcttttcaagctggcttgctccagttacagtaaaatcaccattcgcagcattaatgaagccaggatctgtatcaagagtatttgtatcatatttatcattactttgactaccattataccaataagtattatattcaaaatttctagacatatttgcattacccattattttattcgtcatatctcctttaccacaatctacaaaaatagttctggagaaatttagtgttaagcatgcttgtcctctatagctattccaattagtaaagtctttgctataagcaagattgtatactgtacaattataaaaattaaaagttccatttgaatatccagtaatcttgttaggtctgttaccatttacctgtgcaaaataacttccattctgtacagtactgcaaagagtactctctttaaatgttatattaataaaactacctttattaaaatacacaatcgtattagactgattacatctaataaaagaagcttttactgtaaagttttccacacaatattttttccctgaatcatataataaatgcctattaaggtcatatacattacaaaactgaataacgatgggatctttaataacgtattctccagaagatacttttaattgttcatttggagtcttacttaatccaattaatgaagcatcagaagaacctttctccattgcattacaatagaaatccataaactttatcttcaaaccattctgtgttaatattctaccactttgaccaaatgtaattttcgaatgattaattttatttccacgaattgtaactttacgtgctccaaaatctattggacctgatatagtatattcaccgttagcctctaattcatatgccaactcttttaaagtgccatcttcattaggttccatatcagtctctggaagcggattatcaataaaccattgagtcaaatctactccactaggaatggatgcatatgtttcaagtaaagttgaaaaacttatttcacaggctttttctgcatctttgttattaaactgtttatttccaatggttttaattaagaatttatattttgtatcttcttctacttccaattcaacgctacaaccatcgataaactctccttcaactacagctatcggattttcaggatcatcaactacataccaagaaaactcataaccttctgctccatgcactacaggccattcaatagttgcattttctcctgtggcatcaagttccacttttacattctccaattggggagattccagtgtagcatttttcacatccgactcaaaagattcgtcttcgtgataccctatggtacagctacttaaaagaaataataacgtagcgaataacagtccacgtgttcttcttcgtaaaaataaacgattacttttcatacattaaatttaaattaaacaatacgttcttatgttatcaatatttaagttgaatattatatacaatagtccgttaaacatttcattcacatttatgcagtaatggctgcaaaactaatggcttctttccacagttttcgatttatttctttgttcggtttgattcctaacactaaaataaatcgtttaatgagaaatatattatggcacagcactttaactgataccattaatgatgcctttcctttttctaatactttcactttagctatattcacactctgatgagtgaggcattaaagtgaaaatgcaatttattcagctccctactttgacagtcagttaatcttgtgaattgctttccatcttgataacaattataagaagcttcccataagctcttgaatgaagacatgttagtaaactacttaaataatcataaaatacatataccactcttctttttcttcatacataaaaaggacgtatgatttaaagatatgtaatcacataaaaagaacaaaaatgaagttaattggaaattatatgcaaaaaaaggcctcaagacacttttcctattaaaaggaaagtgccttgaggccacctttttatattaaattacttttttccgggaatcagaaaaatcttttattctgccaatgggtcgaaagtacccataccaccgtgagcataatcttcccaaccaatggtctgatacaatgtcgcattagtttgctgtgcactttgacgcaatccaaagaaataatatctgggttggaaataaggattaatgtccagcacattaccatcaagactgatatctttacgtgagaaataggtatcatagaatgtacatatacttgacacagccggatcaagaatcgtttctccgtctgcttccgtagcaatcttctcattcaatgtcagtgctgctggtcgctctacgtttttaatcggatcactgtcattatttgcagacccggtaccttcaacattgatttctatgcgatatctcttaccacgttcattcatcggagtcacacccaaataagtacaagtattacctccaaagccactcaatgcccaacttgcattcaaagcaccttgtcctacacctccgtcaaatagcatccaacgacgcatatcatacgcacgtttaccttcaaaagccaactctacctgacgttcatacaatatagcttcaaacaatttagcacggtcagtttcaatcgccgcatccaggccataattatttgcactcgtatagcctactctgccacgtacggctttcagcgccttgaccccttccgcatgataagtgccgcccgcaccacaagctgattctgccagattcagcaatacttccgcataccgtatctccatgtaaggagctgccgatcgtctgaatccctgctgatcaccactgctgttatcagtaaacacataaagactagtgcccaaatcaaaatcatccgaacgtttacgaacatagactcctctattcttagtgcccagcatatcggctgcaaaaccgcttctactcggattattacgctcatcagccgtagtataccaacaataattccaaagttcatagttcgcaccactggtataacgggttgggcataaaccagacatcgttgctcctgaaaaatcgacattgccactgttgaatttccactctacccccggaaatgcaaatgtacggtagaaacgcgggtcacgatttagaaagaactttttagggtcataatgaactcctgattccatcggtttcttaccgtcaatcatcgggaagatgtctattatttccgctgtaggagtctttcctccgcctccgtttatatttcctggtcggattccctgctcccacaagttgtatcggttgatgttttgtgaagcaataggagacacattattatataaagtaacaaatacggcttcgcttccacctgtataagtggcgaacattctggcccaattcttggcattgtcttctccgccattgccttcataagcaagtccgaagttaccttcattcagtttagtgatggcagcaaaattggcgtcgtaagcatctttccaacgagatgcgtcatcggcacggttaaaaagtggactagcataaagcaacaatgtacgaccttttagagcaagtgctgcaccggcggttatgcgtccgtaatcctgcccttcattctgccaacgtgcaggaagatagctggctgccagttccaagtcatcgcatataaagtctatacaagccttagtcgaggaacgaggaatgaccagattctcaccattaccatcacctatcaccggattctggacgtggtctacaatgggaacaccaccatacattttcaccaacagataataacgccatgcacgaaaaaagtaagcttgtccgagtaattgttctttctctgtctgcgaaagagtcgcacttcccgtcacaccttcaatcacattattacattcgcggatacgtccccaaggacttctttcactgttgattacataaaaataatcgggaacagtctgaatagtaagagatgccgtaggatcattgaaaatagagtagtctccatattcctccgtacatttggaaaaatcgtcatcaatacccgcactggttatatcggtcaaagcattggaacctccggtagaactaggcaataaagactgatataaaaagtccacacgacttttggctgtttcataattttcgtacacaaccgaagcgtcatagcttccatatactttcttgtctttcagaaaatcatcgctgcatccagtaaaacagattagtcctgtcaccatcgatgctgtcaaacatattttatttatcttttctttcataatcttctttgatattagaatgagacattaacacctaaagttactttacgcaaattaggatatcttccataagtgcctccccatgtactccaaacaccatcaggataaggattgtaaaagtttaaaaggttctgagcagtcaaattcagacggcaactgctgatgccgatccgatttgtccattccttcggaaggctataagcaactgtcaaattacgtaatcgaacgctggctgcgctaactttccaaaatgtagaagcctgaccgtttatggcactatatcttaagtttggatatttagcactccggttcattggcgccactacattaccaccggcatccaatacatcttcatacacatacatatctttccacatggcagatacatttttatattccagatcatcgtatttttcctgacgtaagtctgtctgtacaagagcataagtaccccagcttgcaccaaattgagcactgaatgagaagttcttatacgaagcaccaaaattaaaagtcaatccataaggattattggcacgattggaaatcttcacatagtcattctgatcaatcacgccatctgcttcaccataagtaccatcggcattacgctgaccacgtacatcacgatagatcaacatacccggatgaatgttatctttcgtattcccaagataagaagtgatcttattcactgcgaaatactcttcgatatcctgataggtgcggaacatgccaatacattcgtatccccacacaccacggtcggaacgttcaccccgaacaatgtcatcaaaaccgggagtagcctggaatccggcttctttaatcttgttatcactgtaaccggtagtcatttttacccaataagaaaaatctttaccgattttatctttccaattcaaagtaagttctaaaccatacgtatcaacttctccaaagttctcaggagtagcctgcgtacctacagtagtcggatagaaagaagtacccgtgaaagttgtgaacaactcacgtcccatatcatagtaagcatctaatgtaatacccagtctactatccagcatcctgacatcgatacctaaattggtcttgtaggttttatcccaatgtacatctgcgttgacccctctttgcggcatttggaatgttgcaccactataggtattggtggctgtaccaaatataggacctccatctgcatttcggctataaagttgtgtccacaaccaaggttgtatattatctcttcccaaaataccgaatgaaccacgaattttcaagaaatcaatacctagtttttctttattaaaccagctttcttccgagataacccaacctgctgaccatgaagggaacattccccagtagttactaggagcaaatttggtagatgcatccgaacgaagcaggaactcaaacaaatacttgtctgcatacgagtagttcagacgaccgatataagagagcatacccgattccgtacgaccgaacgtagtcgtttgatccgcaccggtagctgtcgaattagattgtccatcggtaaagctgaaaggatcagttacagtaccggtcagatattcatattccgattctgccttttcaatagaaaacaatccattcacattatgcaaaccaaactgacgtgcgtagctgactgtcaagttcatctggtagttatccgttttattcatcgcacggctcaataaattaccattatccaaagtaaaagtaccaaaattgctatcatctatatttatatcatcgccagtataaaggtgatttccactgccaccacgttccagcagcctgtagacattcattttagtaccgatattattactcttattattgataatgctcctcgaataagaacctttcacttttagccccttcaaccatttgctccaaccaaaatcatattccaatgaaccgtttatggacatattatttgtctgattttgagtattgtcaggagaatcctgaactgctccaaaatggaatagtcgtacagcacttaagcccgaagacacattttccatacctgtatatataacaggacgtccacctacatatccgggcacaaaaggcaaatgtgtcattagagaattaaaatcagcatctgtcccaccactggttataccattacgtgagttattctgttcacccatgtcacctgagaactgtaaggaggctttaatccacttaccgatattagcattaacacccgcacggaagttccaacgatcataatctaaacgtcccatattaccttcttgattatagtaagatgcacccgcaaaataagtagccttctctgtaccgccattaatactgaaactgtggcgttgcgtccaagccgcactccactcatcatccagcaaatcgtagttcagtcctctcattgcttccaattcgtcagcctggaaatattgcgttcttctattatccgattccgattcaccggtagaagttccagctacacgtgcggcattataaatacgtccataatcataagcacttagcatcttaggttttttcaaagcatcagtaaaaccgaattgccctgtataagatatggaaggtgtacctaccttaccgcgcttggttttcaccaatatgacaccgtaagccgcacgtgccccatatacagctgccgaagcatctttcaaaaccgtaatactttctacttcactcacatccaaattattaaatgcatcctctgtagaaataaaatcgtcaattacatataatgggctaggatctgcatcacctccacgcgttgaattgggagtaatgctggtattgatattactttggcgtatttgtagacttggggtactacccggacgaccaccacccgaatttacatgcaaaccactcatcattccgctcaatgcatcacctaagttacccaccgaaagatctttaatctcatccggagtaatggtttcaatcgcccccgttatgtttttcattttttgtgtaccataacctacaataaccacctcatccagattagctacatcttctttcaatacaatctttggattattcaaattcgttattgtttgagaaacgtatcctacaaatgaaacagccaatcttcccccttccgggacgggaaggctaaatttaccatcaatatcacttatcgtgcctaccgtagaatctacaatcttaattgcagccccaataattgggtcaccaaattcgtccacaacaaccccggtcaccgtacgtgcattttgggcatagacgatttgcgcaaaggcttgtataaaaagcatacataagcctaaaatgaaatatcttttactcatagtattctgttattgtttatacattgtattcattctgttgtcggaagccaacgtggatctccacaacgattcgcaatatgctccgagctactcaaagtaaaatcaccgttagcagcattcacaaactttggctctaccttaatagctgttcccgaatggtctcgtccattctcatcactagtatcataatcaaggaatcctcccggaacagcactataataataagtattatatccaagtgtataatttacattaccataatttcccgcattacagatccgtctgaaaacaccttcagttcctgtggccgaacttacgacacagtctgcaaaaatagtattctgcatttccaaaaagaacacagcactattactgtttattacattattaaagaaacgattgttagtgccaatttgatagaacgtacaattactcattttccgaagcgatgtactccagccagatccgctaaagtttgacggagtacgtcctctcatctgaacaaaataggcagatccgggaaccgtataataaatagtactgtttgaaaagctcaaatctttgatccaaccttgaccgttgaatgctataaatatagtacttgctgtattaatgctaaccaagcaatcagtaatagacaatgacgacaaagcataaccattattacagtaatataatggtacgggaagatcttttatagtacaagattggaaaacataaggctgctgcactataccggcttctgtgctattgaacataacgacacctctactattagaagcactgtaagtatcagcatcaaaatcaaaatctataaacttaatttttagaccagctccgcgatttataaaagaagcatttcttttcattgtcagtttggcatgatttactttgtcgccacgaatagtcaatgtagtcgttcctaaatcaatattaccatccatttcatatacaccacctgccactaattcataagctatttcttcttctccttctgcaagaggctcaatcggatttgccgtaaaatattcggtcagattagttcctgttggtattgtttcacgtactcgaaccaatgtattataagtcatttccgtagctgcaacagcatcagcgttattatacttctgatttcctaatgctctgactgcaaccttatattttgtatcttcagtaatatcacgcgtaatcgtacatttatctacgacttcattctcttcgcctataacaactggattgtcaggatcatcaatattataaaatgtcacttggtacccaccggctcctagcactaccggccatttaatttccagagacgtaatatctacgtttctggtaaaagtccaaccttcagtcgacggtgattccaaggttaccccctgaacttccgatgagaaggtccaatcatccttgtatccatcgacacaagaactaaaaagaagtatagctgccgcaaatgccaaactatccctttttactcgcaagaataaatgtttactcttcatagattaaattttaatttatataaaatgatat

SEQ ID NO: 182 - DNA, 14554 bp, Bacteroides thetaiotaomicron
cccgtacaccgatgaaaacacctatttacctacttctaatcgtttgtatttttgcatcctgcaacaccaaacagacacaagctgaaattgattacacatcgtatgtaaatccttttattggcaccgatttcacaggaaacacttatcccggcgcacaagcccccttcggtatggtgcagctcagcccggacaacggacttccgggatgggaccgcatctccggctatttttatccggacagcaccatcgccggcttcagccatacccacctttcgggaacaggtgcaggcgacttgtacgacatctctttcatgccggtcacactgccctacaaagaggcagaagcgccgctgggcatctactccaagttttctcacgatgaagagagcgcctatgcaggctactatcaagtacgtctgaaagactaccatatcaatgtggaactgaccgcaaccgaacgttgtggcatccagcgatacaccttccccaaagccgaagccgccatcttcctgaatctgaagaaagccatgaactgggacttcacaaacgattcgcacatcgaagtagtggactctgtgacgattcaaggataccgttactccgacggctgggcacgcgaccagcgaatctacttccgcacccgcttctcgaagcctttcgacaaggtggaactggatacgactgccattatcaaagacaagcaacacatcggtacggctgtcatcgcacgttttgacttccataccgaagaaggagaacagattctcgtcaataccgccatttccggcgtcagcatggaaggcgcagccaagaacctgcaagccgaagtgcccgaaaatgacttcgacaagtatctggcagaaacaaaagcaaactggaaccgccaactgggaaagatcgaagtcgagggtgacaatcaagacgataaagtaaacttttatacggctctgtaccactcgatgatcgcacctacgatttacagtgacgtagacggagcctattacggtcccgacaaaaaagtacatcagagtgacggctgggtgaattacagcactttctccctttgggatacctaccgtgccgcccatccccttttcacatataccgaaccggaacgtgtcaacgacatggtaaaatccttcatcgccttctttgaacagaacggacgcctgcccgtatggaacttctacgggagtgaaaccgatatgatgatcggctatcatgccgttcccgtgattgtagacgcttatctgaaaggtataggcaactttgatgcggagaaagcactggccgcctgcgtagctaccgccaacttggataactaccggggcatcgggctatacaagcaattaggctatattccttacaacgtgacagatcattacaatgccgaaaattggtcactgtccaaaacactggaatatgcatttgacgattactgcatcgctgagatggcgaacaagatgggcaagaaggagatagcggacgaattctacaaacgttctcagaactacaagaatgtttacaacccggccacttcgttcatgcagccgcgtgacgataaaggaaactttatcaaagacttcaaagccgacgaatacactccgcatatctgcgaaagcaacggctggcaatacttctggtccgtgcagcatgacatagatggtctgattgatctcacaggaggtaaaaaccgctttgcagagaaactggacagcatgtttacctaccatccggcagccgacgaagaacttcccatcttcagcacgggaatgatcgggcaatatgctcacggcaatgagccgagccatcacgtaatctatctcttcaatgccgtaggacaacagaacctgacacagaaatacgttgccaaggtaatgaacgagctttacaagaacgagcctgccggtctttgcggaaacgaagactgcggacaaatgtctgcctggtacgtattcagcgcgatgggattctatcccgtcaatccggtcagcggaaagtatgaaataggtactcccctgttcccggagatgaagttgcatctggctaacggaaagacatttacagtacttgctcccaaagtgagcaaagagaatatttacattcaatctatcaaagtagacggtcaaccgtacaacaagacctaccttacccatgaacagattatgagcggtaccaccgtcgaatttgaaatggggaatactcccttagtggaagtcgaatttgaagaacagacccagtaggtccacctaaactaatctatcggaaaaatgaatgaaaacttcgacttaacctacaaagctctattccgcaggtactaccccagcctgatattctatgccacccgactggtgggagaagaagaggcggaggatgtagtgcaggacgtgttcgtagagctttggaaacgaaaagacagcatagagataggagagcagattcaggctttcctctatcgtgctgtctatacacgtgcccttaacgtattgaaacatcgtaatgtagaagatggctattgcgccgccatggaagagataaaccggaggcgtgcagagttttatcagccggacaataacgaagtgatccgcaagatcgaagaccaggaattgcggaaagagattcacgatgcgatcaatgagcttccggacaagtgcaaagaagttttcaagctcagctatctgcacgacatgaaaaataaggagatagccgatgtactgggagtttcactccgcacggtagaggcacatatgtataaggctttgaagttcctgcgaaatcgtctcggacatctttggttcattctcctcttatttttattggattaaagataagtgtttttggggtttcagttgtattacttatatgaaggaaaagaaaatgagaaatctgagcgaagaaataataaacaaatatctgactggtcagtgttctgaagaagagctgatggaggtaaatgcctggatcagcgaatcggacgaaaatgcccgccagttgttccgcatggaagaaatttatcatctgggtaagtttgaccattatgccgatgaacagagaatggctaatgcggaaaaaaggctttataaacaactgtcgcaagagaaaaagaagaaagataaagtactgcatatgcatcgctggatgagatatgcggccatccttgccgtcgctttactaatgggcggaggagccggatattggttctacaaccggccggaacatcagatgctggtagccgttgccaatgaaggcatcgtgaaggaagttgtcttgccagatggaacgaaagtctggctgaacaatgccgccacgctgaagtacccgcgcgaattctccgaaaaagaacgtaatgtgtatctggacggagaagcctatttcgaagtgaccaagaaccgccataaaccattcacggtagaaagcgacgctatgcgcgtacgtgtactgggaaccactttcaacttcaaatgcgacaaacgttgccggatagcggaagcaaccttgatcgaaggagaaatcgaagtgaaaggcaacaaggacgaaggacaaattgtcctcgcccccggtcagcgtgccgaactgaacagaaacagcggacggctgacggtgaaacaggtcgacgcgaaactggatgctgtatggcgtgacaatctgataccattcaataaagcaaacatatttaccatcaccaaggcactggaacgcttctacgacgtgaagatcattctgtctcctgacattcggtcggacaaaacatattcgggtgtattgaagaaaaaatcaaccatcgaatcggtattgaaatccttgcagaattccatacctattgaatataaaatcgtaggaaacaacatctttatctcttcagataagaaatgagtcctgtgttaaacttaaactaataaacgacatgaaattaaagacacttctgataggatgtttcggaggatttataatgctcaactcctgcacagagtcccccagtgtaaaagattatagtgcttatgtcaatcctttcataggcaccggcggacatggacatactttccccggagctgtagttccgcacggtatgatccagcccagtccggacaccaggatcgacggctgggacgcctgctccggttattattacgacgacaacacgatcaacggtttttcgcatacccacgtcagcggtacaggctgttgtgactacggagacgtattactgatgccgactgtcggcaagccgcagtatctgacaactgatccggaaagccagaaactggcttacgcctctgctttctcgcacgagaatgagacagcggaacccggatattactccgtcttcctcgacacctatcaggtaaaagcggagatcacggctaccaagcgcggcgccatccaccgctacactttccccgaaagcacagaatccggatttatcatcgacctggactacagcctgcaacggcagaccaactacgagatggaaatcgaagtaatcagcgacacggaaatctgcggacacaagaagacgacttactgggctttcgaccagtatattaacttctacgccaagttctccaaaccgttcgcatataccctcatcaccgactctgtcacgatggacaacggcaagcgcctgcctgtatgcaaagcggtgctgcacttcaatacaaagaaagacgaagaagtactggtaaaagtgggtgtatctgccgtcgatatcgccggcgcacgcaagaatgtggaatccgaaattcccgaatgggacttcgacaaggtacgaaaagacgcccgcactgcctggaacaattatctgtctaaaatagacatcaccacttccgataaagaagataaaaccatcttttataccgccctgtatcatacggccatcagcccgaacctgtttacggatgcggacggacgctatctcggcatggatctcgaagtacatcagggagataccatcaatccgctgtatactgtcttctccctgtgggatactttccgcgcgctgcacccgctgatgacgatcattgacccgaatctgaacaatcagttcatcaattcactgattaggaaacatcaggaaggcggaatatacccgatgtgggatctggcttccaactacactggaacgatgatcggatatcatgcagtcccggttatcgtggatgcctatatgaaaggttaccgcaattttgatgctcacgaagcatacaaagccagtctgcgggcagccgaatatgacacgacaggcatcaaatgccccgatctggtgctgccgcatctgatgcccaaagcgaagtattataaaaacgctatcggctacatcccctgcgaccgcgaaaatgaatctgtagccaaagcattggaatatgcctacgacgactggtgtatctccatctttgccgaagcgatgaacgacttcgaaaacaaagcaaagtatgaacgtttcgctaaagcctatgagttctatttcgacaaatcgacccgtttcatgcgcggactggattcgaatggcgaatggcgcaccccgttcaacccgcgtgcctccactcaccgtagtgatgactattgcgaaggaaccgcttggcaatggacctggtttgttccgcacgatgtggaaggacttgtgaaactgatgggaggcgaggacgcttttgtagaaaagctggattcgctgtttacagtcgattcgagtctggacggagaaaccacctcggctgatatcagcggactgatcggtcagtatgcacatggcaatgagccgagtcatcacgtgattcatctgtacaactatgtgaatcgtccgtggagaacgcaggaattagtggacagtgtctaccggagccagtatgccaacaacgtagacgggttgtccgggaatgaagactgcggacagatgtcggcatggtatatactcaactcgatgggattctatcaggtatgtccgggcaaaccggtgtattctatcggacgtccggctttcgacaaagccgtgatcaatctccccggtgaaaagacattcagcatcgtggcgaagaacaactccaaaagcaacaaatacatcgaaagcgtattgctgaacggcaaacctctggacacgcctttcttcggacatcaggacattgtagcgggcggagtcatggagatcagaatgactgaccaccctacacaatggggagtcagacagtagccaacattccggatacctgacatcacgccgtcattcttcgctatgctccggatgacagcgtgatgtttctcaataatcatataaaccattacttatcatgaaaagactcttattaatagcctgtatacttaattgcacgctattgtcccaagccaaagactggacgcagtacgtcaatccgctgatgggttcccaatctacttttgagttatcaacaggcaatacctatccggctattgcccgtccctggggtatgaacttctggactccacagacaggcaaaatgggagacggatggcaatatacctataccgccaacaaaatccgcgggttcaaacagacacaccagcccagtccgtggatcaatgattatggtcagttctcgataatgccgatagtgggccaaccggtgtttgacgaagagaaacgggcaagctggtttgcacataaaggggaagtggcaactccttactactacaaagtatacctggcagaacacgatatagtcaccgaaatgacaccgacggaacgtgctgtgcttttccgtttcacattcccggagaatgatcattcttatgtggtcgtagatgccttcgacaaaggttcttacatcaaaattattccggaagagaataagataatcggttataccacacgcaacagcggtggtgttcctgaaaacttcaagaactactttatcattgagttcgacaagcctttcacctataaggccacggtagagaacggaaatctgcaagagaacgtagcggaacagacaaccgaccatgccggagcgatcatcggattcaaaacccgcaaaggagagcaggtgaacgcacgtatcgcctcttcttttatcagcttcgagcaggctgccgctaatatgaacgaactgggcaaagataatatagaacaactcgcccaaaaaggaaaagatgcctggaatcaggtgctgggcaaaatagaagtagaaggcggcaatctggatcagtaccgtacattctactcctgcctgtatcgttcactgcttttcccgcgcaagttctatgagctggatgcgaacggtcagcccattcattacagtccgtataacggacaggtacttccgggatatatgtttaccgataccggcttctgggatacattccgctgcctcttcccgctgttgaatctgatgtacccgtcggttaataaggagatgcaggaagggttgatcaatacataccttgaaagcggtttcttccccgaatgggcaagtccggggcacagaggttgcatggttggaaataactccgcatcaatcctggtagacgcctatatgaaaggagtaaaagtcgatgatatcaagacgttgtatgaaggactgattcacggaacggagaatgtgcatccggaggtttcttctaccggacgattgggatacgagtattataataaactgggatacgtaccctacgatgtgaaaatcaacgagaacgccgcccgtactctggagtatgcatacgatgactggtgtatctatcggttggctaaagaactgaaacgtcccaagaaagaaatcagcctgtttgccaaacgtgccatgaattacaagaatcttttcgataaagaatccaagctgatgcgtggtcgcaacgaagacggtacattccagtctcctttctcaccactgaaatggggagatgcctttacggaaggaaacagctggcattatacctggtctgtcttccacgatccgcagggacttattgacctgatgggcgggaaagagatgtttgttaccatgatggattccgtatttgccgtaccgcccatttttgatgacagctattacggacaagtgattcacgaaattcgtgaaatgacagtgatgaatatgggcaactatgcacatggtaatcagccgatccagcacatgatttacctctatgactatgcgggacaaccgtggaaggctcaatactggttacgtcaggtaatggacagaatgtacacgcccggaccggacggttactgcggagacgaagacaacggacaaacttctgcctggtatgtgttctctgcgctgggtttctaccctgtttgccctggaacggacgaatatgtgatgggaactcctctgttcaaaaaggctactcttcacttcgagaacggcaatagtcttgttatcgacgcgcccaataacagcacggaaaatttctatattgattccatgaacttcaatggtgctgatcataccaagaattatctgcgtcacgaagatttgttcaagggaggtactatcaaagtagacatgagtaatcggccgaatctgaacagaggaaccaaagaagaggatatgccttattctttttccaaagaatagtagttagttcatcgattaaattcacgttcctatattaggccctttttcttccggttttctgactttctctctgttctgaaagactttatccggataatagcaaaaaaacgatagccagaaagtaaacttctttactatctggctatttttcagttagtattcactacttttgccggacaaacaactataaatcatggaagaagaaattgactttaccaaagtcccctatcagtacgcaatgtgcctcaatcgggaatgttcaaaagcaaacacttgcttaagactacttacagcacaaagtgtaccggaaaagattgaatactgggttattatcagtcccaaacatctcgctgcccaacaagggaattgtccttattatcgttctaatgtcaaagtacgttatgctaagggattcatcagaatgttagaagacttgccttataagcaaatgcaaactgtcatatcacatttaatgagctattttggtcgcagaacttactaccgcatccgcaaaggcgaacgcctccttaccccctccgagcaacaaagaatattaaatatcctcaagaattgcggagcaactcatctacaaaactttgatgcatacgttgaagattatgactggtgatcggcagtaacacgaagtgatactactgttacgctcagaagacacaactgtcaccatttggtggcactgttgtcacatattggtggcacgactgtgccaagccgttggcacaacaatgacaccgtagtggcacaactgtgccaagcccttggcacaagggttcccttacgaggagacagggagggacatagtagcttatacaagaaaagagccaggcttcatcattctgaaagcctggctctaaaattaacttatctgctaatgactagatcttactgagcattgtagatataaacttcagttacgtcaatactgaaacccgctaataattcaactttcacataacgagctgttatagaagagaaaaattggaaataatgattacccacacgaggagtttccaacactccctgcggagtccaggcttcattatccaatgaagttgaaattcctactttcttagaagcatacgtatgataataatccatacctaaagcagaaaaagtctgtgctgctttcatatcaataacaaaccaaaatggatttgaactatacacatctgacccatagcttcctccattaccatcaatcaaataactagctctgccatagacacctgaaggaatttccgcactccaacctactttcgacaattcagtccagacactacctatggcggacaaatatttaaagtttctaagtactttatccacattaaaggttaaaaaattctccttgctattaatcttcacaacggggtcttcactttctactgacgcagttacaacaagagtgtgagattcttctccagttgttgtcagcaagaaatcatcagtaatagtccaggtagcctctgctgattctaattcaccgacagatatggtaatttcagcaggagtaacagtgatattcttcataaactgttcgtccagacctgtagtggcaagttttacctttacgtcttttcttgccggtttgtccaacttcattttgaaggtacaggatataggatcagaattgacaatcgctccttgagagaaaccacgttcgaatgtaacattatttccactgtcaccagccacagagcatgaaacagtatatgcttccttctctattacaactttagattcaattggctcagttcctatctcatatccttccacattggctttcacccccaattcgtaagttgccgcatcataattggatgctgcaaaactaaaatcttcatccttcaaagtcacagtgacagaagcatctgttgaaccggcgggaagaactactttagtgtcactgatctctacattttcctttgggatattagtatttataatatcaaaagtcactgtagcatcttccggtgatgcagcaaaatggaatgtataagttctagtgacaggaccatctaatttcaatgtaccatcagacttgtaaaccgcagttaacgtcgctttggacgctccttccgcatcatcaatcgttataacaggctgattcactggatatttaaccaaatccaccacctcatcatcctggcatccagcaaaagtaacgaataatcctaatgctagagataaaaagagtttataatgtgctttcatattcttgttttttatttgtttctatttctccatagcgattaaaacaccaatcgctatggaaagctttacatttattatttttggggaagatcatccggatatttgtaaggtgtcggatcatcctttttatagaatattgtaggttgttttatctgagatccatacaatgtttcagcaccggtcaaacgtctaaagatacttgaatattttcccggactcggagcaaatcccatataccaaccgtacccatcatttatcagactatgagccgttgacggtgataaatcgccgccaatacccaaatggaattccattgctatacctgcgcattgtttcttagtcatattccctactggatgcgcactgtaaccatagtttggaacagcaacatcaatccattcactcgcatccacaccatcaactgtagctactccatacatttgaccatacgcaaatacagttactaacttatcaggcattgccaacttggtttcataacatagacgagccgctgcagctgtactcggagtagtaagagacgggttactcaaatccggagattttgaatattcatcatcataatttactccatccaaattgtatgctttacaatactgagccacttcgcgagcaaagtctttagcgccctgattagaaagttgagctaaacctgtaatgtcatgatttccaagtaaccctaacagaaccttaacacctcgtttacgaagaggctgcaaaagagtttcattgttatccaacagatattgcacattcggattacactgtacacgcggacgccctgcttcagcatcataattaatattagcagcaaacagcacaataacatcccatataagttttccgttttctaattgaaaagacaaagtattcaatggattaacaccatttacctcaaaaaacaaatagccctttacagcatcttcgcccttataagtatcaccggcatttcgcatatctttcaccaaataaatacaatgtttcgcatcttcatctttaatagtgatatcactgctctgatcacttatagctaccggaatagcatatgttttatcttcctgcagaccttctcctgcccgaatagtcatctctacctccgctgatttagtattagcgttcactgtaagtattccttcgttagcaaaggtaaccaagtcctgcggatacaatgcaaaatctgtattatgcgccttattatacgtttccaaataagcagcatcaattttcacttttgccgatgtagctgtattaggtgtcttgctcaaccccatttttactgtagtagcataagtctcaccgtgcaattcgacaaccttagaaactaagttcgactttccatcacgcagatatgcattattttcataaatgccactgtaggccgactcatcaatattctttccgacctcaagatcatcagcacaagaggtcaagaatgcagtactgctcacaatcatggcagcgaacaaacccgaagttatatatttcatattcataatgaattcttgaataaaagattaaaccaacaattaatttatcttaggaatctctacttttacccaagtaggatcgcccgaacctgtaatatcattaccatgtccagtctggtcggtaataacatttccggcaccttcattaaacttccagtaagcaaccagtccttcactggcaggatctacttcataaggattagtggcaatttgctctgccgttctttgcactgaccacacgcggacttctgaaatatctcccggcaaccaacggctattgtcatatgcacgaccaatgtaacagctactgctcaaagatacattacctgaagctgcttcgtctttataaacaggcacaccatctttataatagattcgttcttttgttgtattatcataaacaatggcaatgtgtacccactcattaaccggtaaacccggaacaacattcggacctgggaaattaccaccgggagctactacctgaacttgatcacgtggacggtcagcatcaccaatacgtacaaggaatttaccttcaataccgaaaacagaactcagggcattatcacgtcctgctacccagtcttcactacgaaccaaagcttcaatagtaacagtagaaagactattcacactgctcttccagttaattgggaaatagatttctttgatatttgccactacattaataagggcagcacccttaaatatgaaataagcagtacgggcactttcgagtacatcaatattggatgcatctagaatggtgacgggcaatacatatcgttttgacttatccaattcgttggtattcttaaagtcaatcacaatattatcactggaaatatcccctgccttaatagtagcagtttttgttggtatattataaaaatatgaatccagtgcagttgcgttatcattgtaaatcaaattatatgctgctgtcatagcgggagccgcatcaaagcttatttgaatatcttgttctgccggcgatgctatacgatagctaagttcacgggtagcctcagttatactgggtttaatcagcaaatcatcacaaacaggagccgagctaacatagagtttattgtcataatgatgctcttcattgatatcttcattcttacaaccactcactgtgactgttgtaagagccaaaagcgcaaaacaatatttatagagtttcatttctattcttatttattaggattcataatacgaataacttcacgcacatatccataagtattgttataataatcattatggacattcataataaagattcctttccgggtgtaattaggagatgcttcaaccatccaccgggctgctcccggagctgctactagtttattgcctttttcatccactgtactccagtaacccttcactttatccttatcgtcagcctgcggcaattcgacacaaacgataaaacgatcagcaggaacaggattcactccttcttctgtaccgcctactgcatctatacccgcctgaatagccaaatatgcttttaaagcaagatcatcagcattggtagaagaagcagttttcaacatgatgtagtcaaacttgcttaacatatccatattctccggcactaaatattgtacatttccgtagaataccagagtcttgtcatcatgattgccttgccagttcatcacctcgccaaaaaacttctgttgacggtcattatattctttcagagctgcctccggaaggctcaccagcgaacgccccgtataatcagcaataacaccatcaaagttatatttgtcacagagtgccaacatctcattggtgcgttcaccgatatactgaagagcatcctcttctgtcaactccggttcggcttttactttctccttccaggcattttcaatgctggaataatcaatactgtaaaccgtacgagttcctttctcgcgtattttgaccatttctgcctgtacttcgggacttacttccggattattcagacaaatgaaatcaacgctgtcaggtacgacggtcagacgttcagcctgcttgccgggagatcccttagggttctcgaaagaaacaaaagtgaccttatgttcttcagacttatatctgttcaaatccttcagatagtcagcatacaactgaggattctgctcttcaaatgtaggagtattcaattggagactttccacatctgtccaatcactacatgaagttattgtcagagctgatgccagaaacagcagagcagacaatctatatttcaggttattt

SEQ ID NO: 183 - DNA, 14414 bp, Bacteroides thetaiotaomicron
cagtagtacatgtgggtattacccagttgtacatcttggtattaccgagtcgtacatgtggggatatctatttatatagattaatatgactctgatataaagaaagagtgtgtatctttatatgttatcttacaatagaaggacatggcgtaggagtggaagaatgctattggaagagatctactatgaaaaagaagtattgggaaaccatgttttttctttctttcttgcagttttaggattttcttgataactttccgccctactttttctaaatactagttgctatggaacgcatgtccattaaatatttcgtgaataataatagtttgggaccagaccggaacatttcttcagtcggctttgaagaaattcccccaaatacttcttatccgactttgaatcattctgccggttattattttaatccggataaaggacgtatactgacggagtatcaactgatttatattacagagggagaaggagtgcttgaaacaagaagtgggggagtgtttactatcaagcgaggtatgatttttgttctttttccgggcgaatggcacacctattatcctaattatcaaacaggttggagtcattattggatcggcttttgcggtccggaagttgatagctggatgacgaatgagtattgttcgaaagaaagtcctgtatttaaggtcggtatcaatgatgagatcgtttctttattcagaaaagctattgatgttgctaacgaagaacctactttatatcaacgcgtattgagtggattggtgacctatctggtagcactaatgtgtagtatcgataagaaccttcaggtagagaatgatgatttctcttctaaaatagattatgcttgtgtgctcatgaaggaattgatagatcaaccagtttctatgcaagagattgccaaaaaagcaggtatgggatattctctttttcgaaagttgtttaaggaacagaagaattatgcacctgtgcaatatttccagaatctgaaaatacagaaagccatagagttgttgactactactactattccggtaaaagagatagcatataggctcgattttgaatccccggcttatttctctgcccggttcaagaaacaaacaggaaaatcacctatagaatatcgagaagaatttcgtatcaaataatgatagtgttctggcaattatcgaaagtctttctcttttaagatgactaagtttgtatcataattaaaaaatgaataatgctatgatacaacaaaaagtaagagtgggacttttaggagtcggattggatacttattggggacaatttgaagggcttcttccccgtctgttaacttatcaggatgaaatagctgccaaaatagaggcaatggacgtacaagttatcaatacggggatggtggattcgcctctaaaagctaatgaatgtgtcctacaattaaaacaagctgatgtagaattggtttttctgtttatttctacttatgctctttcttctacgatactacctgtagctcaacaagtaggcaagcctattattatattaaatatacagcctgcatcagcaatagattatcaaaaactcaattcaatgggggatagaggaagaatgacaggtgaatggttggcacattgtcaggcatgttctgttccggagtttgcgagtgttttgaatagagccggtgtgcgatatgatattatcaccggctatttatcagaagattatgtttgggaggaaatagcctcttgggttgacgctgtacgtgtaatgtatggaatgcgcacaagccgtttgggagttttggggcattactattgtggtatgctagatgtatatactgatcttatgaagcagagcgcagtgtttggtactcatatagagttgctggagatgtgtgagctaaaagcttatagagaagaagttagcgatggggaactgaagcgaaaactggacgaattttatgataagtttaatgtggaagcatcatgtagttcggaagagctagtgagggctgcacgtacttctgtggctttggataaattagtgaatgtgcatcaactgggagcgatggcttattattacgaaggattctgtgggaatgattatgagaatattgtaacttctgttattgcaggtaatacgttgttgacaggatatggaatacccgttgccggagaatgtgaagtgaaaaatgcacaggcgatgaaaattatgtcactattaaaagctggtggttctttctctgaattttatgcaatggattttaaggatgatattgtattactaggacatgatggcccggcacattttgcaatcgccgaagagaaagtgaaactagtgcctcttccattatatcacggtaaaccgggtaaaggtctgtccatccagatgagtgttaaaccaggtgatgttacacttttgtcggtatgtgagggaagagacggagtctttctacttgctgctgagggagaggctgtacaaggagaaactctacatattggcaatacaaatagtcgttatcgctttccgtgtggtgctcgtcggtttatggatcaatggagtaaagcgggaccttcacatcattgtgcgattggcattggacataaagtctctgaactgaagaaactggcatttcttctggatattccaataatagtagttgaataatgctttaaaactctttttatggaaaagttgaagtattctcttttgtttatgatttcgattctggctatttccaatagatgggtgtcggcaaatgacatcgatgacgaaaggaaccgtatatacaatagttcttatagtgggaaatataataatcgaatcgcttttcctatagggggaattggtacaggtatgtattgtctggaaggaacaggctatatatctcatatgtcagtatggcatcgaccggaagtttttcatgaaccgggaatgtttgctgctctgtatgtgaagggggtatgtaatggggctaaggtacttgaaggacctgtatctgattggagaaaatttggaatgcccaattacggaacaggaggtagtatgggatcaatattaggacttccccgttttgatacagtcgaatttgaagcacgttttccgtttgccaaggtttcattaacagataaagatattcccgttaaggtaaccattttggggtggagtccttttattccgggtgatccggataattccagtttaccggtaggaggattggaatatagtttagagaatactagtaaagaggttcaggaaactattttctcctaccatgctcgtaactttctgagttggggtaaaggattggatgctataaaaacgatgcctcatgggtttatcctttcacagtcaggtacagaaacggagcctcatttgcagggtgattttgctatctttacggatcaggattctttaaagattaattattgttggtttcgtggaggatggtttgatagtcttacgatggtctggaacgctattgaggcaggtttaatgccacaatgtccagcaatagagaaaggtgcaccaggagcttctatgtttgtcccggtaacattgatgccaggggaaaagaaaacaatcaggatttatacggcatggtatgttcctaactcgactttgaggcttggagaggaaccggaagactggaatgacaataatgttgactccgcaagactagctgtagaaaaggcagataagggtaattataaaccttggtatagtagccgctttacaggagtaaatgaggttattgattattttctgtctcattataagattttgcgcaatcagacagaaaggttcacagactctttttatcgttctaccttaccgcctgaagtgattgaagctgtttctgctaacttaagtattttaaagtctccaacggtgatgcggcaatatgacggacgcttatggacttgggagggatgtgccgataattggggatcgtgtcatggctcatgtactcacgtctggaattatgcacaggctattccacacttatttccttctttggaacgttcgttaaggcatacagaatttgaagaagggcaagatttgaaaggccatcaagtgtttcgtgtcaatttaccgattcgtcctacccggcacaattttcactcagctgctgacgggcaattgggaggtataatgaaagtatatcgtgagtggagaatttcaggtgaaaatgagttccttatctctatgtatccaaaagtaaaaaagagtttggactactgtatctcaacttgggatcctcgtagggtaggaagtattgaagaaccacaccataatacttatgatattgagttctgggggccggatggtatgcataatagtttctattatggagctttatcagctttcattcgtatgagtgagtttctcgataaagacgttactgaatataagaaactattgaaaaaaggacgaaaatttactgaaacaggcttgtttaatggtgagtattttatccaaaagatagagtggaggggattgaatgcaaaagatccgactgttgcacaaagtttccatagttcttattctcccgaagcgaaagaaatactggagaaggaaggtcctaagtatcagtatgggaacggttgtctgtctgatggagttttggggtcgtggctctcccgaatgtgtgggatggaagaaactctgaatacagaaaaagtgaagagccatttattatcagtacatcgatataattttaagaaagatctgactgatcacgccaatcctcaacgttccccttacgctttaggcaaagaaggaggcttattattaggaagttggcctaaagggggcaagttgtcattaccttttgtctatagtaatgaagtctggacaggaatagaatatcaagtagcttcacatttgatgctacagggagaagtagaaaaaggccttgagatcgtacgtgcctgtaggcaacgttatgatggaagcgtccgtaacccttttaatgagtatgagtgtggacattggtacggacgagcgttatccagttatggcttacttcaaggattgacaggagtccgatatgatgctgtagataaaacactgtatattaattcaaaaataggagactttattagctttatcagtacggagtctggatttggtaatatagaacttcgttccggaaaaccttttgtaaaagtagtatccggtcatatagaggttgacagatttgtcgtatcggggaaagtagttgaataatcaacaataagataataactaaatttttaagtgataactaaatactataatattatggatagaagaacttttcttaaatctgcgagtatgaaaggtactgccattgttacagcttctgctgtgggtactgaaatgcttcatgcagcggagagcataggggcttctgatgttgcgtcaggaaagcggaatgctccaaaagcgaaacggttaccggaagatttacaagagcttgtaaaagatagttctttgttgagaaaacctgataacctgacagttgcctgctatacttttccgaattatcatgcttctgcattgcatgataagatttatgggccgggttggacggaatataatttggtgagaagcgcccgtccttggttccaggggcatgctcagcctagaggtcccttgcttggggagatggatgaaagtaagccgggtacttgggaaaaatataatgagctgtgcaagcagagtggtattgatgtgctgatttgggattggtattggtataataatgagccatgtttgcatgaagctcttgagaatggctttttgagagcttcaaaccgtaatgatgtgaagtttgcctgtatgtggaccaaccacccttggtatgtattgtatccaactttattacccaatggatataaagcttatcctccaagttttgcaccggcagatggtagcttgaaagagtgctggcagagtttgtcctatatcatttccagatattgtcatttggaaaattattggaggattgatgacaagcctgtggtatgtatttgggaccctaatcgtttggagaagaatattggggttgacggggttaaacagttgtttgctgaattaacggaatttgcccgtaagttgggacataaagggttacatttccattcttcaggtttttattctcctaattcgaaagaggttggttataatactgccggttcttacaatccgtttacttgggtagctgataattaccagcccaagaatatcgaactgccggattatggagtggctgctgctgatgtggctttcaaattatggcctaaacatcatgatgactttgccataccgtatcttccatctctttcgccagggtgggactctactcccagatatattccgccggtgagcagaccggatcaacccaatcgcgatgcatggcctaattgcgttattttggataatgaaaatcctgcatctttcaaagcacttgttcagtcggcttttgcgtatttgaataagcataaggatgttcctccgatcctcactattgcctgttttaatgaatggactgaagggcattacttattgccggataaccgatttggatatggaatgcttgatgcgcttgctgaagccgtgggaaagtctgataaccatcagatacatggatttttttaatattgaatttgttgaactttaaataagaaagaaaatgaaaaaccagtttgttaaatgtattagtcagttattgtttttattgttgataataggtgtattgcctgtttatgcacagaaaaaaagtaaagagaagatttatcgtttgcctgatgatcttgaaacattggcaggtgatcctgctttgttaaagaaaccggaaggattaacggtggctgcttatgcttttcctaattatcatgcttcggctttgcataataaaatatattctcagggctggactgaatataatttgattcgtagcgctcgtccttggtttgaagggcatcaacagccacgtacgcccttgttaggggagcttgatgagagtaagccttctacttgggagacatataacaagctttgcaaacaaagtggcattgatgttttgatttgggattggtattggtatgatggtaaaccatgtctgcatgaagcattggaaaatggttttctggaagctagtaatacaaaagacgtaaagtttgcttgtatgtggaccaatcatccttggtatgtattgtatccaacgaagcgtactgatggaagtaatgcttatcctccaagttttgatgctcccgatttctctaaagaagagtgttggaaaagcctttcttatatgatttcacgctattgccatttggagaattattggagaattgatgataagccggtgatttgtatttgggatgcacggcgtttggaatctaaattgggaatagcaggagtgaaacagttatttgcggagttgacggattatgcaaaaaaactgggacataaaggtttgcattttcatgtgacaggtttcagttgtggaaatatgaaagaagagggatatgatactgtaggctcttataatccgatggattggattgcaggtcgcttccaacccaaagaaatcgaattgccggattatggaacagtggcagctgatgtggcttttaagttatgggatgaacatcatggtcagtttgatattccttatgttccggctgtagctccgggatgggattctactccaagatatatagctccggcgaatcgtccggcaaaagcagaccgtagtcaatggccgggttgcactatttttaagaatgagaatccagcctctttcaaggcttttgttcaatcgtcttttgtgtatttgaacaaacatccggaagttccacgaattctgaccattgcttgttttaatgaatggtctgaaggacactatttattgccggacaatcgtttcggttatggtatgctcgatgctttaggggaagccttaggtaaagaaggaaatcacgaaaagcacgggaaatgatttgttaaacgttaaatctgagaacttatgtttactatgacaaactttgcaaagagaggacggttgtcaatctcttggagggcatgtatcctgttagttggtctttgttgtccttttcctgtagtttcttcttatgcaacagacagtataacagagattcagcagaataagacaaagaaatttagaggtaatgtattggatgaggcaggagcaccggtaacaggtgctactgtccagatacaagggaaagctggcggtgtcataactgatatagatggtaatttcacgatcgaagttggcgagagtgatgttttgcaaataacctttataggtttggagactcaactggttcctgttagaggaaaagcgtctatgaagattgtgatgaaagaattacgggatgagctggaagaagtgacagtagtagcttttgctaagcaaaaaaaagagagtgtaatcggttctattcagactgtaaaacctgcggagctgaaaacacccagtagtaatctgactacttctttggctgggcgtatggcaggtgtgatagcgtatcaacgtagtggtgaaccagggaaagacaatgctaatttttttatacgtggtgtaacgacgtttggttataaaaaagacccattgattttgcttgataatgtggaagtatcgtcagatgacttggcgcgagtacagcccgatgacattgctagtttctcagtattgaaagacgcgacatctacagcgttatatggagcacgtggtgcaaatggagttatcttggtaacaacaaaagaaggaaaggaaggaaaagctcaggtgtcggttcgtgtggagaattccttttcagctccgacgaagatgattgatattgctgatcctatttcatatatgagattaaacaatgaagccgttctgacacgtgatcctcaaggggtcattccttatccggaatctaaaattgctaatactatggctcccaataggaatccgtatgtttacccgaccgtagactggatgaaagagatgtttaaagattatactgttaatcagcgggtaaacttcaatgtaagaggtggtggtagtgtggcaacttattatctggcgggcacatttagtaatgacacaggattacttaagaatgatggattgaataactttaattcgaacattagcctgaagaagtacaatatcttatcaacttttaatattcatctgacaaagacaacagaagtgaaggtgcgttttcaggctgattttgatgattatcgtggtcctgttgacggaggtaatatcttattcgatcatgctatacacgcaagtccggttgattttcctaaatattatttgcctgatttacaaaatcaaggggtaggacatccgcttttcggtaacatggagggagctaaccatatcaatccttatgcaattatgactagcgggtataaggattatagtcgtaccaacatttctgcacaagcagaaattgagcagaatttggactttataacagaggggttaactgtacaagggcattttagtacagtgagacgttcttattttgatgtttcccgctcttatactccgtattactataaaattggtttttatgataaagagtcggataactatgtattacaagcactaaatcctgatagcgggacagaatatctgggctatagtgaagggccgaaagatgtctatacccaaatatatatgcaggctaaagccaattatgtccggaagtttggtttgcacgatgtaggagctttgttggtatatcaaaggaaagaagaactcttggggaatgccggtagtgttataaaatcattacctaaaagaaatcagggaatatctggtcgaatgtcttatggttatgatagccgttattttgtagaattcaactttggatacaatggatccgaacgattcgctcagaatgaaagatatggttttttcccttctataggaggtgcatggatgctctctaatgaggctttttggagaccgatagagaaagtggcaaataagttgaagttaaaggttacttatggtcttgtcggtaatgatgcaataggaagtgattcagatcgatttttctacttgtctaatatgaatatgaactcttccggtagaggacaggtttttggaaccaactggggaaattataaagatgggatttccacggtacgttatcccaatgagtttataacatgggaagttgcaaagaagctgaatattggttttgaactaggcttgttcaatagtttggatgtacaatttgactatttccgtgaagaccgttctaaaatcctaatggacagaagttttattcctactacaatgggattggaggctagtgtacgtgctaatgtaggtgaagctgcatctcatggagtagacttgtcggtgaattataaccattggtttaataataagatttggttgcagggttatggtaatttcacttatgcgacaagtgaatttaaagtggctgatgaaccggattatgctgctgccggattaccatggaggtcaagagtcggttacagtttgagccaacaatggggatatattgcagagcgactttttgtagatgaggcagatattgcaaactctccggtacaaagttttgggacatatttgcctggtgatatcaagtataaggatataaataaagatggaaagatatctgatgctgacttagttcctatcggttatcctacaacgcctgagattacgtatggttttgggttgtcaatgggatttaagaattgggacatatcttgtttcttccaaggatctgcaagatctagtttctttatagattcggagcagatagcaccattcaataatcctccgtcaacgacaggttcttatactcggaagacagcattatttcaggcgatagctgatagctattggtcagaagaacatcgtgatatttatgcattctggccgcgtctttctactgaatcgataaagaataatactcaagtgagtacttggtggatgcgtgatggttctttcatgcgcctgaaatcattagagttagggtatagctttccgcaacaaatgataaagaagattcatttgactaaattgcgtttgtatgcgaatggaactaatttattgaccttcagtaaatttaaactttgggatccggagatgggtggattaggagtcggatatcccaatcagcgtgttattaatttaggtatacaagttgacttttaaagaataataatatgaaaactaagaagatatttaatttcctgctactcttaggtttcttgtctggatgtgattatcttgatattgttccagataatctgccgactttagagatggcttttaataacaagagttctgctgaaagatttctgttcacttgctactcttttgttccggaacatggtaagattggaaccgacccggggatggatgtaggtgatgaagtgtggtattatagtgataattctgccgactattcaaataaaacgactttttggatagccaaaggcatgcaaaattccaatgaacctttggtcgattattggaatgggacacaatggggaaaagccatgtttgtagggatacgtgattgtaatgtttttatagaaaacatagagaaggttcctgatctttcggcttatgataaagaaacatggaaggcagaagccaaggtcttgaaagccttctatcatttttggatgatgagaatgtatggtcctatcccaattataaaagaaaacatcccggtttcggctggtgaggatgaagtgagagtcgttcgcgataagatagatgatattgtgacttatattgtttctctgatagatgagtcagtcgaatatttgccattgaatattcagaacgaagcagcagaaatgggacgaataactcgtccggctgctaaggctattaaggctaagatattagcatttgcagcgagcccgttttttaatggcaatctggattatgcaaatttcaaaaatgccgaaggtgaaccattctttaatcaggtatatgataatgagaaatggacaaaagctgcggatgcctgtttggaggccattcaatgtgcggaggaagcgggacatggactttatgagttcgtaaatatgtcttctacccaattgagtgatgaaacaattctttcattaagtaatcgttgcaaggttaccgagcgttggaataaagaacttgtttggggatgtggacaatcgggtataagagatttgcaggtactttgtcagccttggttagagtctaattactcttctgacgaccgatatcataatgcccgaaatggaacatttgcacccactttggctgtggctgaaactttttatactaagaatggtgtaccaatggatgaagacaaaaattatgattatagtaagcgatacactactcaagtagcaactgaagccgataagtattatattcaaccgggttatacgactgcaaaactacactttgatagagaacctcgtttttatgcaacactaggtttcgatggttccagttggtatggcattggtaagatggatgataatgatatgtggtatcttcaggcaaaagccaaacaggcttcaggaaagcgtggaaatactttgtattcaatcactggatattttgcaaagaagctggtacgttatcagaatgcgatggttcctgcaagcatacagatagagacatatcctttcccgataatacggttggcagatttatatctgttgtatgctgaagctttgaatgaggctaagaaagaagaaggcacagtgcctgaggattgctatacttacattgacaaagtgagagcaagagccgggctaaagggagtaaaagattcatggcgtttatatgcgaatgatgccaataaacccaatacttatgaaggctttcagacaattgtgcgcaaggaaagaatgattgagttggcgttggaagggcagcgtttttgggatataagacgctggaatctggctaatcaatactttaataagtctttgcaaggatgggatattaatcaatctgaaacaaacgaatattataagctgaatacttattttattcgtaactatgaagatcgtgaaaatctttggcccttaaaagattatgactgcattgtgaatcctaaattagttcaaaatcctggttggtaaaaatgaatattatgaaatcatatataatggtattgcatcttgtcttgatattcttatcaatcggatgcaaagaagacgataacataagaccctttgggaaagatgtggaagctggtgctcctggtgtagtatcagagattaaagtgaaaaatattccgggtggagcggttatatcttatcaactaccagataatccggatatcatgtatgtgagagcccgctataaagttggtcaggggaaagaaatggaggctagagcctcagtctatgcaaatgaattgactgtcaatggatttggagatatgaatgaacatgaagttgaattgtcttgtgtggaccggatggaaaatgagggggctacgactgttgcagtagtaactccattgaagccttctgttctgactaccttcgaatctttggaagtgaatgctacatttggtggggtatatgtaaatttcaaaaatccagaaaaagcgagtctttctattcatgttgtaactactgattcgttaaatcagccttatgaagctcatgtacaatatacacaggcagagaaaggacctttttatgttcgtggatttaaagcagaagaaaggatgtttgatatttatgtagttgaccgttgggggaatagttcggatactttatataatgttttaactccttacgaggaaacccgattaaataaaaaacttttctatccatacatattgccgaatgatgtagcatgtaatgcgtggggaggaaacttagcttatgcatggaatgacgattatactcctgctctttttgtacatagtccgggtggagatacattcccgatgtggtttacttttgatatgggagtcactgcgaaactgagcaggtataaattctatcatctttttatggaggaacatgctttccagcgtggtaatctaaagacttgggaagtttgggggagaacagatacgcctcctgctgacggaagttgggatggatggactaaattgatggattgtgagtctcataaaccgtcaggactacctgttgggcagcatacagcagaagactgggaatatttgcaagcaggtgaggatttcgaatttccggcagaagctcctccagtgagatatattcgtttcaaggttcttgaaacatggggaggtatggactttatacactttacagaatttactttctggggcaatgtaatatctaacaattaaaagagctgaatatgaaatatttatataagataggattaatac

SEQ ID NO: 184 - DNA, 14061 bp, Bacteroides thetaiotaomicron
aaactaactttaagatagtgacactatcctgttacgatagtgacaccatccaacaaagatactgtcactataataacagcatagtgtcaccaagtattcgataaattagaagctataaatcaatgctaaacaaaagaaatatgataaaccgaaaacaatttctcattaaaagaattttcatttcagctgaacaataaatataagttattaatcaaatatcaccaaccttagaactaccaatcaacagaatcccaatcggcagcagaataccattccacaaattgacgataatatttctcctggctagaattattttcacgcaatatataagtagagactccttcaaatccatccatagaaaccatcttaccatagcccgatgaatatgtacaataattattatctgtagtatttttccatataacagcattcttatacatttctttgtaatgattaaaagcttgtgagtttccttgtattgactgcatcagccccatcaaatcatgataattattttcacgtaaaggatcatagcacaatatactagaaatatcgatattatgcgactgctgcatagagaccgctgtttgcaaaacatctctcgtagcagcagctaatgccgataactcactactttttataacagaaatcgaaactcctcctgtccaattttcatttgaaatgccggcaccggtactattatattttttagcataaacagaataataattttctgcaatactaacagccggactattcacagcaaacaatgcaggaaccactacctcataaggggctccgggacctggtatttctgtcggagaaccaataaaataatcagctcgattacgtaattgataaacgacctcaacagattgcatataacaagcatcaaataatataaaatcaaaatgaggagctacagataatgcttcatttaaatcagggatattcattctgttatctccattaccagtatcctgtccccaccaacgagtagaaggattattataaggaagccaaccatcaccatgcgaccaaaagacaacaccatagctgtccgccggataatgagaaaaagctgttgtaaaaacattcttcataacatcaacatcgacagaattctgtgcatcataagtggcaataacatcttgcactactacgtctttatcttttctcaaacgaatcagcttgggattcgaacctttatccatataaaccagcagattgttgtgattatcatccacactctgcataccttctatcatttcatttaaatcttcactggcaaaacgagaaagagagttgtcacccgcaatataaactaacacagtacgcgaaccataattagttttatcctcttcatcatgacaagccgtaaatagagcaatcaaacacaccaaaagggataatattttaatctttttcatcatattcttcatttgttatgaccgcaaagataaaaaaataagagatgcaaacttgcatctcttatcatattaacaataaatctcttactcttccggttttataaaatggaacttatcagtatcaatccgtgtcactgttgtattcctgttccttttatatttactcagaattttcgttgcttctttctccagcttctttctgttttctgagaaatagatcatacatgtactattctgctgcagtccgttatcttccacatagttcttcaactgatagctatacaaatcacgatgagtgaggaaaccttccttgctaaccttcgcactatccaatatctgaatatccgtaaaatacacaaccgtatccgtaaaggaggcagcaattccgaaggcataaactgttttagagtggcctttctttaaagagaaagccgagcacattgtcaacacaagtgccattgcaaatagtatttttacgtatttcatatcataaatttttaattgtggcaaaggtaacaaaaaagaagaaatatcatctatttatcattaagatttagtatttctattcatatatccataataacacggacttcttttcgacttttagcagagcatccactttacgcatcacctcgtcacaaatcacaggacacccctggctaatgcctaatggaagatacatgggggatatctccgaagccggcaccggagtataagaatgcagtacgatatatcgtttgaaagcattgctatttgtcggttccagcccatgcaatttataatgcacattaattccccatttgctatatgagcgaattccgaccttatactttcccaaagaagaacaataactcccttccacattactatataccggctttttcaacgtgctctccttgccatatccatgagcacacagacttgaatatttgatggagtcacctttgaagtcccagacaaagaaacgttttttaccggaaggaatactgaaatctatcagaaaacaataattcgtattaaatccattctctatacagtaggctttcgctgcaagagctttctcttgcagacgctgttctttgctggagggcgaaggaacggcatgagatgcaacagtcccaactgcaagctcaccagcggtcccagtacatcgcccgtaagcgacaaagccaataccaatccccacaagagtgaataatatcagaacagacttcttcataaatttgcatagtataagataaacaacagctaagtaaaaagtcgcataagtaccttcttcagatgattactccaagaagtgtaacttatgcgactctaattctttttttctttcagaaactgatattcctcacttatcccaagtaggatttgagcaatttactacgattactttgtcttagtcttctaattgctttttctttaatctgacgaacgcgctcacgtgtgagaccaaacttatcgccgatttcttccaatgtcatttcttgttgtccgataccgaaaaacatctgaatgatttctttttctctatcggttaacgtagaaagagctctatcaatttccctcgcaagagactcattaaccagagagcggtccgccataggcgaatcgtcattaaccaacacatccagcaggctgttgtcttctccttccacaaaaggtgcatccaccgaaatatgacggccggataccttcagcgtatcagagatcttgtcaaccggaatttccagctcatctgccaactcttcgggagacggacgccgttcgttttcctgttcgaactttgagaaggctttgctgatcttattcagcgaacctacctgattcaacgggagacgaacaatacgcgactgctctgccaatgcttgcagaatagactgacgaatccaccatacagcgtagctgataaacttgaatccacgtgtttcatcaaacttttcggcggctttgatcagtcctaaattgccttcattaatcaagtcaggcaaactcaaaccctggttctggtactgcttagccacagatacgacgaaacgaagattggcacgtgtcaatttttccaatgctacacggtcacccttacgaatgcgctgagcgagttccacttcttcctcgactgtaatcaggtcctcacgaccgatttcctgcaaatacttgtcaagagaagcgctctctctgttagtgatacttttggtaatctttagttgtctcattctttaaaaacagatttggagtgcaaagttacgacaaataatttgttaacatacatatttaggcaactttttcactatattttcaactaataaaacaaaaaagaatgccgacaagttgtgtgacggcatcctttttctatttcattagcttatcctacaatcttcttaccttaatttataatttattcctgagtcagatcaactgcaaagtatccgcgtttaccggatgggaatacacctgtcaggaacaatacctgattcggagacttaacagcagctttcattgcttcttccagatcactgactttgcgcatcggctggtcattagctttcaggatgatgaagcctttgcggactcctgcatctgacatcttaccggaagaaacacctgtcacttgcagaccataaccgaggttcaactgtttcttcaagtcatccggcaattctttgaatgcagcacccaggatgtccatacctgcgtcttttacaatcttcgttgtgccttgttcgttcttcaacgttacttcaacagtcttttccttcttatcacgcatcagttttactttcaccttatcaccaggacgatgtttagcaagagcttcctgcaagtcggccatatttgaaaccttcttattatccagaccgataattacgtcatcgactttgatatcagcacctgcagccgagccaccttcaacaatttcagaaacccagactccttctactacacccagtgccttagctttatctgccaaagtagtaccggacttatcaatcggttgtctgtcatccatcaagctgctgccaatagatcctccacggataccaagcaaagcacgctgcacagttccatattgtttcaggtcagcaataaccttcgtcataatgctggtcggaatagcaaatccatatccggcataagctccggtcggagaagaaagtacagagttgatacctaccagttctcccttagcattgaccagtgcaccaccactatttccctggttaatggcagcgtctgtctggataaaagattctataccaccattatatacacccaatgaacgggcctttgcgctgacgataccggcagttacagtagagttaagattgaacgggttacctactgccaatacccactcgcctactttcagtgcatcagagtcacctaccggaatagtcggcagatcatctccttctattttcactaatgcaaggtcagtgctcgggtcagtaccgattacacgtcctttaaactcacgattatcattcagcttcacactgatttcatctgcaccttcaatcacgtggttgttggttacgatataaccgtctttagagataatcactcccgagccaaaacctacgcgaggctgggtttgtacctgacgctgttgtccacgtccgtcaccgaagaagaaatcgaaaatatccggtgcctgctgaatcgttttagttttggattcttgcgtagatcttatatgtacaacagcatgaagggagttctcagcagcctgtgtcaaatcaaccggctgagcgtttaccgcatcaaaagcagccaatttgacattgggattctgcttgaacatctcattaaaagatgtttccttggcagcttcgttagattgcaacaatttgtaagttgtcaatcctgcaactcctgagctcagaagaataattgctcctactcccagaatgttctttgttgtctgtttcatgatttataattctttaaaatgttaatattcgacattgttttaacttttacgacgttaaaataataacaaatatcgttcacttattctacttgtcactcttttttgtcctcttttaacagagaatatttagggcttaacagcgcttaacgacagcaactgacaaatttacattcgttgtatgtcagatggctttaacagtctgacattcattcagtaagatcagattttcatgacaccaattccgggtaagtcattcaatgtgatttttccattcactacttccactcctttgaagcggtcgttggagataagcaggtttccatcaaggtcggcaaaatcgactgccggagaaaattgcgaggcagcagatatcgcacacgaagtctccgtcatacaccccaccatcacgcgcattcccaaagcatgtgccagcgtgaccatcttccatgcttcacgcattccggtacatttcatcaatttaatattgattcccgtaaatgcacctttcaaagcggctacatcccctaaacgctgcaacgactcgtcggcaaatacaggcaaaggactttgttgcgtcacccaagcaatgtcgtccaactgctctttcggcataggctgctctatcatcacaatccctttctctttcagccaatgaatcatatcgagtgcatattggcggtctttccagccctggttggcatcaacggctatcggcaggtccgttaccgaacggattgtctctatcatttccttatcattgtctcttcccagcttcacctttaatatattaaacagaccggcacattcttttgttttcgcacggaccacatcgggcgtatcaataccaatcgtaaaggtggtagaaggcgtcttctctttgttcaatccccatatcttataccaaggcgctcccagcagctttcccaccaagtcatgaagggcaatatccaccgcagcttttgctgccgtgtctttaggcgacagactgtcaacgtatgacaaaatgtcctctaattgaaaaggatcgctgaattgctccagatttacttttttaaggaagttcattaccgactccactgtttctccgagataagggggcatagacgcttctccatacccggtcaccccttcatattcgatctctacctgcacatcgggcgtagtagtacgcgaataagtggctaccgtaaagacatgcctcaactttaactcataagggaaaaaagtcattttcatctttccccctataccatatttattaatatgaatagcagaaggcatacattctcccgccaatacctgactgacagctattccggaacctaaagtcgcaaaggcagccgttttcagaaaatctcttctatttggcatttgtttaatggataatggttagtgatgtagataatagaggttatggtcggtggtattcatacctttctccttatttatatagggcaggaagcgagtggcaaaaagcagacgaccggtgttgaactcatcgtagcactcgtcttcgggatcaaagctgctgatatgtacgtctcccaaggcatggatgaagcgtttattacccaggtagatgccgacgtgtgagatgccttctttacggtcggctgtagctttacgaccgaagaagacgaggtctccgcgttgcacgttggagaaatcaggggctatctcaatacgttcgcctacataagcctgttgtgacgcatctcttgggatgataatatcatgcataaagagtacggtccggaccagcccgctgcaatcaactcctttcgaagaagtccctgcccacagatagggaattccgatcattgtataagcagttttaataatactttcagcatcttgtttcaacgaagctctccatttactctctggttgtgaaatatgtctggagatataagcctggcggccatccggataagacaccttgtaaaaatgccctttacttccctcccacttcaggcgattgccagcaacaacatccgatacggtctgcgagtcgtcatccggtttttcatacgtaaatccgtagtgggaagtcaccacaatcttctctgcacggttccattcatcatatttctctttcgacatcggcgtaatcaccatccgatgcacccatcccgtatagtcatccggagtctgaatctcgtaccagccggtgtattgcaataccttgaccggcatcccaagcagtgcctgcgtgctcattccggaagtaaacttaccttcatcacgcatattacaaacagaaatgtgtactaccccataagctgaatcagcaggcatggggcgtatttcctgagctttcagactaactactgctactaccagcaagcaatagaaaaaaaggatatttttcttcattgaatcatgatttaatgatagcaaaggtagaaattatttctatttgtgacactttctttggctaaaacaaaataaatgacgtacttttgcagtctaaagcagttggccggtctgtcgcgtgcgcgtttcgtgcaggaggaaagtccgggcaacacagagcatcctacttcctaacagaaagctgtccgcgagggtagagtaacgtagaagaaaataaccgccgctcctttcggggagaggtaagggtgagaaggtggggtaagagcctaccagcagcatggtgacatgtgggctgtacgtcttaggagttgtaaggtcatgtaaaccggcgttatgagagttgctcgctccatgtcggagggtagaccgctaaagtgtcgtggtgacacgccactcagataaatgacaggcaccttattatataaggtacagaactcggcttataggctgactgctttttttcttttttaaactgcttttttaaattctgggccatgaagaagaaaatcaccgatatatggaaattcatcacgtatgacatctggcgcatcacggaagatgaagtgactagaacgaagttctcgctctacaatattattaaaaccgtctatctctgcatcaatcgatttaccaaagaccggatggctaataaggcctcagcactgacatatagcacactgcttgctattgtacctatacttgctatcctttttgccgtagcccgcggattcggatttgataatctgatggagcatcagttccgcagcggcttcggaggaaacaccgaaacgacagaagctattctttcgtttgtcaactcctacctgtctcaaaccaaaggcggcattttcattggagtaggtctggtgatgttgttatggaccgttattaatctggtgagtaacattgaaatcaccttcaaccgtatttgggaagtcaagaaagcacgctccatgtaccgcaagataacagactacttctcgatgtttctgctcatgccgattctgattgtcgtttcgggaggactttctttatttgtaagtactgtactcaagcagatggacgatttcgttttactggctcctgtcatgaaattctcaatacgcctgatcccatttgtcttaacctggctaatgttcaccggactctacattttcatgcccaacacgaaagtgaaattcaaacatgcactgattgcaggcattttggcaggctccgcttatcaggctttccagttcttgtatatcaacagccagttatgggtatcgaaatacaatgctatttacggtagctttgccgccctccccttgtttctgctatggctgcaaatctcgtggacaatctgtttgtttggggccgaattgacctatgccggacaaaatatccgcagttttagcttcgatcaggacacccgtaacatcagcagacgttaccgtgatttcatttctatccttatcatgtcactgatcgccaaacggtttgaaaaaaacgagccgccttatacagccatggagatatcggaagaacaccaaatcccgatccgactgactaatcaagtactttatcagttgcaagagatagacctgattcacgaagtagtgaccgaccagaaaagtgaagatattggctatcagccttcaatggatatcaaccaactgaatgtagccattctgcttgaccgcctggatacgtatggctccgaaaactttaagatagacaaggatgaagagttcaatgacgagtggaaagtactgactgagtccagagaagagtactataagaaagcaagtaaagtactactgaaagatctgtaaaaacaggctttgttgtatctgttttttaccaaaaaaaatactcacaagcactcatattcgtaaacaactaatagtcaacaccttacaatgaatgatttttagtttaaaagaaacagtgcgttggttttaaaggaaagcctcgttggttttaaaggaacggcttcttccttttaaaccaacgaggccttctcttatatatctacttctcaaaagtatggaatatacatttttttcaattaataccgattataagaaatgaccttttctttcgtcttcctcatcttctttcgtttttctttcaccggatacccgatagcgatatccaacagcaagcgtttagaagcaggaatcccagtcaattgctttatctctttttcatcaaaccaccccaaaatacaagaccccagtccttcactttcggcagctaatgtaatatgagcggcagcaataccaatatcaatcaacgggaaatgcttatcctttactttacccccaagcagggatgtaatattggcagactcttccactatcagaatatgcacaggggcatctttagcaaacttattcatccctagtccagctgctgccctacctacttttaaagccagctcatgatctgtcactaccacaaacttccacggctgcgcattgcaggcagaaggagacagacgggcagcttccagaatccgttccagcttctccgcttctaccggacgacctttatcatatgcccggtcactttggcgagacaacactaattgcagaaaatccatccaatttagggttttacgatttataaattacgattgaagctaacaattcccaattgactatttatattgaatcatccggctgatatacttgccgatgatatcaaactcaatgttcactacgctaccgatctcgaacgtatgaaagttagtatgctcataagtataaggaataatagctacctggaaagtatcatccgtcggattacataccgtcaagctgacaccatttacagtgactgaccccttatccactgtgatatagccacgtttcgccatttccttatcaaatgcgtatttgaatgtaaaataccagcttccgtccgcatcctttatttccacacaagtagcggtctggtccacatgcccctgtacgatatgtccgtccagacggccattcatcatcatgctgcgctctacattcaccttatcgcccactttcagcaaaccaagattcgaacggtccaacgtttctttcatggcagttaccgtatacgtatcatcggtcaagttcactaccgtcaggcatactccattgtgagaaatactctgatcaatcttcagctcatttacaaacgaacacttaaatgtaaagtgtatattctcctggtctttcaccagtgctaccaaggtagcatactcttctacgattccagaaaacataatgttaattattaatgttctacaataaaagactgactaaaaagggaaataagagagcttctaaaccttttagccaactatactaatatattagctttttcatcaacagctgcgctaatataatagcacaaagatacgaataaggaaggaagttggaaaactttctgttttttttcatatattgcaaaggttaacttgtgaataaattccgcccgttcgttcattttattttttaaagagaaaaaataaacggagttttgtgataggttttactaaacaagaagaatatatgaaaatcaaaacatcacaaatcagcatccggaaaataggacttattgttcctgttcttgcttatttccttatttatggaatattctctacggtatcggcattaaccatgagagtttattctcatcagtcatttgcttctatagcatacaccattccttacatcaacatgatttcattaatatgtgcatatctttgctgccatttatacacaaagaagaaaaggtggggatatttaggtttcacattctctttcgttctggtcaatgtcttttattatctgagaagtgacaaagattatggatcgatgttatgggcggacagttacttcctgtactcctccgtaacaggtattctattgtatatactatacgattggtatcaaaagaagcagaaacaaaaagaactgaaaagacaaaaccttcaaagtgaactgaaactgctaaaaaaccaattgaatccgcactttctattcaatactctgaataatattgatagcctgatttgttcctacccggagaaagcttcgaaatcactggtacaaatgtcggaaatgatgcgatatatgatctatgagaccaatactcccgaagttgatctgtcacaagaactaaaatacatccacaattaccttgacctgcaacaattacaatatgacaatccgaatttagtatcatatacgctggaaggatcaccggataatgttcgtgtcgcccctatgctgttcatcgcgttcattgaaaatgccttcaaacattgtacggataagaaagctcctgaggctatccgcctgtttttccggattcagaaatccgagatatattttgaaatattcaatatgttcgatccggcaaagcagatcaacaaagattcctccagcggtatcgggttgaatataataaagcgacgactggatatcctgtaccgacgcagatatgatttgcaaaccaaccagaaaaatggttactttgatgtttcattaacgattaaactcacatgatcaattgtattatagtagaagatgctccgttagccgtagacaaactaaagaactttatcagcaaagtgcctttactggatttggcaggcacttttgacaatggtctggatgctttcgacttccttcagtccaatacgatagacttactattccttgatatacagatggaacagttcaccggacttcaattactgcaagctctccatacccgtccacatattataatagtatctgcctatggagaatatgcagtacaaggattcgaatatgacgtcaccgactatctactgaagccttattcctttgaacgctttctaaaagcggtgaacaaggtgcagacagaaatggcatccaatcccccagcccagccgcttcccaaagattatatttttctcaaaacagaataccggatggtacgcatcaacttatgtgacatcttatatatagaaggaaaaggagcttatcttcatgtgatcacagatactacaagaatcatgactttactcagtttcaaagaaattgagtcgctattacctgccaagcaatttatacgtattcacaagtcatatctgatagccattaataaaatagataacatagaacgtaatgtcgtaaaaatcgcgaatatgcgcatacctatagggaaaagttatttgaaagacttttatctacgattacaataattggttctcaaactcgttcttcaaattgattctttcaaggcggaaaagcaatagatgcaaagaagaatcccccctctcaaacaccgtataacgcaacttcctgaccttcagtatagagcaaaaaaaatggggcttttcacaaagctccatttttcagttttcaataggtattagtttttttttaaggtaaaaagattgttttcaggataacggtgcaaatatagtcgcttttactgttattctccaaattataaaacatgtcatataacatctttttgaaatatctttggatttattatcatttgcagtaaaaacgcccgtaacttgtccgttacaggtgacaaatataggattattttctaagtagccctaatttttgtttaaaaacatgcaaaaaactacgattttggatagttttcgtctacttttccgctatgttttaagacttttgcatcaataaagaatactatttcctctgcaatgttggtaatatggtcacctgaacgttccaatttccggaacacgccaaccaagtctacacaagtatgagccgtttccggatgttcacggatataatctgccagaatacccgttgcttccgcattaatgtcatccaacaggttgtctttgccaaataccgcagtcgccatctcaatattttcttcgttcaaggcacgtttcgccagttccagcatcgataaaacctctgcctgcatctctcccaggcgcagacgggccagcaaatcggcatccagcaccggttccttgcagcggataacaaaacgggctataccttctgcaaagtctcccagacgttccagattcgtattgattttcagcattgccagcacaaaacggaggtcaatcgctaccggattgtacaatgcgatgatatcctctatatcactgtctatcttcagttcaaaggcattcacccgacgttcgcgcaccatcacttgctgtgccagttctttatcaagcgtcatcacggcctctcccgcacggtcaagctgattgtacaccaatgtccacatttcatccacttctttcttcaatagaataagctccgattctataaactttaccatagtctctttatatataaa

SEQ ID NO: 185 - DNA, 13972 bp, Bacteroides thetaiotaomicron
ttcatatactacttgacttaattgaataatatttcataatgtgcaatatcagaaaatacagataagcccatataaataaaacagatctgcaagttaattgtatcttggctaactatatttttaacatattgtcattgcatatacttcgatagagatctatgaatgtctaaataaaagcgggcaaatatgtgataaataacatatttgcccgctttctataaaaaataagattcgtatcttacttaccggtaatcgaatttttcttcccctgcttatttacaactgaagggcttcctttatattcaatatcaccactaccactaactctcgcatccaactgtctggaagcgtagcatactatatcacccgaacctgcaactgtagcaacgacattagttgcagccagtttttcagcactaatatctccggaaccatttactgtcagtgtcgccttctgtgcagaacctttaatattgatatcaccggaaccattaacttctgacatcacagtagtcgctttcacatttttcaaatcaatgtccccgcttcctttcaccaaagcaaatatattagtatattgcagattctccgcttcgatatctccggaaccggctatattcaaattcaggtcattccctttgattgcacctttcagatatacatctgccgaacctttaatatttacctgattcaatgaaggggaagaggctatcactttcaaacgacgctctccactaagaatcttgacaccctttttgatattcacctgcaatactccatttactgtagaaacttccagcaagtctaccaaattatccgaaccgtatatagaaactgtcgttttagaaccattactctgacgatactcaacatcaggactgcctaatacgctgattgagctgaagttgcttacgttattcagttcttttgtgatatatttcttactgggagtaacggtctgcgcctgtattcctgtgaccaacagaaacattagcactaccaacatagatgtaacctttgaatttctcataatttcttttcattaaatattttaatgacaaatataggaagtatatttcgaattacaagaaaagaattacaattttgccaaccattctccaagttcctgaagccactcctgcttatacacaaaactatcattataaccgaatccatgtcctcccgcaggatagatgtgcagagaaatggggatatctgctttctgtagtctggcagcatacataataccattcagagggcttaccacagcatcatctgcagctgctacaatgaaagcggcaggtgtgccggaagtaatatgctcaatcggtgaatactgctccatcttatccggtgaataggaatgaccaaacattcgttcacgacaaggaaaatgtgtcaaacgatcatcgacactgactaccggatacatcaatatctgaaaatccggcttctcatcatcaggcaaaagcgtagctgaaaaagttgccagatatcctccgatagaagcccccatcactcccagtttatcacaaaactccggaaacttttctcgcacaaccttcaatgccaaccgggtatcttgttcgggaacatcaggattaccatgaggcattctatatttaaagacgatatatgtaattcccagcttcgtaaaccattcggcaaaatcaataccttcattctccagattagtcttcagaaatccacctccgggacacataataacactgcttccattgggcctgtcacaagtaaaaacaaataaagttccttcggaagcattttctacgattccaatcagttcggcattgtccactttcgacaaatcataggtcgtcatggataagtcctcatacaagctaatacaaattaatttcttcatatcgattaatgtttaagtttcttccctattttatgaacaacagaaggaccggaataaataaatgccgaataaatctgtaccatatcggccccttgggaaatcatatcggctgcatcctctgctgtcattattcctcctgccccgataatcagaaagtggcggtcggtgtgctcggacagataatgcactaccttctgcgatttctttccgataccccgaccactgacgccaccgttaccgatcttttccaactgttttgtttttgtctgatgcaattctgagcggtccatcgtcggacccgtggctataaagccttctatggaatatttatatgcaagggaaatgaccagatccaattccttctcatcaatatccgccgggagcttaatgaaaatactgcaccgtttgttcactgcctcacggaatgttgtgaagttttctaaaactttagcaaatgattctttatctatactaccccagttcaacgtaaaataatctacactttcatataaacgagtgaaaaccagctcaaaatctttgatgatctgctcaccgacagaaagcggattcttattgatatttactccgagtatgtaagaatgttttctgtgtcttctgatatgcgccagagctacatcgacaccgcaattattgaaccctgtacgtgagatcagtgattcgtcttctaccagcctgaagatacgggaagaaggatttcccggttgataatcaggagttacagtccccacttccagaaatccgaaaccaaaatctgccaactcatcaaatgtttccgcatttttatcgaatccggcagacaagcctatccggtttttgaatcgcagacttccgtatgaaaaaggttcgtccacttgatagtgtcctcttacgcatgcacgaaccggaagcagatagcgatagattcttaaccagttcaagagcatccgatgtactttttcaggatcaatgagaaataataacggtctaacgattaaattatacattttcaattatctgttttttagattaaagatatgaatccacactcaggaaataacttcttcctagtgctcttacgtatgcaaagtaagacctttttgagcagatattgaagttcattttttttatacccgataacttttgattatccctgcttcttattgcctgtatattgggtacaaaattcctttttaatcgtcctcctataaaagtataaaagcgattagatgaaaatgaataaaaagagattaatcggatatctgtttgtaatggtctctgcaggatgtattcatgcgcaggagaaaaaagtatctgcacaggaatataagctatggtatgaccgtcccgcacaggtatggaccgaagctttacccttgggaaacgggcgtctgggggcaatggtatatggaacgccgggaacagaacaaatacaactaaacgaagaaaccatttgggcaggacgccccaacaacaacgcaaacccgaacgcactggagtatattccgaaggtacgtgaacttgtttttgccggaaaatatctggaagcacaaacgctcgctacggagaaagtgatggcaaaaacaaattcgggaatgccttatcagagtttcggcgacctgagaattgctttccccggacatacccgctattccgattattatcgggacctgagtctggactcggcacgtgccatcgtccgttatgaagtagacggagtgcaatatcaacgtgaaacgatcacctcatttaccgatcaggtagttatggtacgactgaccgccaaccgtccgggacaaattaccttcaacgcacagctcacctcccctcatcaggatgtaatgattcactctgaagaagggaactgtgtgaccctttcaggggtgtcttccttgcatgaaggactgaagggaaaagtagaatttcagggaaggctgaccgcccgcaaccaaggaggaaaaatagcttgtaccgatggcgtcctctctgtagaaggagctgacgaagccacaatctatgtgtctatagccactaacttcaataattatctggacatcacaggcaatcagacagaacgtgcaaagagctatttgtccgaagcgctggttcgtccattcgcagaagccaaaaagaatcacgtagaattttatcgtcgatatctgaccagagtatctctggatttaggggaagaccaatataaaaatgtgacaaccgacaaacgtgtagagaattttaaggacacacatgatgcgcatctggttgccacttacttccagttcggccgttatctgttaatctgctcgtcacaaccgggcgggcaacccgctaacttgcagggtatctggaatgataaacttttcccttcctgggatagcaaatatacctgtaatatcaatctggaaatgaattactggccatcggaagtgactaatttaagtgacttgaacgaaccacttttccggctgataaaagaagtgagcgaaagcggaaaggaaacggcaaaaatcatgtatggagccaacggatgggtattgcatcataacacggatatatggcgtatcacaggagcactggacaaagccccttcgggtatgtggccgagcggcggtgcatggttatgccgtcatctatgggaacgatatctgtacaccggagacacagagttcctgcgttccgtttatccgatattgaaagaatccggactgttctttgacgagattatggtgaaagaacctgtacacaactggttggtagtctgcccaagcaactcacccgaaaatgtacattccggcagcgacggcaaggcaactacagccgccggatgcacgatggacaatcagttgatattcgacctttggacagctattatttcagcttcccgaattttggatacggacaaagaatttgccgctcatctggaacaacgcctcaaagaaatggctcctatgcaagtaggacattggggacaattgcaggaatggatgttcgactgggatgatccgaacgatgtacaccgccatgtatcccatctatatggattattccccagcaaccagatttctccttaccgcactccggaactatttgacgctgcacgcacttctctgattcaccgtggagatccgtccaccggatggagcatgggatggaaggtttgcctgtgggcacgcctccttgatggtgaccatgcctacaaactgataaccgaccaattgactctggtacgtaacgaaaagaaaaaaggaggtacctaccctaacctgttcgatgctcacccgcctttccagatcgacggaaacttcggttgtgctgcaggtatagtcgaaatgctgatgcaaagttacgatggctttatttacctgcttccggcacttccgactctctggaaggacggttctgtcacaggtatcatcgcccgtggaggtttcgaacttgatttaaactggaagaatggaaaagtaaatcgcctggtcgtgaaatctcataaaggtggtaactgccgtctgcgttcactcaacccgctgaacggaaagggcttgaaacgtgccaaaggagagaacccgaaccctctctatgcagtccccacgattccccagccattggtgaatgaaaaagccagcctaaataaagtggaaattgcaaagacttacttgtatgacctgcctaccaaagcagggcaagaatatatattgattggaaaataataactctacctatatgaacagaaacttgttaaaactgattgttgcttgcggagctgcttgcttcatcgcctgcacagcacctcaaaaagcagaaacagaaaaatggagcgaacgtatggcacgctctgagatgaaacgttttcccgaaccctggatgattgaaaaagcaaaagtaccccgttggggatatacccacggacttgttgtaaagtctatgctggaagaatggaaacataccggagacagcacttactatgaatatgccaaaatctacgcagacagtctgatcgatacggacggccatatcaaaacgatgaaatatctttcattcaacattgataacgtcaatggcggcaagattctttttgatctttatgcacaatcaggagatgaacgctataaaatagctatggataccctacgtaaacagatggcagaacaaccccgcacaagtgaaggaggattctggcataagctaagatatccccatcagatgtggctggatggcatcttcatggcttctccttacttggtacagtacggcagtactttccaggaaccggcactatacgatgaagctgtgaaacagattcttctgatagcacgcaaaacttacgaccccaccacaggactttactatcacggatgggatgaaagccgcgaacagaaatgggcaaatcccgaaaccggttgttctcctaatttctggagccgcagtatcggatggtatggagcagccttggtagacgtactggattatctccctcaggaaacgaccggacgagacagcgtaatgcagattcttcagggattggcaaaaactttaatgaaatatcaggaccctcagtccggcacctggtatcaggtaacagatcagggagcgcgtgaaggaaattacctggaatcttcggcaaccgccttatttatctatacacttgccaaagctgtcaataagggatatatcagcaaggattacatcgaacctacccgcaaagcttttgatggaatggtcaagacatttacccgtcttgaagaagacggtagctataccattacgaattgttgtgcggtagccggactgggcggagactccaaaagataccgtgacggttcattcgaatattatatcagcgaaccggttatagagaatgacccgaaatcagtaggatcgtttattctggcggccatcgaatatgagaaaatgacagacaaataaatgtaaagatatgaactccaaaaacgataaagtacaatgagaaaatttaagattcttcctctcttattgctgctgttgacattggcaacttctgccgcagcacaaaagaaaacacaaaagacgtatatcccatggagcaacggcaaactcgtcgtttctgaagaaggacgttatctgaaacacgaaaacggcactcctttcttctggctgggagaaaccggctggctgctgcctgagcgtctgaatcgtgacgaagccgaatattatttggaacaatgcaaacgccgcggatataacgtgattcaggttcagacattgaataatgtcccgtctatgaatatctacggacagtattccatgactgacggctacaacttcaagaatatcaatcagaaaggcgtatatggttattgggatcacatggattacattatccgtaccgcagcaaagaaaggtctttatatcggcatggtctgcatctggggaagtccggtaagtcatggcgaaatgaatgtagatcaggcaaaagcatacggcaagttcctggcagaacgctataaagacgaacctaacattatctggtttatcggtggggatatccgtggtgatgtgaagactgccgaatgggaagcattggcaacctccatcaaagcaatcgacaagaaccatctgatgacattccacccgcgtggcagaacgacttctgctacttggttcaacaatgcaccgtggctggatttcaatatgttccagagcggacaccgccgttatggacaacgtttcggtgacggagattatcccatcgaagaaaatacggaagaagataactggcgttttgtagaacgcagtatggctatgaaaccgatgaagcccgttatagacggtgaacccatctacgaagaaataccgcacggtctgcatgatgagaacgaattactttggaaagattatgatgtacgccggtacgcttactggtctgtatttgccggttctttcggacatacgtatggtcataactccatcatgcagtttatcaaaccgggtgtaggcggtgcttatggtgctaaaaagccttggtatgatgctctgaatgatcccggatacaatcaaatgaaatatctgaagaatctgatgctgaccttcccattcttcgaacgagtaccggatcagtctgtcatcgccggacagaatggcgaacgttatgaccgtgccatcgcaacacgcggcaatgactatctgatggtatataactacaccggacgcccgatggaagttgatttcagcaaaatcagcggtgccaagaagaacgcatggtggtacacaaccaaggatggtaaactggaatatatcggtgaatttgacaacggtgtgcacaaattccagcacgacagcggctacagcagcggaaacgatcatgtcttgattgtagtagacagtagtaaggattatgtgaagaaagactgctatcaaattgacactcatgaataaaaagatacttatattatcattcttatctgttctgtttcttgcagcaggtccgatacgtgcagccatagacgtaaccaacctgcggacagagcagctaaagaatccgtcgggtatcgatacgcgccaaccccgtctgggttggcgtatcgaatcggacgaacagaatgtgatgcaaaccgcgtatcacattcttgttgcatcttcccccgagctattggcacaagggaaaggagatatgtgggattccggaaaagtagaaacagatgcttcccaatggataacctaccagggagaaactttgaaacgcaatgctccctacttctggaaggtgaaggtttacaccaataaaggtgaaagtgattggagtagtccggctttctggagcatgggactattcaatgaagcagactggcaaggtcagtggatcggtctggaccgtgcagctccgggggacagtgaaactcaatggagccgcctggcagcccgttatcttcgcaaggaatttgccttgaagaaagaaataaagcgtgccacagtgcacattgccggaatgggattgtatgaactgttcatcaacggacaacgcataggtgatcaggtactggcccccgctcctaccgattaccggaagacaatcttgtataacacatatgatgtcacttcccaacttcagcaagagaacgccatcggtgttactttaggtaatggtcgtttttataccatgcgtcagaattacaagccatacaagattccgaccttcggatatcccaaactgcgcctgaatctgatcgttgaatatgctgatggcagtaaggagacaatcgcgacgaatacttcatggaaactgacaaccgaaggtcctgtccgcagcaataacgaatatgacggcgaagaatatgacgcccgcaaagaactgggaaactggacgcagacagattatgacgatacaaaatggatgccggcagaacgcgtcagtattccttcgggtacacttcgtgcccaaatgatgccggggatgaaagtaacggaaacgctgaaacctgtttctatccaaaaaatgggtgacaaatacattatggataccggtcagaatctggcaggatgggtacgtttccgcatcaaaggtcaggcaggcgacagcattcgtcttcattttgcagaacgtctggaatcagatggagaaatcttcacgaaaaatctgcgcgacgcacattgtacggatatatatgtagttagcggacgtgaaccgcaaggtgccacctgggctccccgttttgtgtatcatggtttccgttatgtggaaatcagcggatatccggatgccaaaaccgaggatttcgtagtggaagtcgtagaagatgagatggatcatacaggctctttttcctgttcggacaaaacattgaaccaagttgtacgtaatgcattctgggggattcggagtaactataaaggtatgccggtagactgtccccagcgtaacgaacgtcagccctggctgggagatcatgcaatgggctcttggggagaaagtatgttcttcgacaatcatgccatgtacaacaaatgggcacgtgatatccgcgaagcacagcgcgaagacggctgtattcctgatgtagctccggcttactggaactattattcggataatgtcacatggcctgctaccctgcccttagtctgcgatatgctcttcactaattatggagacatacgtccgatagaagataattatccggctatcaagaaatggatatcgcacatccgtgagtattatatgacaaaggactacatcatcaccaaagataaatatggagactggtgtgttccacccgaatcgttggaaatgattcacagtcaagatcctgcccgcaaaacggatggtgccttgatcgctaccgcctattacctgaaagtgttgcaactgatgcatcgcttcgccagtcttcagggattgactgcggatgcaaaagagtgggaagacctggaacataaaatgaaggatgcattcaatgcacatttcctgcatataaaggaaggtacttcacttgtacccggtcatactctgtatccggatagtgttttctacgggaataatactgtaacagctaatattctgccacttgccttcggtctcgtgcccaaagcacatatcaaagaagtagcaaagaatgcagtaaccaccattattacaacgaacaaagggcatatcagtaccggagtaatcggtacgcaatggctgatgcgtgaattgagtcgtcgggggcatacagatgtagcttatctgttggctaccaatgatacatatccttcatggggatatatggcagcacaaggtgccaccactatttgggaactttggaacggtgacacggcaaatcccggaatgaacagcggaaatcatgttatgttattaggagacttactcccctggtgtttcaacaatctggcaggtatccgtgccgaccgttggaaatccggttacaaacatattgttttccagcctgctttcgaaattcaggaattgagtaacgtggatgcttcttatatgagtatctacggaaagattaccagccgatggaaaaagactcctatgcatctggaatgggatatcgaacttcctgccaatactacaggagaagtacatctgccggatggacgaaaagaaaaaataggttccggaaaatatcatttcagcgtagatataccgacacggaatgctgccatcatcagcgatgaatttctatatgagaaagcttctttcccggaatgccacggggcgaccattgtagaactgaaaaacggtgacctcgttgcttctttcttcggtggaaccaaagaacgtaatccggattgctgcatctgggtttgccgcaagcccaaaggtgccaaagaatggacggctcccaagctggctgccgacggagttttttcactcaaagattcgcaggctgctttagccggcatagattcgacctgcactcctgtagtggatgccaaaggaaaactgactgcccgccggaaagcttgctggaatcctgtacttttccagataccgggaggagatttgattctgttctacaaaataggactaaatgtaggcgactggaccggctggctggttcgttcaaaagacggtgggaaaacttggggcaaacgcgaagccttgccggaaggatttctaggtcctatcaagaacaaaccggaatacatcaacggtcgcatcatctgcccgtcaagcagagagggcaaagggggatggcgcattcattttgaatattcggatgataaaggcaaaacctggaaaacgacagagtcggtacctgccgaactgtctgtcccgactcagaaccgtaaaaaaggtggtattaacgtagatgatcaggaagcgggagaagctattcagggagaaggggcacaaccgattcttgccatccaacccagtatcctaaagcataaggatggaagattgcaggtactttgccgtacacgcaatgcaaagattgcaacatcatggagcagtgacaatggtgaaacatggagtaaagtgacattaagcaatgttccgaacaacaattccggaacagatgccgtgacaatgagtgacggacgtcacattctcatttacaatcatttctccacattgccaggcacaccgaaaggtccccgtactcctctctgcatagccatatcagaagatggaatcaactggaaacctattctcacattagaagacagccctatcagccaatattcttatccaagcattattcagggaaaagatggaaagttacatgcaatctatacctggcgtcgccaacggatcaagtatacggagatagatctctcaaagtttaagtagtagctgaataaaagaaaaacagattctctgttatcattataccgcactgacaattatcgtatcagtgcggtatttcaatcaaaaagcaagacacgcacggacgcaatgtttactgttcttataatcccaatccatggcgccgacgtaggtgtcggcatagtatgcgttgagaaacggatcgtagtcgtcctccgaactcgaccaataccccaatttccacccatagtcattatccccggtagctttattgacagcggataaaagataagctttattgtacatccaataccagcattgacctagcgagggtaaaaaccaaccactgctgtttgcaggagcgggatggctatactcataatccgttacccaatagacagggggaaatccattctttaaagttcgattctcgttttccgcaaacgagatgatcccctgtgtattcttatagccatagaaaccggtgctcggctcacctctgtttatatcagttaggctccaaagcccccatgtacaagcatttcctccattggcatcataaagcgcaagaacgtaaccatgtacggtatgcatctctgttataccatatttctgtttatatttacagtagtctacccattcgccttcactgtctttacctgacttcaaaacgatacccaagcagttcatatctgcggaaagagcagtaacatcaccgggaatcaaatagccgttattactttcatccttgcaataaaaatcgcccatttgagctttatccaatgtataatcacctatatcttttaaaaccggagtgaatgtataacaggtattagcagataaatctgtatcaggcatcgcaccactatacatctctttgttatattcataaagccaacgaacctttgcccttttcggagaaataattatttggtaactgccatcattcatttggtaagggaaaagaggctctgttccgacattgaaactcacatcactaatcgaagaaggaacataagtaaagtctctccttccattaattttgcattttatggaaggagacaacgaaagtaaggaataagcatgttcaaatactatatccaatttctttaacggtctaccactcgtgtcactccataccaacaaatcggaagcacggtaggcatctttgctgcgttggtcaccctgcggtaagaatttaccttttagatcatctatgttaatcacgttatccacttccttactatacggaaagtaggcaaggtaaacggtggctttattgtcgtagtaaatggttgtttttccttcatcgttattgctgtcgaagctccaaatgttaccatcatatcgataaggtatgttgtcggatagtacattattatctgcatccagcacaatgatgccgatacgatcaccattttcgaaagtacccgtacttccgctatccgtagcacgaatactggaaacatcgttgatagcaaagtcaccaacacgaacgttcagttgcaatacttcaccgtcttgctgcaccatacccgaatctattttttcatcaccattgcaagccatgaaggataataacgagagcaacaacaaatacttcaaattctttttcatactcatttttctatatattattaaaaagtcaagatgacacggatagaattcttatccgatacgctctttgcatggtcattataaagagcatttcctactaatatgaaattcctctcgatactaaaaagctagaactgtttttaagacgtttaccattattcatagccactaatggtttaacatttttcaacactatatacaagtaaaagcccaaagacttatat

SEQ ID NO: 186 - DNA, 13885 bp, Bacteroides thetaiotaomicron
atgttacgttgccttaggtattctgttgatgagttccgggatagtagcttcatgcgacagctttaatgaagacctgccggaatgccgcttgtcagtgaagttcaagtatgactataacatggagtttgcggatgcgtttcatgctcaggtagataaagtagaactttatgtatttgataagaatgggaaatatctgtttaaacaagctgaagagggaagtgcattgtctaccggcaattatctgatggaagttgaacttcctgtcggacaatatcagtttatggcatgggccggtgcacgtgattcatatgatatcacttcattgacacctggtgtctctactcttacggatttaaaattgaaactaaaacgtgaagcctctctcatcatcaataaaaggatggaaacgctctggtatggtgaagtcatcaatgtcaacttcgatgggaccgtccaccagactgagacgataaatctgatcagagatacaaaaatcgtacgatttggcttccagtcttatacaggcagctggacactggatatgaatgactatgactatgagattatagaatccaatggacatctgggacatgataattcattactggatgatgatgtgttgagtttccgaccttactatatggaacagaaggatcctgcgactgcctatgtagacatgaatacaatgaggctgatggaagaccggaaaactcgtttggtgcttactgaaaaagcatccggaaagagagtgttcgatataaatctgattgattatcttgctatgaccaatgcggagggtaaaaatctgagcacacaagaatatctggatcgacagagcaactatcatataatctttttcttgtctgaatcatggcttgctgtacagattgttgtcaatggatgggtgcatcgcattcaggaagagaatcaatagaatgatctaagaatagtggggaactattattagtgggacaggataaatagtaatatcctgaagggagaacagcccgggtcgataatgatccgggctgtttgtactttagagagtatcgatcactgtacgttgcttttgcaggaactcgatacgctgggcttctccactttctgaaattagtgtggaatgtcgtttcaatgattgaatccagttccgctgtatctgacagatttgcggactttgcgaatccatcgaattgatggaatacacccggagcaaactgacttggtagtcttgtttctctatgtaggtgtaagtcgcttcgaaatcaatgtttgagagatagaaagagacttttcgcccctcactgaattctcccttaacagatagtgtctccatgactgaaagcaattggtagagttcatctttcaggtgtgccacgtcgtcttccgtaatcagattcagacttgcgaaatacttgatctctttgacaaaggaaagaaagatgttgctatcccagataaaataggtcttccgacattgctttacactttcactcagcttattatgcgctttcacgattctgtcttctacctgcatctctgccagtgagttcggtgttttcatttgcccgttctgataaatccatcggcaaaggcggaacttagacatgtattcgtaagatgaataaagagtgaagggaagaaggttggaagctgtatatacttccgtcgtatcgtctcctttcacataatcgaatatctgctgataacggctgataatctcataataactttctaaagtgttgggcgaatgcagcaggttcatatcaaaagtaactctattggaaaggtggttacctataatctgatcaatagaaatccccagttttttagacagaagggctacttcgtcgatagtaaaagctacttcaccccgtagtctgcgatagacggcttctttacccatatacaaaatgtctgccagagaattggcaagattttgtcctttggggatccgttctttcattgcagtaatcaactcgtttacaataccatttttcattgtttgttctcttttatatacgttaatactttatgtgatacattctatgcaaaattacggcatgtaaacgagagttttgtgtgggaaaacagttctgaagagtaagagctttttctcatttgatagaatagagatagaaaaagaacgtataatggaaaaaagtaggcaataagcttgtctactttcatgatttggaattataaaattcagttagtttcgattatcgaaattaggaagaactctatagagcatcaatgatttcgcgctgttgattaaagaattggatgcgttgcatctcaccactttctgagatgagtgtagagaatttctttaatgactgaatccattctttcagactttgaaacatctgaacgtcctgtgtagtgagtgaattaatggaataaacacgtatcagactaagttgtagtgtacttgtctcgagataactgtaagtcgcctcgaagttgatttgtgacacataaatatgcacatcattaccaaagtctgtctttccttttatagcaagcctttccaactcatctgtaagtatcagcaattcttctttcagattttgcttcatttcgtctgaaatgagatgtatgtcggaaaaatactgtatatcattgataagatgaagaaaaaccatgctgtcccaaatgtaatcggtagaatgaatatgatgcgaaagtttcgcaaaatcttgctggacattgattatcttttgaggaatctccagttcttcgaaatgtttgcacttaatatgttcattctgatacatccacttgaagaaacggaacttggccagaagttcgtgcttcagatatagtgtctgcggaattacattggaggctgtacctaatgaggcattcggatcttcccgcagcgtatggaataacttgacgtgcttgttgaggaaatcatagtaagtttcgaaggggttgccatgatctactacattgatatcgaacattgcattgttgctgaagctaactccggcaattctgtccagggatatccccagttcttttgaaataatggctgcttcctgaaatgtaaaggggacttcgccacgcagcctccggtagatagcttccttacccatataaagggtatccattaatatatttgccaattgtccttttgcagggaacttttctttggccgcttctatcaggtttgtattaagttcattcattatcataatcctattgaattagtggtttgtttctattaataacacttgacacaggaaagttgtttcggaaactgaaactattttatttttgcttttcttaaaaaatatccacctttaaaattgtatattatgagcaaatcgtttacatttgcctctataaacaagacggggaagttctcttctctgaaaaacaatagttaaaattagaagatgaaaagaatattggtaagtggcggggctggatttataggctcgcatctttgtactcgacttgtaaatgagggacacgacgttatatgtttggataacttctttacaggttctaaggacaatataaagcatttgatgggaaaccatcattttgaagttgtaagacacgacgttacttatccttattctgccgaagtggatgaaatttacaatctggcttgtccggcgtcacccattcattaccaacatgatccgattcaaactgccaaaacatctgtgatgggggctatcaatatgctcggactggcgatgagactggatgccaaaatactgcaagcctccactagcgaagtgtatggtgatccaattattcatcctcagccggaaagctattggggaaatgtgaatccggtaggttatcgctcatgttatgatgaaggaaagagatgtgctgaaaccttgtttatggattactaccgccagaatcagactcgcatcaagatcattcgtatctttaatacttatggtccgagaatgcttcctaatgatggtcgtgtggtctcaaactttatcatacaggcgctgaataatgaagatatcacgatatatggtgatgggaaacagacacgcagttttcagtatatcgatgacctgatagaaggaatggtgcggatgatggatacggaggatgactttacgggtccgataaatattggaaatccgaatgagtttccggttcttgaattggcggaaagagtgatccggatgactggctctacttcgaagatagtttttaaacctctgccgaccgatgatccgaaacagcgtcagccggatataaaactggcaaaagagaaactgggatggcagcctaccgtcgagctggaagatgggctgaagcgtatgattgagtattttaaaaatgtctgatgtaacataaaaaatagaatgatatgaatgtggaaattaatccttccgaatataaggtccttattgtggacgacgtaatttcaaatgtccttctgctgaaggtgcttctgaccaatgagaagttcaatattgtaacagcaggcaatggaactcaggctttggagcaggtgaagaaagaaaaacctgatcttgtgttgctggatgtgatgatgccggatatcagcggtttcgaagtagcccagcaaatgaaggccgatgaagaaatgagcgaaattccagtgatctttcttactgctttgaatagtacggcggatatcgtgaaaggatttcaggtgggcggtaacgattttatttccaaaccgtttaataaagaggaactgattattcgtgtaacgcatcagatctcgttggtggcagccaaacgaattatcatagcacaaacagaagagttgcgcaagactatcataggacgtgataaactctactctgtgattgcacacgacctgcgttcgcctatgggctctattaagatggtgctcaatatgctgattctgaacttaccgagtgaaactatcggctctgaaatgtatgaactgctgacaatggccaatcagacaacagaggatgtattttccttactcgacaacttattgaagtggacgaagagtcagattggtaagctgaaagttgtttaccagaatatcgatatggtagaagtagtggaaggagtgagcgagatctttacaatggtagccgggctgaagaatatccacattgctgtggaaatacctgaagatcgtatggaagtacgtgcggatattgatatgattaagacagttatccgtaacttgataagtaatgcaatcaagttcagtaacgagggatcggaagtcttggtatcactgagagaagaagatagcatggcgatagttagcgtgaaggatagcgggtgtggtattgatgaagaaaatcagaagaaattgttgcataccgatacgcatttcagtactttcggtacaaataatgaagaaggttcaggactcggactgctgctctgtaaggactttgttactaagaacggaggtgagctctggttcacttcgaagaaaggagaaggttctacgttcagtttctcgattccgttgttggaaagctaatataagttcgatataagataaaaacctgtcctgttttctaagcacattactttagagaagtagtgacagctcagaataacaggacaggttttgtttgatagttataaattattctttcagcattttatcgtttacaaatggctttaaaatcacaataagcacatttctttgtatcttctgtctgtgtgaaaggctcattctcatcgaatatttcttttaatagtctttgcagacgttctcggaattcatcttcaaaaaaggcaaagttgttgaccggaatcttcggttggcgtggctctcccatttcaatgacgggcgaatagctttcagaggctgcccgatggatgtagagaagggaaggagctactttcagagactgctgccggctcataatggcagcatacaggaaagtctggaagatatagttgggacgcgtttccgacggagtaaacagttgctcgatgttggcaggcgtcttggggcttcctccggttttatagtctacaatacgcagggtggtgtctttggcatccatacgatcgatggttcctcccaatcggagggtgatcggaccttgaccggtctgaatcgttatcttttcggcaacaggtttttccatggcgaccatttcgaagggggcgtattgcaggtcattcctcagcagttgtttcagataggagacgattactttggagttgatgagttgtacgccattatattcgggcttttcgtctgccggaaccttgaaaagctcttgcttgaaagcgaggtcaacatagttttgtagtttgacttcgttgcgcagcaagcgttccaaatcttctttttgtattattttcctgttagcggtcaggtctgtataagctaattgggcggagaggtggaagatggttccgaacaatgcggagtcgatttccgcactgacttcgtccggtgcttttagtctggctacataacggtaatagaatttcagccggcaatcgagataggcgttgagggctgaaggagaaagtatatacgattggggattcgaacaatcataagagcagcgaagtcgttcgaatacttccggagttttctctatgctgatatctgttgtaccttgaggagattgtccggcttcaagatattcgcgggtaatcttgtgaggcccttctacaagcaattgtaacatgaaacgggattcttctccacggttcagcccattggaagaagtgttgtaaagcaaggtgatgttttccgcccgttgtatcagtcggtagaaataataggcatagaccgcatttttgtgttcgatggtggtcataccgaaagctttccggaggttatagggaataaaggaagaatcacctcctgatttaggcaattgtccttcgttgagagagagaaggatgatattgcgaaagtcaaggttacgggtttccagtactcccatgacttgcataccaatggcaggttcaccgtggaaaggaatgttggaggcggtcagcactttgctgaccaggcgtcttagtgtgtcggtgcgtacattcagctctccggtttctatcaggctatagagacggttgatggtggtatagctcttgaagagggattcccggtatagctgattgaagatatcgttgtactcgctttcttcccgatagagaagggagatgtctttgattaattctgtcaggtagtcgcatagctccttgatgccgcttcggggagtgaaaagtttgatcaggaaatcatccattttcagttccgaagggagcgggtagaagcggttagtcttggtcagttcccgttccagaggttcagcgttgatggatagctgacgggtatatgggtgcttcagtatagcggatacggtttcgtaggtgaaacgtccggtagcggtacggtagccgttcgtttgtaattccatagcggcattaataaagctgtataccggagtttgtgcaagcgggaaacccatcgtgatgttgacgttctccacttcttgcgggatggagtggagtacgggaagcagcagggcttcgttgcagaggactacggcgttctctttttcttcgttggcagtggaaagagtactttgtacccattccggaagaaagcgggcttgcgcgttctcggtagaagcggagatatagcgtatgttcttcggcttccgcagagtgtcgaaacaactttcgggcaattcattcgggaatagtttcagattacggttgatgaattctccggcttcgtgtttgactatttgcttggtataaaagagatcgtaatcccagtagaacatggctttatccgcatcttgtaatagctgaaagaacttggtctctactttgttgagcacgttgaagccgacaaaaatatatttgtcgtatttcagtcgggtggtatcgagttgctcgattacattgcgatatagcattccttcataggctattccgagttctgctaagttctcacggtagcggtggtagatagtacccagtttgtcccaaagggagataaacttctctttgagtacggtacgacgctcgatagagaagttttggaagaactgttgaatcgcttcttcctgctctttatcaaggaattcataatcgtccatcagattcttcaggtcctgcaagttactgaagagcttattcgcatctaccaggtttttatctacatcgtcgaaatcgctgatcagcagctcgccccaaaaatagaagtcgtccagtgtttcctggctttctgtttcttcacggaatactttatatagttcgcagaccaaccggatagggtcacccgctttctgtacagataacttcctgaacaggtcgctgatactcattgcggcaggagaccagatcggttggtcggattctcctgccagatgttcgttgaagaataagttggcacgcttgttagggaagacgagtactgtacgagacagatcgtttcctatcttggcatataaatcgtgagcgactagttggagaaatgattgcatatcaattataagttttttctatcttagatatttgtttattgcagcctgaacattacaggaatcgtaaagcggacggctactttcgttccgtcatccagttctcccggtttccatttaggcataagaccgacgacacgtaatgcttctttatccagataaggatctacaccacgtacaactttgggttgaactatatttccttctttatctacgataaattgtacaatggcgcggccttgacatacacctccctgggacattgaggggtatcttatgtttgcactaatgaatttcattagttctcgtgctcctcccggaaattcaggcatgacagcagccacttctaatacatcggtaagcgaatctttttcagaaagcgagtcttttaccgttattatatcacctgatataggagtaatctcaattaatcccatctcttggggtagttcaggtaattcttgtttgtttactgtatctttctctaccataggtatagtatcttctacaggagtcgggcatatttctccaaacattacactagcattggtagagtcactgatagtttcctggttagttcctttattaggagaactactacatgaagtcatcggtgccattgctaccagtccggcagatatccccaatatagttatggcttttccagccatccgtttacgttccaactgttgttccagataacgtacttcggcttcgcacttgggacaagtgcccagacaatcaccctgatattgacactcggaagtaatgaactcaatatcattagcttctgctatttgtctgcggatatcctttaatatcttgcaggtttgttttcctcgtttcatggctgacaattgttaggtgttttataagtaaaccgatcgaattggatgattcccatttctttcagtaaacggatgctattatcgacgtcgttctctgtattgtatgcgggaatgacgggggtacggacaatgatttgttcgttttttccgtgctcaatcaaatattgaagattatgcaggactttttcattattttttccggtgtacttctggtatatggtattattaatgtctttgatatcgatgatataagaatcgacaacaggtactagtttctctatattctcttgcgttacattgagtgacgtttctacggaaagctgccattcctgtccacagagttgacggaattcataaatgaaatcgctctgtaaacaaggttctccgcctccgaatgtaatgcctccgttagtggctagaaagtataattcatcctgtcggacttcctcataaagctgctcgcagtcatagttcttccatataccttctgagtgcagagattgcggattgaggcaatatttgcagcgcagcgggcaaccatggaaagccaccagagtagtgactccctctccatcagtactgagccgatggcggctaattcctatgagcggtgcggctttcattatttcacttttacaattagctcttcatctacgtaccacaggtagccggtgatatttttatatcccatcttagtaagcagttgcatatatccttttacctgtttgttatattggaggttctctttaccgaatttgaagtcaactacaactacttgaccgtctttcatcattacacggtcgggacgtcgggtttgcaacacccctttttctttgtaaatgatggcacattcgttaaacagagtccattcacccgaataccagttctgaatctccggggaggagaatgcttttcgggctacttcccgtatttcttcggccttttcgctgctggcgatgaccccttcgaaaatgaggcgctcaatagccggatcaatatcttctgctgtttctatggcagaaaatagcgtgtgcaacatacgtccgcgatgaatgaaacggtcatccgattcttcttcctcgatcccctgaatgaaatcggcggagcggttggattgacggaattcaatctcatgacgcatggactccatgtggacaggcaacttatccggcttctgagtcagtttattggtcgaagtttttgctttttcttcttccgaaggacagagttctccttgttcatagcaatcttcctcccagtcgaggccttctttgagggcaactacaggcagtgtattggccaacagttcggacatggttcctttttgtcctttcttgctccagatgatcagattctttccggcacgggtgaaggctacataaagcaggttgagattgtctacccacagttgaagacgttccagcagataatcgttcccatagatagattcggccatttgtgtcgagtaattgatgggaaggatatccatggcattgaacggagcttcctgaggggcacaccataccagttggttattcgtttcattctccagtttccagtcgcagaagggaaggagtactgtatgaaattccaatcctttggatttgtggatggagaagattcggataccttccacttcaccgctgggaatggttttgctgcacagcgtctcatcccagtagcggataaaaccgtcgagctccgaggagttactttgcaaataatccgttacggcatcgaagaaggcaaacagataggcatcctgttcttcaatgtgactcattttgaagatgctgaatagttcttccagcaattcgtagagaggcatgagacggagttctttctgcttttcaagaaatgcgggcggcagatagttttctatcggaaggagcagaagggtgttccagtccagattcttttgcagaacttcgttctgataggctattgccagttgggcccgtgcaattttattgctctcgtcggatagaaatcgcagtgcgtctatcatcatgcagatggcaagagaggcatcgaggcggaaggcttcgtctgatacaattttataatgtaactctttgtcgaagtagtccgcgatgcggggaatacttttgttcttgcgtacaaggatagctatgtcattcagccgtacaccggaagaaagcagatgctctacttcttcaccgagacttatcagcgtctggtctgtatagtcatgcgcttcgtccggttccaggaaagtggctttgacatatcctttctgtacacttcgcggagattcctgtaccacatcggcataggctttctgaagatcatcgcaatctttacccaactgttttttgtatacttcgttcaggtaatttacggcagcagtgaatatttggttgttgaaccggatgacattggtctcacttctccggttggtggctaaggtctttaccttgatggggaaatgctcgatgcggtcgttcagaccgttaaggattccccagtcaccgtttcgccagcggtagatggactgtttgacgtctcctactatcaggctgtctgctccttgtgaaagcccttcgagcaggagcagtttgaaatttccccattgcatccggctggtgtcttgaaactcgtcgatcatgacattgcggatgttggttcctatcttttcgaacacgaaagaggaatctccgtccttaaccagttgatggagcagggcattggtatctgataaaaggaaccggttgttgtcatggttcagctgtcgcacttcttcgtcgatattggcgagaagctgtaccttgttgagatgctgcagggaaagccggcaactatttagcaggagattgtttttagaacgcagcttctccgcatcctccagtatctgcatcaggctggatttcgcaagatcaataatatcggcaaaccgtggagatgttttggtagcccagtgtttggcatcttccaggcatttctctacagtggcattgcggatgtcattacttagaatgccattgttcagcttacggaaatagctgccgattcctcgtgaaccgttttttagttcatctgcggtaagggcgtgtccttccagttctccttcaaactggtcatagaatcctttcatttgctccaggatttctgtttccaatgctttcagctgcttgcggtattctttgatggtatccggattgcggaggcgctggcggagaccttcacctttttctatatatccttcgtcgaagatgttgcgcccgaaatttttgacttcatccgatacattccagcgtttgtcatcagctattcgttcgttgatgtagtctaacagccatgcgaggacaggagaggtgggacccagtttctcaatcatgctgtccaccgcatcactgagtacttccgcattgttcagttcgatattcagattcggactgagttccagctcacgtgccagattgcgcatgacggactggaaaaaagaatcgatggtctctacacggaaacgactgtagtcgtgcaacatatatccgagggcgattcctgcggcttcccgtatttcctgttctgtcttctttgtttcttctttgatgcggttcaggtaggcctcggaatctttgtcgccgatctgaatgccgtatagctgactgagaatacgttctttcatttctgctgttgccttattggtaaaggtaacagcgagaatctgccggtaggcacgtggattcagtatcagcaactttatgtattccactgcaagggtaaaggttttgcctgaacctgccgaggctttatagactaggagttcactcatgcttttgatatgaattgtttcatgattgtttgaatatgtcaagcccgaaataaagaataaataaaggcaaatagtcttttagggcaatgcgtaatagctttaaagcctgtccgatacgatagttaacggtttggggagagacgttcagcttttctgcaatttctttatgggtcatccggtgattacgattcatttcgtatgcttcccgataatctttgggaagctgtttcagagcattctcataaaggcggaacaactcattttccagataaaagtcaggattgtcgaattctttctcgaatttttctgtaatctcctgatgtacttttcgtctgatctcgaaatgggaaatacggttcagagctttgtttttgacaatagtaaagagaagcgttttcaatgtaagctcttccataagactacagcggttttcccataaccacatcatcgtgtcctgtacaatctcctcaatctcctcctgctcgctgacatattgcgaacaaaaggcgcacaatctacggaaataatacctgtagacagcgtcgaatacatattcttcgcctgctttcaaggcattgatgatagatttattattgttaatatctaggtatataggaggttgttgcattcttcattattttttatgcagagcaaaaataatgaaagcaatgaaagaaacgaaataaaacgggagaaaatatttttttcttttttagtttagtatatttgcgctgccaactgtattaataacagaggtattatat

SEQ ID NO: 187 - DNA, 13842 bp, Bacteroides thetaiotaomicron
cttattaataagatgaaaagacgatattcatgtaagataaatgtataaaagataaaagaaaaagtataatgcgttttccctgtatctaaccgacatcttcatcgttccacccgggtgaacagtctctatcacctaggtgaataagccagttcattattgtgcaatgatctgttcacccgggtggaacgatgaagatgtcggttagataacagaataagatatataggataacatctaggatacagtgacttaacatacaaacaactgctggttttaaacagatatagcggaccacatcttatgtacttactttgatgtgagagatagcaatgagagataaccgaaaactagtggttttgatggaaaaacaatgagagatacctgttcggaaaggtatctctcattcattatattaatgattgtcagcatactagatattccacagtgagaccgtgagactaaaattattttttttctttctagaagagtctttttccaataatgacaaaggattcattgtaacaggcaaaagcagcacataccgctttgatgatattggggaactgccctctatgaatatgacaatgatgcatatggaatcacaatgataaaaaataatgtgtcaatgcagtcatcattaaaaaaaggcactactccttatttcaaatccgagagattttcactacattcacagcatgaaatgcagaattatacttggactatcagccattctcttttttacaggatgttataatagagaacatatttcccggcttgacgaggcggaagctctgttacaaaacaagccggacagtgccttgacaatattaaagcagctcagacaggaaggcagtcaggccgaacaggccagatatgccttgctttactcggaagcattagataaaaaccatattaaagtaacggatgattcactgattcgccaggcttggagccattataaacactattccaaagatttacgacaccaatgtaagactctctattattggggacgaatcaaactacgggcaggagacaaaccgggagcattgcgcctttttctcaaaatagaagagaaactgaaagacaccaatgaaccttattatacaggactgttatacgggcaaatcggtgaagtatattatgaacagatgaactacagccgggcttatcattatttccgtgaagcccgcaataacttccggcagtcggataatgtacgtgaagaaacggagtcaacacttgatatggcagccgcagcttttcattcgaaagacatagagaaagcaatgcgtctctacgccgccgctcttgatctggccgacgaacaaaagaacgatcacctggcaaaagccagcctcacgaaccttgcctctctttatgtagtatcgggcaagcggcaaattcctcatgacttgctgcaacgcatcgagctttccgcccgacaggataccctgtacggctaccatacactggtagatgtgaaccttctgaaaaatcgtatagacagcgcacgctactatctggctctcgcagaagcacagactaccgacatccgtgacttggccgacctgcaatataccgcatatcgtattgaagcacaaaccaggaactttgagaaagcaaccgataacatacatcgttatatctatctgactgattcgctgacacgctcaaacatgcagttttccgccggcatggtggaacgcgaatattttaaagaacggactgactttgccgaataccggatgaaaaaccgtactacctgggaaatcgcagcagcaactgtaatccttctgatgataggagtggcttattacatcacccgccaacgcctgcgactgcaacgcgaacgcaccgaccgctatctgctactggcagaagaagctaattccgagtataaaactctgaccgaacgcatggaaggacagcgcaatactgaaaaccatctaaaaggattgatagcctctcgttttgacattatcgacaaattgggaaaaacttactacgaacgcgagaataccgcatcacaacaggccgccatgttccacgaagtgaaacaaataatcaccgattttgcagaaaacaatgaaatgctgcaagaactggagcttatcgtaaatacctgccatgacaacgccatgcaaaaactccggaatgatttccctgcaatgaaagaagctgacattcggttactctgctatatctttgtaggtttttcaccacaagtaataagcctgttcatgaaagatacggtagccaatgtatatgcccggaagtcacgacttaaatcacgtatcaaatcagcagagactgctaacaaggacctgtttttatcacttttcggataggtgttaggccagtgttagaaatctgagaacccattcaaaataactatctgaatatcaacactattaaaacaccagtgttagatttacaagatcgtaccataactcaaaaatgatatgatcttactacttttgcattcgaaaaaattgaaaaaagagaagattatgagaaagattgttattctgctaggtatcatactttttatgatagcgtgcgaaaaaggaaacgaagaagtgagagaagctaaagtagtggttgtcgtttatgatgaaaatggaaaaattgcaacgggtattcccgtaaagatgtataatgaaaaagattataaagtttttgagaaagataatctgaccttacctactgcggttgcccgaaccaatgaaagcgggatagccacctttattttaccgcaagaagaatggttcgcagcacagtcgcagcggttctttacgttcgtggtacaagaaggtggcggacctgataactaccagatatggtcttccggcagaaccgtagaagcaggtaaggtagtgaaaatagaaatacgtttaacccaattccctaactaagcttttatcacaatgaaacaaactaaacttaatatattaatagtactttgcctgcaaatgatgacaggacttacattactgagttgcagcactgaaaacgatgaattcaagaaggaactgcctccaacggagcaaccatctgaacccacaggagccttacttgaacgtttttccatagaccagctgcctgcaaaaacgatttatgcattaggagagagtatagacttaactggactcaaagtgacaggtgaatatgatgatgggaaacaacggtccgtgaatgttgccccaaaacagatcagtggtttctcgtcatctgtccctgtcgacaaacaggaagtgaccataacaatagaaggaaagcagaaaagctttactattcaggtggcgcctgtccgtgtggaaaacggagttctgacagaagtcctgaaagggtacgatgaaatcatactccccaacagcgtgaaatccattcctaaaaacgctttcaacggcagtaaaataaacaaggtgacactcaatgagggactgaaatccatcggagatatggctttcttcaattcaactattcaggaagttatatttccctcgactctggaacagcttgaggaaaacatattctactattgctatcaccttaaaaaagcagatttaagccggactaaactcactaaacttcccgcaagcacctttgtatatgcgggcgttgaagaagtgttattacctgctacgttgacagaaatcgatgcacaggcattcctcaagacgtctcaactgaaaacgattgagattccggagaacgtcagaacaatcgggctggaagcattccgggaaagtagcattacaaccgtgaagttaccgaatggtgttacaaacatagcgcaaagagccttttattactgtccggaattaacggaagtgacaacttacggaactgttttcaatgatgatcccgaagctatgattcacccttactgtctggaaggatgtccccaattaacacgtttcgaaattccacaaagtatccggatattgggacaaggattattgggcggtaacagaaaagtcactcaactgaccattccggcaaatgtgacacagattaatttttcagcattcaataacacaggtatcaaagaagtcaaggtagaagggataacacccccacaagtatttgaaaagatatggtacggatttccggatgacattactgtcattcgtgttcccgccgaatctgtagagaaatataaaaccgcagccggttggcaagactacacaaacaaaatacaagcgtcctgatgatttatctgaattttcggttatcattgtaaaagtcgattccacatctgctttttatgatgataatcggaaattcttttttattcggtttctgtcagatatattcagtaaatattccgctatatattcttctttactcccaaatactgttctattttccagttttattctttatctttgacgcaataaaaccacttcgaattcacaaatatagaaaacggcaagaggatgccagacatatagttatgactatactaattattatagctgtagtagtagtgattttcatcgctatttacaactcactggtgcgaaaaagaaatgagacggaaaatgctttcgcagccatcgacgtaatgctgaaaaagagatacgacttgattcctaatctggtaactacagtcaaagaatatgcagaacatgaaaaaagcacattcgcacagattacggaaatgcgcaacaagtcgtacgcatctttctctaatcaggataaagaaaatctggactctgctttctcacaagcctgtacacacttttttgccattgcagaaaattatccgcaactgaaagcgtctgaaaacttcgaacagttacaacgtgcgcttaacgaaactgaagagcagctttcggcagcacgccgaacttttaacgcttgcgtcactgactataataatgcagtacagactttcccgtcaaatctgttggccggtatgtttggtttcacacgcaaaagcgtattctccatttccgaacaggaacgtactgttccgaatgtgaataacttgttgaatcagtaaaaaacaatatataatatggcagaaagtccgcaatttgagacattggtacaaagtctttcctctactctgcaaagtcttgaacagaaacgcaaagaactaaaaaagcaaggacattccaccggaatatgggtaggagggattattctcgtgattggtattgcattttccctttatgcccatgtagcacttattggaatcggtattgcggcaggtcttgctttgttggcatactacagttgtataaatgccaaatcgcaggagttatccacctattataaacaggaagtaatcgcacaaatattacaatctttttgtgaaaatgccgtcttcacacccgaagagggaatcaaggaaagtacattcaggaactgtgccctgttcacttctcccgaccgttatcacacagaagatctgatacagggacgtgtaggaaaaacggacttctgctgtgcggaaattcatgccgaagaacgaaaaacacgtgtcaattcaaaaggacagacaagtcattattgggtagatatctttaaaggtttctttttcattgccgattttcagaaagactttcagggacataccactattttaaggaatagcctgttcaaactaagctccagcggttcgcgggtgaaactggaaaatccggatttcgagaaaacattcgatgtttactctacagaccagattgaagcacgctaccttctttctccttcaatgatggaacgacttcttgcactagacagagaattcaataagaacatcacaattagtttcagagattcaaatattctgatagctattcctgaatcaagaaatcattttgaagccagcatctggaaaccgatggatgaccttagccagctcaaaaacgatttcagcatgattcatgcattggtctctattgtagaggacttgaatcttaatacacgaatctggagcaaaaaataaaacgaatcagcagaaacagaacccgttttatatgtcgaacttaatagaggtttgattgatacttctatagagtttctgcaactcaaatctccccgttgactcctaatccaaataaagcaaaatcacccaggcaaggatcatccggaaagacttcagccaatgcagcggtgatccgacgggcattcttcaaagaaaaagtttccgtatccgtcaacttgaagtaataagctaccctacagacatgagtatctaacggaacaatcaggtctttacgatcaaaactctcccaaacacccaaatcaacctccgaatcccgacgaatcatccaacgtaaaaacatattcagtttcttttgaggacttttggcagaaacttcgagaaatgcacataacttctccataggtattccggaatatatattcaaagcatcttccaaacttccgaactgcgtataggccgtatataaccgacggaagtatccatgaaaatcagcatacgacagcatccgataaaaactatgggttgccccggaaggaaaatcttcctcccaccggcgggataatacatattgataaggtgaagttcccattagcttatgcaactcatccgctttcttcaatatctgcttgcgattgccaaaactcataattgccgtcagcagtccgctaatctctatatcttgtttcagcgtataacgatgagggaactgcaccggatcacttgcgataaagcctgcacaatggtacacctctgcacacatcaaaagtttattctttatatcttcagtcatttcgagaaagtatcaatcattgaaagtacaaaagtacatattctgtttggatttcctcttcaagtacagaatggattgtattcccaatagaataacgaacagatattccgccgtcatatacaccgtcaaagaggcatgaaaacactcactcagcaaatatagataaatcagatagatcaggatagtaaccagttgaaagacaaaggcaagtcttgtctttcccgtacctgtaacagcattgatataaacatatccgggcaatgcaaacacataattcaacaacatgactataaaaggccagaaagcaagttttactaaataatcgttatttgtataaaatccgatgatccattgattgccccaaagagctgtcagtatcaatggaagccctaccacatagcctaatctgagaactttgcggcaaacgggaaaaagttccttcccctgtcctcccccgatcagattgctaactaacgatccggtagtagaagcgaaagaattgactatcacaaaaaagagggtagacacacttcgggtaatattggaaatagcaagttctgtcttccccaaatgttcaatagccacaaaaaacaaaaaccagggagcgacactgataaaagcatgaagcatactccatacggacagttgcagtagtttcatcagcaatctgccatcatagacggcactcagaccatattttttcttatctaccgttttacacatatataacaagagtatgagaaacgctccaaactcagcaatggaggaggccatcgctgctccggatatgcccatatctagtttgaatatcagtaaatagttgaaaggaatattgatacagactgccgtaagagctgctccggagaggagtttagtattcgtgaccccaaccaggaaagcccggaaagctaagaaaggaaacgaaaataacaatccgaaactacgccagttcaggtaacggatcacagcctgataaatttcatcagaagtaatcagctgttgcagaataaacggagaaacaagatgtatcagcagacaaagcatgattgccatcaccatcagaaaatataatccctgaaagaaggtacgccctgtttctttgtaatgctgctccccatttcttcgggcaatcataacctgcagaccaatgctgaatccaaatcccagcatataaatcgctaaataatatattcccgcaagtgcggatgctcccaattcgatttctcctacgtgtcctaaaaagacagcatcggtaatgttgattaattgctccattagaatgctcatcatcacaggaaagttgatgagccatatttgcttatatgtatatttcattgctcaactaaaaatagcacgatacagcatactacactcatagcagtacacagtttcgtaaattcataaaaatgggtataaaaactctttggcaagcgggtcgttgcttaccggatagctgaatagcctgattagaaaggatgctattcgttgagcgtagctatatacagagtttcataaatagatggatatactattagttcattaatcacgctacaaagatagtcatttttatatcatctcctaatatggtatggtattagcagattacatctagtaatggactgcttcagaagcgggaataatagaattaataatttgattctgaacaacatacctgataatcaaatagcagatcgatggcaacagaccatctctatttgaaaaaaggcatatcattttgaaaagatcagtaaccaataaattatcagataacaatgaaagtttgcaaatttgaaaaaatgaaagaagaggatgaaatcagacaagtaatcaattacatcctaaaggaacatccttacgtagttgtggttccgacactgacgcaactacaagaatggctgcaggatatttctatcagctggtttcacgaagaagacagtgcttcgcatacaacaatcaataatatcgaagaatattgctgcacactggcagatcacctcataacagatttgccactaaatacggatataaagaaatatatccgggaatgtatcgaaaagatgcacaaactggtggaggacaaagccgatttattaattgataaaataataaaagccgaaatataccggttatccggagaattgtttgcctgctgcctgcgtcagcatggactgaatgcccgcacattggataccggtacttttatgcagatgaatctggaaaggaaaccggatatcccctacattcaggaatctatcaggcagtatatcaatgagaatcgggatactgacattttcatcgctcctctttccttatgcaaaaatgtatatggcgaaattgatttcatgaatgagaagcgtaatgattattatgctaccgtactcgccagcatattcgaagcagacgaaatcattctgtcaaccgaactcacgaatatctatgccaaccggaactgtgccagggaacaacattctctgacctacaccgaagccgaacagttgattaacagtggagtacacttaatttatacagactgtatcactcttgcagcccgttccaatatcgttatccgcttaatagacacccatgacctggaaacagaacggctctacatctcttcccatgatacggaaagcagtgttaaagccattattgtccaagactcagtgacgtttgtacgcttcacgtcattgaacgtcctgcccggctatttactcatgggcaaattactggaagtcattaataaatatcagataaacgttatctcaatggcctcatccaatgtttctgtctccatgattctgacagccagtcgtgataccctgcgaataattcaaagagaactgcacaaatacacagaaatggttgttgacgaaaatatgtccgtaatacatatcataggatcacttcattgggaacgtacgcaactggaaagtaacatcatggaaacaatcaggcatatccccatatcactgatttcttatggcggcagcgatcattgtttcacaatatcagttcacacggctgataagaagcaattactcaattcgctgtcacagcgttttcttgaaagactttcagcctgattaacaaagtaataaatacaaatccataaaaacatgaaaattacaattataggagccggaaacatagggagcgcagttgctgcctgtctggcaaaaggacatctctacaacgaaaaagatattatcatttctacccctcatacagacaagctagaaaatctgcacaaacaatttcctgcgatacgcataatgacagagaatcagtatgccatatcggaagccgacattattattctggctgtcaaaccatgtatagtagacgaagtattatctccgttacgattctcacgcacccaaatcctggtttcactggtaaccggaatatccatttctcacctggcacatttatcggaaaccgaaatgcctatattccgggttgttccaaacatcgccattacggaacattcgagcctgaccctgataacttcacgcaaagccggcaaagaacaccagcaactcataaaacagacatttgaagaaggaggaaagtgtttgttcgcagaagagaaacagctggatatcatttctgcattaacttccagtggaatcgctttcgcattaaaatatattcatgcagccatgcaagccggcatagaattgggtatctccgctgaagatgcaatgcgaatgacggcatatagcatggaaggagctacagaactgattttaaatcacgacacccacccgctgttagaaatagaaaaagcagctactcccggtggagccaccattaaaggattgaatgaactggagcacaggggatttacttccgccgttattcatgccataaaaagtagcgccacagtatcgaccgataaagagactgaagaatagacaaacgatcccctaaattttcacgcacataatttcgcactaatataaagtatatatttttcatataaagaagaagatactaacagcattattatacgtttattatacattaaaaagagttaccctatacacagagtaactctttctaaattcagttcttcaggttcagatttaacttacgatactttatatcgacaattctttacttataagttaatggaacttcaaagatgttcacgaacagcattctttattatccaaagctaaaagggaaagtgctttcatcagataaagcaattaatccatttttccgctggatacaaattttgttctctctcgccagccaaccggcggctaatgctgtactctctacgctaaggtttaatcttctcgccaattctggtatcgaaatttcaccaatttctttcagggcacaccagaccttgccggcattgttccctactactcttttatccatggctattctctattaataattcgaaactaagatagctattttaataatagttcataacatattctcttattttatttaacagattgacattatttaaagattcaaaaaagaatcgggttcaaacagttaaatattcggtcatattttatactaaagcaccattctggaatactcaaaatcatcaaataaattcatagcataactaaaagagaatcaacaggttttattaaaaaaaatgaataatagcaatatcggacaagttcgttcccttttttaccaatacctttgcgaagtgaaataccaaaagaagttatgcaacagaagaaaacaaccaaagaagagtatcaaaagtgcgtaaatgttgtggtggaatatatcaatcaacatttaggagaagacattgatttgaaatcgctggccaggatatcaaacttttctcctttttattttcaccgaattatgaaagcattcctcggtgaaccgatcggtacctttattgtccggacgcggacagaagcagccgcacgtttattgcgctattcggatattcctattgccgatattgcctatcgcatcggatattcatccccttcttccttgtcgaaagtgttcagacagttttatggtatttctcctttagagtatcgaaacaataaaaactttgtaattatgaaaccagcgattatcaggccagacctggaactgaaaagtgaaattaagagtatacctgcacgcaatgttatttatatccgcctgtccggtgactacaaactgaatgactacggagggacatggggacgtctgtggcagttcatcaaagaacaaaagctgccgatgggagatttcagcccgctctgcatctatcacgacgaccccaaagtgacaccagccgagaaattgcgcaccgatgtatgtatggtgatgcccgtacaggtagctcccaaaggagatgtaggattcaagacacttccggcaggacgttatgcaatcttcttatataaaggtacgtatgacaatctgcaagcggtatatgatactatctatggaaaatgtctgcccgaaatggaatgtacgctacgcgatgaacccagtgccgaacgctatctgaacaatccgtgcgaaaccgctcccgaagagctgttgacagagatttatattccggtagaataagaaggatttaaaaataaatgagactgcatccataaaaaatgcagtctcattctactttcgctcatcattacccatcagagggcaactacgccggacagataatcttcctctcttttatctgttatttatcagcgtaaagccctaccctgtttccctcgctatccgcaaacaaggcaaaccagcctctgccctctacttcgattttcgtcttgggcatcatgatttttccacctttccgaaggactttttccagtgtctgatcgatgtcttcacaattaaaagagataatcactcctttttccgaaggaagataatcgggagcatgaaaaatagcgccgaccgtttcaccttcttccgtgaaacacgccatcttctcctcttcacattcaaaaaccggaagctgtaccccaaacactgtttcatagaaatcgacagcccggtgaaaatcaactgtaggaatctcaaaaaatgcaataaactttttcatttcgttctttttttatggttactattgagcctttgcaaagacactgcaaaagtaagggatgccacaaagctctgataggaaaaaaaagacattttcaaaattccgagaagtaatcagaataaggagcacaaacagaaagatattctgcaggcgtataaccggaaaatagtttgaattccttgatcatgtgggactgatcggagtatccacattcataggccacttgtacaaaaggcaaagtcacatcctgttgcaacagaaataaagcacgttgcatacgcacaatacgaagatattccttgggagtcgtaccgacatgatcggcaaaaacacgtccgaactgcttgctactcaaacaagccgcctccgacaattgaggaatatttatctgtggttgaagattgatttcctgaaagacagcagacatcctcttcagattatactcggaaaaagcatataaacgacgaagaaaaaactgctctatcagacgaatacagactatattatcagaagtatcagtgacttgcttcgccaaatccgatagttcgacatcttccacttcatccatcgctacatctttcccatgaaacaagtgaacgggaatgtggagcaaggctttcgctgcataaggttgaaaaacaaccgtaatcatctctatcctacccgtcgacaacacatcggagaatccgatcgactgtccgcaaataaaagactgtggctgcaactttaaatcattctgcaggaagagttgtttccctttatgaaaaacaagttgcatacaaccgatgggcaaagtccgttcggaaacaggaactgctgcatcatcctgcaatatccaataatggcggatgtaaggcgatagcacaggaacgggctttataatctgaaatgactgcatatggcaaagatatcacttttttaattatggaagcaaaagtagatagtctctttgaatctgtattgtaaaaaagagacatttaattattaaatcaaacctaaagaattatccttctgttaaaatgataaaaagaatagaag

SEQ ID NO: 188 - DNA, 13784 bp, Bacteroides thetaiotaomicron
atattaattatatcaactcatagcttgccatttgtatcggcatatccagattatgaagcactttttccagcaaaataccttcccggttgtcatactcatagccaaaggttgcccgaatcccttgcagaataaactgggtagcacggtccaacgccatcggaagactgtctccctgcatcaaggagccggtgatcacacttgtgaatgtatcccctgtgcccggatagtgggcaggcagataagggcaagtcactttccagtagcggtttccctgacgattgtaggcatatacggaagtcttatgaggctcatcgtgcaccggaacactggtgataataaccacctgtggacctttatcggacaggagacggagatattctttcagttcctcatccgtactatccgctttatacggttcgtccagcaaataaaacagttctgtcagattcggtgtgatcacatccgctttggttatcagatgacgcatttctttcaccatctccatatcaaagttggtataaagccggccgttatcacccagcaccggatcggctactatcagactatccggctgacggaaatccttgatgaaatcggaaacaatctgaatctgccgcggggaacccagataaccggtataaatagcgtcaaactgaacttccagcttcttccattcggctatgatcttcggcatttcatccgtcaggtccagaaaggagaagccgggatactgcgtatggttggacaataccgccgtaggaagcggacaaacctgaaaacccatagaggataagataggaataacgactgtcagagaaacacgtcccatccccgaaaggtcatgaacggcagctatcttctttactttatttgcatacatactgtttttattatttagacgattatagttctttccatggatgagacagaaaacagaggctctatatatcaacaacaaaggctctgtttcctatcaacagagcctttgtttatcttatacagaagctccatttttctttgtcctaacaaaactaagcttctattgttttaaatccaaatttattttagaataataaagcggagttacgtcaatatgaccaaaacctcccgtgctccatgcgctcccatgaccaatgcctgttcgatgtccgccgtctttgacgggccggaaataaaggtaccgaactgatattcctgtccgtccagtttgcgataagcatcgtacatggtatccacaatcttattccggtcgatcagaatcaccagtttctccgaaataaaataaatcgctttatacttcacggtttgcggtatccagacagcaccgttctccgctactccgatctctccccgaataacggctacctcagtaccgtccagttctttcgggtcgtccaccatatccggattgaaagttgcgcaagatatatccggcaatacggaagcaatgcgcatcgcatccggatacgtccggcgaatgacagcattcacatcttcgccttcacccaataccactaccgtaccgcctaccgcacggctgatagcgcaaaattgctctattttgtccggatacgtcaaacgtttcatatctgctatatccggtttttcgtagcgtgtctgcgtatgcttacggatgctcgccaatatttcttctctgctgctcattttgattcctcctttccctgtacctcgtttttcttccacatttcgttgaatgactctttggcaaattccggcagttcgcgtcctttgccccaatcgtcaaagtcattgtacttcataaagcgtggcaggccgtttaccatcggagccgcccacagagccgcattgaacaatgcaggacgctccatcaggaacttcatgccaccggacattatcttctttccggtattcgcctttcccaatccgtcaaggtcttgacgccacttgtaaatctgttctgccaaatccacttttaccggacagacatcagaacaggacatacacaaggagcaggcggaaagattatcataatacttctccggatcatgagccatccccagattgataccgatagggccgggtataaagtaagtgtaggagtatcccccactccggcgatagaccggacaggtattcatacaggcaccgcaacggatacagtttaatgtcttgatatggtcgggcttggaaaggatcgtactccggccgttatccacaataataatatgatattcgccaccttcacgcggacggcggtaatgagaggtataggtagtcaccggctgtccggttgccgaacgtgccagcagacgggtgaacacacctagcgcatccagatccggcacgatcttctccatgccgaaagcggctatattcaacttcggataagaagtacccatatcggcattcccttcattggtgcagactacaatgtctccggtagaggctacggcaaagttggcgcccgtcatggcggcttccgcattcagaaagaggtggcgcagattcttgcgtgcggcatgagtaaggtaggtcgggtcgaagtttcctttttccgtccccatttccttttcaaacagttctcccacttgctcccgtttgatgtggatagcaggaagaacgatatggctcggctcgagatgcatcaattgcagaatacgttcgcccaagtcggactctaccacgtctattccgcgttccatcaagaagggattcaacccgcactcttcggcaagcatcgacttgctcttgatgaaatgatgtacattatgctcattcagtatttcgtacacaatggcacaatattcgtccgcatcttttgcccagtgcacaatcgctccgttggcagtggcgttcttttcaaactcttgcaagagctcttcgaggtggctgttggaataaagtttcagttcacaggccttgttgcgaagctcttcccattcgggaacttccttgctcatcttgtcccttttggctcggaccatccaaagggtttcgttatgccatgctgccatcttgctgtcctgcaagaacttttcggcagcctttgaatgtttggtactcatgattgcgacgctaaaatttcgacaatgtggataatttgaatcggcagatgctcccgtttgatcacaccttgcatgtgcatcaggcaggaactgtccgctccgacaatgtattcggctccggtagccatgtggtctttcaccttatcacgccccatgcagacggacaccgcctgctcttctacggcaaacataccaccaaacccgcaacattcgtctatatggctgggctcgaaaacttcgatgccttcgaccatatcgagcagatcgcgcaatttattgtaataagggatatttaactcactgggagcggaaattaagagttcacgcacaccgtggcaactgttgtggatactgactttatgcgggaagcgtgcgggtatcttcgtcggtttaagcacatcatggataaactcgcaaaggtcgtaaatcttccccgcactctggcagacgtgcccttctttttcaaggataccgggatgattctctttcacaaatgccacacaactggcggaagggccgacaatgtaatcgtactcccggaacagatcgtcaaaacggagcgccagcttcatcgattcatcttcaaaaccggcattcgccatcggttgtccgcaacaggtctgatccaacggataatcgacatctactcctaaacttttcaatagtttatacgatgctacccccacattgggatagatagcattgatataacaaggaataaataaacctactttcataattatattacgtaaaatttagatgcatcctctgctactacatccgttttctctgcttaccggatgtcgattagtttgtgtgtttgcaggcttagtctccatttaggatgtcgcattacacagtccactgtcaaagcagtgttattacaagaacaaggctggaggaaaaaatgttcagcgggaagcagttcataaatacttatatcttgcccttcgtagacaactttcacttcatccatccgggtaatccctaatttgacaccctgcttgggcgaacaggtcacccagtcgatggactccggcagcggtcgcgtgccgttggtttcgatacaaacgtatttacccgcttcgtgcagacggtcgatcagtgcgtcgtctatccagagcgaaggttctccccctgtgaggataacggtaacggcgggatatttgctgacttcggctatgatttcgtcgtcagtcatcaaggtgcctgcttcgtgttgtgtgtcgcaaaaactgcatttcaggttgcatccggaaaaacggatgaagactgccggagtacctgtgtggtagccttcaccctgtagactgtaaaagatttcattaatctttctcatcattcgagctgttctaaaatttctattgtctattctgtctctcctgctgccggagttttctcgtttgccacagcatctttctcgtagatgacgatgtttccttcggactcctgcacttctactttatagcattgcggaatctgcctgcaaacccatcgggcaatgttttctgctgtcggattgaatggaagtacttcattcagattctgatggtccagtttctccgtgaccacttctttgattcgggtgaaatccaccaccattccttcggagttgagccgtgaggaacggcaatagacagtgataatccagttgtgaccgtgtagactggcgcatttactgcgatacggaagtaccagcttgtgagaagctgatatctccatgcgtttgattactgtaaacatggctgtatatatttaatatagttacaagcatctaatgtcacctcgatgcaaggacaaaggtaatataaaaagagctttcatccagcaaacccgattattttttcctgtttttacactatctttgccgaatgaaaactctttatattgttttaggaagcatatctctcggactcggcattctcggcatctttctgccgttactgcccactaccccttttctgttactgaccgccgcactttatttcaaagggtcgccacgattatataactggttgctgaatcaccggcacttcggtccatacatccgcaatttccgggaaaacaaggcaataccgctccgcgccaagattatctcccttgtgctgatgtggggaacgatgctctattgcatcttcttcctgattccgttcctatgggtgaaaattcttctgggactgatagcggcaggagtcacctatcatattctttctttcaagacattgaaatagttcgaaagcccctgacgggcgtcggcaagtttgtcctcccaatgtttcacggagttttgtccgataatgtcggtcacgtacttcacggagataaaaggaatctctttggaacggcagacgaaggcttgcgcatacgcttccatgtcgacgacatctccgcttacgtgagtcagttccgtcaggaaaccatctcccgtattacagattccctcttccgtccaatgcttgcagaagccttttgtttcgagcaaagcggaagaatctatttcgcattccatacctagtccggcaagtttctgcatatcgcggtctataaatttgcggcagacaaagatatcccctacctgatgattgactgttcctgcacttccgagattcaaaacgagatcgggctgcacctggcggatcgcttctgccagatgaaaggcggacttcacttttccgatccccgtacggatgtaataaggctctacatcgggccactttatctctacaaattcgccttgaacggcatacgttactaatattttcagcataagttttctgtataaatagacattatcagatgcaaaaataagcatttatactcgaaatggtcagagattgttctaaaatgatcagtttttaatgatggttgctttcggcgttcgctaactttgcctacataacttaaaaacaaaatatcatgactcaaaactctattgcggacaaccggatggtctggctggatgttgtccgttgcgtcgccatgctaatggtaatcggcgtacattgcattgaccctttttacatttctcctacgatgcgcgttattcccgagtacacacattgggcagccatctacggttcgcttctccgtccttcggttcccttattcgtaatgatgaccggattactgctgctaccggtcaagcaacagcctttaggcactttttataagaagcgcatcttccgcgtacttttcccgttcctcatctggtcggtactttacagtatgttcccctggttcacggggctgctgggtctgcccaaagaaatcatcggcgacttcttctgctatactcagggacatgagtcgcaaagcctcatcgattctctgaaagatgtagccatgataccgttcaacttcagccataaggagaaccatatgtggtatatctatctgctcatcggattgtatctttatatgcctttcttctctgcatgggtagagcgggcaagcaataaaaccaaacaaattttccttttcatctggattgtttccctgtttatcccgtatatccgcgaatatgtagccaatatgcttttcgaccggagcggctatgtattcggcactgacacgtggaacgagttcagtatgttctactactttgccggattcaacggctacctgctgttgggacattatctgaaagaaggcggcaacggaaatgcactaaaaattttctggccttttagtggttcgtcaaaagatgatcgtcttactaatgattggagtgtttggaagacattcctcatttgtgccgtgatgtttgccattggatattatgtgacgtacacagggttcagcacaactgccgccaacccgaatgctacggagactgagatggaactttacttcacattctgtagtccgaacgtgttactgatgactttggccatgttcctgatgttgcagaaagtagtgatcaatacacctgtcatcgtcaaagcattagccaacatgacccaatgtggtttcggaatttatatggtacactactttgtagtaggtccgttctttctgctgataggtccttcggaaattccaattccgttgcaggttccgttgatggcagtttgtattttcctttgcagctgggcattcaccgcgttactatataagctgatgcctcacaaggcaaagtatataatgggataaagaaactaaaaaagatatacgatgaaaattaaagttggtcttattggattcggtcgaatgggacgattttatttgaaagagatgcagaaaagcggaagatgggatgtcgcatacatttgcgacatcaatcccgactgccgcgaactggcaaagcaattgtcgcccgaatcgaaaatactcgaaaatgaacaggaaatgttcgatgatgaaagtgtgcaggtggtcggactcttcgcattggcagactcaaggcttgaccggattgaaaaggctatcaaatacgggaaacatatcatctccgagaaaccggtatcagacaccatagacaaagaatggaaagtagtagacatcaccgagaaagccagttgtttttctaccgtcaatttgtatctccgcaacgcctggtatcatcagactatcaaacagtttattgatcagggcgagatcggcgaacttgccattctgcgaatctgccacatgactccgggcctcgcaccaggcgaaggtcacgaatatgaaggtcccgccttccatgactgcggaatgcattatgtagacattgcacgctggtatgccggatgcgaatacaagacatggcatgcgcagggcgtcaatatgtggagttataaagatccttggtgggtacagtgtcacgggacattccagaacggcgttgtttttgatatcactcaggggtttgtgtacggacaattgtccaaagatcagactcataactcatacgtggacatcatcggtaccaaaggtatcgcccgaatgacgcatgatttcaaaacagctgtcgtcgatctgcgtggagtgacgcagacccatcatatagagaagccgttcggtggaaaaaacatcgatgtgctgtgcgacttattcgccgactccatagagaccggaatcagaaatccccaactgccgctcatacgcgattcagccatcgcatcggaatatgcatggacctttttgcacgatgcctatacacatgatttgcctgctatcggtgaactggagacacttgagcaaatatgggaaagaagaagaaatatgaaaaatggatacggattacttcaaaagccataataaatattcaataaaataagaaactgaaatcaattattaactcttaaaaataaaaccatgtcagacttttcaagaagaaaatttcttaaaacgggggctgctgctttagcaggaatcaccattgctcccagctctatcttaggtatgagccacggacacgtttccccaaccgacaaactgaacctcgcagccgtaggtatcggcggtatgggacatgccaacatcaacaacgtgaagggcaccgaaaacatcgtagccctttgtgacgtagactggaaatatgccaaaggcgtattcgatgaattcccgaatgcgaagaaatactgggattaccgcaagatgtacgatgaaatgggcaaatccattgacggcgtaatcattgctaccgccgaccatactcatgccatcatcacggcagacgctatgacaatgggcaaacacgtatattgccagaaaccgttgactcactccgtttacgaatcccgtttgctgaccaaccttgccgcctctactggagtagttactcaaatgggtaaccagggagcatcgggcgaaggtaccgacctggtttgcgaatggatctggaatggagaaatcggcgaagtaaccaaagtggaatgcgccaccgaccgtcctatctggccgcaaggactgaatgcacccgaaaaggcggaccgcatccccaacacattaaactgggatcttttcaccggacctgccaaactgaacccgtacaacaacgtttatcatccctggaactggcgcggatggtgggattacggtacaggtgcactgggagatatggcctgtcatattctgcatcagccgttcagagctctgaagctaggttatcctaccaaggtggaaggttcttctactttattactgagtgcctgcgctcctcaggcccaacacgtgaagatgattttccccgcccgcgacaatatgccgaaagttgccttgccggaagttgaggtacactggtatgacggcggtatgatgccggaacgtccgaaaggtttcccagaaggaaaacaactgatgggccccggtggtggtctgactattttccacggaacaaaagatacattgatttgcggctgctacggagaacaacctttcttgttgtcaggccgtgtgcccaatgcaccgaaagtatgccgccgtgttacttgttctcatgaaatggactgggtacgcgcttgtaaggaagacaaatccaaccgcgtgatgccgaaagcggatttctccgaatcgggaccgatgaatgaaatggtggtaatgggtgtattggctatccgtctgcaaggattgaacaagacattggaatgggacggcgctaatatgtgcttcactaatatcggtgataacgaaacactcagaacctgcattaaggacggatttacaattcatgatggtcacccgtcattcaataagacctggacagatccgatcaatgcgaaacaattcgcagccgaattggtgaaacataattatcgcgaaggatggaatttgcctgatatgccacgataagaggaaattaaagatcaaaaaaataaattgatattatatgaaaaaagtattttacccattagcttgttgtctcgcagcgggagttttagtttcctgcagcggtcagaagaaagccgggagtgctcaggaagagcaatcggcaaacgaagtagcattatcatattcaaaatcattaaaagcggcagagatggatagcttgcaattaccagtagatgcggatggttacatcactatctttgacggcaaaacatttaatggatggcgtggttatggcaaggacagagttccttccaagtggactatcgaggacggttgtatcaagttcaacggttctggtagcggtgaagcgcagaacggtgacggcggagacctgatctttgcccacaaattcaaaaacttcgaactggaaatggaatggaaagtttccaaaggcggtaactccggtatcttctatttagctcaggaagtgacttctaaagataaggacggtaacgacgtgctcgaaccgatctatatttccgcacctgaatatcaggtattggacaatgacaatcatccggatgctaaattggggaaagacaataaccgtcagtcggcttctttatatgacatgattccggcagttcctcagaatgcaaaacctttcggtgaatggaacaaggctaagatcatggtttataaaggtacggttgttcacggacagaatgacgagaatgtactcgaatatcacttgtggaccaaacaatggaccgaccttttgcaggccagcaagttcagtcaggacaaatggccgttggctttcgaactgctgaataattgcggtggtgaaaaccacgaaggatttatcggaatgcaggatcacggtgatgacgtatggttccgcaatatccgcgtgaaggttcttgactaatgcatcatattatgaaaacgaactatttattagtgctgttcgcattgctgctggcaattccgcaggcagcagatgcgaaaaagaagaaagacattgccatacaactctattcggtcagagacatcataaataatggaaccgacctcaacgtagtgttgaagaatctggcgcaaatgggatacaccagcatcgaagccgccaattatgataatggcaagttctatggcaaaactccggaagagtttaagaatgctgtcgaaaaggctggtatgaaagtactgtcttcacattgttccagaggattgtcggacaaggaagtggcttccggagatttctccgagtcactgaaatggtgggatcaaagcattgccgctcataaagcagcaggcatgaaatacatcgtaaatccgggaatcggtgttcctaaaacaatgaaagagatgaagatgtattgcgactatttcaatgaaataggcaaaagatgccagcagaacggtatgaaattcggatatcataatcatgcgcatgaatttcagaaagtagaaaatcaagcggttatgttggactatatgattgagaataccaatcctgagtatgtcttttttcagatggatgtatattggattgtcagagggcagcacagtcctgtggactatttcaacaagtatccgggacgtttcaccgtgcttcatatcaaagatgacaaagaaatcggagatagtggtatggtcggattcgatgctatcttcagaaatgcaaaggttgccggcgtaaagcatattgttgctgaaatagaagggtacagttgtcctgtagaggaaagtgtcaagaagagtctggactatttgctggatgctccttttgtaaaggcgtcttatagtaaatagaagtaaatacagaaaaaggaaacagtaggttcacgctttattgcttgagtctactgttttttcttattttattttaatatacctcccaacatttccaccctttgttagagcagatatacaccacataagttcgcacattgtaattaggaaatttcctttttgtatcctcagcatagccttttacctgctccacgtgctcaggaagcggttcactaagagataacattctctcagcatccttaccccgatagtacttgaactccactactctatcatccgtatagtaatccgtaccgggaattcctgccatttcaaaatccgaacgtccggcagagttgttctgttcgatagcaaacgtataacagctgctcaaataacgggaaacaagttcataaaaagaacaacgaataaaattctcatttattttgtcgaatacctgtgccaggaattgtcctaaatattgttcaaaataattctgcaccaatggttccaaacgacggtcagcatcatatttccggtatacaggaacataacgctgtgcatttccctctatttgatttaactgattataataatccatatagacgctgcgcatcgtcatattaggcaatgtcgtcacatagttatctttaagcgttgtcatccccaaatagaacaagctcaccggataaaattccttattaaagaactttctcttattgaatttactggaaagatcagctacattgtatggtaattcatcgtcaataactaatgcgtccagcatctttttagcattatccaacgataaagtaagacgacgtatccagttaatgtctgtacgtaaattctcgtcaaccagctcatccggaatgctaccggcattagcagcgaactttttgaaaaaataagtaaggatggtagaattaaaaaggcgttccccattaggacggaaacggtaaccatcgtagttactcactatgagttgccagatttcatcataacgatcttgtccagcagcatatttatcaagcacatagcgcaaataagtttctgtttcttcatacgtaaagccgagcatattcaggaagttcggttccagcgtgagtatttcggcaatattatatccactggtcagatcgtccatagtaacaggtagcacacctgtgcaaaaacaagtgcgaatgctcccttcaccaatacctttctttattactttaaaaaaagtgcggagaaagctatcggcagtagtaacttcctcatagagcggatcattgtaagctgtaaggagttgattggtgaagttgtcatattcatcaatcagaatatagacttttggcaattcatgagaacgaatataagtaagagcctcttcgagcatttttgcggcatccccccgattgacaaactgaaaatccccgaacaaatcacggttatgttctaccatgacttctacaggaccacagttcaaatcattaaaattctgtgtcaaaccttgtatattgtccgccattaccatagccgaaaaatcatagcggataatcatataacggttgtgttctgatgtgggatgactaccaatccaagtgtttccaaacagttcttcgaaacgatgtgctttagtacgatcgtaataacaggctagcatagaaatcagcaagctcttcccaaaacggcgaggacgtaggaatacaggagctttataatcctcaagacctgaaatgtaccttgtcttatcaacataataaaagccacgctctcgcatctctacaaaatcggatactgcataaggaatcgttatttttgccataatctcaatattttttgctctatacaggcaaaggtacaaaatagttgataataaaggcgagagaagaaaataaattcatttatttataggatatataaccaatacgcagatgatatacaatctgcacatactcggctatatccacattaagagaaatagccgagttcacgcgcatcaactttactaccatatattcgacactatcccttcatattttcaatctatgcacagtccttcctagtaaaataaaaacgattactataataatcagcatagcaattccccctaagtccagtttaaactgctgccatttagcaagttgtttctctactggataaggaacttgtattgaatcagtctttatcaaagtatctgtc

SEQ ID NO: 189 - DNA, 13666 bp, Bacteroides thetaiotaomicron
gataaataacaataaaatagtacacatattaaaaagaactaataataatgaatattaccgtttttagagtttatcaattaaatttattaaccgctatttctatgtatatgaaaagcttattttatttattcctatctattgtaggtgcgtggcttttttcgtcttgctcagatgattttctgggtgagacagaaaccacggacttagatcaggcaaccgtattcgctgatagtacttatacggcagatttcttaaaccagatttatgtggatattggttttgatatccaacataatcggtataaagatcagtataatgatcatggaggattgcagactagttgtgatgaagctgcgtataaagctagtaccgggcttacgacagatgtaatgttcgctactggaacagtcaatcctgttactatttctgaggacgatgtttggagaattgcatatcgaaatattcgtcgagtaaatgtgttttttaaatatgcagatggatcccgaatggctgaagtggcaaaggaagagtataaagcagaagcacgctttttgcgtgcttggtattatgcaatgctattaagacattatggtggtgtggctttaattggtgatgatgtttatgaaactgtagaagaagcaatcaaggagcgtaactcttatgcggattgcgttgagtatattgtggatgaagctaataaagctgcagaaacattgccagttgaaagaagtggaaacaaatttggacgtgtaacccgaggagcttgtaaagccttaatttcacgtgtacgtttgtatgctgctagcaaattattcaacggtagtgattttgcgcctgctgattttccaaaagaattgttagggtatcctacttatgataaggagcgttggaaaattgctgtagatgctgcccttgatgtgataaagatgaagcagtatgatttgtacattcgtaatgaagatgagaataatgaggcttatccgggatggggatattatgcacagttgttacctgctgattattatggaaaagtgggaacggaggtttattgtggtacaatctttgaaaagaaagcaggagctagtatagatacaaaccgatggtttgctcctcctagtacaggaggaaatggtattggagggtatgtttatcatgatttggctgaacttttcccaatggcagatggcacaccgactaaggatagtccagattatgaccctacgaatcctgctaacaaacgtgaccctcgtttcatgttcactgttacttatgatggatgcataatgaagagtaatatgcaggatactgaaattaatatatctgtgggaacacaacaggacgctatctatcgagggactccgacagggtattatacacataaattcttgaaatttggttcaatggcaaatcaaatgctttatggaggttcgcaagcacgaccattgatgcgttatactgaaattttgctgaattatgcagaagctgctaatgaatattatggacctgatcataaagatgtactaggagatcaagaaattagcccatatattgtattgagaaagatacgtgagtgcgctggcatagagcctggcgaggatggaacatatggaattgaaaataatatgagtcaggctgatatgacagaagctattcggttggaacgtcggttggatttagcgtttgaaggacatcgtttctttgatgtacgtcgttggatgattgctgaagatacagataataggatgatgcatggttttgaaatcacaagaaatggtgagcggaagacaggaagaatcattgatactcgtcagcataccttccgtaaagcgatgtatttttatccaataccttataaagagactgtgaaatcaccggatttgttgcagaatccttattatgaataggaatgattgttatattaaaaataagaaatatgagatttaaaatacaaactacggttttacttttcgtcttattaggtactgtgagtgcttgcaatacatttaaagatgaaatagctcctgattcttatatggaagtaccaaagcagttagatgggaagtggcaattaaaaactgttgtacgcaatggaacggatatatctgaagtgatggactttagtcagtttcgtctgattatgaataaagataatacatataatattgaaaactatctcccttttttagtaaagaaaaatggtacatggagaattgataatttgacatatccttttttcttaacttttcaggaggaaggtgctgaaagagaagctataactgaaatcacttacccgattgtacaagggaaacgccatataacccttacaattagtccgggatgctcgagcaactcttatgtttattcttttgaaaaaatagaagaatgatttaaaaagaaaagcttatgaaatattattttaaaaaacatagaataaaaatcttttttttgttggtactttccttaatagtctttggatgttcctttttgattaaggaggtaaatgttaaacaagagaacgaggccggagagatggttgcctatattaaggctggtgaaattgcaacttttacgtttagtggagaaataaacatcgatggtgatgcaagcaatgaaacgtttattgttggattcttggctccaagaagttggaatgtacgtcagaatgcaactgtgacatacagagaagataggtatgaaacggaagtggatcacaaaatgacagtaattccagatactgaacagcctgcaaattataaaggtatgagttggtcagcggcattgaaaaaaaaatatggtgtacgaggcaatgtcttgaacgatatggaatggattgcatttaaatcggataactatcctagtgtaaatggaacaatacattatacagtaacaattaagtgtaattcaggaaaaagcaacttaaaattccgaccaagtttttttatcaatcactctagtgatgggattggaggagacgaggctcattattctgttaaggatgctgatgattgctttgaagtggtagaaggatcaggtactgtgattgatttttgttctacgcactattatcaaattgaacctttgtctgctttacaagatgattatgtaacattcacttttcaaggggatattaataccaatgaattgataaaagctgagaatgtgtatatagaagctactgcttatacgatagaaggaaagatatatacagtcaatgaaaagagtgcgaaaacactaatgaaaagagaaacgaaattgccaagatataatgtaactctttggcctggtggattttttaacattccggacggtgaaacaatttctcgtatagagtatattttcacaaatgaagatggaacagtatctatttcccagtcagatgacagtagagataatgaaggagaagaggtagaagaaggaataaaagagcctttcgtattcgaatttcaatgtgaatagagtttaaccttaaaaaaagattatatgcgtaatattttgaataaaagaaatagtcggtactgtttcacatgttttgtaatgtggctactacttggcttgggacatttgaatgcggtggctcaagaagcaggaggaacggctaatattacaggtaaggtaatcgatcaatatggcaatcctgtctcgggtgttgtaatcacgatgaagaatactgattttaagactgtgacaggtgatgatggtacttttgaatttcagtataagaagggcgatatgcttcgtttttctcatccaggttttttacataaggaaattaaggtgaacaagctaagaaatcaggaacgtatttttaaagtaacgttgacagaagagttcgtgaaatttccagatgtaataaatggaccttatgatacgaaagataaagcaagctatttaggttcagctgctacggtttatacagatcaggttagttcattgatgggaactactattcttccttcattacaagggcgtttaccaggactagatattgtacgtactcgtggtgcacgtaagagtcaaattgaatccagttcttctggaaccatctttaactttaatagccctacattgggtaaagaggcatatagtgataatacggaatttaatgttctatcacgccacaatgcaccggtggtggtagtggatggtgtgcaaagagaattatattctatcgatcctgatgctattgaatcggtatcaattcagaaggatgctttgtcatctatgtttttggggatgcgcagttcccgtggtgcattagtaattactactaaagatcctatcaaacagggatttcagttatcatttactggacggtttggtgtgcagagttcagtgaaaaaactaaatccgctgtctacttctcaatatgcttatttattgaatgaggcgttgctgaatgatggtaaaaatcccttttattcttatgatgactttattaagtttcgtgatcattccagtccgtatacacatccaagtgtgaactggtgtgatgaactgatgaacaaaaattcgactactcagtcttataatttgaatgctacaggcggtaacaagtacgcacaatattttattagtgtaggctatgtaggtgaaaatggattatttaaaaatccaggtggagatgctcacgatacaaatatgacatttgatcgttatatgatttcttctaaagtgaacatcaatattactgatgatttgacagcaaaagttactttgatgggacgtatagaagaaggtacccaaccaggagggactggaaatgggtatgatgatattctcagttcaatttattctactccaagtaatgcatatcctgtgacaaatccagatggatcatggggaggtagtcagtcgttcaataataatttgttatcgcagactattaactctggttatataacagatggggctcgggatgtattgggagctattaatttgcgctatgattttggtaagttagttaaaggcttgtctgttcgtatggtaggtagtgtaacttctcagaatcgttcgactacgaaacgaacaaaaacttccgaagtttttgattatactattgataaggatggcaatgacgtttatactcggtatggagaaaagaaaacgcaatcaaattcatttagttctgtgtctacctatcggcagatgtatggtcagcttgctgttgattatgaacgtcaatttggtaagcacaaatttaaggccagtgttctaggagatacgcgaaatactcttactaactgggatcttcctgaatatccatcaaatattataggtgatgtctcttatgattatgcggagcgatattttgcacaggtagcattaagtgaaagttattacaatcgttatgctccaggcagaaggtggggaaccttttacgctttcggtttaggatgggatatcagcaaagagaattttatggaaaactgtgagtggctgaatcaactaaagatacgcggtgtgtatggtaagacaggtaatggtatgaataatgctgggtattatacgtattatcagacttattcctcaggaggtgatgattatcggttggggactaatttaggacaaagttcaggaagttttacagaaaaagataaactggcaaatttatatcaaacgtgggaaaaaggcaataaactgaatattggtgtagatatagctttgtttaacaacaaattacaggtaactgctgattattttaatgataaatattatgacttgttgcaggctcgtggaaaaagtatcgaactaattggccagaattatccagatgaaaatattgctaaagaacgttggtatggaggcgaattctcaattacctatcaagatcacgttggcgattttaattattatgcatctgctaactggagttgtgagcaaagtaaagtgttatataaagatgaacaaaaagtgccttatgaatatctgcgtactacaggtaaacccaaaggggcaatcttcggtttggtagcagaaggttttttcacttctcaagacgaaattacaaagagtcctgtaattgaaggatttaacaatattcagcctggtgatatcaagtacaaagatcagaataacgatggagttatcaatgactttgataaggtaatgattggtggcgataaaccactctcttattttggtattgatttaggtttcgaatggcgtggattagaattctcaatgttttggcaaggagtgtacaataaagatgttttaatgagtgattggaatttattggaaggttttcaaactcaaggacaagtttatggacaggcatatgagaatatgctggatcgatggactccagaaactgctgctactgcaactttcccgaggttgagtgctggtggtaataagtataatcaaggcaatggctggggctcttctttttggttacgttccggtaattatattcggttgaaaaatgttagtttaggatataacttacctgattcattctgtcgtaattatttgggtggagcacgtgtgaaagttttcgtaagtggacaaaacttattcacaaaagctgctaatgaactcgttgatcccgaagttagcttcggtaactatccgctacaacgttgcatcagcacaggtattaatgttaaattctaatatactatgatatctatgatacgaaataaatatttgacgctaatcggagttggattgttgtttacagctgtatcctgtaccgatgggtatgaaccagagccagttgaactggtatcaattgattttgtattttcaaaaaccgattctcttggtacgaatgcggtaaagtttatgaataatatttatgccacgttgcaaaacgggcacaatcgtgtaggaagtgattatttagatgctgcgtctgatgatgctatatctataaatgtttctgacccggatgtttataagttggcaatgggacggtatactgcgagtacacgtgttgaatcggatatgcgatggaaagagtattattcaggaatccgtaaggcaaacattctgattaatcatattgatgttgtcccttttatgctgacttataagaacgcaaagggagaaacaaaaccattgaatgttacaatgaaagcagaagcgcgtttcttgagggcttatttctatttcgaattagtgaaacgctatggtggtgttcctttgatgggggatgatgtacatatattgggtgatgatatggagatcccaagaaatacttttgagcaatgtgtacagtatatttgtgatgaattagatgatattaaagatgatttgcgtaccaatccaatgcctgattttgaacaatatgcacatactcctactcgtgaggcttgcttagctttaaagtctcgagtgctattatatgcagcgagtcctttatttaatgaacgtcctattgagattggtaatgaattgataggctatgcttcttatgatagagagcgttggaatgatgcggctaaagctgccaagacatttattgacgagtacggtccgaatggtaatggggcatatggtttaacacagtctacatctgatggcgataatcgggattttcgtgacgtctttttaggtttttataataagactaataatcctgaagtcatcttttatcgtccggggggtgaagataagtctatagaaagcaataatgggcctttaggattttctggtgacaatttaggtaaaggacgtacgcttccaactcaaaatttggtagacgctttccctatgaaggacggcatgtttgctggacaaggtagtaaatatactcttaatcagagtaatccatatgaaaaccgtgatccacgtttggattatacaatactgcatcatgggtcatcttggttgaataatacgcttgatatttcaatcggaggagttaataatccatctaactctgctgaatattctaagacgggctattatatgtgtaagtttatgggtaaatttggtgaagagtctcaatatgggaataaaatacatctttgggttatgtttcgttatgcagagatgttgttgaattatgcagaggcaatgaatgagtacctttcttctccttctcaggatgtgtacgatgctatcattgcattacgggcacgtgctggtattgaatcaggtaatgatgaatctccttatgggcttaagaaaaatatgacacaggcagagatgcgtgaagtgattcaaaacgaacggcgtattgaaatggcatttgaagaacaacgatattgggatattcgcagatggagaattgctgaagagatatttaagaatcctttggaaggtttggagattagggtaaaaggaaatactacgagtttcaatgaagtggatgtcctaagtacgacgtttgatgtgaaacgctatttatatccgatcccatataatgaggtagttaagaatgataacatgattcaaaatccgaagtggtaatattatgaaaagactattattaatattagtatgtataagcctttttatctcggcgttcggtcaatcgttcgttttgaagggaattgtctcttcagccgacggtgagttgttgccgggggtaaatgtaaaaatacaaggtacaacagtgggtacaattaccgatattgacggtaatttccaattaaatgtaaacaaaggtgctgtattggagttttcttatatcggttttaagaaacaaagcattaaagtaaatagtcagcaaatgctgaatgtagaattggctcctgatcaaacaaatttggatgaagtcgttgtcgttggttatggtaaggctaagcgtataacgttgacaggtgcagttagtggaatacaggcacgtgagattcgtaatgttccaactagtagtgtacagaatgctttgacaggaaagctgccgggtttttttagtcagcaacagtctggtcaaccaggtaaagatgcttcagacttctttatccgcggtgtcagttcattgaataatgatggtaataaaccgttgattatggtggatgacatgcagtatacttatgaacagttgtctcaaattaatgtcaacgaaattgaaagtatatcaatattgaaggatgcttctactacggccatctatggtatcaaaggtgctaatggtgtattagtagtaaagactcgtcgtggggagcaaggtaaaccgaaaattaatgtacgtttggaaactggtatgcaaaccccagttcgtacgcctaaatttctgaacgcttacgaatctttacaattagtaaaggaagcacatacgaatgatggtactttgtctgatttcccgtatactgaagacgatatgatcgctttcagagatcatactgatccttatgggcatcctgatgtcaattggtatgatgagatttttaagaaaatggcatttcaggagaacataaatgttgatgtctcaggtggttctaagaaattgagatattttgtttctgcgggatattttactcagaatggcttggtaaaagactttgggggtaattctggtgatggtgtgaatcctaattattcctatcgtcgtttcaattatcgcactaatcttgattttgatgtgactgataacttcaatatgcgtttggacgtttcttcacgcttcatggatatcaatgaaccgtacaatatgaatgtaacaggtgagctttatgatttctctaaaatgcacccttattcggctccacttttgaatccggatggttcatttgcttatttatatgatacgcaagatagaaaaccgacattgaacgcacggttggcaaatgaaggatataaacgtactagacgtaatgataataatattttgtatggtgcaacatggaagatggacttcttaacgccagggcttgcagctgattttcaattggcatattccagtagtgatgaaaattatcgtgcagtgatgcgtacacgatatccgacttatcattacgattctgcaacaggtttgtataatatcaatccgaatggagtctatgattatgagcagtattttgtatataacagtacagataaagctatcaaagatttgaatatcaaagcatctttgaaatatgctcatgttttcaataatgcacatgatgtaaatgttatgtttttgtacaatcgtcagagtacaacaaatgaaaaggatgcagctgttcccaataatttcgaaggttatacgatgcagctaggctataaatataaaaataaatatttggtagatttgaacatggcatataatgggaccgatcgttttggtaaagataacaatttcggattctttccagcattggctataggttatgctatctctcaagaagactttttcaagaatgtagattggttgggaaggaatgtgcagttattgaagtttagaacttcttatggtcttgtagggtcagatgtagcaagcggcgatcgttatctgtatcggcaagtatataaaacaggtgattcttatacttttggtgaaggtaacaactttggtgttagtggcatcaaagaaggtgatttaggaaatttaaatgtaacgtgggagaaagcgagaaagtttaatgttggtgtagatatgaatttgtttgataaattctccttgactttcgactggtttatagataaacgttatgatcagctagttaccagaaatgatattccggatatattaggtatcggcttgtctcctgaaaatgtagcagaaactaccaataaaggttttgatggacagattggttatcaagaccgttttggtaacttcaattttaataccaattttgtatttggttatgctaaaaatcgagtcgattataaagctgaggctcaacagaaatatgaatggttgagagaaacgggtagacagattgggcagccttttggctatcattggattggctattatacaccggaagatattgaaaagattaattctggtgctgcggacgctccggctaagcctgatattgctgtgcaggcaggtgacttaaagtatgcagatttgaatggtgatggtactatcaatgattttgataaacgtgctattggcaaaccgaacttgcctactacaacattaggatggacgattggaggaagttggaaagggtttagtatcagtgttttattccaaggatcgtttgattatagttttgctatcaatggaacagggattgagtctggtaagagtcagttccagccacttcaccaaaagcgttggacacaggaacgttatgaaaatggagaaagtattgagttcccacgtttgacaatgcaagatggtacaataaatagtgcttctgcttataattcggatttttggctgattaatgcatggtatattcgtttgaagactgttgacttgggctatcaacttcccaagacagcattacctaagttcttagacaatgtccgtttttatgtaaatgcttataacttactgacttttaccggttatgataaatatcagcaagaccctgaaattaagaccaatacagctggtgatgcttatatgaatcagcgtgttataaactttggagttcagttgggcttctagtaaataagtagggtttagataaaaagagaataatgtttgctataaaaacattattctcttttacttttttaagaagttagtttagtggttattgtatatttgttcgtcataaagtaaattgaaaaattgtatactataaaaaagtagttaatatgaataagaattttgtaatctctctattctttctattagggagtgctacactctctgcacaagtgaaattgcttccgatattttcggataatatggtgttacagcaacaaacgcaagcccctatatggggcgagtctaagcctaagaagaaagtagaaattacgacctcatgggatcagaaaaaatatactattcaggctgatgcacaagggaagtggagtacgaaagttgctaccccagtagcgggtggtccttataatattacaatttctgatggtaaaaaggtgaagctttctaatgtaatgattggtgaagtttggatatgttccggacaatccaacatggaaatgcaggtagaaggttggggtaaggtgaagaactatgaacaggagaaagaagaggcaaataattatcctaatattcgtttcttattggtagaaaatgcgatgagtcctacacctgttgagaatattacagtaaaagagaatggttggcaagtgtgtacatcaaagagtgtagcggacttttctgcagcaggttacttctttggacgtgatttgaataaataccgtaatgtgccaataggattgattgatacatcttggggaggaacaattatagaaacatggaccagtaatgaggcactatccactataccgagtatgaagaaaagactcgaagcattggtcggtttgcctgcatctcaggaaggacgcaagaaaaagtttgaagaagatgttgagacttggaaagctgaagttgaaagaattgacaaggggtgtgttaatggggaggctatatgggcagctcctgattttaacgatgcggcatggaaatctatgaaagttccaggtttgatgcaagaacaagatttaccaggatttagtgggcttgtttggtttaggaaaacaattgatattcctgctggttgggcaggaaaagatttgatcttgaatttaggtgttattgatgataatgattttacttatttcaatggtatacagataggacatacagaaggatggatggcacctagaagctataagattccgaaagaacttgtgaagaagggaaaagcggtgattgctgtacgtgtaatggatactggtggtactggtggtatcaatggaagtcctgaaagtatttcacttcatctttccgatacagaagctatccagttggctggtaattggaaatatcaggtttctttagatatgagagaggttgcaccaatgcctgttgatatgtcatggaatccgaattctcctactttcttatttaatgctatgcttaatccactgattccctatgctatcaaaggagccatttggtatcagggagaatcaaatgcgggagaggcttttcagtatcgtgatttaatgccgttgatgattactgattggagaaatcgctggggatatgattttcctttctatatggtgcagttagctagttttacagcgaaacaaacagctcctgttgaatctacttgggcggaattgagagaagctcaaactcggactttacatttgcaaaatacaggtatggctgtggcaattgatataggtgaggagtttgatattcatccgaagaacaagcaagaagtgggtagacgcttggcattagcggcccgggcgcagacttatggcgagaagattccttattccggtccgatatataaatcttataagattgaaggaaataaaattcgtatcttctttgatcatattgatggtggtctgaagacggcgaatggcgaaatgccgaaaggatttaccattgctggtgtagaccataaatttcattgggcagatgctgtgatcgaaggaaatacagttgttgtttcctcatctgaagttaccctcccggttgcagtacgttatgcatgggctgattatccgatatgcaatatgtataacggtgcggatctgccaatgtctcctttccgtactgatgattggaaaggtattacttatgtcaataaatagtaagtctttatttaattaatat

SEQ ID NO: 190 - DNA, 13657 bp, Bacteroides thetaiotaomicron
caaaacccacttgcgtgacctgttcgataagactaatttcaatgatgtcaaagatctaaataatccccttattccggggctatttgattaattgtttaactcgtcccattttaacgggacactaatgattgaattattataaatggttacgaaaaagaggacaatacaacattgtcctcttttttttttgttatatttgcgaccatatttagatttatatagtagaagttaaagaatgaaagaatttataatatccgaagccaaagtagaaaccgcagtacttgtcggactcattactcagatgcaggatgagcggaaaacgaacgagtatctggatgaattggctttccttgctgagacggctggggcggaggtagtgaaacgatttacacagaaattgccgacagccaattcggttacttatgtcggaaaaggaaaactggaagagatcagacaatatatacggacagaagaggaagaagaacgtgaagtgggaatggttatctttgatgatgaactttccgcgaaacaaatacgtaacattgaagccgaactgaaagtaaagatactagaccgtacttcattgatcctcgatatatttgcgatgcgtgcacagactgccaatgcgaaaacgcaggtagaactggctcagtacaaatacatgttaccacgtttgcaacgactctggactcacctggaacgtcagggtggtggctccggtagcggaagcggtaaaggaggttctgtgggacttcgcggaccgggtgaaacgcagctcgaaatggaccgccgtattatcctcaaccgtatgtcactgttgaaagaacgtctggcggaaatagacaaacagaaagccacacagcgcaagaaccgcggacgtatgatccgtgtcgcattggtcggctatacaaatgttggaaagtcgaccatcatgaacttgctggcaaagagcgaagtgtttgccgaaaacaagctgttcgctacgctcgatacaacagtacgcaaagtgatcatcgataacctgccatttcttctgtcggacacagtcggatttatccgtaagttgcccactgacctggtagactcattcaaatcgactttggatgaggtgcgtgaagccgatttactggtgcatgtagtagatatttctcaccccggatttgaagaacagatcgaagtggtgaacaagacacttgccgacattggcggcggtggcaaacccatgatacttatattcaataaaatagacgcctacacctacgtggagaaggcgccggacgaccttaccccccgaacaaaggaaaacttaacactcgaagaactgatgaagacgtggatggcaaagatggaggacaactgcctctttatttccgcccgcgaacgaatcaatatagacgaactgaaagatgtagtttatcagcgagtgaaagaattgcatgttcaaaagtacccctataacgattttctttatcagacttacgaagaggaagaataataatcaatgtaccgcttactgattgggggaggcggtacatatctatttttatctatatgaaagactatcgtaaattgactgaggacgaagtgcttcagttgaagagccagtcgtgtctggctgatgattggggaaatgttttggttgccgaggggtttaactgtgagtatgttcaccatacccgcttttcgggtgaagtgaagttaggcgtatttgatgccgaatttacactgcccggagggatcagaaaacattcgggactccgtcatgtaactctgcacaatgtggtagtaggggataactgctgcattgaaaacattcaaaactacattgctaattatgaaatcggaaatgataccttcattgaaaatgtggatatcattttggtagacgggctaagcacctttggtaatggggtggaagcgacagtgctcaatgaaacgggcggacgtgaagtgctgatcaatgataaactgtcggcacaccaggcgtacatacttgcattgtatcgtcaccgtccggaactgattaatcgcatgaaggcgattgccgattattattccaacaagcatgcttctgcggtaggtagtataggtgatcatgtgatgattctgaacacagggtctatcaagaatgtacggatcggtgattattgccatatctgcggtacttgccgtttgacaaacggtagcgtcaacagtaatgtgacagcgccagtgcatatcgggcatggagtaatatgtgatgatttcattatctcttccggttccgaagtagatgacggaacgatgctgacccgttgttttgtcggtcagtcttgcaaactgggacataactattcagcctccgattccttgtttttcagtaactgccagggagagaacggggaggcatgcgccatctttgcgggacctttcacggtgactcaccacaaatcgactttattgattgccggtatgttctcgtttatgaatgcgggatcgggatcgaatcagagcaaccatatgtataaactggggcctatccatcagggaaccatggaaagaggagccaaaacgacctccgactcctatatcttatggccggcacgtgtcggagccttttctctggtaatgggacgccacgttaatcatgccgatacctccaatcttcctttctcttatctgatcgagcaacggaacacgacttatctggttccgggagtgaatctgagaagtgtgggtaccattcgcgatgctcagaagtggccgaaacgtgacaaacggaaagacccgaaccgattggattatatcaattacaatcttctgagtccatacaccattcagaaaatgttcaagggacgttctattctgaaagagcttaggcgggtatccggcgaaacatctgaaatctattcctatcagagcgcaaagatcaagaactcctctttaaataatggtatccgtttttatgagatcgctattcataagtttttgggtaactccatcataaaacgcctggaaggcattaatttccaaagtaacgaagaaatacgccagcgtctgaaaccggacacggaaatcggtaccggcgaatgggtggatatgtccggactgatcgctcctaagagtgaaatagaccgtctgctcgatggcatcgaaaacggttctgtcaaccggttgaagtccatcaacgccagctttgcggaaatgcatgagaattattatacgtatgagtggacctgggcttacaacaagattcaggagttttacggcttgaatccggacgaaataacggcacaagacataatccgtatcgtaaaagcgtggaaagaggcggtagtcggccttgataaaatggtatatgatgatgcccgcaaagagttctcgctgtcttcgatgacaggattcggagccgacggttctcacgatgaaatgaagcaggactttgaacaagtacgtggtgattttgaaagtaacacgtttgtgacggctgtcttgaagcatattgaggacaaaactgcgcttggcaatgaattgatcaaaagaatcgggtccattcaagagtaaaatttaaagccggcttattggctagttgcctcattaacagtagttattgtgatataaagttctcagaccattctcatatcgatgagaaaaaattctcaccacaatgagaaaattttctcatcgcagtgagaaaaaatactcataggcatgagaaaaagttctcactgcaatgagaataaattcttgttgcggtgggcatagttcctttctgcgttattcattcttaattcttcattcttccgttatcattctttatttttaattactacctttgcctcactaactaacattacgtaataaaataagaaattatggcaacacctccgtttaagtatcaacccatgtttgaaaagggaaaagataccactgagtattatctgcttacaaaagactatgtatcggtaagcgagtttgaaggaaatcctatcctgaaaattgagaaagaaggcttgactgcgatggcaaatgcagcttttcgtgatgtgtcattcatgcttcgccgttcgcacaatgaacaggttgctaagattctgagtgatccggaagccagcgagaacgataagtacgtagcactgactttcctgcgtaatgcggaagtggctgccaaaggtgtacttccattctgtcaggataccggtactgctattatccacggtgaaaagggacagcaagtgtggaccggctataccgacgaggaagctctgtcactgggtgtttacaaaacatataccgaagaaaacctgcgttactctcagaatgcgcctctgaatatgtatgatgaggtaaatacaaaatgtaacctgcctgcacagattgacatcgaagctaccgaagggatggaatatgaattcctctgcgtaacgaaaggtggtggttctgccaacaaaacatatctgtatcaggaaacaaaagcaattttgaaccccggtacactggttccgttcctggtggaaaaaatgaagactctgggaactgccgcttgtcctccttatcatatcgcttttgtgatcggcggtacttctgctgagaagaacctgctgacagtgaaactggcgtctactcacttctacgataatctgccgactacgggaaatgaatttggccgtgctttccgtgatatcgaactggaaaaacaagtactggaagaagctcacaagatcggtctgggtgcacaattcggcggtaaatatctggcacatgatgttcgtatcattcgtctgcctcgtcacggtgcttcttgtccggtaggtctgggcgtgtcttgttctgccgaccgtaacatcaaatgtaaaatcaataaagatggtatctggattgagaaactggattcaaatccgggtagcctgattccggcagaattgcgtcaggccggtgaaggtgatgtagtgaagattgatctgaaccgtccgatggctgagattctgaaagaactgaccaaatatcctgtatctactcgtctgtcactgaacggtactatcatcgttggccgtgatatcgctcacgctaaactgaaagaacgtctggatcgtggagaagatttgcctcagtatatcaaggatcatcctatttactatgctggtccggccaagactccggctggtatggcttgcggttcaatgggcccgacaactgccggacgtatggactcgtatgttgagctgttccagagccacggtggcagcatggttatgttggcgaaaggtaaccgtagccagcaggttacagatgcttgtcagaaatatggcggcttctatctgggttctatcggcggaccggctgcaatccttgctcagaacaacatcaagagcattgagtgcgtagaatatccggaactgggcatggaagcaatctggaaaattgaagtggaagatttcccggcatttattctggtagatgacaaaggaaatgacttcttcaaacagattaaaccacgttgtgccaaataacaaataacaagtaataagtaacaagtaataagtaatggcaagttattcttgcggttgattacataaacattcatttgggatacctgtcagttttcgtatgggtatccctttttttataaacttgcttatctaataattaaaacaccatgaaaccacctgtgatgaatttatccaatcaaaagaaccagcatattgtctggctggatgtcgttcgttttattgcgatgtttacagttgtctgctgtcattgcaccgatccgtttaatttttatcccggcacggctccgaatatcggagaaataaaactttggggtgctatctacggatctgtactgcgtccgtgtgtgcctctgtttgtgatgattaccggtgcattgcttctgcctgtaagaggtgatgcttctactttttacaagaaacgtattccccgcgtcttttatccgttcctgatatggtcggtgctctataatctgttcccttggattacaggcctgttgggactgaatcctcagattattcttgatttcttcccgtatgcgggagaggaagtgatgcggcagtcattctctgtatctttggaatatattttgatgattccgttcaacttctccatcttagccgtgcatatgtggtatatttatctgctaatcgggctgtatctgtatttgccggttttctcagcttgggtagagaaggcttcggaacgtgccaaactgatgttcctgctggcttggggggtaactttgctgcttccttattattatcagtttgtttctaattatttatggggaacctgttcatggaactcttttggaatgctgtatgcttttgccggtttcaatggctatctgttgttgggacattatctgaagaatctggaatggagcttgaaaaaaacgttgacgattggcattccgatgtttgcagtcggttatgcggtgacattcttaggtttcagacatataaccgcattgccggaatatacggatgagatgctggaactcttctttacgtattgttctcttaatgttgtaatgatgacgatacctgtgtttatgttggcaaagaaagtgaaagtgaactcggaaaggatgaaaaaggcattggcgaatctcactgtatgcggattcggtatttatatgatacattatttctttacagggccgtcggtcgtgctgatgagagctattgatatgccgattggtttgcagatacctgtagccgctattcttgctttcgctgtttcatggggattggtatggctgatctatcgtgcgggaaaggttgctaaatatatagtaggatagtcatagaaaatagaaataggtaagaggttatcaaaagtcaatagtaactaaactccttcaggaaggaggagagtttagttactattgacttttgacatcccctcttatcgcatcctccggtattatttcctatttaattcctttttccatttctcatattttgccagtactttgttgccgtctttattgtaccagctatatccgttccggcgttcatgtccgatttctgagatatcgtattttttaattccgtcgcggtcggagaagaaaggacgattggtgtccagttcataaaaacgtgcccatagtacggggcaatcctcgcaagggatcatccgataatctctttttccgtcactgttggtgaagtattctttttgtactccttttatttcggacttcttgaaccatttgacggctgattctatcgattcaattactttttccgatggatgggggagagacatcagcagaagcacgatattgtcagattcttgtccgctcaatgaaggcaactcatatgcacgtgccttgcagggctccagtgtgatgcggtcatgctgtgcacaccatactgtcagttccccgttttggcgaacctgtgtccggaggatacattctattcctttgtcaaaggctttacgtgcttgctggcaggtttcatcggggatgaaggtataaggggactgcttctcgtagatttcccgtaactgctgcatgactctgaccattgcgttgtcattgtatgtgatttggacatagtatcctgtaggacgcggatagaactgaggccatccaccgttgtcatattgtgctttgagcagatattggatacctttcagtactccttctttgtatttctctttttgtgtagcttgataaagacgggccagatattggatttcagttgtcgtggcattgttgtcaatggtactttggttgacgtcttctttcgcattccttgctttggcatattcctgctcagtcagttctgccggcatatagatgtttttgggccagcctccggtgacttgctggtatagcaatacattgtctccaatgcgttgtgcttcttctgtccggaaaaaggcatcatcgaacttgggagcgaggtgtacccattctttgtaattctgttgtttcctgtaatctgttgcttgggctgaaattccagtctgaatgaaaagtaacagaaagaaaaaggctgtttgtctcatgacttctattgttaagtgaatgttatggtgcgtgcaaatgtagaagaaaaggtcgggaatgaagggtaatatctgttctttatggcataaaaattgggctaatcgcttttatcagatgattagcccaatgaaaacaggagaataaaagtcttattgctccagatatttggtgatttttccgctgatttgcagtagtgatatctcgcaaagtttggtgttgtattctgccgagagaatacgttcttcggcatccagcagactcttttgtgcctcgcgtacttcaaaaccggaaaggtctccctgtatataacggtccatggcgatatcatgattgtctttggcggtcacaagattctgccgttccagattcagcagctgaagattgttacggtatgcttgccacaagttgctgagatcggaacgaagggctaactccagttcctgtcgttccagacgacgattcttgaaggcaagggttgcgttgcgcttttcacggcggcggttgccgtcgaagatattaaaaccgacagtaaccccggcattaaagcctaagttgcctcttctgctgtttgcattgatatcgtatttattaaaggtatatccatagccggtattcagtttgaggtatgggtagttgcgggagttgatctttttgtaatccagctgtgccagtacagtgttctggtcggctttcagcaaagaagcattggtggataaggtagcattccataaatcgtcgaacagtaagtcactgtgtacgtcaatggtagaatctttgatgacgataatctgatttacattattgttggccatcaattcattaagttggatgcgcgaggagtgcagcaattcctgttgcttgatgtattgggcgctgtccgcattgaagtccactttggcttgctgataatccagacccgagaatttaccgacaagatggcttgcttctgctatacgcaggcgttctttggaaagtgacatcgcataatgaaagttcttcagacggatcttttgttggatgaagttgtagtattccgaggcaagatcggcgatgaagtcttcaatggcaatgcgggtgttggtttcgccctgccgttccagttcttttagctgcttgtacgtagtgctgatgttgaatccgtcgaagatggtccagttgaggttgaggccgacgttaactgtctggtcgtagactccattatttttggtgacctctccggtggcacgggctttcgtctcgatattgtccaggtttccggtatatccggcagaaaagtccagggtaggcagataacccgcatttccgagtgtcgcgttattcttgctgatctgttcttcgttatggacgatgcgcagagaataattgttttgcagcccttcttccaggcagtctcttaaggaatagattcgctgtgccttcgcagtagaaactgatacgaagacacatgcggtaactatatatatgattcgtttcatgcaaatacctttctgtttcattcttttgttattttgattcggttagtcgaaatataactgtagatggccggcacaatatacatcgtaagcagtgtggaaacaaccataccacctactacagccgtacccatggcgatacgctgattggcgccttctccgctggcaaatgccaatggaataagtcccagtacagtagaagcgcttgtcattaaaatcgggcgcagacgctgtaatgcggcatctttgatggcactcatcttatcctcgcctgcttcttgtttctgattggcgaattccacgatcaggataccgtttttagccacgagaccaatcagcatgataataccgatctgactgaaaatattcattgtgatatctccgaaatacatgaataccaaggctccggcaatagccaaaggcactgttaacatgataattaacgggtccttgaaactttcaaactgtgctgccaggatcagataaatcagaaggatagccagtataaaagcaaacatcaggctcgaagaactttcacggtattccttggagtctccggataatgcggtacggaaagtatcgtccaatgtttccttggcaatcttatccatttcatccagtccttgtccgatggtctttccgtcagccagtccggcggaaattgtggctgatacaaatcggttgtaacggtacagtttgggaggggcgataccgttttccagttcaatcagattgtccagctgtatcatatctccattgctgctacggatatagatagctttcagatcggcaggcttgtttcgttgctggcggttgatttcacctaaaatttcatactgctttccgttcatatagaaatatcccatacgctggccgctcaatccgtattgcagcgtttgggcgatatttttagtactgactcccattacgctcgctttgtcacggttgattctgatacgggcttccggtttactgaacttcaagtctacgtctgccatctggaaaaccggattctcatatactttggccatgaactgcggtaatacctcctgcagcttttccagattggtagcctggagtacgtattgaacaggcatacttccccggcgtccgccgaaagaagactgctgttgtacgaacgagcgtgccatggtctttttctgtacggcctttgatatcttttccgcaacttccatctgcgtgtagtcacggtctttcatgtctttcagtgtaatgcgtacgtttccgctaccactggatacacgtgctgttaccgcttccgcatccggtagaatagaatctacaagctggttgatatcttcggtatagtcacggatatattcataagtgacaccttctgcacctcgggtgttgatagagatttgcgaccggtcttcaagtggagccatttctgccggaatagcattccataagaaaccgatcaggcagatggttataaaagtgaacggaagtgctagccagcgcttacgcaaaaaagcagcgagcgaacggctgtaccatcggttcatcccttcaaaaaacggttccgtcttagtgtagaaccagttttgtttttcacgtttgatgagtaacttcgtggccagcatcggagtgaaagtcagtgccgcaaatgaagagataatgacagaacccgaaattacaatactgaattcccggaacaaacgtcctgtcataccttgcatgaagacaatcgggaagaatactgcaaccagtgtgatggtcgttgaaataacggcaaagaagatctctttggctccttctattcccgcttctttcggactcattcctttttcgatacggatatagatgttctccgtcattacgatggcgtcatccaccaccagtcccacggccagcacaatggcaagcatggaaagtacgttaatggagaatccggcaagatacatgacgaagaatgctccaatcagcgatacgggaattacgatgcacggaaccagcgtcacccgccagtcgcgtaagaaaaggaagatgatgatgataaccagaataaaggctacatatacagtctcttttacctcattgatagatgcccggataaatttggtattatcaaaaccatagctatacgtcacatcttccggcaggtccttcttcatctgttccatgcgtttgtacacagcatcggcaatttcgatgtgattggctcccggctgtggaataacaacaacacctaccatgggtacaccgttcattttcatgtaactcttgatgtcggcaggaccaagttctgcacgtccgatgtcactgaaacggacgatacggttgttatcttcttttacaataagattattgaactcatcggcagtatgcattaatcccaatgtacggattgtcagttcggtagtgtttccttcaatactacccgaaggaagttcgacattctcattgtctaccgcattctttacatcaatcggagtgatgccatatcctgccatcttgaccggatcgagccaaaggcgcatggaataacgcttttcaccccaaatagatacactacttacatcagagatggtctgtaactgctctttgacagtcaagtctgcaatctcacttaattcaagcagtgagcgtttgtcgctttggagggcaaccattaaaataggcatcgcatcggcatcggcttttgatacagtcggcgggtcacagtcccggggcagataacgttgggcacgggaaactttgtcacgtacgtcatttgctgcagtttccagatcgactgaaagttcaaattctaccgtaatacggctttgtccctgctggctgacgctggatagagaccggatgcccgggataccattgatattttgttccagtggctcggttatctggttctcaatgacgtcggcattggctcccggataagaacaactgacagaaatgatcgggttgtccaccgatggatattcacggacacccagataactgtatccgataaatccaaaaaggagaataatgattgtcagtaccgtagctaataccggacggcgtatacttaattcagatatattcataaggcatggcaggtattagtcaatattatccaatgtaacaggaagtcccaggcgaagttgcagtgttcctgatgtaagaatggtatctcctacttgaagtcctcttacaatttgtacttcagcatctgtacgaatgcctgttgtcacttctacaggttcggcttttcctgatttatacaagaaaactttatcctttcccatctccggtacgatagcttccgtcggaatggcaatcgcattcgggatttcttctttctttaattggatacttgtatatcggccgggaagtaaggcgcgattggtatttggataaagtgcgcgtgctgtaaattgatgcaggttgggatcaatcgttgattctacagcatatacttttgcgctgaaggcatctagttttccttcaattctaaaattcaggttcgtacctttcttaatctggcttgcatagcgttccggtactgaaaattctactttcagcggagtaatctttgtcagtttggcaacgatagttgtcggcgaagcgtatgaaccgacactgatttgccgaagtccgatgattccgtcaaatggagcacggagctcggttagggcaatgttcgcttttactatttctatatcagcatttagagttgccaggtcagtctttacttgttcataagcttctttactgactgcatctcgtttaagcagagcatcttgtcggaatacacggtcctcagctaactttagttgtgaaaccaaccgttgaagttgtgcttgtagctggcggtcgttgactttggcaagaagttgtcctttttttacgggagttccttcttcgaagttgatctctattactttcccggaagtctcaaaagacaaatcaacttcttcatccggcagaagtacgccggtagtagtgtattcgtctgttaacagttgaggctttattactttggcgttgacgttcagaatcttttttccattcttttgggtattttttaccttgtcagcagcagccagttcgtcgttagtttttggtaactgtgagtaaattcccccaccgataattccggcaccgataagaataatgatgccccatttagtttttttattcatggtttagtatagtatatagc

SEQ ID NO: 191 - DNA, 13544 bp, Bacteroides thetaiotaomicron
accgagatgtacggctgaaacgtattatttatatatgttattgcatttatgttagtagcttataggccaatacactgcataacgttcaaaatgtactttataaaacggttctacaactacattatcaaattccttcaaatctattttaaattttaatgtatctgtagaaattgatttcacataagcaggaatctgcttaagtggcatcctaaataccggaatcttgttcaaatcgatcttattcattgccgtattgttcatctttccccaaaaagtagtaggcaaattctcagttcccatgcgcccggcaagtacgtatggaccatatagtaatgcagcataacggtcagaacccatcaaactttcgacatatacatgcatcggaagttgcaatatgattttattctttcgtgcccaagttctgttaaccacccaatatccatccttatcaaggataggatattctacttttccattaataatgaaagttactttatccgcccaatccggtttacgaatacgaagtatcaattcttgctttttctttaaattcagcataaagctcacttgctccgattcagggagtcggttttgctgaataagttctattcctttttctttccagaaaagaatagaaggtataaacaaattgactctaatatcaggatctccatcaataattctctttgaatgactataaataaacttgctaagttttgccggactctccagaccagtatgtccacagcaccaaaaagaactgtcacgtgaagcataaattctataatgccccggacgcatagaggtgaaatagcaacacatgcccttttctggatcgtaggctgacaaaatatgattaaacaatacccgctcataataacttgctttggctgcatcaggatactgacagaaaagagattcagtcaaacgtagcatattcactgagttacaagtttccggacctcctaccaaaagtacccgatcagcgaactcctctttcggaaaaaaatgttccccagtactgtttccccctattacccatgtatgattctgagttacaatattccaaaaattagttgctgctgtcaggaaacgttcatcacccgtaaactgataatacttatgaaatcctgtaaactttggaatctgcgtgttagcatgccatccaaaaagaatatccttcccctcagacagaggaccccacatcgcatggtcgttcaaccgacgcgcccaatcaagaaaacgcttctctccggttagttcataagcctccacataagattcattgatagagccatgttcgcagataagcaaccgctgaatctgatcatctgtcagtttgtccaacacttgatatccaaaccaatcagccaatcggattaatataggtaatgcctcttccatttgacattgcgtataggcagcagaaagcccaagaagcattttattaatcagataaaccggagcccatgcaccgtttactgtaggattatttgtttttatctttccagaagcaacttcagcaaatagctttctaccatctttgagccctagtaagaaaccatccttccctgctttttggcatagttcaagctctttcagtacatactttaaacgttttaataaccttttatcatcggttgactgatacatcatagatacagaagaaagatagaatcctaagaaacctccgcgcaaaggtccggcaccccatacatcttgtgattcccaacctgcatagggtgcagcttttgaaggtaatcctgcctctattcgataaaaatgcaataatgaatcaggattcaaccatagaagatattcctttccttttcgttgtaaatcaagaaaaggactgtccagcaaacgtacttctcttaatggaaaataagattcaaaagtgacatctgcaggtttactccctccatatgacgcagatacaacaggctcaaatgatccaataagcaataataagctcaaaagaacttttatagatgtctttgtcaatacacctttgcgcataaatatatcaattattttaattctatcttctttgcaaaaactaatcggacagggcctatcaaacccgattccagcaaaggtgaatctttccgataatgtttccaggtagtgaatgctactcttccccctttcggcttattcacaccattcttataccaatccggtaattttttgatagcaccacgactcaatgcggcaataccatttataccacctccaagtacatattcattctcttccggtagttgttcatcaccaatcaaacgattagtccactgattggttacttttatttccaatgtatttttgcccggctttaatacatcagtaacatcaatcgaatacggacgagcccacaaaatccctttattcactccattgacaatcacttctgccatcacctctaccgctcccaaatcaagaaagacaactttttcatcagacaatatagaagcctttataacaaagtccgtcatataggtagctgtacctgagaaatacttaactccttcgtcttcgtgtttatgcagagaaaatagtttaggcagagtaatcttctctggtgccccacaaccatcaggaaaagtaatctcccatttctgattgagcattacgggagttccaactttttcaacctttattttcttctttacaccatccgatgttataaaatcatagtttccatcatgccaagccagcagaaaacgattatctgcgtaaggcacccaattcaaggctcgttcatctgccttttttacatatccttcagctgccaaacgggaaatttccttgttcgataacactctctgaaataataccggaacagacatatctccattataataagaggctccttctttcaaagtagtaggattcaaccccggatgaattgtctgcagagatctcgttttataagttacatactcaccatttatataaatatgcggagcaccctctttatataccaagcaaatatggctccacccggaaatcggcttctctactgccatcttaaactcagggtatccttttgcattctcccacacagcaactccgtttctacctatagccattccacaagtagcatgtcctgtgccatatagcaattccccatgcgacggatagatagcataatattctgtccagggatatgatatatatcccattggattatccgtattcaacatagcatccgattccggttttacccataatgatatcgagaaatcatcttttacaccaaaatatttagcctgttcctgctcttcgacagaaacaactgaagcatccaccagacactcactatctttataaatagaacgaatagctgtctgttcaggaagatctgaacgaaatacaacaaaaacagaaccgtattcatccaactggataggaacagaggtcattccttcatttttctgatataccaaagcacgtgacctttcgcctgttagaggattccagaattccggaacttttccttctacacgaaagttacaaattatgtcttccggagtccgtctctgattagttacaaagtagacatccgtatctcctatttgtctatgaatataccgtatcggagcactattcggattatctccaacttcaaagtctggttttaactgaatctgcctgaatacctgattcaaattcaaagagatttcccaaaatactctaccttttccaatattacggtctatcattgtagccatattctttccccataattcatcacaaagctgttcgaattctttttcctctgtaatagaataagactgcaatcccacagtctgatgaggacgggcaccaacaataaccaagccctgctctaccatctcccgaagtttcctcaacaaacccaatgtaatatacgactgttcttgtagaacaagaatgcggtaactcatcccatccggaagtcttaaccgtccctgttctatccatgctctattcagcagggtttccgtattcatcagatcatagtcatatccttccggtggcaccgggttcaattcattacggtgtactttagtatagcccacaacattatcccccgtaaagtatgccagatcagcaacaaataagccttcttgcaagagagtttgacaacgattcagataatccatccaagcgcgcgccggttcccaccaagtgttcgtccggtcgaagtgtattccccaaggtcctaaagtcatagcaggaacagcatttgaatgaggctgcatcgcgtaacgatgaactaccatccggttaattccctctgtaaacgccttatcaccaacagccttcaatgcaaacggatattcctgccatcgccccgattccggttcagaagtatatgcctcggcacctactactttctgtccattgatatgggcaatagaagatgccaatttagcggtacgacgcatcatcaaattgttttggaaaatagcggatagcccattccaaaactctcccatcactccatccactcgcgaacctatctgtaattcttccatcggtccgcgatcataaggctcacaatacgataccaaaccatattgattacataaactcctgaactcaccataatagttatcagccagtaaatcagcctgtatacgacgaatatcccataaaaagcgttctgttatctctttacttcctacaattttaccagtcatagccggcaaatatctaatcaaatcgtatccggttctctcacagaattcatcctcaaatcccgatgtccagttctgcataccgacctcccaactatctatttccaaaccgatctgaatttgatgaacatatggtttgattaatggatataacaggtccatcatcttattaaaatgaagttgaatagcctgcttactaaatttatcacattcaagtcccacacctgtatccggagccgcacaattctttcttcccgtagaagtatgtcccatacgaatgatcgtccaatttcccgaaggtgcttcccaactcaaacatccgtttgaatcaacctgtttagttaaatcaatcacatcctccggatgaataacttgttctttatcatactcccgtatatcaatcagacctttatgattgaaaacactattatttagtaattgccaatcagaaaaacctattggctttccattcctaaaagaaggaaaagccaatatagcaacatctttataatatcctaactccatagcaggctgaggcaacaaagtatctatctgctctcctcccaccacttctatctcactccaagttaatttctgcattgaatattcaggagtaatccaaggtcctccactcgatgaccatcccggacaattatgcatcacataatcgatccccaaacgagcagcttcttttacggcatgtgcttttaactctgaccattccgaactcaaataagtaacagcccccttcggaatacctgtgcctccttctaaattaaagacacctcctactccgatacgatgcatagcctctaagtctttggtaataccttcctttgttatatttccattcatccagaaccaatatgtataaggacgggcagtcgaagaaagctcagtaaagtctttttcaagatcaaccattgatttagctttcactaaatgagtagtccccgaaggtaaaggtagtttctcgcctaccgagacaggtttaccgaaacaaggaacaccagatgcatcaaaagtgaacttctgtagacggatatcacgtttccaaccaggtgttttctctcttttcgaatgataacagatataatattccctatcatcaggtgaagttgtaaagctagcatgtccaactccaagcacttgattagttccctcaaatgccggcttctcactcttaatccaactctctgggtctaagaggtctgcatccgaatctttcagacgcaaataagatagtttatatgtatccagccacgactgaccacacgaataaacaataaatacatctttctcatgcttcaatatttgcggtccctcattcaatggcagttctccctgttcataataacgatccggtgaagatattttcactcttccggaggccatagtccagggatttagcattttggctatgtaaaggtgttgctgagttttgtcagttaattcattaccttcccaaccagaccagactgcatatagttgtcctttatgatccaacaaagtcatatcaatcgcccatcgattattttcccaatcccctagagcatcacctgtaaacagcattcctttatcaacatacttccccattgcatctgatgtaacggattccaacacacctgctttctgatgaatgaaaggaggaccactatatcctgcggcataatagatataccatttacctttccaaaaatgaagttcaggcgcccaaacacaagttgagttccattgtcctttctctggtaccttccatacacgcactggaggatttatcttatgaagatcacgcgaacgagatactcctataccacccgggaccccactacaataataataccatccttcatgctttatcacccagggatcagcacccgaagataggatcggatttgtataatcaccatcatgttcttgtccatagaccatcgtcgaacagataatcattattatccaaaaagataatctttgtatcatttaaaataagattttcaattcagcttttcttttaaaatatctcttttatagcgcactaaagcctcaacataataataatcggcataggttaatggtacatcaacttctgccttacctggattattacctacagaatgctttaggataaaattgcaatttgtgccaggctccgccaaatattccggcgaagaaagggttttcaactgtgtttctgcaacagagagacattgcttcgaaaaatccccttctgtatacagactgagttcaataaaagcagaagccatcaatgcaccagcagaggcatcgcgaagttcattaggtatattaggagcatcaaaatcccaatatggaatcttatcttcaggcaaacggggatgatttattatgaatttagcaacattgatggcatgccgcaaatacttctcctgccctgtttcacgatacatcatagtatagccatacaatgcccaaccttgcccacgcgcccaacatgactcatgtgcatatccctgacaagtattcttcttttccggtaaaccggaaatagtatcataagaaattacatgatatgagctataatctgatcggaaatgatatttcatcgtcacatccgcatgtgacttagctatttcctcaaatttaggatcatcagagttcttggaagcccacattaacatctccagattcatcaaattatcaataattaccggatactcccacaccttctgattccagtcccaagaacgaatgcaacccacctgtggacgaaaacgggtactcaacgattcagacccctgcaataatgtctttctataatcatcattacctgtcaagcgtaatccattaccaaagctacaatacaacataaatcccacatcatgattatcagtagtatatttctggttttctatccgttttgtatagttctcagcatacattttcaaagaatcattgccattcacctcgtacagataccataatacaccgggaaaaaagccacttgtccaccaattggattttgatgtcatcaacttaccatccttgccgattgtacgaggtagttttccttcttcattcaataaatcctcagccataagctttgactgtacagttgccgtttgtaaactgttattcacgagagtactcatttcgcttttcggagttgaacaactacaaactgtcaaaagcaaaagagatgcaatgatagatgaacttactttcatttatatattcttttaaattatttctataattgagatttccggatcttaatctgagcctcaagtttatctctttctctactcaaatatgggcaatgcaccttgttttcattctccgatgcatccaattggcgatcaaatatcatccgggctacaaccgaatctccttgcagccatatagtgctactatattgctccgaaacaatattatacccacctttccactgaataaaggcgtattgttttgtctttttcccactgtcttgcaaaataggcacaaaactctttccctgtaattggtccttaggcattggcactccacacaactcgcacaaagttggataaatatcgacaaattctacaattccttttgctttgccacctctacaatgaggaacacgaacaatcaacggagcacgagttgcatgattcattagattatgttttccccagaatccatgttcccctaaatgccaaccatggtcacctaatattaccactattgtgttctcagacagtcccaaacgatcaagttcgtcaagtatcagaccaatctgtgcatcaatataactcacacatgcataatagccatgcttagcttctcgctggaaagtctcatctttagttgtaacaaatttcccatacccacgaatttcaccggaagaagtaacctgtttaggtaaagctttcggtctataaggattttgggcgaggtgtatttcttctcgccgatataaatcccagtattttttgggagcattgaaaggcaaatgcggtttccaaaaaccgcatgcaagaaaaaacggtttttcctttttatgcaaacgccttaaatccgcaattgtcttttgcgccactctaccgtctatgtaagttgtatcagcaacatcagccgactcacagaaaggacctcgtaaagttttaggatgaacataacgggaagactcttcattctgccataattcccacttgttatattcagcccaatccttaccatatccatcaggatgcactctccatggagcttccgaccaactatcagcatgatccgttatattatgaaatacttttccattagaaacgacataatatccgttcttcttaaagcattccggaagtgaaagagcctccggacaatctttctccgcactggcatcaaacgcagtaaaacgattcgggtaacgaggatacattcctgtaaacagacttgccctggaagccccgcttacaggaatgttacaatatgcattctgaaagaccgtagcataccttgccaagctatccagacggggagtcacaatatcttctattccataacatcccaattcaggacgcatatcatcggcaataataagcaaaacattcatcttattattctgtccatggagatgaacagaagacgacaaaacaatcacacttacaaaacaaaaagattgagtgtatttcatagccacatcctccagaatactaaaactatatcatttaaagtttaccccttcgaaagagaatttatttttaacatcattcttatattccttcagatagggagaataagtttttactctgacttgctgtttcttcacgtctatatccacaatacgcaagaaaccggtttgccctctgttcgtccctttcactccatcttgaaaattggctaacatctgaaacactttattaccatgatcacctatactgactaaggtcccaacaccgctattcagtacatgcccactgaatacaaaaagaatattaggatatttactaaccaacttatcccacatttgctcaccgttattcaccgcattttcaccggtatctttgcctaaaccgtatttctgcggcagccaacgatcgccttctcccatacgtgtatcatccgagtacatatatgcatgcgtattgataatcaccttatgatgcggatgtttcttcacaatctcacctgcccagtcaagcacactagtacgaggtccaaattccaaacaaagaatcagccatttcaatccggcagccttgaaagtataccacacattatccattttcccttcttcaaatgcaccaccgaaatttctcgtcttactgtatttatcataaggaaaatatcgattgaagagttccgaatctcttttattcgaatttttacctaaatcgtgatttcccattacaaaagcataaggaacttggttgtccatagtattcaaagcggcagctgcaacctcccactccttatcgacattgtgatcagtcatgtccccctgttgcaaaacaaagtcaatactatctgcatgatctattgcccattgagtttgcgattttaaaatatcgggataaagccgtgaataagtttgtatatccggcaacaaaaccagtctgacctgtttttgtgttttacaacccgagaaaataaaaactgccgtagtcaataaagctatccatttcatttgatttttcatctgtttctactctttattcaactttctcagaagtttatttagttacatctactttcttttcaatacttccctaagatttaatcctagtttttaatagaaccgtccttctttatatctcggctcccactccatattttgactgaggaccattcttcaggtttggccgtccaaaactcatcatccgcttgcaaacctaaaggtagaaaaataaacgtacacagataattactgcctgtggatacatatctatcggctatctccggttgatgtccacagaatcccaagttcaaccatccgtctttatcaaatgttcccttaattaactgtcttttcatcaccttagtcaatgcacagcgtacctgtgctggtttgatatgttccggtaataatttcatccaggaaacttgagctaatacctgaaaagccccaaaacgatatcccatcgacctgcccaacacaggataagtaccttccggagagatcatcttttcttgttgatcggcataacggatcaatcgttgtaactgtacatcataaaaatcggctccttcaacttcatgcttcttcataactgacaatacatctatcaacataggctggatcacataactattataataatccagatggaagttgcgtccgtcaccataccagccatctcctttgtaccattctttatgtctttttaatgcataatgaatcgggttcaattcacattcacctgtaaattccaatagagcagcctcaattgtagcagaaaacatcaaccagttagattctgaggctttgattctacgggaagctttcagttctttgataattctctcctgagtcactttatccaacttcggccagatctgatccttcgaacgtaataacccctgtgcaaaaaaagccgcatctaccaatggttgtccaccaggtccatcaaaacgcatataatccgaagaatccggattcacagcattggatatagatttcaccaccaggtcagtatatttagcacggagttgtccttcttttgtgccatcaggaggtaagtttaaccaagcagaaatgccattaaaggaacgccctaaagcttccaaatgtgttacattctttctagtattgccattattcaatccatcaaaggtttcaacaggcatgttctttctcagagtattctgactcaagtttgtataaaaaggatcaatgattttaatcattgtcttcacccagtattcacggtccttgcccggttttgcctgagcaaaaccggtaaacaataactggaccaaatataataatattactactttacgcattctttctatcctctttatttaatttcaaattcatccgattcactatagaaataatcgatagcagtttcttccggcaaataaacagaacgataaataatacgatcgcctgcaaaatcatctatcttaatctgcgtctcgggtgctttcagaatcaccgttttatcccctccatcaatgctcgtataagtaatttcggaaccaaagaaagtcggttcaagcgaagctgcaaaagtaatggtcaacacatcgttttttaaaactgccgtctttacttttgtattaaacaacaacttctcataaacatcaccatatacagtacaaggaacttctgacataatagaagaattaccatgagtatcatatgtgcaaacttcaaatacatacgaaccttccgccaaatccttcactataacctgtgttagaccagccttatcagttaattgtaattcagtggacctcgttctgttttcccagaagattttagctgttttagcacgtggatcaagcaacttctgccactcaagcatagctcggttacgtccggcatacgctttcaacgaatccacttttcctatataaacaataggtccttcttcaataaactctttatatgttgcatccatgccatcacaagacgccaaagtacctataaataaaaatacaagagcaaaattcttaaatagtctcatagcattatttctttttacttattactaattatgctttgcaccgaagaatgttagttcgtgaagatgcatgtagcgtgtatttccccaagtgttattcgtcctgaaacgaatgtaacgaacagcaggagcattatccggaataataaaattctcaccattctttgcagcttcctgatcttcagctgttagagcatcattaacaccaccacctgaaggtttcactgattcatattctgatagcaatacccacgaatcatcaaagcttccatccggattcggattaatacttccccaaatttcaaaatgtttcggatgaccagccttgaacgtattgccatatttacccggataataacgtgaaaccatcacaaaacgacttaatttataattctctcccatatcaaaagtaaaccattgaggcattaccgttgtcgtcttagtctgaaagcaggggtctgcatctgttattccatcccaaagtcgtgtcatatcattcccttttgtgacctcattccatgaatggcattcataagagtcggtcggtaaagccatctttctgaacaaagacttatcacattgttcttcataaagaggagtttcagttacatacaatgtatccgaaaggtgcccccatctatccctgacaaatataccaaaatctgtagtaacagcatcaagaccacgtacataaaaatctccacctttagcttcagtataatgcatatatacctgtgtccaaataccctctgcttgtttttttataacgcccagtccaagtttcgctttttccggattatcaaaattcactctgataccgccaaatgtttcggcagaaaccaatgttccacgaactttctgataaggaggtgtatcaggattcactttcacgactaacggagaagacacaacctcaccataactaacagaataaagctcaatatcatattcccccttagtcgggaaaccttccactaccaaagaatctgtgtagaaagaagcattaactgtgcggaccatgttatcaaccttataactggccctaacatatttcagattctgatcatccggtaagtcataatagataattgccgcaccaggcagattctttaccgttgcgttcaacacctgtgccggaggcgttgtacttcctgccggttcattcaaatcagcattatcagcacaagcagctaaagccactcctatataaagc

SEQ ID NO: 192 - DNA, 13329 bp, Bacteroides thetaiotaomicron
atggacaaccatctgagagcaaattaagtttaaacgccgcaaaagccgaggatcacgaatttgatctgtctctaataacatcaagcaaagataaaaaaaataatatatacttgtgtataaagggtagcttcccgaaggaggagaattgagatactaccgactttttagtcactccccagttatcggcagtcaaatgaaagcgtttgcttatttcatgatatgtttgccataattccatcctttgaggtcgtatagctctgcatccttacgaatcctttctttaaagtcttcataattccttttttcttgtggtgtccatccggcttcggcaacggcggcaagacgtggcaacatcaggtattcgagaacggaaggttcggtcacccattcggtccaaaagttggcttgtacacctttataataaggttgcaaggcagcatccacgtctttaagcggctgatagttataaacggcctccacagtttccgttccatgtccctgcgacatcggttccgtgggaagtttcgactgttttctgttgatataataaggtatttgcgggctcagtatggtgttcattccttgcttggcagcctgttttgcggcggcattagctccgatccatgccataatggtgatgtcattgccaaggatactggtatttccgtgaagcacttcgttccagaatataagttggcgttgttgatcggcaggtttggtggcaatgtaatcttttagttgtttgtagaaataaatctgcaagtctctgaagttggaagaacctatttcactcagcagcttcttgcattcgtcattcttttgccatttccttgtggggcattcgtcaccgcctaaatgaatataattgaatggaaacaattcagtgagttcatcaattacctctttggcaaactgcatcgctttcgggttggctacgttgattacatcagtagaaatcccttgttgtagccatacttcatgtttatcccttgggtcgcacgccaagaactccggataagctgcaacggctgcctgtgaatgtcccggaatgtctatttcgggaatgatttctataaatttcttctttgcatacgctacgatttctttgatatctttctgagtataaaagccgccataacgctcaccgtctggtttcacgtcaccgtatgcaagtactttgctgtttctccatgcgcctgtctccgtcagtttggggtatttctttatttcgattctccagccttgatcttctgtcagatgccagtggaaacgattcattttgtagatggccatcatgtcgatcactcgttttatctcatctttaccgaagaaatgtctgccttcgtccagcataaaacctctccattcgaaacggggagcatcttcaatctcgacagatgggagactccattgtgaatggtcggacgttgctacgcctgccattacgttgcggggcatcagttgctttagcgtttgtagcgcataatagaaacctgccggacgggaggcttcgatccggacttgttttttcgagacgttcagcttataagcttcagcgggaagttgtggattcaaatctaagataatccttgctttagcttctttttgagtagatgaaaccttgatgccggttgcttcttgcaattcctttttgaatgattcaaagaccatacggatgctgtctccctgataaggagtgactttggctttaagttggttgccaaactcaaagcggccgtcttttacggtaaggtgagccggttgtggggtgagagcgatttcttgtgctgtaagcatctcattgctaccgagtagcaatagcaggggtagaaaatgtttgattttcatggtaattgggggtatttaaataaaaagtataacagcggacgaagatagaaataataaatcagaaaagtatgtctttatgattattttgtttgctctttttgatttgtttgatctaggttcctcataaatttgcttaatttgataaattagtgtttctttgcaccatgatataagtcatgataactaacccccattattacaacttatgaaaaacaacaagatttatctgttgggagcctgcctcctgtgtgctgttactacctttgcgcagaatgttagtctgcaacctcctcctcaacaactcattgttcaaaacaagaccatcgatctgcctgctgtctatcagctgaatggcggggaagaagccaatccgcatgctgtaaaggtactgaaagaactgctttccggtaagcaaagcagcaagaaagggatgcttatttctattggtgagaaaggtgacaagagtgtgcgtaaatatagccgccagattcctgaccacaaagaaggctattacctgtctgtgaatgagaaggaaatcgtactggccggaaacgacgaacgaggtacttattacgctctgcaaacttttgcgcaattgctgaaagacggaaagctgcccgaagtagaaatcaaagattacccttctgtacggtatcggggagtggtagaagggttttacggaactccctggagccatcaggcacgcctcagccaactgaagttttacggtaaaaacaagatgaacacttatatatacggtccgaaagatgatccgtatcatagtgctcccaactggcgtttgccttatcccgacaaagaagctgcccagttgcaggaattggtggcggtagccaacgaaaatgaagttgactttgtatgggcgatccatccgggacaggatatcaaatggaataaggaagatcgtgatcttctgctcgctaaatttgagaagatgtatcagctcggtgtccgttcgttcgccgtattctttgatgatatctccggtgaaggtactaatccgcagaaacaagcggaactactgaactacattgatgagaaattcgcacaggtaaaaccggatataaaccaactggtgatgtgccctacggaatataataaaagctggtcgaaccctaatggcaattatctgactacgctgggcgataaactcaatccttccattcagatcatgtggacgggagaccgtgtcatttccgatattacccgtgacggcatttcatggattaacgaacgaatcaagcgtccggcttatatctggtggaacttcccggtgtccgattatgtgcgcgatcatctgcttctcggtcctgtgtatggcaacgatactacgattgccaaagagatgtcgggctttgtaaccaatccgatggaacatgccgaatcgtcaaagatagcgatttatagtgtggcaagttatgcctggaatcctgccaagtatgatacatggcagacgtggaaggatgcgatccgtaccattctgccaagtgcagcggaagaacttgaatgctttgcaatgcacaattccgacttgggacctaacggacatggataccgccgcgaagaatctatggatatccaaccggctgccgaacgtttcctgaaagcgttcaaagaaggcaaaaattacgataaggcagatttcgagactcttcaatatacgttcgaacgtatgaaagaatccgccgatatcctgttgatgaatacggagaacaaaccgttgattgtggaaatcactccttgggtgcatcagtttaaactgacggctgaaatgggagaagaagtgctgaagatggtagaaggccggaatgaatcttattttctgcggaaatacaatcatgtgaaggctttgcagcaacagatgttctatatcgatcagacgagtaatcagaatccttatcaaccgggagtaaagacagctacgcgagtgataaaaccattaattgaccggacttttgccacagttgtgaaattcttcaatcaaaagtttaatgctcatctggatgccactaccgattatatgccgcataagatgatcagtaatgtggagcagatcaagaacctgccgttgcaggtgaaagcgaaccgtgtactcatttctcctgccaatgaagttgtgaaatgggcggctggaaacagtgttgaaatagaactggatgctatctatccgggagagaatattcagataaactttggtaaggatgctccttgtacatggggacgccttgaaatctctacggacggcaaggaatggaaaacggtggatctgaagcagaaagaaagcagattgtcggccggtttgcagaaagctcctgtgaagtttgtccgcttcacgaatgtgagtgatgaagaacagcaggtctatttgcgccagtttgttctgactatagagaagaaataagaatgattatataggctgactaaaaagtctgaactacccacaattcccctccttcccgaaggaggagagttggaagttaccaccgactttttagtcagcctttttttgatttacgatattcccgcggtgacattcccatgatcttactgaataggcgggaaaaataataagtatcttcaatacctattttatagcatatctgatttatcttcatatcggtggtatccagcaacaggcaggcctgctgcatctttagcagattaaagtaagtaagcggactgtgtcccgtttgctttttgaacaacatggagaagtgcgacggagaatatccgatttgtgttgatatctcttccagactcagatgtttctccatattctctttcatgtagtggatggcaacgttcactattccctcgtcttctgcctcattggtgcctgcattacgatattgctggacatagcgtaacgttcccaaataaaagtgaaacatagaaaacgcataacgcaggttctcgttgctataaccatttttgagtgtattgaatatctcttcaaacaggttgatccgcgtactgatgcgggagtgttgttcggactgaatatccatcggacggttggcgtctttggcatagaacggagcaagaatacctttgaagtgaatccagtaaatagtccatggcgtcgatttgttggaagcataagaatgcgggactcctgccggaagaataaaatactgattggcggagacggtatattcctggtctccgatccggtaagatccggcaccatcaatacaatagatgaagacatattgattgatgggctctttccgttcccgaaaatgatgcttggctttgggataatatccgatgtcagtgatatgcagcatggaggtcagcgggtcctcttccatcttatcaacgatgatgcggggcaatactaaggctctttccccggtaaatccatcttttagttttaccatagtacataattggttattctgcgcaaatatataataatgtatgcgatctgtcaaataatacattaaaaataagattgtccatctttataaaatgaaattctattttttgtgctttggatacgctctatctttgcaacatcaattaatcaatcttctagtggtatgaaaagttataataaaaagtttgtctattccatttgtttggtttctgcgatgggcggtctgctctttgggtatgactgggtggtaatcggaggagcgaaacctttctatgaactctatttcggtattgccgattcgccgacgatgcagggactggctatgagtgtagccttgcttggctgtctgatcggtgctatggtagccggtatgatggctgaccgctatggcaggaaacctctcttgctgatttccgcatttatctttttatcttccgcatacgctaccggtgcattttccgtattcagctggtttttggcagcacgctttttgggaggtatcggcatcggtatcgcttcggggctgtctccgatgtacattgccgaagtagctcctacttccatccgggggaaactggtatccctcaatcaactgactattgtattaggaatccttggcgcacaaatagccaactggctgatagccgagcctatacctgccgactttacgcctgccgatatctgtgcttcatggaacgggcagatgggatggcgctggatgttttggggagcagcatttccggcagcggtattcttgctgctagcctgttttattcccgaaagtccccgttggctggcaatgaaaggcaagagagagaaagcatggagtgtacttagccggataggaggaaaccgctatgcggagcaggaacttcagatggtggaacaaacttctgcttccaagtcggaaggaggattgaaattattgttcagtcgcccgttccgtaaggtactcgtactgggtgttatcgtggctgtgttccagcaatggtgcggtacgaatgtgattttcaattatgcacaggaaatattccagtcggcgggttattcgctgggtgatgtactctttaatattgtggtgaccggtgtagcgaatgtgatctttacgtttgtggctatctatacggtcgaacgtttggggcgccgtgctttgatgcttttgggggctggaggactggcaggtatttatctggttctcggcacgtgttacttttttcaggtcagcggtttctttatggtagtgctggtagtgttggcgatagcttgttatgccatgtctctggggcctatcacgtgggtactgcttgctgagatattccccaaccgcgtgcgtggtgtggctatggcaacctgtactttcgctttgtgggtcggtagtttcacgcttacctacacatttccgttgctgaatactgcattgggcagttacggcacattctggatttattcggctatctgcgtcttcggcttccttttcttcctgcgtgcattgcctgagacaaaagggaaatcgctggagacattggagaaagatctgataaaataaaaagatataattaataatatcatggtaaaagcatggagagaaaaggttgtaattcctacttatgaagtaggtaaaccggaaaagaatcctattttcctggagaaacgtgtctaccagggcagtagtggggtagtttatccttatcctgtcatcgaatcgatgtccgatgaaaaagtagataaggaatacgaagctatctttattgaaaacgaatacatcaaggtgatgattctgcccgagttaggcggtcgtgtacaaatggcttatgataagatcagggaacgtcattttatttattacaatcacgtgattaaacctgcattggtggggctggcaggtccgtggatttcgggaggtattgagtttaattggcctcagcatcatcgtcccagtacttatatgcctgtagatacgacgattgaagaaaatgctgacggcagcgtcactgtatgggtgaacgaaatggaacggatgtttcatcagaaagggatggcgggcttcacgcttcgtccgggacatgcttttctcgaaataaaaggggtgctctacaaccgtaccgaagtgccgcaaaccttcctgtggtgggcgaatcctgccgtagcggtgaacgactactatcagagtgtatttccgcccgacatcaatgcggtgttcgatcatggaaagcgtgccgtatccagcttccctatagcaacgggtacttattataggatggactattctgccggagtagacatttcgaactataagaatatcaaagttcctacttcgtatatggctgtcaactcccgttacaactttgagggtggctacgaaaacgacacttgtgcaggtatgcttcatgtggcaaatcatcatatttctccgggcaaaaagcaatggacatggggaaacggtgatttcggccgtgcatgggaccgtaatctgactgacgaggacggaccttacatcgaactgatggctggtgtctataccgagaaccaaccggactttacatggctgcaaccttacgaagaaaagagcttcgtacagtacttcctgccttaccgtgaactgggagtggtgaagaatgcaagcaaagatttgttgatgaacatagaaccggaaggtgaaaaggaggtacgtttcaagatattcgcaacatctaagcaggtggttaatgtagtgctgaaaggtgacgatggaaaagtgtattatagcaggcaagtgaccattactccggaagaactattgaatgaaacggtagacgtagcaggggagaagttgaacaaactgaatcttgaaatcaccgcaaacggcaaggaactgctttactggcatgccgaaccggacgaagtaaaaccgattccggatgctgccgaagctgctttgttaccggaagaaataaaaacaaccgagcaactctatctgacaggtttacacctggaacaatacagacacgccacctataatccggtagactattacgaagaagccttgcgccgtgacccgatcgatgtacgtagcaataatgcactcggattatggtatatccgtaaaggccgtttccgtaaagctgaacaatacttgcttacggcagtgaagaccttgcagaagcgcaacccgaacccgtgtgatggagagcctatctataatctcggacttgccttgaaatatcagggacgctataatgaggcttacgaccgtttctataaatcatgctggaatgcagcctggcaggatgccggttattttgcctgtgctcagattgctacgatgcaaggacgtctggaagacgctttggacgaagtggaccgttcgcttatccgcaactggcataatcataaggcacgtgctctgaaaacgaccattctccgtcagatggggaaagcggaagaagccttgcaagtgattgaagattcattggctattgataagttcaacttcggttgccgttatgagaagtacctgataaccaatgctgccgaagacctgcttactttaagggcgatgatgcgtggcgaagctcacaactatgatgaaatcgcacttgattattgtgctgccggttgctggacagaagccgcttctttgtggaatgtagctatcgctgagggcagtgtaacgccaatgacttattattacttgggttggtgtcttgttcagggtaagttatccggggcggaacaggcatttgccgatgctgccaacgcttgtccggactattgtttccctaaccgcctggaagccatccttgctttgcaatgtgctatggaacaaaacccgaatgatgcgaaagcaccttattatctgggtaatttgtactacgataaacgtcagtacgatttagcactcgaagcatgggaaacttccgccggactggatgacaagttcgctacgatatggcgtaatctggctttggctaactttaacaaaaaggatgaagaagcaacggccatcgaatatatggaacgtgctttccaactcgatacgaccgatgcacgtgtgttgatggaattggatcagctctataaacgtgtccgtcgtccgcattccgaacgtctggcgttcttgcagcaataccccgaattgatagcgcaacgtgacgacctcgtactggaagagatcactttgctgaatcagacaggcgagtatgaaaaggctaaaacgttacttgatgcgcatatcttccatccgtgggaaggcggcgaaggaaaagtaccgggacaatatcagtttgcccgtgtggaactggcgaagaaagcacttgaagccgggaattacagtgaagctgtctcgttgctggcagagtgtcttgaatatccgcatcacttgggtgaaggtaagttgcacggtgcacaggaaaatgatttctattatttcatgggttgcgcttatgaaggtctggggcagaatgacaaagcggtggaatgctgggaacaagcgattgtcggtcctaccgaaccggctgctgccatgtactacaatgatgcaaaaccggataaaattttctatcagggactggctttgttgaaactgaaccgcatggatgaggctaacggacgcttccataaactgacaacttacggagagaaatatctttttgacaaggttaaaatggattattttgcagtgtcactacccgatttgttaatatgggaagatgacctgaccatacgaaacgtcattcactgcaaatatatgatggcattgggttattggggattgaacgaaaaagagaaatccgttcggttgctgagtgaggtagaaagattggatatcaatcatcagggtattcaggcttttcgtagtctgattgggtaggaagtattggttcttggttaggaccggcgtactcttgtttcagtccggtgctaaccaagtacttcttcctgtttatggtacaaacttaatgcagacaggcttgtccacctttatatctttacgtatatccgtcagtaatcctgtatccgtatccctttcataaacctgtatcacattactatcccgacaagccaccagcaaatacttgccgttaggcgtgataatgaaattgcgcgggtgaatgcctgtcagttgataaccgactttcgtcagcataccgttttccggatggatactgaagatcgccagcccgtcagcctttagccggttacttgcatacaggaatttgccgtccgggctgatatgaatatcaccacttcctttggctcccacagtgtcggcagcaatagtctgaatttcttttaactctccgtcgttatattcaaacgcaatgactgttcccgatagttcattgatgagatacgcatagcttccattcggtgcaaatgtcagatggcggggacccgaaccggcttctactttataagaggcgggacttccttctttcagaaaaacatcttcattgtctgcctttgcattcggattaacaataaatttgtgtatctggtccgtgcccagatcgtctgcaaataagtatttgccatccggcgtgatgcggacacaatgcagatgcggtttctcctgacgttccttgtcggctcccgaacctttgaacttcaccacctcagaagcggggagaagtgaaccgtccttatcgatcgggaagacagaaatgcttcctccactgtaattggcagtaaccacattacttccgttggtaatgatgtagcaaggatcttcgcctccggttttctgcgtattcagcagtcggaaagttccttcctccttattgaaagcaaatgcgttggcagcagcttgttcgttgctgaattcgctgactgcatagatgaatttgccgtcggcagaaggtacgagataagatgggttttccacttccgcttcactgagtgcggttgcggttccgttttcttcattgaatcggaaactatagagacctttactgtctcccgaagtgtaagtaccgacaatcattgtcaggtcctgttctgcttcatgggagccttcggtccgggaagccttttttgatgtacaactagatgtgaacataccgataatacagatggttgcaaaagtttttagcatatataggttctttttattagatagcaacttccttagtctatactaatgtcttgtataatagatgattgcagtttccttgtcgttcccttacgaggacacgatggtttcccgacgaggaaacggtcgtttctctacggggatacttgcgtttctctacgaggaaactgtcgtttctttacttgaaacggaaatctcccttacctgtcccagttatactctactatataactgtcgaaatactcactttgaatgactcccagttctttggcggtatttataatccattgctgctcggcgggagtgagcgccagtttgccactgcgtttcaagtagtagtttttacgtcccagatatccgatcatccggtagcggaacgtgtttgccacgcgcactgtgagtgcatttattgtgcacatgaatcctttggcgtagcgcaccttttcgttcgaacagaaatagtcacatttttcttttatgccctttatatggtttggattcataattggcagaaaaactttgtttgcaggggcgtgttttaaagctatctgtcgcaggcaagtcgaggcttgcgggcaattttcggcagcgcacattccgaatgtgaaaggtacttgagaataatcaaatggttcttccattgctttttggggttgatagtatttattatattccacaaatgtacggataatgttggtaagttggaaataaccggacctacaaatgttgtatgtctgggaaccaagtctgcctccgctcatgatatatctctgtataccggatagcatatcatcggctaatatttgcaaatatatgatggttagtaacaaaagaatatgtatctttgtgccaaagaaaacaggattattgaaaggatatgatgtattatttatcccttatttgtttctcaaatataaaataacgattgttctcttttgattttcagaccgttataaagtcatggggttgactggatttgacagcgggcagaaatggtaggtaagcatgcagtgggtcggtaatttccacttaaatctcagttatcaaaactttatctggcgaaactaattacgctcttgctgcttaatcgaatcacagtagattagcttaatccaggcactaggtgccaggacgagacatcactcggaagctgttgctccgaagcattccggttcagtggtgcagtaacatcggggatagtcagaagcggcctcgcgtttttgatgaaactttagaggataaggcaggaattgatggctttggttctgctcctgcacgaaaatttaggcaaagataagcatgtagaaagcttatgatttcctcgtttggacgagggttcgattccctccagctccacctgaaaacaaatgaaagctctgattatcagagctttttctttttatgggttttctcccttattcccctttttattgttgatttgttatttttcctttttttagatacaaagtcaatttcttatacatacttttattctcttctcttttggtatgacgatatcgctatttggtattgtcaatatttatgtgtttttgttttatatacggaataattataaatatatgcaaacaagtattaataatatatctttattatgttctaatctttgagaatgtctatttttatacttgtaatcgataataatcttagcggatatggaaaataatgttaaccaaattgagctgaagtttcagcgtttttttatttctaattttccgaaagtaaagaattatgcccagctgttgcttaagtcggaagttgatgctgaagatgttgctcaagatattttctgtaagctttggttacaaccggaaatatggcttgacaatgaaaatgaattagataactacctctttataatgaccagaaacattattctgaatatcttcaagcatcagcaaatcgaacgggaatatcaggaaggataccttgagaaaacagtacttcatgaattgatagaaggggaagatgcccttaataatatatattatga

SEQ ID NO: 193 - DNA, 13260 bp, Bacteroides thetaiotaomicron
atatgatatatgggatatcgggataagaaaaaataattcaaccctagaacagggttctgaatagtacttttataaattgctgatttctagctataaagaaaaatatgaataaaaaagtgtcgaaaagtttttgagttctcgcaaaaagcactacctttgcatccgcaaataaggatggttccgtagctcagctggatagagcaacgcccttctaaggcgtgggtcaagcgttcgaatcgcttcggaatcactgatgtaaacgttgattatttaataatagtcaacgtttttcttttgtttggggtacatcaattttattgaattctgagtggtttcatattgcgattatcccctataaaacagtaaatgtccccctatgtccccctttgctgtatactatattgatttgataaacaggcaaatatttgatttaattaagaatatatttataccccctattttataaagcaactcccattattattcctacatttgcattcagagattcgtctctttagttgggaaacataaaccttttgttcatgaagcatttacgacaaactgtactttttatattgttaggattcttattgactgcttgtcatcatacagccgaccgattgttatctatcgaacaattgatcaagctgaaaccggacagcgctctttctttacttcgccaaattcagtatccggagaagctgtcggattcaaatagggctttgtatgcattgctaatgactcaggtgatcaatcagtcatctgatgaggagcataaaagtgattcacttatatctgttgcaattgattattataaaggaaccacggactctgttcatgcggcactggcttattataatgccggtctggtagcaatggataatgaagattcggaagcttccctgcataatttcctaaagacaatcgattggttgggagagagtgataacgatgaacttcagttcatggtcaggtataaaatgagtcgtcttttcaacttgcgactgattcctgatgaggaactacggttggggaaggcagcgttaccttatgccgaacggacaggcaaccctttgtatatctgtgcactgttgccgtatatcactcacggatttatgcagacaaatcaactggatagcgcctataaatattctgtgcaagcgatacaactggctgagaaagagaacttggtccgggcattatcacatatttattcacagcatgcccatctttgcatggcgatgaaggactataaacaggcgttgatgtatcgcgataaagatttggctattctatttgaacttttcggagaggaaaatgaatatatctatgatcattatataaataaggcaaacacactgactgaactgcatcagtatgattctgctttctactacattaataaagcggtggaagatacaacagatatacaatatacaactcgaaagtctttggctaaggctgaaatttatgctgctaccgggcagatggattcggcatattattatatgaaccgacatgctgacttgcgggataggctcatagaggagagagataaggaaggtttactgactttgcaccggaattatcacaatgatgaattgaaaaaagccaatacccgtctttggcaacaggcggtggaaaggaagctgcaactgtacgttgtgactattgtttgttgcctggcgattttgttaggggtatgcatctacttctttttatataaaaggaaacaacaggaagtattgcgtcagaaaggacagattgcccatcagcaggagttgttgaagtaccgtgaaatagaaaaactacaggcagaaaaagacttgtcggaagctaaggaaagggaagcgcagattcgggagaaagaggctttactaaaggttgagttttttaagcgcctgaatgaaacttgtattcctgtgattgaaaatccgaaaacccagcagaatataatgctcaaggatgaggactggaaagtaatattcaagaatgccaacagtatcttcctgaattttacagaacgtctgaagaatcagtatcctgcactgaatgaggaggatttgcggtattgctgtatggtgaaaatgcagttttcgcagactgatattgctaagatcatgcatctggagaaagattcggtgaagaaaagactgaaacgaattcgtaccgaaaagatggggatagcgcaggaaacaacattggaggctgtgcttcgggacttttaaatgattaagaatgagaatgaaataatttgttaaaccaaacattagaattatgaaacaaacactgagttttcatagtccgatcattgcttctacacagagcaaggtggatgtagaagcttttgagaagagtacagatgcttttgaaaagggagagcacttacagtctttttatctgttgctggattatattgatccggagttacgcagcaaatttggtaatgcagaagggacagagtttgccgtacctcatggttccattatggtctatctgaggctggagggtgaccagctgaatattacagctccatttctgttgttgccggaaaaggggaggattcctttgctgcgccaggtggcagctttgaatctgacagaactgacgttagcatgtatctctttgcagaatgataagttgttctttgactttcattgtccggtggctttatgcaatccttacaagatatactatgtgcttgaggaaatctgccggataggagataagtatgatgacgaatttgtgactaagttcaaggccgagcgcatttatgagcccaaaattactccatacgacaatgaaacggtggataaggtatacgaagccctccagcagagctgtaaggaatgtatggacgctgtaaaatacttcgagacagaacgaaaatatggttatgcctggaatatattatccagtacgcttcttaaaatatgctattttgtctgtccgcaagggcaactgctgaatgatcttgataaagcgattacagatcatgggcgggaggatatgccgttgccggagatcgtatcccgtaccaaatctgttgtcacacgccttcaggaaatgacgaaggagcaactggctgccgatctttactttgttgaaactttcatttcggacagacgccattccgtactgaaaaacattcaggataactttgaagatgcatacgagaaagccggctcggcattggaatcaggtgacttcatcgtttgctgcctgcttattattaataaattctatgaattgtactattataataatgtgcagaatgatgtgaatgcggtagttgtgaaagcaatgaaggctacctctgccatgtcatgggaagaagctgctccgatattatatgaagcgatggataatatcatggaaggagaactggatgtagatgatgacgaagaaggtggtgacgaagacggagaaacaatgggcttcgatatgtcacagcttcaacagatgcaacaggaaatgatgcagcaggcgatgcagaatattgatatggagcaaatacagaagatgcagcaacttgctatggagaatatgcaaaagatgatggccggtatgtatggcaacaataacaatacggaagaggacactaacaaataaagaacaagactatggaacagaatatatacaatgccatttataaagtgaatcatgccggtggctgcggcagttgtttttatctgaaacaatatgatctgtttgttaccaattatcatgtagtagagggattccgtcaggtagcgatccaggataatgataagaattcgtttctggccagggtcgttatggtaaattccgtattggatattgctttgctgtcggtggaaggggatttttctgctcttccggatatccggttatcggagttgaaagaagtcgcgatcggacagaagataaacgtggccggctatccgtttggtatgccgttcaccgtgactgaaggtacggtttcttctcccagacagctgattaacaacagttattatattcagacagatgctgcggtcaatccgggaaatagcggaggtcccatgttcaatgaacgtggtgaattgatcgccattaccgccagtaagatcaccgatgcggataatatgggatttggtatccctgtggatacactgaaaaaggtgctggagaatatagaaagtctggatcgctctgttttcaatgtgcagtgtaatagttgcgatgaattcatttccgaagaagatgaatattgcccttgttgcggtgacaagttgccggaagaaatctttaaagagagaggactgaccgatctggctgtattctgcgaagaagccattgaagcgatgggaatcaatccggtattggcacgtgtgggatacgaaggctggaaattctataagggaagttcggagatacgtatgtttgtgtacgaccgttcttatctgtttgccacctctccgctgaatattctgccaaaaaagaatctggaacctgtgctgacctatttacttcagacagagattgctccttatcgtttcggactggatggaaatcagatttatctttcttatcgtgtgcatatatctgatatattctccgattattcggaaaatgtcaagacgaatctgacccatctggctttcaaggcagatgatctggataattatctggtggatacttttggctgtgagttttccgaatatgctaataaaaacgctatctgaccaataactaaactatttgaatatcactcctttcgctgaattattgaggcggaaggagtgtcttttttcctccctgccggacactcgcaaatctatttttacgaagaataacgaacgttatataggtttcaaaaagctcaaaaaaggtaaaatgatgttgcgattctctgttattacttatacttttggacgattaacaactaaaaaacacaataaagttatgaagaaattgatttttttatttgcattttgccttactgtgactaacattttcgctcaaactgaccctagccaattgaaaaaagaaggaagcgacgcttttaatgccaagaactatcccgtagcttatgctaaattcagtgagtatctgaaacaaacgaataaccaggattctgcaatcgcttattactgtggtatggctgcagatgaagtgaaaaagtatgcagaagctgtgactttctttgatattgctattcaaaagaaattcaatataggtaatgcttatgcccgtaaagcgctggcactggatgctatgaagaagactgacgagtatgttgctaccttggaagaaggtctgaaagtagacccggacaataaaacaatgattaagaactatggtctccactacctgaaagcaggtatcgctgcgcagaaagccggaaaagtggaagaagcagaagaatgctttaagaaagtgattcctttggatcataaaacatataaaaccaatgctttgtatagcctgggcgttttatgctataacgacggtgcgaatatcctgaaaaaggctgctcctctggcaaactctgatgcagacaaatatgctgcagaaaaggaaaaggcagatggcagatttaaagaagctataggttacttggaagaagctaccaaagtttctccggaagatacaaagtctaaaactatgctttctcaagtgcaggcagctatgaagtaaactaccaattccagatagaaagggttgccggggaacattttggcaacccttttttattgcttctttttttgaatgatctactttttgcgtacttttgctttcccaaaaagaaagactttatgcaattatatacaagagaagaaacgattcggaaaataaaccatttagggcaatcctgtcggccttttatttttattattaattatttgcaggatgcatcttatattgaagaagttgcctctgttgacccttctgaagtagtatataacctgaatgggtttaccaaccaatcttcatcgaaggatgtgctttcttgttttgaagaacctgtccactggaattcttatcccgaatctttcgatagttaccgtcggtcatttgatatcgttcaacggaatatatttgccggaaacagctttctgaccaatctgacatgccgcacgccgatagagacgaaccttagtctgaaagatattttcttccgttcaaaagcaatgtataaattgtgggtcagggatcagttcacagttttctctcccgagatatttgtcagaatccaacagggaaaaatcagttcttatccgatgaaaggtactcttgatgcatcattgccttcggctgtccggcagctgatggatgatccgaaagaggctgccgaacatgctactatcgtagatttgatccgcaatgatttaagcatagtggccgatcgggtatctgtgtcccgatacaggtatattgataagttgcagacgaatcgcggaactattcttcagacgagttctgaaatacagggaaccttgccggataattatcgggaaaatctgggacacattcttttcaaactcttgcctgccggttctatcaccggtgctcccaagaaaaagacgatgcagattatcagtgaagccgagacgtatgagagaggattctatacgggtgtgatggggtatttcgacggaagtagccttgatagtgccgttatgatacgttttgtggagcaggaaggcgacagaatgtattttaagagcggaggcggaataacctgccgtagtgaagtggaaagtgaatatcatgaaatgaaacaaaaagtatatgtgccaatttattgaaacgattcgcatagaagacggacaggtttataatctgtcgtatcacacagcgcgcatgaaccggactcgtgccgccttttggaaagaagcggctcccattgatttgtccggctttatatctcctccgtctctgtccggtatctggaagtgccggattgtgtacgataaggaaatcgaagaggtcggatacactccttatcaaatgagaatggtttcttccttgcgtccggttgcttcggacactattgattatagttacaagagtaccaatcgggaagaattgaatgatctgtttgcccggagagggaaggcagacgatattctgatagtgaaagacggatatctgactgatacctccattgccaacatagcgctgtatgacggacatacatggtatactccggctcatcccttgcttcaggggacgaagcgtgcggaactgttggataatcggttcatagtggagaaagatatccggcaggcgcaattgggcgattactcccatatcatgttgttcaatgcgatgatagactggaaacggctcatcatacctgtcaatgaaaaatattttattctataactaaaattaacggaaatatatacagaaccgttgaacaaagcctctttttaatctgttatatttatgtgtttttcatagtattagataaagattaattaaaagagattgtacttcacttgtgaaagcttagagtacatcagaagcagaagagtctgtttttttgataaatgtgttagagcatcggttttaccaggccgatgctttttttatgtccttttgttgcgttttgtagtttatatgaaataaaatttgtacgtttgtagggtaataatagaaaatgatgaagatgaacatacccgttatctttcagtttttaaaagatctttctgcgaataataatcgtgagtggtttaatgagcaccggtcagaatatgaagtagcccgtgccgagtttgataactttctggcaacagtaatcgcccgcatttctttgttcgatgaaacaatccggggaatccagcccaaagattgtacctatcgtatttatcgggatacccgcttctctgcggataagacaccctataagatacattttggcggttatatcaatgccaaaggcaagaagtccgatcattgcggatactatgtgcatctgcagcctgacggaagtatgcttgccggaggaagcttgtgtttgcctcccaatgtactgaaagctgtccgccaagccatttatgacaatgtggaagagtatatctccattgtagaagaccccgaattcaaaaaatattttcctgtagtgggagaggacttcatgaaaacagctcccaagggattcccgaaagattttaaatatattgattatctgaagtgcagacagtttgtctgttcttatcttgttcccgatgattttttcactcgggcagacatgatggagcagatagagaaagcattccgacagttcaagagatttgccgatttcatcaattacacaattgatgattttgaataaaataatacctaaaaatataaacttaaaaattaaactcatatggtagtagatactttagaaaatctggaaaaatacgcgtctttgaatcctttgtttgcacaagctattgagttcttgaaatctcatgacctccaagccatggaaataggcaagactgaactgaaaggaaaagatctgctagtgaatatcgcacagacaaagcctaagactaaggaagaggcgaaattggaaacgcataatgaatttattgatattcagatcccattgtcgggaacagaagtgatggggtatactgctgccaaagattgtgtgcctgccgacgctccttataatgtcgaaaaagatattactttcttcgaaggactggcagagacatatgtagctgtgaaaccgggaatgtttgccatcttcttcccgcaagacggacatgctcccggcattactcctgatggagtgaagaaagtgatcgtaaaagtaaaagcataaacctaattcaattctgatatgaaagagacactcaacattatcaaaaacgatccctggctggaacctttcgcagatgccattaccggtcgtcaccagtatgcactgaacaaggaagccgagttgaccaataaaggaaaacaaactctttcggactttgcatcaggctatctttattttggtctgcaccgtactcccaaaggatggacgttccgcgaatgggcaccgaatgctactcatatttatatggtaggtacattcaacaactgggaagagaaagctgcttataagctgaaaaaactgaaaaacggtaattgggaaatcaatcttccggcagatgccattcatcacggagacttatataagttgaatgtgtattgggatggcggacaaggtgaacgcattcctgcatgggctacacgtgtggtgcaggacgagcagaccaagatattcagcgcacaagtctgggcaccggaaaagccatataaattcaagaaaaagacatttaagcctactacgaatcctttgttgatctatgaatgtcatattggaatggcacaacaggaggaaaaagtaggcacatacaatgaattccgcgaaaaaacacttccacgcatagcacaggaaggctataactgtattcagattatggccattcaggagcatccttattatggtagttttggctatcatgtatccagtttctttgctgcttcctcccgctttggtacgcctgacgaactgaaagcgctgattgatgctgctcatgagatggggattgccgttattatggatattgtccattctcatgcggtgaaaaacgaagtggaaggtttgggcaactttgccggtgatccgaaccagtatttctatccggctcctcgtcgtgagcatccggcatgggattcactatgctttgattatggtaaaaatgaagtgatccatttcttattgtccaactgtaaatactggctggaagaatataagtttgacggattccgttttgacggtgtgacgtctatgttgtattatagccacgggttgggagaagcattctgtaattatggagattacttcaatggtcatcaggacggcaatgccatttgctacctgacattggcgaatgagttgattcatcaggtcaatccgaaggctatctctattgctgaagaagtttccggtatgccgggacttgccgccaaagtagaagatggcggttacggatttgattaccgtatggctatgaacatccctgattactggatcaagactatcaaggaaaagattgatgaggactggaaaccttccagtatgttctgggaagtaaccaaccgtcgtcaggatgaaaagacgatctcttatgcggaaagtcatgatcaggcattggtaggagacaagactattattttccgtctgattgatgccgatatgtattggcatatgcagaaaggcgatgagaattatgtagtcaatcgcggaatcgctttacataagatgatccgcttgctgacatcttcgacgatcaatggcggttatctgaactttatgggtaatgagttcgggcatcccgaatggatcgattttccgcgtgaaggtaatggatggtcttgtaagtatgcccgtcgtcagtgggatctggtagataacaagaatctggcttatcactacatgggggactttgatgctgagatgctgaaagtgatcaagagtgtgaaagatttccaggcgactccggtccaggagatctggcataatgatggtgatcaggtattggcttatggacgtaaggatctgatatttgtatttaacttcaatccgaaacagtcttttgtagattatggtttcctcgttagtccgggagcttatgaagtaatcttgaatacggataatgttgcatttggcggaaatggtcttgcagatgattcagtagttcatttcacgattgccgatccgttgtataagaaggaaaagaaagagtggctgaaactctatattcctgcacgtacagctgttgttttgagaaagaagaaataactcagggaataaaaaataagaaagcccttgccgagcatttaatgtttggcaagggctttttttataagaatgttcccggaccgagaatgtcgtacatataactgacattgcgggtttttagcaacattccttgcggggaataaaagagctggtatttgatatctacattatcttgtcctaccttaatgacgatgattgcctgccatttaggaaactccaccatggttacatcatttactacccaactggcataaggaccggatacaaaggcattgtatacggtaggtgtcacccggtcgagactgacaaggtccgtctgtgtcatttgccattgagcctgcgtattgaaccagacgtttttagtgaatccattcataacaaagttagcgcaataatagccatcatcctgcgaccatgctataccgttggctttggggtacatctttttgaaggcagcctgtatattgccgggaggtaagattgcgaaggcagatacagacaataataatatgactgccaaaaaactaattttcttcataaggttctggtttaggaaattatttatctaactaaacagcctttgagaatttttgttttcagttggggagaataaatcagtagtatctccattggggctgcctaaaaagtcaatagtatcatcaattcccctcccttcgggaaggaggagagttaagatactattgatttatcatttgccttcaatcggagcagatcagaatgtaatcttcagaatcttcccattataggctccaacggaaacctcagtggctttataaggcaataaacagatttcctctttggcaccggtcaataagtctgtagcctgatatttttccatttgtggtatctgtaagaaatcaaacgcgtgagaaggtacgttgattgctacatcaaccagttggctatcgaaattgacgatgatgaacagcaattcattcttatactttcgcataaaagtatattgcttatgttcgtcgaaacgccatccgtttttattggcgtacatcaggtcgaagaatactcctttggcgatggatgtctcttcattacatagcgtaagtactctttggtaaatgctgtacaggcgtttatgctcttcggtcagcattttgccgtcaaacttaccgccattgcgccagcgacgaatagtatccacgctccagtaatcgaatatcgtagtccgtccgtctcttccgctgaaaccttcgctgtccattcccagttctccaaactcctgaccaaaataaatcatcataggattggtgttcatacaagcagaaacgatcagagcagggattcctttacgtggatctcctgcaaagaaatcggaagcgatgcgctgttcgtcatggttttccaggaagttcagcatttgcttttctattccgttcagactttgccagcagtgggtgatggatgcagcggattcgtagccgcaagctacattgcggagtgtatcgtataaaccgaccttatcatatagatagtcaaatttcccacggaagagataattgcggtattcgttgggattatagacctcggcaatgaaaaggatttccggatgtgcttcctttacttgtggaatagcccattcccaaaattctacaggaaccatttccgccatatcgcagcggaaaccgtcgataccttttgaggcccagaataaaagaatgtccagcatctttatccaggtatccggagtcggggagaaatggcaagtgccgccattcagataatccactccatagttcagcttgatggtttcgtaccagtcgttgatgttcggtgtagcgtcaaaacggttgttacctgtcgctttggccggatattcatggtaaggctctgctgcgccttctttcatatcgaactgggcacgcaactcggactgcggtatatagtagaaattattgtacgggctgaaagcgtagttcgggtcatcgtttgctcccagttcggtagtgccgtccggttgtgcatccgagtgatactggcgtgctacatggttggggacaaaatctataataactttcagtccggaacggtgagtgcgatgtaccagattctcgaactccttcattcgttccggcacatcggttgccaagtccggatctacatcataataatccttgatggcgtagggagagcccgctttgcctttcacgatggcggggtggtcgggacgtatgttgaagcgacggtaatccgtctccgttgcatgctcgataatgcctgtataccagatatgggtagcacccagtttcctgatttctccaagtgccttgagggtgaagtcggccattttaccacatccgttggcggtaatgtctccattatagacacaatggttgttattgtttccgaacaggcgtgtaaacacctgatagataatcattttattttcgttgttcatatagagt

SEQ ID NO: 194 - DNA, 13218 bp, Bacteroides thetaiotaomicron
gttctttttcttcttcatttattttacaggagtgttccaactttcttgatgaccttattgagtgcttataaccataataaatacaattttagtaatgttacaggattatacggtggtctcccttctgattgaagtttgacatgtttaaccccaagtttatctataggcaagatatccacaaataaatcgataatccttgcccaagaatctggagcaaccaattgttcaagagttatcatttgaatttgattttctgtttcctcctactatgtagtttatagatatattgtttagtttctttccataaatatacgaagaaccaataattcaatatagcgtctaaggtttttgcacagactctcggtggaatacatttccatgatatctgctccataacgaccgtgatgttcgtgcagcattctttcgaatgcactgattacaggccgtaccaccgtacagaaaatatcatccttacttttgaagtagttatagatattgctcaaccctacctgtgcttcttgcgcaatttcacgcatggaagccttcggaaagccgttttcgaggaataccttttcggcagctttcaaaatttctttttgtatgtcatctttagagtattgcataagttttatttctcgactgcaaagtaggggagaatccgcgttttctgaaatacccattaatgatggttttttgttagatttttataaaaatcacaattattgggtattgccaaggtcgctgaaagcatgcaactttgcgcgtataatctaactataaactactatatggtgaaactaacgaatcataaaaagacaattgacagacctttaggttgtaagagatggggaataatagctattattattattatttttgcaggtagcttatcttttttactgtactcttacttttcgcatgatgctgataatcctcagtgtaactgtttgctatgtatgcttaatcatgttcctgaagagggagagtacatttataaccgctatttgatatttattagttttatctggattgctgtgatctttgcggctatctttttagtgaattactgctttgtaaaaaagaacaaaaagaaatagtgttcgtttaagtacctacttattattatttttaataacacaatactcatatttgggtattgcccgcctttttaactccctctacttttgcgccaacaaaatttaagataaaagatgaaaaaattaacttgcttattcgccttaggtttcttgctttttaacaatactttacgggctaatgaacccgaaaaagtaacctcaacagaagaggtatctgaaactgcggcaaagaaagagagaataaaacaggtaacaaaagatgacgactacgaaaagttccgtttcggtggatacggagagatggtagcaaagtttatgaattacggaacgaatcgtttctatggtggggtcgataacagtgatcaccgcaataccattgcgattcctcgttttgtgttggcttttgactacaagtttaattccaagtggatactgggtgctgagatagagtttgaagcaggaggtgtaggtcttgaaactgaacttgagaattcagaaaacggtgagtatgagacagaaatggaaaagggtggagaagtcgctcttgagcagtttcacattacccgtctgatacattcggctttcaatattcgtgccggtcatttgattgtacctatgggattgaccaatgcacaccatgagcctatcaacttctttggaacatctcgtcctgagggtgaaaccacaattattccttctacctggcatgagacaggattggaattcttcggttcttttggtaaaggatatgcgcgttttgattatcaggcaatgattgttgccggcttgaatgctgatggttttggtcgcgataactgggttgccggtggtaagcagggactctttgaacaagataactttacttcacctgcttatgtagcacgtctggactataaaggggtatcggggttgcgtgcaggtgttgctttttactattgtaatgacgtgacggccaatgctgataagaattataagtatagcagtgtaggccgctcatcagtgaaaatttactctgccgatgcacagtataaaaataaatatgttaccgctcgtggtaatatcatttatggtgatttagagaattcttccaagatcagcaaggttactctttccaataactccaattattatcacggtgctatgcgtaatgtagctaagaatgccctgtgctatggcttggaggctggtcttaacctgagtgctttcttctcgcagaagaaatgtccggttatttatccttatgcccgttatgaatactacaacccgcaggaagaggcagaaggttctgctacaatggagaagcgctgtcaggtaagcaaatggacggcaggagttaactggtttgcattgccgaatctggttgtaaaggccgattatactacccgtcatattggtacgaacaaggtatttggatcgactaaatataacaatgaaaatgaatttgctatcggtatagcttatgtcggttggtttaccaagagatagttcaaataggtatttataattaatttaatgtttaagtaatatgaaaaagtttttttatttgtcggctctttcattgggcatgatgtgttccattacggcttgtagtgatgatgacactacgactatagacgctaaaaatcttgactatacggcggagaatgcaagtagttggggaaattacatgcgagtagttgcacaattgttggtgaatgatgctactgctctttatgatgactgggcggttaaatacaacgaaggtggaagttatgcagatttctttaagaatcaagatgctttgacgagtgttgagcagttgattgacggctgtgtagacattgccaatgaagtaggtactgccaaaattggtgacccttacgatcttttcatacataataatgaagaaaaggctttgtatgctgtagagtcatggtatagctggcattctcgtgaagactatcgtaacaatatctattctattcgcaatgcttattacggaacacgtacaggggctattagcgagttatctctctcaaaagcagtagccgcggtaaatgctaatcttgatactgaagtaaaaaaagcgattgatgacgcagcagcagcaatttgggctatcccgagtcctttccgcaacaatatcaatagtccggaagcagtaagtgctatggaagcttgtgccactttagagggagtactcaagggtagtttgaagagttgtatcgaaggtattgataaaacagtgttggctgaagtcgtaaaaaattatgtggatgtagttgtattacctacttactctgatttgaaagcgggaaatcaggctcttttcgatgctgttgagacattccgtacttctcccagcaatgctaacttcaaggcttgcgccacagcatggcttgctgctcgtacaccgtgggaaaccagtgaggcattcctttttggtccggttgccgacaaaggtcttgaccccaatatggatagctggccactcgatcaggatggtatcgtacagatcctgacttccggtaactattcagacttgaactgggatggtgactatgatgaagaagatgataaaattgccggtgcacaagctttgcgtggttaccacactttggaatatttgatcttcaaagatggcgaagcccgtaccattcagtaagatttttacttgttagaaatcagattttgcggaaacagtgggataatgaatattctgttgtttccgcaacatctgcgttaaaaagataaatgttagttacgtattttgcaataataattcaataacgaatgaatggcttattaaaatactcatttccaatctgtttttcgcttctggcattgtttgcctgcgaggatgatggaattgatgtggataatatagaagtacctgccggctttgccctctctgccggtactgctaccaacttcctgacttcctcttatgcttatgacaggtcggctgactggataacaggggcatacgataaacgtttcacccgtggtgacaaattgtatgatgatatccgcaccagtagtaatggaataggtggaggactgggaccggtttatgccggttattcttgtggtagctgtcaccgaaatgccggacgtacgcaacctactttgtggagcgaaggtggttccggtagctccggcttttcgtctatgttggtttatattagtcgtaagaatggagctttctttcaggattatggacgtgtgcttcatgatcaggctatttatggtgtgaagcccgagggaaaactgaaagtggaatatacctatgagactttccagttccctgatggtgagacgtatgaactttgcaaacccaattattctatttatgaatggtatgcggacagcatcaaacccgaagacctgttctgtacggtgcgtattcctctgcgccacgtaggtatgggacaaatgatggcgctcgatcccactgaaattgaagctttggctgctaaaagcaattatccggaatatggtatcagtggccgttgcaactatatctccgagagaggaatgagaagtttaggcttgtccggtaataaagcacagcatgccgacctgacagtggaacttggtttctccagcgatatgggagttacgaacagccgctatcccgaagaaatctgtgaaggacaggcacaagtaaatcaaggcagtatgatgggactttcttatgcccagttggatgtatctacggaagaaatggagaatgtagatctctacatgcagagccttagtgttccggcacgtcgcaatgtgaataatgaacaagtgatcaagggtgagcagaatttttataaggcgaagtgccatctctgccatgtaaccaccttgcacacaaaaccacgtggttctatactgctgaacggaacccgccttccttggctgggtagtcagacaattcatccatattcggacttcctgcttcatgacatgggctctgaaattatgggcgtaggactgaatgataactatgtaagcggtttggcccgtggcaacgaatggcgtacgactccgctttggggtatcggattgcaggaaactgtgaatggtcatacttacttcttgcatgatgggcgcgcccgcaactatattgaggctatcatgtggcacggtggtgaaggtgaagcatcgaagaatctcttcaaaaagatgagtaaagaagatcgtaatgctttggtcgcatttctgaaatcattataaaacaaataacgaacaataaaaccaataagtattatacaagcaattatgaagaaattaattttaatggttgtaatggctgccctttcgttggctgctatggcacagcatgaagaagatacagaaaacggtgtagtgtcacttgccggaagagagggatttacgatagaaaccaagaagggagactttgtattcaagccctatctgttggtacagacttgtgcaaatttcaattggtatgatgatgaaggcctggataaggcatacaatcaggataatgtagctaattccggtttctcaattccctatgctgtattgggcttcactggtaaagcttttggtaaagtagcctttaatctttctatcaatgcggctgccagtgggggagcattgcttcaacaagcatggttcgatgtgcaacttaaaaaacagtttgccgtgcgtgtcggtaaattcaaaacacctttctcacatgcttatctgacgacgttgggcgaaacattgttgccgcagttgccagtatcattgacttccgccatcattctgccttattccttgaatgcggtaacgcctaacatcggtaccggttttgacctcggtgttgaaattcacggattgttagctgataaatttggctatgaagtaggtttattcaatggtaccggttcttctgtaaatacagctacaaaaactctgagtgatgattggcatattccttctttactgtatgcgggacgctttacttatatgcctaaaggtgtgatgccgtccacccaaggtaatcctaaccgtttgaatgaagataagatcatgttcggtgtatcggcttcaatcaatgtggaaagtgagaatgaaagtaccaatgatacccgtgtgggagtggaatttgccatgttaaagaataaactgtatctgggcgccgaagcatactatatgaatgtgggcttcaccgatcgtcagaaaataaatgagacatacaattacctgggtggttatgtacagggcggctactttgtagctccccgtttgcaggctgccttgcgttatgacttctttaaccgtaacggtaccagcgatgacggatttctgaatatgccggctgtgggtgtgaattatttctttaagggttgtaacctgaaactccaggctatgtaccagtatattgcccgtacggggcacgatacacagctcgaccgagataatgataatttaggtctggccactcattctgcaacagtaatgctgcaatatactttctaaaaaaacaaagagagtagttatgaagaaatgtatattattctttgctgctatctggatgacactctgcttctgttcatgtgatgatggaagaatctatgagaaggagatagaggtgcagcgtggtggccgagtcctaaagttgacaggtcgtttcagtggtatcagcaattggacggatgattatagtgtcgttgtggcaggcttcaatgataaaagtgaatacgctgttataacgaaatcactgccagtcaatgtaaccgacggaacagatatcgttatgacactgggaggtatcagtgatgaagtgaaatcactcaaattgtgtgttatcagtcgtctgcgcgaatgtattgtcgaatttaagacgatggaagatgaagaactcgcagctattacagatactatattaatggatgtgggaacactggacgtgggtatgttcagttccatccagtcacaggttttcgataaaagatgtgtagcgtgccatgggcagaccggttctgcatcgggtaatttatttctgacggagggtaagagctatcatgcgttggtcaaccagccggcgcataagaatagtgatatactattggtgaagcccggcagtgcagaagagagttttctacatctggtcttgaacagggctggtgatacgagtatgaaccataccgatatgctgtcagaagatgagcaacccttattgaaactgatagataattggataaacgaaggtatttttttgaataacgagtaaacgatattggaaatgaacaacaaaaaacaaccaaccaatcaatcagagaatacattaaccgagatttttaaatatgaagtaaaagaaggcgtttcagagtttcatgtaatgattcactctacccggccggaagacacttatgaagaacaattaaatgcagtagccaatgcctacaatgatttgcttgcaggtgaattgaaaggtgccatggctgtgtttaaacgttattttctgagtgataccgccaatcaggctgacctcctgctggctatcactaccgaaagttccgactgtgctctttccgtggtagagcaaccccctttggatgggacgaaaatagctttgtgggcttatttacagaccaatgtgcagacacaagtgctgcacaacggattgtttgaagtaaagcacaatgcgtaccgccacctgtggggaggcagtgttttcaatcgtgccgcaaattctgagtaccagacccgtttgttgctgaatgactacgcgatgcaacttatggaacaaggatgtaaattggcggataactgtatccgtacctggttcttcgtacagaatgtggatgtgaattatgccggtgtggtaaaggcgcgtaatgaggttttcgtcactcagaacctgacggaaaaaacacactatattgccagtacaggtatcggcggacgtcatgctgatcctaaagtattggtgcaaatggatacctatgctgtggcaggcttaaagccggaacagatacacttcctttatgctcctacgcatctgaatcctacttatgagtatggtgtcagctttgaacgcggaacgtatgtcgattacggtgaccggcgtcaagtgtttatttcaggtacggcaagtatcaacaataaaggggaagtagtataccccggcgacatccgtaggcagacggaacggatgtgggaaaatgtagaagccttgctgaaagaggcggagtgcacgtttgatgatttggggcatatgattgtttacttgcgtgacattgcagactatgcagttgtgaagagtatgtatgacaagtgtttcccagatactcctaaagtatttgtacatgcgcctgtatgccgtcccggatggttgatcgaaatggaatgtatgggagttaaggctttgaagaataaggaatatgcacctttttaatctgaagaaaagtctcgtctccttatatatctgtctggtggctttacttgctgtggtgacctttgtggagcatgtacgcggaacagagtttgtagaaaagtatgtttatcatacagtttggttttgttgtttgtggggagtacttgctgcattggcagttgtcgtgttggttaagcggcagttgtggcggcatctcccggcattgttgttgcatggctccttcctttttatcttggtgggagccatgattacattttcatgcagcaagaaaggatatatgcatctcacagtaggcactgaggtgggaactttcatagaccaagacagtaagcgggtgatcgaattaccattcacattgtgtctggacagtttccgggtggagtattatccggggacggaggctccggcagattatgtcagctatatccgggatgcggaaccagtttccatgaatcgtatcctctctcgtcaggggtatcgcttttaccagtcttcttttgatgatgataaggaggggagttggttgtcagtgaattatgatccgtggggaataggggttacgtatgcaggatatattttgctgggtatctccatgttgtggatgcttgtcggtcgcagtggagaattccgtagattactcaggcatccattgcttcggaaagggggaatgtttgtgtggttgctcatggctgtggtaacggtggtgcaagcagaaaacagaagccttccggcacttgcactcaggcaggcggatagtctggcattcaaacaagtgatttatcatgatcgcgtagtaccttttaatactcttgcacgagactttgtattgaaactgaccggaaaaccttcttatggtggtatgacacccgaacaggttgtcggaggttggctacttcgtccggaggtttggcagaatgaaccgatgatttatataaagagtgcggaacttcgtcatttactccggttatcgtcttcttatgcccgtcttactgatttgtttgatggacaaaactatcgattgcaggaattttggaagggtggacaaaagccacatatgaaaatgacttcgttggaaaaggctatcatggaaacggacgaaaaggtaggattgatactgatgctacggagtggaacacttatccatcctttaccggaagatgggagtataaaaccactatctgacgtaaaagtgcaggctgaaatattgtacaatcgtattccattcagcaaactgttgttcatgttcaatctgactgtagggatgctggcatttttctatttactttattgcagcatgcatcgttcggcaggtaaggcatggagcgtttttacagttgcactttatgcagcattcctttttcaactctttggctactgtttgcggtggtatgttggcggacgtattccgttgagcaatggatatgaaaccatgcaatttatggcactgtgtacacttctgcttgcatgcatattccggtgtcgcttctcttttacgttgtcttttggattgctcatttcgggttttgccttgttggtagcttatcttgggcagaacaatcctcagatcactcctctgatgcctgtgttgctgtctccctggttaagtattcatgtttctctgattatggtatcttatgcattgtttgcctttatgatgctaaatggattactggcattctgcataggaggttggcgaaaaaaggcaatcgattcggagattcaggaacagcgtaaggtccgtgtggagcaattgatgcttttcagtcggttgatgctctatccggcagtattttgtctgggggcgggaatttttattggtgctgtgtgggcaaatgtttcatgggggcgttattgggcctgggacccgaaagaagtctgggctttgatctcctttttaatctatggtgcggcattccacggaccatcgcttgccgtcttccggcaaccccggttcttccatgcttatatggtgttggctttccttacggtgctgatgacttacttcggagtaaattatctgctgggcggtatgcatagctatgcctgattatctttctattttcggatgatataataaaaatgcctgcggaattcgcctatgcacccaaagagaacgcccggtacgtgttttccgggtaggggcaggccggctcccccccgtatcagcgtgaccgtgccggaagaggtgagccaacaggaggacctgctggtagcccggtcatctgagctcgggggaaacagtaacacggctgttgcactgaccttcaaccatgcactgaccgccgtcagattcgtgtgcgggaatgatatgcgggaaggtacggtcaagcaggtccgtttgaaaaacgtttattccagaggaacttacaatatggggacacaaacctggagcggtttggatactcccgcctccttctcacaggcattggataaagtgacgacaggaacagctgacgaggcgctcacgagtgaggcgcagacctttatgatgctgccccagcggtttcctgagggcgcgcagatagaagtcttattcacagacgacacccatacaggccacactttaatagccgatataaaaggaagtgagtggccgatgggcaagactgtgacctacaaaatatccagtagttctctcaactggacttacacgcttgatgtcactgccctggccgattttacatataccggtggtacacagcaatattgtgttaccagttacaggcaaaacgcccaaggggaaaaagaagctgccgaatggaccgcacaatatgcagaagacggaaccacgtggacagacaccaagccggtatggcttaccgcattcacggcatctggtaccggcggtgaatttgcgcaaccttgtgatgcgacggtcgaggcgcagaccggaatatcaaatgatttacatgagaatgctttgaaggcggccacagccaagggatcggaaaccacaccgtataacctttccaacaacaccggggggaatactgttgagaacactgccaactgttacgtggtcaacgctcccggttactattctttgccgctggtatatggcaatgcgatcaagaactcagccacgaacgcttccgcgtatacctccacggtgacaggaaccaatatcctgaatcctttcatcaaccatgccgggaacgggatcacggatccatacatcagcggtaatggatgtacgccggccaaggccgaactggtctggcaggatgcgatgaacctggttacggatataaaatacaatgccgattccaatggcggcaatatctctttcaaagtggaccgttcttccatccggcaaggcaatgccgtcattgcgatcaaggatgtgagtgatgccatcctctggtcctggcatgtctgggttacagacgaagacattaacaatgtgattgagataaccaatcatcaaaacgtaaaatataattttatgcccgttaatctgggacaatgcgacggtaataccatcacctatgaagaacggagttgcaaggtaaaattcattgccggggaccagagtaaggaaataaccatcaagcagttggcgaacgtaatcgctaccggaagtaatgctcctttttatcaatggggacgtaaagatccgctctacccttcgaacggaatgggtaacacaaccaaaatctggtatgacaaggagggaattccatctacagcaaatcctatgaaaggaaccttttcggccgggaatgattgtatcaagaactgtattctcaatcctaatctgatgcacaatagatataatggagattatacctattacaacctgtggagtgccgataataaaacaacttctgccaatgacaatcctgttaacaagactatttacgatccgtgtcccgttggttttaaacttcctgccagtaacgctttcacaggatttaccacaacaggagaaagtgtatcatcttccactcaagttaacggtacctggagtagttcggaaaaaggttggtatttttatacaaattccgaaaaaacacagagcattttcttcccggcgttagggtatcgtagttattccactatgcggccaggtagtatcgggacacagggttgcttctggtcggcacatccggtagcgaagggcaataattattaccttagaactagctcagtagacgtacagccaacatatatggtcgatcggggattcgggtatgcgctccgtccttgccaagactaaagggttgcaataaaaacaaggagctgcttactaacacagttgcagctcgagaaagaacacggcacagagggaaaaaaggtaagtcaaattagccgaagcggagaacatgattcattgcttcggctttttctcatctatgtttggaactcatcagcgtctttccttagctcccgagctgtttattgagcagctttacacgctttcagcgtttctttctacttccttctgtcgtactcagaatcgatcacagaatcggttcggttccggatgaatccgttatctctctactagttgcatttgatttccagcatatcaaaggctctcctctacttccccccacatcaacaaataacggtatttcacattattatcctgcactcgttgcatccactgcggttttcccactttttatcactaactttatagataaaatccctccgaagagaattgccaatgacacgatcaggaaatactcggaatgggaaatatatgggagaggataaaaggagatatcatac

SEQ ID NO: 195 - DNA, 13089 bp, Bacteroides thetaiotaomicron
atcaatatcagtaattatgaaaaaacattttatttcgatggcagttaccgctacgatccttgcatcctgcggtggggccaaaacaacaactgccgaggcagataaatttgattatacagtggaacaatttgcagacttacaaatattgcggtacaaggttcccgaattcgaaaccttgacgctgaaacagaaagaactggtttattacctgactcaggctgcgctggaaggacgcgacatcctgtttgatcagaacggaaagtataacctgagaatccgtcggatgctcgaagccgtttacaccaattataaaggagacaagtcggctcccgacttcaaaaatatggaagtgtacctcaaacgggtatggttctccaatggtattcatcatcattacggcatggaaaagtttgtgcccggtttctcgcaggacttcttgaaacaggcagtgctcggaacggacgcccaattacttccgttatcagaaggacagactgccgaacaactctgtgatgagctcttcccggttatgtttgatccggctatcctggcaaagcgtgtaaatcaggcggacggtgaagacttggtgctgacttctgcctgcaattattacgacggagtcactcagcaggaagcggaaagcttctacggagcaatgaaagacccaaaagatgaaactccggtttcttacggactcaacagccgattagtgaaagaagatgggaaaatacaggaaaaagtctggaaggtaggcggactttatactcaagcgattgaaaagattgtgtactggttgaagaaagcggaaactgttgccgaaaatgatgcacagaaagctgtgatcagcaaactgattcaattttacgaaacaggcagcctgaaagacttcgatgaatatgctatcctttgggtgaaagaccttgattcaagaattgacttcgttaatggctttacagaaagttacggcgatccgctgggagtgaaagccagctgggaatcactggtcaacttcaaagacttggatgctacgcaccgcacagagattatcagcagcaatgcgcaatggttcgaagatcattcgccggttgataaatctttcaaaaaggaaaaggtaaaaggggtatctgccaaggtgatcactgccgctattcttgccggcgacttatatcctgcaactgccatcggtatcaatcttccgaacgctaactggattcgtgcccatcacggctctaagtcagttactatcggcaatatcacagatgcttataataaagctgcccacggtaacggattcaatgaagagtttgtctgcaatgacgaagagagacagcggatcgaccaatatggcgacctgacaggtgaacttcatacagacttacatgaatgtctgggacatggttcgggcaaattgcttccgggagtagaccctgacgctttgaaagcgtatggttccactatagaagaagcacgtgccgacctgttcggattgtattatgtggccgacccgaaactggtggaactgaaacttgttccggatgcggaggcttataaagctgaatattatactttcctgatgaacggtctgatgactcagcttgtacgtatcgaaccgggaaataatatcgaagaagctcatatgcgcaaccgccagctgattgcccgctgggtatttgagaaaggtgctcctgacaaagtggtcgaaatggtgaagaaggatggaaagacctatgttgtagtcaatgattatgagaaagtccgtcagttgtttggtgaactgctggctgaaatccagcgaatcaaatcgaccggtgattttgagggtgcccgtacattggtcgaaaattatgccgtgaaggttgatcctgctttgcacgccgaagtgttggcacgctataagaaactgaatctggctccttacaaaggttttataaatccggtttatgaactggtgactgacaaggatggaaatatcacggacgttaccgtgtcttataatgaagactatgtagaacaaatgttgcgctacagcaaagattattctccgttgccttccgtaaataattaatattgaaaatggatataaaagaacaactgaaggatatcaaaacacagctccgtctctctatgaacggggctgtgtcccaaagtatgcgtgagaagggattggtatacaaactcaatttcggagtcgaaatcccccgcataaagatgattgccgaagggtatgaaaagaaccatgacctggcgcaggcattgtggaaagaagacattcgcgaatgcaaaatcatggcagccatgttgcagcctgtggataccttttatcccgaaatagctgatatctgggtagaaagtatccgtaacatagagattgcggaactgacctgtatgaatcttttccagcatttgccgtatgcccctgctaaatcttttcattggatggctgatgaacaggaatatgtgcagacttgcggtttcctgacggctgcccgtcttttgatgaaaaagggagatatgacagaaagagcctccggcgaattgctcgatcaggcactttgcgctgttcattcagaaagctatcatgtgcggaatgcagctcttctggctatccgtaagtatatgcagcataacgaagaacacgctttccgtgtttgccggatggttgaaggaatggcagattccacagtggaagcggagcagatgctctataatatggtaaaagaagaagtggagaataagtaataggtaataagtaataggtaataccatgcgggcattcgccggatggaattttaagtaactacggttattacctattacctattacttattacttatttctcagaaattcttttgctttccacaaaaaaggcttaactttgttcgcgctaattttgtgctgatgatggaaactcaaaatgtgaaagatacagtaaggcagatattcacagaatatctcacggcgaacgggcatcggaagactcccgaacgttacgccatactcgaaactatctattccatcgacggacacttcgatatcgatatgctctattcacggatgatggatcaggagaatttccgggtgagccgggcgactctttataatactatcattctgctgatcaatgcacggctgatcatcaagcatcagttcggcacttcctcccaatacgaaaaatcatacaatcgcgagacgcatcatcatcagatatgtactcaatgtggtaaagtgactgagtttcagaacgaggaattgcagcatgccatcgaaaatacaaaattaagccgctttcaactttcgcattactccttatatatatatggattgtgcagcaagtgcgacagagctaataaacggaaaaaagtcagtaacaacaataaaaaagaaaaatgaaagtagatgttctattaggattacaatggggcgacgaaggtaaaggcaaagtagtcgacgtattaacacctaagtacgatgtggtcgctcgttttcagggcggtccgaatgccggtcatacacttgagttcgaaggacagaagtatgtacttcgttctattccttccggtatttttcagggagataaggtaaatattatcggtaacggtgtagtgctcgatccggcattgttcaaagcggaagctgaggcactcgaagcatcgggacacccattgaaagagcgtttgcacatttctaagaaagctcatctcatccttccgacacaccgcatactggacgctgcttacgaagcagccaagggagatgcgaaagtaggaacaaccggtaaaggcattggccctacttatacggataaagttagccgtaacggtgttcgtgtaggtgatatccttcataatttcgaacagaaatacggtgcggcgaaagctcgtcacgaacaaatactgaagagtctgaactacgaatatgacctcacagaactggaaaaagcatggatggaaggtatcgaatatctgaaacagttccattttgtagacagtgagcatgaggttaacaattatctgaaagacggcaagagcgttctttgcgaaggtgctcagggaacgatgcttgatatcgatttcggttcgtatccgtttgttacttcttccaatacggtttgtgcaggtgcctgcaccggtctgggagtagctccgaaccgtattggcgaagtgttcggtatcttcaaggcatactgtactcgtgtaggtgccggtccgttcccgacagaactgttcgacgagactggtgacaagatgtgtacattgggacatgaattcggctctgtaacaggacgtaaacgccgttgcggatggattgacctggtagctctgaaatattccgttatgataaacggtgttaccaaactgatcatgatgaagagcgacgtgctcgatacattcgataccatcaaggcttgtgttgcttataaggtagatggcgaggaaattgattatttcccatatgatatcactgaaggtgtggagcctgtatatgcagaactgccgggctggaagacagatatgacaaagatgcagagcgaagatgaattcccggaagaattcaatgcttatctgactttcctggaagaacaacttggtgtggaaatcaagattgtatctgtcggaccggacagagcccagacaatcgaacgttatactgaagaataagaaatgttattctattcctagaataactttgttctataacttaatgagaggcggagaaatggaaatgactccgcctttttgttttctctttacccccaatattaactataacgcattatgaaaacacatttcatcactttcctattattagtaggtatgagtctgggaatctcctcccggctccacgcacagtcttcttaccagcctggtgaagaaaacctcaaagcccgtgaagaatttcaggataataaattcggtattttccttcattggggactgtatgccatgcttgccaccggtgagtggactatgacaaataataatctgaattataaagagtatgccaaactggcaggcggtttctatccctccaagtttgatgcggataagtgggtggctgccatcaaagcatcgggagctaaatatatctgtctgacttcccgccatcatgacggcttctccatgttcgatacccaatattcggacttcaatatcgtgaaggcaactccctttaagcgggatatcatcaaggagctggcagcagcctgtagcaaacagggaatcaaacttcatttctattattctcatcttgactggacgcgggaagattatccttggggacgtacaggacggggtacaggacgttcgaatccgcaaggagactggaaaagctattatcagttcatgaacaatcagttgacggaactgctgactaattatggtccggtaggagccatttggtttgacggatggtgggatcaggatggaaaccccggctttaactgggaattgccggaacaatatgccatgatccataaactacagccgggctgcctgataggaaataaccatcatcagactccttttgccggtgaagacattcagatattcgaacgtgacctgcccggagaaaataccgcaggactttccggacaaagtgtaagtcacctgcccttggaaacctgcgaaacgatgaatggtatgtggggatataagattacggatcagaattataaatcaacgaagacactgattcattatctggtaaaggcagccggaaagaatgcgaacctgttgatgaatatcggccctcagcccgacggagagcttccggaagtagccgtacagcggttgaaagaaatgggagagtggatgaatcaatatggtgaaacgatttatggaacccgtggcggtgcggttgctccgcatgattggggagtgacgacgcagaaaggaaacaagctgtatgtgcatattctgaatttgcaggataaagccctgttcctgcctttggcagataagaaggtgaagaaggcagtactgtttaagaacggcacacctgtccgattcactaaaaataaagaaggcgtgttgctggagtttacagagataccaaaagatattgattacgttgtagaacttacaattgactaatttttagctaattcttcataaaagcatagggaaactatcgttacatacgtagtttccctttatttttggcaaacaatttgtttatatagatatagagtaataattaaaatgaaaagtatatgatgtcttattgggtattatttattggtattgccgtagcaagttggttggtacagatgaatttgcagaacaaattcaagaagtattccaaaattccgacaggaaacggtatgacaggacgcgacgtagctctgaagatgctgcacgacaatggaatttacgatgtacaagtaactcatacacccggtcagctgaccgaccactacaatcctgctaacaaaacagtgaatctgagtgaaggtgtatacgaaagtaatagtatcatggcggctgccgtagcggcacacgaatgtggacacgctgttcagcatgcacgtatgtatgctccgttgaaaatgcgcagcgccttggtgccggtagtgaatttttcgtcctctatcatgacttgggtattgctgggcggtattctgctgttcaactccttcccgcaattattgtggatcggtatcattctgtttgctaccactactttgttcagctttatcaccttgccggtggaaatcaatgcaagtaagcgcgcgcttgtgtggctgagttcatccggcattactaattcatacaatcatacgcaagccgaagacgctcttcgctctgctgcatacacctatgtagttgctgcactgggttcattggctacgctgatctattacattatgattgctatgggcagaagagactaagagataagattaatcgttttgacgcctccatcgttttcaaagactatggaggcgttctttttttattgatgttttttttagatatatgcaagcgttgctcggaaatttgcagtaaatttgcgcaattaaaatactaaacagtaattatatcatggcagcaaaaccaagtattcctaaaggaactcgtgacttttcgccggtagaaatggcgaagcgtaattatatattcaatacgattcgtgacgtatatcatctgtatggtttccagcagatagaaactccgtcgatggagatgctttctacactgatggggaaatatggcgatgagggtgacaaacttctatttaagattcagaactccggagattatttttccggcatcacggatgaagagttattgagtcgtaatgctgttaagctggcaagcaaattctgtgagaaaggtttgcgctatgacttgacagtgccttttgcccgttacgtggtgatgcaccgcgatgaaataactttcccgttcaagcgttatcagatacagccggtatggcgtgcagaccgtccgcagaaaggacgttaccgtgagttctatcaatgcgacgctgatgttgtcggcagcgattcactgctgaatgaagtagaactgatgcagattgtcgatacagtattcagccgtttcaacatccgtgtgtgtattaagatcaataaccgcaagattctttccggtatcgctgagattatcggtgaagcggataagattgtagatatcacagtggctattgacaagctggataagattggtctggagaacgtcaatgcggaactgaaagagaaagggatcagtgatgaggcgattgccaaattgcagccgatcattctgctgagcggaaccaatactgaaaagctggctacactaaagagcgtgctggcagccagtgagacaggcatgaaaggagtcgaagaaagcgaatttattctgggcacattggaaacaatgggcttgaaaaatgaaatcgaacttgacttgacgctggctcgcggattgaattattataccggtgctatcttcgaagtgaaagcgctggatgtgcagatcggcagtatcaccggtggcggtcgctatgacaacctgacaggagtattcggtatggccggtgtgtcgggagtcggcatttcttttggtgcagaccgtattttcgatgtattgaatcaactggaactttatccgaaggaagcagtgaacggtacggaattgatgttcgtaaactttggtgataaagaagctgctttctccatgagtatgctggcaaaagttcgtgcggcaggtatccgtgcggaaatcttcccggatgcggcaaagatgaagaagcagatgagctatgccaatgccaagagtgttccgttcgtagctatcgtaggagagaacgaaatgaatgaaggcaaagcaatgctgaagaatatggaaaccggcgaacagaatcttgtttcggtggaagaactgatagctgctttgcgcaactaaaagcagggtatagagtaagaatatccgcttttccggtgaagtacttgacaaatgactttttatgttgtatctttgagaaaagaaaaggcataaataagatgaatgtaataagaaaaatagatacataaatatcacctttatactgttacttataagtatcagaagaacttggaatggggcaatgatcagatgattattgccccattttgtcgttaattatgcctgctacatttcgtctcttacttaaaaagggacgaatatcgtttttaataaacttgggtaccgtttataataaacgtgcgataagtttattataaacagaatccgtgtttattaaaggccgtttttgtttttgtaaagatataaggatgtggtttcgaatgaaaactgactatcggaaactatatagaatggaatggtaattatatgtaacaattacttttggggatcatattctcggaaggcttaattctacttcttaattaaaaactttggatattagtttttagattagactgaaaaggtaaggagaaccggacagtaatttctatctttgtgcatacattaaatcgttagcaaatatatgaaaaacgacaaactccaaagtagtatgaaaacaataaaaaacacgttttttctaagcatagtctgtgccgccagtgttgtttcttcagtagctcatgaactcgaagcaaatgagaaataccccgggaagtcggtgaaggcacagacaagaaaagagattgttacgttcttttctgaatctctttccggtaagacaaccacttttgacgcaggaaaaccgttgaaactgtcagaagtagaacactatcgtgatgtcgtatggcagttgtggaaagaggcaaatgatggttttaaagaagaaaaattaatagctttggatacactctcatccgcttctaccggctactggaaacttcctgatagtttggaacccaatgcagtgatgccctattactggggaatgaaagggacagatgaaataggaaatgaacttccattattcctctatctgcatggttcgggacccaaagagcgggaatggagtaccggattgaatatttgccggaattttgatgatgctccttccgtttactttataccacagattccgaacgaaggcgagtactatcgttggtggcagaaagctaaacagtttgcctgggagaaattgctgcgacaatccttactcttgggaaagattgatcccaacagagtgtatgtttttggaatctcggaaggcggatatggcagtcagcgtctggcctcattttatgctgattattgggctgctgcgggaccgatggcaggaggggaacctttaaagaatgctcctgcggagaattgtagtaatattgctttttctttgcggacaggagataaggatactggattctaccggaatacactgaccggatatgtacgggaagcattcgatagtttggcgcatcagcatcccggctatttcactcacaagatagaactgattcccggaatggggcatagtattgattatcgtccgacgactccctggctgaagcaatatgtccgtaatccttatcccaaatatgtaagctgggagaattttgaaatggacggactctaccggaaaggattttataatctgtatgtgaaggaaagatccgatgaagaggggaagtcgcgtacttattatgaaatgagtatttcgggaaatcatatttcattgaaagtcgatgatgttgtttatgaagccacggagaaggatcaacgatggggaatagagatgaagtttgcgaagaaatatgcgcaggcgcataaagggaaagtggtcatttatctctgcgacgagctggtcgatttaactgaaaaggtgactctgacggtgaatggcaaaaaggttttcgagggaaaagtaaaggctgatttgaagaatatggttaatagctgtgcggtgttcttcgatccgcaacgactttatccggcagctatcgaggtagaattaaaatagatgagattgctcaaaaaaaagtatccccggtcgtatatccaagaattactcttgtgtacgaccggggatacgtatttatcataaattataaatggcgttccggatacatttccttccaccattccggctgatcctgtagccaacgggcaaaccatgccatgatggaattatgccatttgattcgcttgtcataatcggagatgaaatggttttctccgtctacggtcacgaattctacagtcttgccaagtatcttcaaagcgttgaaaagctggatactttcaccgataggtacattggtatctaccgtaccgtgtagcagcagtaacggagtgtttatcttgtcggcgttgaacagggagccttgtttggtgaacaagtccgggtccttccacgggtaactgtcggctgcggcgatggcattgtaggaatacccccagtaaccttccccccagtagctggtcacgtcactgattccggcgtgcgacacggcagcggcgaaaatatccgtctgcgtctgtaaatactgcgtcatgaatccgccataagaagcaccgagacatccgattttcttttcatccacaaacggatgctctttgcagaattgcttcgtgccttcgatgatgtcatctgctgtacgtttgccccacgcattgacgtggcgggcggagaattcctgtccgaagccaatcgttccgctaggctggatgacgtagaccacatagtcacgtgaagcgaataattgtgcgcaatacggattactgattccgcgggtagtcggagtcgtaccgccatagtaatatacgatcatcggatatttcttgttcggatcgaaattcggaggcaggcacatcttgccagtgatgacagttccgtcggaagcggtaaagttccacggctctgttttgcctaattctattttctccagaatcggtttcatcggatcggcaagcaggctggaagtttttttcttcatgtcatagagataggctactccggcattgtagtccgattgaccgatgtaagctgcgatgcccggattgtattcggacagagcgaaagcgctggtaacatccgtttcaaggttcagcttctcaaattttccgtccttcggagaataacgatagatgtttttgcaatcgccatcgtccgtattgaaatagatgcacccatcgccatgattccattgcagagggctgactgtcggattaaagtctttggtaatcggctgtatcttgcgggtactcaaatccataataaaggcttgagtatcgaaatcattggcaatagggtggttgccacaattctttccgatgccgccgaacgcttcggggctgccggtcagcaatagctgcttgccgtcaggagagtagcccgcgcctccaacaaagcgatcttcatagaaaagggtatccactttcaacgtttccaaatctacctgataaagtgaggacagagagaacggacgttgagtgatgttttctttggatgtactgtataacatgtattttccgtccggagaaatatcttgcagatatgtgctgtggttgccataagtcaggcgctcggagataccgtcggccaggttgtatttcgcaaggaaactccgtccgcgagaattgggaatacggtctgcaggacttacgatgcggcggagaggaccatcttctttgactccttcttcgcggggatagtaaatcagaaaatcttcgttgggcgaccatctgaaactctgttcgggaatactttgcaaaattgtttcttcgcggagtgtggcagggtcgagggtgattacgtcatttcctgtcagggcggttactgtgtagtatagtttatcacttttgggcatccaactcatgccgtctctgagattggtcaggagtacttttccgctctttagttccgtcagttcgcaataagtgcgtgagcgtttggcggcgtggttatcccaataacgggtcaacagatactttccgctgggagagatggaaacagcgatggcacggttgccataaactgtattgtctagagaaaaacgcttctttgcttccggatctagattgcaggcaatgtctttgaatttctcgtctttgatcagttcgcatttcagcgttggtgccgctttgtcatcggaagcagaaagcagtttgatgattatctcgtaatcccgctccggttcaaggctgagagcgatgtcacgtgatgagccggaggtgatgctgtcttctgccgcatcctttacttgcttggaggctccgtcaatgaagacttcccagcggacgggggaggtgattttcaacttccctttcaggaaacgttctgcacgaatctgagtcttaaccagataaagtttattgtctttatccgctttctcgaagctgagatacccggctgtgtccgcagtgagcgactgcatcggcgcatccggcaaatgtagtacgaccggggtttggagtaacatctttttggtgtgtttttctcctttaggattgatgctgtcgttcataatgggggtacgaacgctgatggcattccggactttgtactgtgtcagtcggtcttgtgcttgcatagtaacaccggttgccagaaagatggccaaagccatagttctctttttcatttgtttatgtctaaagttaataaatatttgattgcgtgactaatat

SEQ ID NO: 196 - DNA, 13005 bp, Bacteroides thetaiotaomicron
gtctatatatataaaaaagaggatgcccgtgggaaaaatgtgaggggcatcctctgtaaggaacagagatcggaaaagaagactttcacaagcattgctttccatctgcaccttgtggggttatcttcactaacaagtgaagaaagggttcattgcagaagtccgggctttcacaagtacgggcttcctcttttacctcccatacaggtccctcatacttttattaatagaatagaggaatggggtatatacccgcatgagaagtgggaaaatattattctgcaatacagacgcttacccggttttcttcaggcacccggaaaggctgtactgtatctcctttgaaatccgtaacgattctgtccgccgctattcctttggctttcaaggcatcggcaacaatcttcgcacgtttttcggataaagtcatattgattctcggattaccggtttctttgtcggcatatccggttatggcaactttgcttgccggatacttttccatgtatgccaccattgcatcgatcttcgattgctggtctttctggagaagtgcggagttcagagcaaagaatatattctgtttcataggttccactaccactgccacagattccggttcgggctgtttcacgacaggttgtggttttggttgttctactatcggttccggttcataatataccggagctgttttcttatagctttttcctaatttgatgttcaggcccactaatacgttaaattgccagtcgcagttgcctgcctttttcgagttgaatttgtcggacagtgcatttgcgtttccttcaatattgatagccagccggtcattgaggcgcagatcacatcccagtcccatacgtccggctataagattttgtttgtcctgccataaatactctaattcatgagatcttgtgtccagtgcgtttgcttcgtcgttgtcgaaagcatgattcaatcctgcaccgccaaaaatatatgcgttgaatacacgtttaggattaaaaccacaaaataaagtactaagatctgccatgatatccagattgccttgcagatatttgtattgataggtttgagaaggagtgacccatcctgcctttgcctgccaaccgcttacgcctaaacgggctccaaatgcgggtgcaaacttataccctacattaacggctgctgccggagagatcagatctgtaaaatcggcttcgcctaccgtatgcgcagctccagcctgaacttgcataaaccaatgaggtttgaacactgtcttgccctcttccttgatttgtcgctgttcctgagcgaatgctactgtgctgctgacagtaagtatggctactagtaaatttcttattctcataattttatatatttaatgtcttatcacagagtattccacagaatgtacttgttatggtgaaaagggtgctcttttctgattagagcaccctttttgttattgaatgtctaagaattcattgacatttcaattcttagttcttcggattaactgtaatagtcaatgtagaagaagtagttccccagccataatttactgtagcaggaatgaatatctgataagtatatccaactggtgagctaacatttacatatttcactgtgttaccttcctgaaccaaagtagcaccgtcaggcaacttgttaccgttgtattccaagcttgtagttactttgttcaaatccagtgttacatcgccgaacggaccatagaagaaccagtattgtccaggattccaatccggtctgccccactctttcttcgtccattcccaacatcctgagatctgtccgtaagatgttccttcgaatgcaggcttttcagtgtgtttgtgaggaaccattgtccagttaccttcaacccacttgtaaactgccggtacgtagttgatactcttcacatagtcgtactcaatagtagtgcttgcaggtttagaaacttccgtatatataatatcgccatctaattcaacatgtggatatatcaacggccatccagctaatttctgtgcttcaagagaggcgtcaacttctgcctgagtcaagaactcttcagttgtgtaagtcttcttagtagatccacccaatctgttatagtatctataagtagccttacctgtatacatagtagtcacagtagtggtagtaaacttaatcgtaccatattctacatccaactgagccggtgtaaccatttcttcgtgaccttgaacatattcgaattcaggagtacaaactctcttccagtaagaatgaacattttcaacccatgaccagctatccttcacaattgcttcgtttctccagtcagtcaacagaccattccattggaagtcagcaacatcaccgccagtcttagcgtctattactgcaataccgctcggcatgttcaagttaacaggacggataaagtcaaccataaattcgttcacagtcacttcgtcgccattgctcatcgtgtagatgtgtgcaacgacagcttgcagaccgtttgcgctgttcaacgcagccttcacagcagcattgctcttatccaaagtgatatagttaccgtcgatctgaacaccagacattacaggagaagtcaagttaccgttagagtaagtcttgattactttgtaacgagcagattcgcaacccggaagtcctttcacagtgtaagcagagtaagcttctgtcaatgctcttctgaactgacaatcacttgcaggagaagcaactgagttaggtacactcacatttacattgaagtacttgtactcatcaccatctttcgtccagtaaatatcattttcagtagcatccaaagtaagttcaggcaacttcacgtttactgtgaacttgaatgtgatgcttgcaggatattcagaagaagtcagcttgttcttcactgttacagttgcaacaaattgagaaccaccggcaccgatcttacccagttcaccatgattaaatgaccatacgatcttcttcgtagcagtacctactgaagtatcaccgtcaacgattctcggcagagtcatagtgtgtgacaggttgttcttcttcactacagcaacagcaccggaagcatcatacaagttccagaattcttcgtggctcatgcttgtttccttaccgttagtaataacgcggtaaacattttcacggatgaattgctctgtgatagtgtattcagcagctgtttcagtacatttagctaccaagtcataagccttgtcacctactacaaggtcatcttgcttcgtcacaccaaattcgatcttcacgaatccgcgacgtactacattgcctgcttcgtctaccaattccactttcaggataggagtacgaccgatcgcttctttattgaagccttctgcctggtacaaacctgccgcagcgtcgttacataccacccatttctgctggttggttgaagtttcaccttcagtgatgttgtaatcagaagaagctacagagaacttatatgacaacttatagtcttcgatcgggaattctttgtgattaccgttaccgaagcaagtagccaccaggtctttcaggttgaatacttgatcgtaaggagttgtatagcgaacagcttctgacttacaagcagtgaaagtagttgcataatgagcaccgtcagcacctgaaactaaagtagctttatcagagatgcgaacgtccggtgcagccagtacgtcatcatagatagatacatacggagaagtaaccactacgttagtctcgtctttgtctacagcatcacccttcagagtagcctgcaaagcaaccatgtttactttatcttctgccggctgagtagaatgaacgttaagacgaagcagtttgaagtccactgttcctgttgcagcgttagcaaccggagtaccgctgatctgaacccactggctggcagccgcacgagtgttgatcactgtagcgctacgatccaagtagctatagtcagcattgcccaacttgaagctagccgggttgaagtggtagcttgcagttgccaaagcagctgtagaaatactataattcgtaggaatagcagcattttcaccgcttcccatcggagcatatttcaatgagttgaacttgatcgcttccacaccgtctacgatatagtcgggagcaaacgtgatgcttgtcagacggcaagtcatcaaagtgtgcaggctcaccaagtcagcgttgatagtaataatctggctgttgatggttctgatgtcaccctgaatacctgagatatccgatttgatagcatccagctcatcgttgatcttatcttcgaggtcagcgatatcctgagctgtagagttcttcaacgcttcaatggcagatttattctcaccgatcaaagctttcagaccgccttcaccgttgatttcatcccaaagtttcttaatctcatcctgtgcagcttcgatagcttcctgcgctgccgcgatatcttccttgttagcgtcagctatatcctttacaccttctgcataaagtttcaaagcggcgagctgagtctgcaagtctttatctgctgtaatcaacgtttcgatagcatcctgagcatttttgatcgcttcggtattttctttcactgctccgttggcaagattgctcaaacctgtttcgataccttcaatctgagcaccgagtgcttttacagcagcttcgtgtactgtcacatccagtttgttgtcaatagcagcctgcattgaatttctcaatgcttcaacctgtgttgcggcttccgctatcgcatctgcttttgcttgcgcagcggcagctttcgcttcttctgccagcgctttcgctgtagcagcatcggcagcagcctggtcgccggcagtttttgcagcttctgcggcagtcttagcttctgcagcagctgtctttgcagcatcagcagcagcctgtgcagcttctgcagcactcttcagcgttgtcagctgagtctgaagatcgccaacggtgcttccgcttttgtcaatttgttcctgcagactcttgatgtcgtcatcgtagtctttacaagaagtaaatgtacctgccgaggacgctatcagcgctccaaacaggacagcatttaaaaactttttgttcataataaaaaacttttaatttataaattaaaaaaataataaaaatataatttctcacttttgattttaaatcccatgtgttgttccgttcatttctcgtgcgacctccttttcttaattcattcaacctttatttcccttatataatacactatgaagcatacgggccaaacagcctttacccgttactttctaggtaacgggtaaacctttgtcctgactcctgtggagctatctatatgaaaaaccagactattttacagtgaaacatatttacccctgcttcagacatgcggcagaggggaggaaattctttgtatcttgatcagaggttaacaggtccctaatagaaagaaatccgttgttttatcgtattatttctctttttttagtagtttatcagaaaaaatatcttttttgtttgcatgttttccaaaatatatccatctttgcaacgctatttagctccgttacctagaaagtaacagattcattttcaagatactactccagctattgaatgttttacaaaatcaataatctgattattagcctcatcaattttcttattacggaaaggttttagataagtctcggtcaccttgatggacgagtgccccatagcttcggagataatacccggatgaatttcgcaataataggctgttgtagcccatgtatggcgggcggtgtatgaactcagtttatcgttcagtcccaatacctcccccaagagcgtgagctgctggttgaagctgcgcaatgccaactgatattcccggtaagcctcctttgttccctctccgcttttcagcagtgagaagagatagggcgaatggctgtcgcggttcatatacttctttaatagttcgagcgcttccggagtaagcgtcaccgacaagggccggcctgtcttccgcctgcggtaagtgatcacgttatccctcaaatcacttttacgcagataagcgagatcgacaaacggcagaccacgaagcaagaacatcagcacgaacatgtcctgcgcacgcctcacggcaagaggtatggcggaagatgaaggcagtctggtgaataccttcttcatatcttcatcacacaatgccctcttatggtccgcacgcgtgcccgtataaacagagcggaacagatggggcgtataaacgaccatcctactgttgacggcacgattgtacaccgcacgaaatgttcttagataagtggaaacggtgttccagctacatcccttcccacgaaggtgtatctcgaaacctttcaaccactccggggtgacctcgtcaaaagaaaaatccccttccccacaataagcaatgatggcattggtgctgctgcgatatacgtgcgccgtaccaaagtttccccccatccgtagctcttcggctacttgcttcataaatgctactacttttaacattgtactcagtattaaatattacacaataaatatacacatatttcagcaactataattgcctaatacgcatatacacgaccaattttcagaataagacactccgaaaatcagtatcaccgaaaaacgaaacaacaaatagggaaagattgagttcatttattcaaattaccatgaataacttttcacatatagcgacatctattgatcactaaaaaaggacctttcttaaaaaaggaatatttaaacagtgaaagaagggcataattgtatcccactttaaagaaaggcataaaaatgccatcattcacaaatacaggattcctcttttttactattcaaagagtttatcggtcaaatcagaagtataattctttttcactgatcattctgatcgcttactgaagaaaaacagttccgaatgacacttttattttcccggtatttatggatcaattagaagaaaattaagcaaaaacagctttttcaggtcttccttaccgacggaaaacaggttggtcggtgaggaaggaggcgttggttttaaagaaacacccccttggtttaaaaccaaaagatacttttttgttttgaaaaggtgtatatttcatgtagtttcatgcaaagaatgtttttttttcgtatattattgcatttatttatgcagatttttctctagttcgttatttttagagtgaccgtttttcaatgtaatcttaaaaatagcacattcgtccgatatttcgggtttcagaaaagagaaggaggtataaatagaagaagaggatgcatctcacgacacatcctcttcttttttcctgatatcttagtagacttctatttcttagtttttagaagcttccaaagatgctttgcggaattctttcattgctttttcgatttccaaagaagccttacgagcacgagttcctgctgctttgttaccgttttcaatctgagcgttagcatcttttgagaagtcagcatacagagctgctactttttctaccaattctttcataatccttttatttttttcgttaataatgtgtcgcaaaaatacactgtttcccgaaataaacgcataaaaacaatattttttttgaatttatctgcgaaaataagctaaaaaaaaggcttttcaccatttttccctacctttgtagccatgaaaacgcttactgatacggatcacatacatactttgatagctgaaggagagcatcagcaacaggacttcaaattcgaaatttccgacgcacgcaagattgccaaaacgctgtcggcttttgccaataccgacggaggacggctattgatcggcgtgaaagacaatggacgaatagccggcgtacgatctgaagaggaaaaatatatgattgaagcagccgcacaactttattgcatcccggagatagattatactttacaaacatatatcgtggaaggcaaacaggtattagtagccaccatcgaagagaatccgcacaagcctgtctatgcgaaagacgaaaacggaaagcctctcgcctatctccgcatcaaggatgagaatatactggctacccctatccacctgcgtgtatggcaacaaagtggcagcccgcggggagaactgatccgctatacggaacgcgaacaactcctgctcgacctgctggaacagggaacgctgctttcactcaaccggtattgtcggcagaccggtatttcccgacgtgccgccgaacatctgcttgccaaatttgttcggtatgatatagtagagcccgtattcgaaaatcataaattttatttccgaatgaaaaacgagtgatatattacgatttactcttttcaaaaacctaactatgaactttatcaatgaaataaatgatatactctggacatacatcctgattatcatgttactgggctgtgccgtctggttcagcatccgaacgcggttcgtacagttccgtatgcttcgcgaaatgattatattactcagcgagtccgccggaaaaggaaaacagggcgagaaacatgtttcatcttttcaggcattcgctattacgattgccagccgtgtgggtacgggcaacttggcaggggtggccaccgccatcgccatcggcggaccgggagctgttttctggatgtgggtgatcgccctgctgggagcttcgagcgcttttatcgaatctaccctggcacagttatataagatacgcgggaaggactcttttatcggaggcccggcttattatatgaagaagggattgaaacagccgtggatggggatacttttcgctgtgctcatcagcattactttcggttttgctttcaattcggtacagagcaatacgatttgtgctgctgccgaacatgcgttcggattcaatcatacggtgttgggaggagtgcttaccgctctgactcttgtcatcatcttcggtggtatccgccggatagcgcatgtaagcagcattatcgtcccggttatggcattaggatatgtaggactggcactggtcatcgtattacttaatatcacgcatctgccggaagtgatatctctcatcatcagtcatgccttcggctgggaacaggcattgggtggaggtgtcggtatggcgctgatgcagggtatcaagcgcggattattcagcaatgaggccggtatgggttcggctccgaatgcagcagcgacggccaacgtcactcatcctgtcaaacaggggttgatacagacgctggcagtatttaccgatactttattaaattgcacctgtacggcatttatcattcttttcagcggtgctcctttggacggttcctccaatggggtgcaactaacccaacaggcgctcacgaatgagatcggtgcttccggaagcatctttgttgccgtagcgttgttcttcttcgcattcagcagtatcttgggaaattattattacggtgaagcgaatatccgtttcatcaccgcaaagaaatgggtgctccacacctaccggatattggtcagcggcatggtacttttcgggtctgtcgccacactcgatttggtatggagtctggcggacatcacgatggctctgatggctgtctgcaacctgatcgccattatctttctcggaaagtatgccatccgcctgctctcggactatcgtgcccagaagaaagcgggcatccaaagtcctgttttcaggaaagagaccatgccggacatcgaaaaggacttggaatgttggtgaaaaccaacactttttcgtacctttgcggctcattaaaatctccacacacgatttgtaaattgtaaattataaaatagtaaatataacgatgggcttatttggtttattcaaaaagaaatccgatgaaacaaaagtcggcaatgtagaagatttcatatcactgacccgggtttatttccagtcagtcatcgctactaacttaggtattaccaacatccgctttttaccggatgtggctaacttcaaacgtttgttcaagattcctacgcagggaggtaagctgggactggcagaaaagtcagcttcacgcaaaatgctgatgcaggactacggactgaatgaaagtttctttaaggagatcgacagctccgtgaagcgtaattgccgtacgcagaatgatatccagtcgtatctgtttatgtatcaaggtttttccaacgacttgatgatgctgatgggaaatctgatgcaatggaagttccgtatgccgtctatattcaagaaggcgctttacgggatgacgcagaagacggtacacgatgtttgtacgaagacggtgtggaaggctgatgatgtgcacaagactgcggcgactgtccgccaatacaaggaacgcctggggtattcggaacagtggatgacggactatgtatataatatagtgctccttgccaaaaaggaaccgaaaaggaagaacgacgacacggaaacgaaaaaataaggtcgcgtaaatgttagaaaatcgtaaagaatagcatagcaggaaaagcgggagtggcatacttccgctttttttattatctttatgtactttttcttttgccttgatgcaaaagaaaaagtaccaaaaagaaaaaatcaaggctgcgcctgcccggctactccggtctcatttccggctaaagggcagaaactcgcttcgctcaaacagtctgccctttttaacgccgtaaataagacctgcgcttgacgccgggcagtcgaggccgggggaaccttgcggagggataggtcgttactaatcaataaataatataataatatagaggatgcttatgaaacaaaagaaaatgcttgtacttactttttcgcagttgaaacaaatatacacgcaggagatgccggagttggtagagatggcggcggtgagtccgacagtggaggactttaaggctggtctgctaaaacatctggatagttgcgggatggttaatgaggttgcggaggaggcaagggagcaaattcgactcttactccagtatgatggacaggatgttcatgaactgtctacgggacaggatatttcggtacagacgatacggttgctttatcagtttctgacggagaagttggagaatatagagatgccgacggatttgtttgtagaattgttccagttgttcaaacgtttgcagggggaaaatgttccttcgccgtctccgcagcgcatcaagagccggaatgaccggtgggataccggattggatgaggaagtgcgggagatgcgggatgagaataaggaacggatgctgcatctgttgattcagaagattgagaaccggaagtcgaagccttcggtacggttccattttgaggaagggatgagttatgaggagaagtatcagttggtaagcaaatggtggggagatttccgctttcatttgtcgatggctgtgaaaagtccggctgagttgaatcgctttttaggaaattcactttcgtcggagacgatgtatttgttgaatcgggcacgtaaaaagggaatgccgttctttgctacgccttattatttgtcgttgctgaatgtgacggggtatgggtataatgatgaagcgattcggagttatatactttattcgccacgattagtggagacgtatggcaatattcgtgcatgggagaaggaagatattgtggaggcaggaaagccgaatgctgccggatggctcttgccggacggacataatattcaccgacggtatccggaggtggctatccttattcctgatacgatgggacgggcttgtggagggctttgtgcatcttgccagcgtatgtatgactttcagagtgaacggctgaattttgaatttgagacgttacgaccgaaggagtcgtgggacagtaagttgcgacggttgatgacctattttgaacaggatacgcagttacgcgatattctgattacgggaggcgatgcgctgatgagtcagaataagacgttgaagaatatattagaagcggtgtatcgtatggcggtacgcaaacaaagggcgaatcttgaacgtccggaaggtgagaaatatgcggaattgcaacgggtgagactgggttctcgtttattggcttatttgccgatgcgtattaatgacgagttggttgacattttgcgggagtttaaggaaaaggcttcggctgttggcgtcaagcagtttatcattcagactcattttcagacaccgctggaggttacccccgaggctaaagaagcaattcggaagattctttctgccggatggattattacgaaccagttggtatatacggtggctgcctcacgcagaggacatactacgcggcttcgccaggtactcaattcactgggagtggtatgttattatacgttctcggtgaagggatttaatgagaattatgcggtgtttgcccccaacagtcgctcaatgcaggaacagcaggaagagaaaatttacggacagatgactccggaacaggcggaagaattgtataagatactggagaccaaagtcagtgcaggtataaatgaagaaaaaacgaaagaagatgctgacaccgccaaacaaataagacggttcatgagaaagcatcatctgcctttccttgctaccgaccgcagtgtactgaatctgcctgctatcggcaagagtatgactttccaattggtaggattgactgaggaaggcaaacgaattcttcgcttcgaacatgacggtacccgtcaccatagccctattatcgatcagatgggacaaatctatatcgtagagaataaatcactggcagcttatctacgccaactcagcaagatgggggaagacccggaagactacgcttctatctggagctatacaaaaggggaaaccgaacctcgtttcagcctctacgagtatccagatttcccctttcggattacagataaaatgagtaatttagaaataaataataggtattaggtaat
